United States Patent 9,029,636 (ISOLATED NOVEL NUCLEIC ACID AND PROTEIN MOLECULES FROM SOY AND METHODS OF USING THOSE MOLECULES TO GENERATE TRANSGENIC PLANTS WITH ENHANCED AGRONOMIC TRAITS) - sequence listing, part 49

SEQ ID NO: 227268 - protein, 134 aa, Glycine max
  Coding DNA Sequence Number=SeqID_110490
  Homolog annotation: Hit_ID=Q9SK32; Match level="QueryCoverage=67%, HitCoverage=17%, E-value=2e-08, Identity=37%"; Hit description =Expressed protein
MVRTRGLGHALGRVIGRALGREDHHHSDDVPKQRRTTTSAYKWPRDPSVLTDYGDHVAVIIWNGEERPELKLSSHGRKVQKFGKSAPEIEGLVAATGLSFLIAYSVDTGDRGLISAFVERWHKETSNFHLHVGE

SEQ ID NO: 227269 - protein, 84 aa, Glycine max
  Coding DNA Sequence Number=SeqID_110491
MVGYTPSSFADMVFAGKRIEVGLERGKFGHPALIKTGANEEDESEGETLDVAAIPIWPSFPPTQKCHYSTNNNPSPYPPPSYPQ

SEQ ID NO: 227270 - protein, 49 aa, Glycine max
  Coding DNA Sequence Number=SeqID_110492
MARWELGSTHDSRYSSDAMAGASVNTRHQLSTIVLQYLLLKNSIEEGFE

SEQ ID NO: 227271 - protein, 123 aa, Glycine max
  Coding DNA Sequence Number=SeqID_110493
MSQGISESNPHLQCQPFFNNSDWTVILSRENKLSRIPQQMGLAFHHMEAPLTIKKWAFRENTRLHSNGDVSSTSRNLEISPRPKILLKAKVFPSLLCFSPLFSALHKALLVYSDSLSFSSLQA

SEQ ID NO: 227272 - protein, 112 aa, Glycine max
  Coding DNA Sequence Number=SeqID_110494
MGIAPTKTPSEPEEVQQGPGVSSSGLRASISPTGCPYPPDKGSRLQDTQWTRRSPTGSWSCQALITGLCQFYGVPVTSSKGIRPPTNRAFIKKYCVSRQAQGETPQQPGDGR

SEQ ID NO: 227273 - protein, 34 aa, Glycine max
  Coding DNA Sequence Number=SeqID_110495
MADQQATKSKAKAKDVKKALLGGNLVPFESVLVI

SEQ ID NO: 227274 - protein, 86 aa, Glycine max
  Coding DNA Sequence Number=SeqID_110496
GVVLAEVLLADSRFTRPDMGFHPTKLNFVPSDADEAPLDVSICLHAFGIVGCGSFSGVKSCEREDPFHPGLFVGTLEDFKVPHVNH

SEQ ID NO: 227275 - protein, 98 aa, Glycine max
  Coding DNA Sequence Number=SeqID_110497
MTIDQPLLPMSDTDPVPSGVTICRKQPFDGRVRQKAKGAPSKKENAWESPPTFIRGKPPLELVSLGSSSSMDSFASWKMNGSGMEKGKERGDATSRRR

SEQ ID NO: 227276 - protein, 95 aa, Glycine max
  Coding DNA Sequence Number=SeqID_110498
  Subcellular localization annotation: CTP_CleavageSite=34; ConfidenceScore=5.05e-01
MWVQAIGPFAQVTCAPEFGLPRPFNQRLLVLHVGGAAVKQRGQPFPCVQESPTTRDPRSLNPFSEIRRREEEISLKRDRLYNEDQSKFLIEYASG

SEQ ID NO: 227277 - protein, 74 aa, Glycine max
  Coding DNA Sequence Number=SeqID_110499
HELKIYPKDQENPRAFPWISGPICLDSSIQCPCGVGLHQLGCLPAALFACPELGMGRRFIDHDPSLHLRPSLST

SEQ ID NO: 227278 - protein, 105 aa, Glycine max
  Coding DNA Sequence Number=SeqID_110500
  Gene Ontology: Mol. function=carbonate dehydratase activity; Cellular component=extracellular region; Biological process=one-carbon compound metabolic process
  Homolog annotation: Hit_ID=Q6YZ80; Match level="QueryCoverage=69%, HitCoverage=26%, E-value=5e-13, Identity=48%"; Hit description =Putative dioscorin
MQPQSHISIAILLISILFCSVSTRALDEPGYGYNEKSANGPRYWGDLKEEWAACKIGKIQSPIDLSTNGVEVIPKLGGLKYWNYKPQHATVSNRGHDVAVSTNII

SEQ ID NO: 227279 - protein, 111 aa, Glycine max
  Coding DNA Sequence Number=SeqID_110501
MMMKEERRRFLFCPKMLSAIKLGHMRFNCHVFKRRMEKSDKTNFKEKKEKKGYITWEDNVINYSSDSEKKTISLGIMMKDYENGEEQSRYIDSNFSKHMACIKVYSYFSSR

SEQ ID NO: 227280 - protein, 91 aa, Glycine max
  Coding DNA Sequence Number=SeqID_110502
MAIPFELYYNIENDIELIEEAEEYGTAVPSPRASHESQNHDVRKLYASQVVDVDEESQKRIRSLEAKYSAFESKVGLDARPLRLSFLPGFD

SEQ ID NO: 227281 - protein, 245 aa, Glycine max
  Coding DNA Sequence Number=SeqID_110503
  Gene Ontology: Mol. function=metal ion binding
  Homolog annotation: Hit_ID=UPI0000DB6B0A; Match level="QueryCoverage =58%, HitCoverage=30%, E-value=1e-21, Identity=32%"; Hit description =PREDICTED: similar to ring finger and WD repeat domain 3
  Pfam annotation: Domain name=zf-C3HC4; Domain location=110-155; Score= 22.2; E_value=0.00079; Accession=PF00097.15; Description=Zinc finger, C3HC4 type (RING finger)
MANRVQVFFNQFPQFDYPDPDPDPPFDLLSIHDEEEYGTSDEDNYDAIYILSLPRTITTNPSSYNQQELIVIPDDDESQNCFREDGSNKRCRTELESEASRSKDIDHLLCPICMDVWTSSGDHHICCLPCGHMYGLSCIKKWLQQHRNSNKCPQCNRNCSIKDVRKLYASPGVAVDEESLKRIRSLEAKCTALESKDNDWRKKEAEWQKREAALHLQVEKLTKDIGGGKRQGPVYDAGDPSLSEH

SEQ ID NO: 227282 - protein, 54 aa, Glycine max
  Coding DNA Sequence Number=SeqID_110504
CFTLLGIDRNKIIKTELINPCPESQVKRAITEELKQSKILAYVTALKKLCNHPK

SEQ ID NO: 227283 - protein, 414 aa, Glycine max
  Coding DNA Sequence Number=SeqID_110505
  Gene Ontology: Mol. function=DNA binding; Biological process=DNA integration
  Homolog annotation: Hit_ID=Q8XF72; Match level="QueryCoverage=62%, HitCoverage=95%, E-value=3e-76, Identity=54%"; Hit description =Isrso14-transposase orfb protein
  Pfam annotation: Domain name=Transposase_8; Domain location=40-128; Score=57.2; E_value=5.4e-14; Accession=PF01527.10; Description =Transposase
  Pfam annotation: Domain name=rve; Domain location=220-378; Score =143.0; E_value=8.3e-40; Accession=PF00665.16; Description=Integrase core domain
  Pfam module annotation: Pfam domain module=Transposase_8::rve; Domain location=40-128::220-378
MTLPRHDCSFLALLRYASAVTAASVAGWQLTASHEDIPMKKRFSDEQIISILREAEAGVSALELCRKHAISDATFYTWRRKSGGMEVPEVKRLSHAGLGGASGGSGPKALTTDQKREAVEAMCETTGLSQRRACRLAGLSLSTCRYSAQRPAADAQLSLRITELAPERRFGYRRIWQLLHREGFHVNHRRVYRICHLNGLGVKRRRRRKGLATERLPLLRPDAPNLTWSMDFVMDSLASCGRIKCLTCVDDFTKKCLTITTAFGITGVQVTRILDSIALSQGYPATIRTDQGPEFTCRALEQWAFEHGAELRLIQPGKPAQNGFTEGFNGRFREECLNEHGFGDILHARKIINDWRQDYNESRPHSSLKYQTPAEFAASWRNGKLEGHQDRTGRNRQAPSSAARCSPAAYPHRT

SEQ ID NO: 227284 - protein, 68 aa, Glycine max
  Coding DNA Sequence Number=SeqID_110506
MCTSYQLDKAPLKYVCHQSKQWFLYQYPFGLSRWLPYPLVDLILEGLLELLQNKECAHWKAKYVSGWI

SEQ ID NO: 227285 - protein, 49 aa, Glycine max
  Coding DNA Sequence Number=SeqID_110507
  Gene Ontology: Mol. function=amino acid binding; Biological process =metabolic process
  Homolog annotation: Hit_ID=Q9SJM1; Match level="QueryCoverage=90%, HitCoverage=10%, E-value=5e-13, Identity=68%"; Hit description =Expressed protein
MKREAEVGRHVVGDREWEVYRILLDEGEGLSIPRNKIEKGVWKMLMGWE

SEQ ID NO: 227286 - protein, 513 aa, Glycine max
  Coding DNA Sequence Number=SeqID_110508
  Gene Ontology: Mol. function=heparan-alpha-glucosaminide N -acetyltransferase activity; Cellular component=integral to membrane; Biological process=glycosaminoglycan metabolic process
  Homolog annotation: Hit_ID=Q1RV57; Match level="QueryCoverage=88%, HitCoverage=93%, E-value=1e-101, Identity=40%"; Hit description =ENSANGP00000004406, related
  Pfam annotation: Domain name=DUF1624; Domain location=74-273; Score= -121.1; E_value=0.029; Accession=PF07786.3; Description=Protein of unknown function (DUF1624)
  Pfam annotation: Domain name=DUF405; Domain location=72-219; Score= -69.2; E_value=0.087; Accession=PF04171.3; Description=Protein of unknown function (DUF405)
  Pfam module annotation: Pfam domain module=DUF1624::DUF405; Domain location=74-273::72-219
MDEDPKRMEEGLNSALNGDGNKDDLKKRATIKTSNGGSIFEHDKDTMAKPVAEGESVQQIAEQEQPPVKQKTKRVATLDAFRGLTIVLMILVDDAGEAYPRIDHSPWNGCTLADFVMPFFLFIVGVAIALALKRISKIKHSVKKIILRTLKLLFWGIILQGGYSHAPDDLEYGVNMKFIRWCGILQRIALVYCVVALIETFTTKLRPTTLASGHLSIFAAYKWQWFGGFVAFLIYMITTFSLYVPDWSFVDHFNGDEPKRYTVICGMRGHLGPACNAVGHVDRQVWGVNHLYSQPVWRRLKACTFSSPGSGPFRDDAPSWCLAPFEPEGLLSSISAILSGTIGIHYGHVLIHFKGHSERLKQWVSMGFVLLIIAIILHFTDALPINKQLYSFSYVCFTAGAAGIVFSGFYILIDVWGLRTPFLFLEWIGMNAMLVFVMAAEGIFAAFVNGWYYEDPRSSLVSITKVHWIKKHVFVNVWHSERVGTILYVIFAEITFWSVVAGVLHKLGIYWKL

SEQ ID NO: 227287 - protein, 243 aa, Glycine max
  Coding DNA Sequence Number=SeqID_110509
  Homolog annotation: Hit_ID=O80960; Match level="QueryCoverage=90%, HitCoverage=39%, E-value=2e-63, Identity=53%"; Hit description =Nodulin-like protein
  Pfam annotation: Domain name=Nodulin-like; Domain location=12-239; Score=302.2; E_value=9.5e-88; Accession=PF06813.4; Description =Nodulin-like
MKTLIYNVLTGRWFMLFASLLIMAAAGAAYMFGMYSNEVKTSLGYDQTTLNLLSFFKDVSATVGIIMNFFGYFIIFLAVTGRIAKPQAWKMCLYICIGLNSQTFTNMGGTVTCVKNFPGSRGNVLGLLKGYVGSSSAIVAQLYHAFYGDHNPQAVILLIAWLPAAVSFLFLPTIRIFNSVHHPNENKVFYHLLYISLALAGFLMVLIIMQNKLSFTRPEYVTVGVVVFIFLLLPLVEVFLEKK

SEQ ID NO: 227288 - protein, 262 aa, Glycine max
  Coding DNA Sequence Number=SeqID_110510
  Gene Ontology: Mol. function=chitin binding; Cellular component =extracellular region; Biological process=chitin metabolic process
  Homolog annotation: Hit_ID=UPI000044A8F0; Match level="QueryCoverage =96%, HitCoverage=99%, E-value=2e-38, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
PSEDSHVLACRRTHALAFRGLHVLAFKRLHVLTFRRLHVLAFRGLDVVAYRGLHVFAIRGLQALTFRGLHVLAIRGLHVLTFRGLHVLAIRGMHILTFRGLHVLAISGLHMLTLRGLHVLAFRGPHALPFRGLHVLAIRALHILPFRRLHILAIRGLHVLTFRGLHVFACRGLHPLAIRGLHALAIRGLYVLAFRGLHVLAFRGLDVLAYRVLHVLAIGGLHALTFRGPHVLAIRGLHALTFRGLHVLPIRGLHALTFRGLH

SEQ ID NO: 227289 - protein, 463 aa, Glycine max
  Coding DNA Sequence Number=SeqID_110511
  Gene Ontology: Mol. function=transferase activity, transferring nitrogenous groups; Cellular component=intracellular; Biological process=regulation of transcription, DNA-dependent
  Homolog annotation: Hit_ID=Q0XQV7; Match level="QueryCoverage=53%, HitCoverage=38%, E-value=1e-74, Identity=56%"; Hit description =Transcriptional regulator containing a DNA-binding HTH domain and an aminotransferase ...
  Homolog annotation: Hit description=domain (MocR family)-like protein
RDPGHRGRAAGVIPDGRRAAGPLATRGLRGARPPACAQHLFAAPPALGARGRGWGRCGGRWPAAAGLYVRHALAPESHHRDDEPAAARAAAAPRRAGRFRDHRGRLRGREPLPGHAHARAQEPGQERARDLCGFAVQEPVARAAAGIHRCAARADRRVARAAPCHGHAGTRGSGGPLAARAPAGFHLPPAPGRRVAVGAGTGLAGRRCAGRRGAPPRRADRGRQRVLCDAAPALPLFPAAPVLHCHRSDRCRHCSTGTGGGRTGPQLLEHVAHGQVQRGILGRNGLHEPLVVDLRHFARGHHAHQHVVHSLLEGGIVAAKQDGDGLGAQHLAHDPEACRVLGVGDDAGQQVVVQHEGIGTARFEHQKALEMVLAQRGGQVHAIVAPVLAQQLHGSRTGRGRHGLAVELLEGGDARVGAHGHAHLAHVGGHGKGHLLLAREVVGGRAAADVHGAVLHQGHGVLR

SEQ ID NO: 227290 - protein, 137 aa, Glycine max
  Coding DNA Sequence Number=SeqID_110512
MEGPCRLLKNMRWGILLPLDVVSKKGTNSPDPRIPRLHLCHMHSIMHSSIPPMKYRSFDLHQLLSHFSKHGNKSNRQEVLPSQGQKPRYHQHQGIRAVDGTPPNASLPQDLRKDLELTIAEVSIEAIASLTQYYDQP

SEQ ID NO: 227291 - protein, 100 aa, Glycine max
  Coding DNA Sequence Number=SeqID_110513
MKFLELKQGNMTVAEYAAKFKELTKGALSQPTLLRASEARLTGASSEGGKCVESPPALICGKRRKNQRKPVMKNILDLGVVFTFEEGISTSHVCPKGQQP

SEQ ID NO: 227292 - protein, 212 aa, Glycine max
  Coding DNA Sequence Number=SeqID_110514
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=41%, E-value=1e-109, Identity=87%"; Hit description =Photosystem II P680 chlorophyll A apoprotein
  Pfam annotation: Domain name=PSII; Domain location=1-212; Score =135.7; E_value=1.3e-37; Accession=PF00421.9; Description=Photosystem II protein
MGLPWYRVHTVVLNDPGRLLSVHIMHTALVAGWAGSMALYELAVFDPSDPVLDPMWRQGMFVIPFMTRLGITNSWGGWNITGGTITNPGIRSYEGVAGAHIVFSGLCFLAAIWHWVYWDLEIFCDERTGKPSLDLPKIFGIHLFLAGVACFGFGAFHVTGLYGPGIWVSDPYGLTGRIQSVNPAWGVEGFDPFVPGGVASHHIAAGTLGILA

SEQ ID NO: 227293 - protein, 571 aa, Glycine max
  Coding DNA Sequence Number=SeqID_110515
  Gene Ontology: Mol. function=hydrolase activity; Cellular component =integral to membrane; Biological process=metabolic process
  Homolog annotation: Hit_ID=UPI00006DBC1C; Match level="QueryCoverage =74%, HitCoverage=95%, E-value=2e-89, Identity=41%"; Hit description =COG0402: Cytosine deaminase and related metal-dependent hydrolases
  Pfam annotation: Domain name=Amidohydro_1; Domain location=41-355; Score=69.0; E_value=1.5e-17; Accession=PF01979.10; Description =Amidohydrolase family
  Pfam annotation: Domain name=Amidohydro_3; Domain location=41-353; Score=-49.9; E_value=0.00027; Accession=PF07969.2; Description =Amidohydrolase family
  Pfam annotation: Domain name=DUF606; Domain location=418-558; Score =93.9; E_value=4.8e-25; Accession=PF04657.4; Description=Protein of unknown function, DUF606
  Pfam module annotation: Pfam domain module=Amidohydro_1::Amidohydro _3::DUF606; Domain location=41-355::41-353::418-558
MDENVGNLERGDILVTGSTITAIGKDLNAGDAYVIDATKMIAMPGMVDSHRHAWEGQLRRINPNATCLDDYSNATHFSFAKYYRPADIYVGNLLTALGAIDAGITTMIDNSHNSRTAAHADAAVEALLDAGIRAIHASGAPVAGEWDKAHWPGNWQRLQEKYFKDNPDGLVSLGVMAQLEPELWAEARRLGLPIVTEFFGAEMASELKSLHQQGLLGPDNIFNHCTALPDEGWEILREAGVRVNVCPRSDSHYGIESGMFAIEAAQRHGINPGLSVDNETSYSTDMFMEMRVAFYLQRVMGMHKQHCCDSGHSLTTLPAAQLLKSATVDGATCAGLQDKVGSLTPGKQADLILINAADLNLYPNGNTFGTVVHATERSNIDTVMIGGRIVKQNGKVLGVDSERLRAAIDESREHLFAAAGYEPDIFAEKFLPLTTLNSQLAKGLGGDPVTAAFFSFTAGASCLGIYSLLRGGLFTSLAAIPSQPVWSLAGGLIGACALFSYVVLAPKIGFSALLGLAIVGQLLSSQMIDHFGLLGAVRRPVSLLRLGGMLVMLAGLAIMLFGDRLSARFLP

SEQ ID NO: 227294 - protein, 58 aa, Glycine max
  Coding DNA Sequence Number=SeqID_110516
  Homolog annotation: Hit_ID=UPI0000673D07; Match level="QueryCoverage =75%, HitCoverage=31%, E-value=6e-08, Identity=65%"; Hit description =COG1974: SOS-response transcriptional repressors (RecA-mediated autopeptidases)
MPGSSAEGPGGGQLQALDRKLAVDLGNHDVAVCGFLGPVNHHDVAVAEAQVPHALDAD

SEQ ID NO: 227295 - protein, 286 aa, Glycine max
  Coding DNA Sequence Number=SeqID_110517
  Gene Ontology: Mol. function=oxidoreductase activity; Cellular component=cytosol; Biological process=electron transport
  Homolog annotation: Hit_ID=UPI00005FA2E6; Match level="QueryCoverage =60%, HitCoverage=88%, E-value=8e-65, Identity=63%"; Hit description =COG2249: Putative NADPH-quinone reductase (modulator of drug activity B)
  Pfam annotation: Domain name=Flavodoxin_2; Domain location=94-286; Score=186.3; E_value=7.4e-53; Accession=PF02525.7; Description =Flavodoxin-like fold
MAAVVVSLLSGISLTGILCAPGLSMLWAAILGFGCGASMMLGLTFIGLRTTNSGDAAALSGMAQCVGYLMAAMGPLLLGKIHDWSGGWTVPLLMTAAITVAGACTGLAAGRNLNQLYVDTAGDVLRQLGHNVSVTKADSDFDPHNEITRILDSDILIYQMPGWWMGEPWTVKKWIDEVFTLGHGSLYESDGRTRSDSSKKYGSGGLLHNKKYMLSLTWNAPLEAFNDPEQFFEGVGVDGLYLHLHKANQFLGMTPLPTFITNDVVKSPDVENEIRRFSDHLIATYS

SEQ ID NO: 227296 - protein, 207 aa, Glycine max
  Coding DNA Sequence Number=SeqID_110518
  Gene Ontology: Mol. function=transcription factor activity; Biological process=regulation of transcription, DNA-dependent
  Homolog annotation: Hit_ID=Q2KZR0; Match level="QueryCoverage=84%, HitCoverage=52%, E-value=1e-42, Identity=52%"; Hit description=LysR -family transcriptional regulator
  Pfam annotation: Domain name=LysR_substrate; Domain location=1-172; Score=54.4; E_value=3.7e-13; Accession=PF03466.10; Description=LysR substrate binding domain
MAGVSDRQVDLVQEGVDCVIRTGELQNSTLVARPLGRLRWVTCASPDYLREYGIPRSPEDLTRHRAVHYFSGQPRRNDTLRFMRGSEPLSVAVSGLGAVNETGLYIKMCLEGFGLIQLAENIVSEHLQQGALVEVLADWQPPSVPVSLLYPHQRFLSPAVRVFADWVTGVFMQGRTEAVSSPETDWLYGDEDIIRPHRRPQRTAPDR

SEQ ID NO: 227297 - protein, 104 aa, Glycine max
  Coding DNA Sequence Number=SeqID_110519
  Gene Ontology: Mol. function=sequence-specific DNA binding; Cellular component=intracellular; Biological process=regulation of transcription, DNA-dependent
  Homolog annotation: Hit_ID=Q8PKE0; Match level="QueryCoverage=100%, HitCoverage=39%, E-value=3e-33, Identity=61%"; Hit description =Transcriptional regulator araC family
MEYFNGCARNLLQEHGSNSAGFIIRGIAGILLSKIKNELADKRRNGNRTASYRHNDSTGFNKKKAGSGILCYATTMRNITGDPDGMPGRNQPQCILNFTAHGAM

SEQ ID NO: 227298 - protein, 572 aa, Glycine max
  Coding DNA Sequence Number=SeqID_110520
  Gene Ontology: Mol. function=serine-type peptidase activity; Biological process=metabolic process
  Homolog annotation: Hit_ID=Q6D8Q7; Match level="QueryCoverage=49%, HitCoverage=87%, E-value=1e-52, Identity=39%"; Hit description =Putative exported protein
  Pfam annotation: Domain name=Abhydrolase_3; Domain location=101-325; Score=25.8; E_value=2.4e-09; Accession=PF07859.3; Description =alphabeta hydrolase fold
  Pfam annotation: Domain name=DLH; Domain location=98-343; Score= -81.0; E_value=0.1; Accession=PF01738.9; Description=Dienelactone hydrolase family
  Pfam annotation: Domain name=DUF1738; Domain location=452-568; Score =59.0; E_value=1.6e-14; Accession=PF08401.2; Description=Domain of unknown function (DUF1738)
  Pfam annotation: Domain name=LIP; Domain location=102-350; Score= -131.2; E_value=0.051; Accession=PF03583.5; Description=Secretory lipase
  Pfam annotation: Domain name=Peptidase_S15; Domain location=81-323; Score=-52.6; E_value=1.1e-05; Accession=PF02129.9; Description=X-Pro dipeptidyl-peptidase (S15 family)
  Pfam annotation: Domain name=Peptidase_S9; Domain location=116-346; Score=-17.0; E_value=2.5e-06; Accession=PF00326.11; Description =Prolyl oligopeptidase family
  Pfam module annotation: Pfam domain module=Abhydrolase_3::DLH::DUF1738 ::LIP::Peptidase_S15::Peptidase_S9; Domain location=101-325::98 -343::452-568::102-350::81-323::116-346
PACHYGLRSRLNVGYFPSSGRLSTESASEASGLPTAGITDSDKHNIPGYTKGADIMQINSTEKQIDYIGNIVYRQVKSMRSVRQLHMSVLVPRTSDLKPAIIYFPGGGFTTAEHDKFIEMRLALAKAGYVVAAAEYRTIPDTFPSPVVDAKAAVRYLRQHATDYGIDPGRIGVLGDSAGGWLVQMLGTTNGDKSFDTGNFLSQSSAVQAVATLYGISDLRSICEGFPENRLKVHQSPAVTEALLVNGVAFRDFAGASLISTPQKALSASPVGRLRGSNPPFLIMHGSRDTLVSPEQSATLYNALRKSGGRADYVLINGAEHGDHHWYQPAVINRVVDWFRQILGTPEKQDAICSASSALMGKRRHLNGFHLSGKAKPDRALSVMKLPQVLSVKWINWSVAATTPPAGADFAFCQPARALRNYQCRAQSVLLTGPVIERTLSGLLTQGVFSMKLPFYYLAALFLTAGTHSGTVIYTDSAHPVTDRAYSGFNVLLLWMAAEEYGYTSERWLTFLQSKTAGGHVRKNEISTLAIIYKSFEKQARDSIDNLLFRDGERVMEQLAMLKQLQLFNVEQ

SEQ ID NO: 227299 - protein, 227 aa, Glycine max
  Coding DNA Sequence Number=SeqID_110521
  Homolog annotation: Hit_ID=UPI00005F8869; Match level="QueryCoverage =91%, HitCoverage=88%, E-value=2e-35, Identity=38%"; Hit description =COG2200: FOG: EAL domain
  Pfam annotation: Domain name=EAL; Domain location=7-227; Score= -115.5; E_value=0.0054; Accession=PF00563.11; Description=EAL domain
MAIFRRRINVFQTALFLKVDLGIDVSFILEPIVSSGGHLMAMELLSRFFVSGEMNPTNLSPELLFRKITSEQKKKLLSCQIDAIKTQSIFFLKNNIICSLNIDECLADFICNTPDVRRRLINMPFIRLEISEAFPELDNAMRNPLLTDLSRDFGLWLDDFGSGYANMSAVHSGLFEAVKIDKAFFWKHIESPLWPGLLREVRRDVTSIVVEGVETERHTEQLRDSVE

SEQ ID NO: 227300 - protein, 197 aa, Glycine max
  Coding DNA Sequence Number=SeqID_110522
MTLTIPQLFLKPLQVMWDATIFGVFNQNFPFHLTETSVRAGNSDVYGFLEPQSIQRSGQSQFESESYIKSWIQSSKRDVYLGAYLNGGHWQMVVILPKENFVVWFCSLHNRPDNYFKGIINSALKGLDDTPQPKSKAAARWIVVKCNRQKGITECGYYVMHWMSMLILGSFRNNWETLDHWKQRDSRHFAYSGHSII

SEQ ID NO: 227301 - protein, 135 aa, Glycine max
  Coding DNA Sequence Number=SeqID_110523
  Gene Ontology: Mol. function=protein binding; Cellular component =fimbrium; Biological process=cell adhesion
  Homolog annotation: Hit_ID=P08191; Match level="QueryCoverage=82%, HitCoverage=41%, E-value=4e-09, Identity=36%"; Hit description =Protein fimH precursor
  Subcellular localization annotation: CTP_CleavageSite=65; ConfidenceScore=5.64e-01
MAYGSKVRLASTSDSSVNVVIPFVAANRSVIVNRNCDFSSQSASVTLPEYSVAGTSAFSVPLSLSCTAGGNIYGTMSLTGTTASGDNTVFTSDGSAQGGLQFGPISGNNIPTPLGLSVAYARTGGRLTAGTVQSR

SEQ ID NO: 227302 - protein, 96 aa, Glycine max
  Coding DNA Sequence Number=SeqID_110524
MVLPPVHGSKPGGIPKLLAYCLSYLPLNERNKAQHISPNTGIVGKPVVPAALMNRPTRGERRFAYWALAECILAYYVGTDEGVSEVLHVAGEKRLH

SEQ ID NO: 227303 - protein, 132 aa, Glycine max
  Coding DNA Sequence Number=SeqID_110525
MPPTRNPLDPDKSNMALEFPALITGLCHSFGAADAPPPPHQGDPAGSFGMERYLQHLVRRRRPTTWGRCRYMSVSTSSASVSRVRLSLLLRALLQISSGLRLHGSEIGLRPRQGKCPQRLPAMQRRPAWMGR

SEQ ID NO: 227304 - protein, 48 aa, Glycine max
  Coding DNA Sequence Number=SeqID_110526
MLDIPVSHEEEYLYLRACHSVWNSLETQADSHGGELPVHNWVTSTLTA

SEQ ID NO: 227305 - protein, 108 aa, Glycine max
  Coding DNA Sequence Number=SeqID_110527
MKLQENRDTVTYTTTLNHSIQSTRKTCPLRQQAPPSHDGFENKRHSFQQVTYISVSVFITGCFAKNLGISKSIYVEFLGAIIVVEIAISKGWHSLWLECDSTCWAGFL

SEQ ID NO: 227306 - protein, 237 aa, Glycine max
  Coding DNA Sequence Number=SeqID_110528
MANLQGGPDFDKIFHFLSICILAFINEGSSSLSSAFMNEPWSWGLSIPISLYVKFALEIHTHLGICVGVGVPSLVYWGATRGAIDWYWEAALKFNHEIFKTCLFNVVIGLLHLLVSKLAHYIIEWVRDHKLMNKGLLSHLLVVANLDLEALSQHPLLRPISFKTLFLKLIELLVVFFYNGNILLLSWCFSGQVYSYEVGKAISWVSLGSSMFVWIKSLLRELGTQQEPLEEKPCMKE

SEQ ID NO: 227307 - protein, 77 aa, Glycine max
  Coding DNA Sequence Number=SeqID_110529
MAKHQHQGCILSARSVCYLQQVSSARLNERLALSPNPLTRAKREGDLCTLFQSAYFGKRALEAARAAACALKPKFCK

SEQ ID NO: 227308 - protein, 470 aa, Glycine max
  Coding DNA Sequence Number=SeqID_110530
  Gene Ontology: Mol. function=receptor activity
  Homolog annotation: Hit_ID=Q9FQZ2; Match level="QueryCoverage=80%, HitCoverage=93%, E-value=2e-74, Identity=40%"; Hit description =Avr9/Cf-9 rapidly elicited protein 137
  Pfam annotation: Domain name=DUF668; Domain location=320-408; Score =89.3; E_value=1.2e-23; Accession=PF05003.3; Description=Protein of unknown function (DUF668)
MAWRQKTVVPGANTLGILAFEAGKTMSHLISLYHSLSDEEIIKLRKEVIKSKGVTYLNSQHECFLLNLAAAERLEELDTAADTVSRLGRKCSDPSLSSFDLVYADLKLGLIDLRKLSYGTRNTPKIISKIEKLVSSTKSLHSAMHCMAEHETSEKKKQRLKTVMRPINYNNNYNAKQNNMEYLNEQIAYQRKQVQHYKEVSLWSQTLDKTVGIMAKVVCIVYARICSVFGGYISNCNCYEINDDNNINNNCCCLLEHRELYKKNYCLYEESLQKRVTRSGPIPKASNNNKTGVIRFLNREVDRPMSNVNNRVLRLAPPSTVGGAGLAARYAEVVLAAERLLHAPATVAEDARERFYEMLPERVRQKVAAKLRGRWRREEEGEALAEGWRDAVEKMLEWLSPVAHDTVRWQAERSMETARFETKTTALLLQTLHYSDLEKAEAAIVEVLVGLSCIYYCERRCWQGHSYSCG

SEQ ID NO: 227309 - protein, 160 aa, Glycine max
  Coding DNA Sequence Number=SeqID_110531
  Gene Ontology: Mol. function=nucleic acid binding; Biological process= DNA integration
  Homolog annotation: Hit_ID=Q1S1B7; Match level="QueryCoverage=46%, HitCoverage=11%, E-value=8e-20, Identity=65%"; Hit description =Integrase, catalytic region
MTALDARGTWELVPLPIDKTTMGHCWVYTVKVKPNGSIDCYKTKDTSSLKYLLGIEVAQSSFGISISQKKYALDILTEIDMLDCCPIDTLMDLNVKLLPDQGEPLEDLKRYNHLVLLGEITTEFVSSKDQLADMLTKSLKVSYVDDICSKLGSYDIYAPT

SEQ ID NO: 227310 - protein, 71 aa, Glycine max
  Coding DNA Sequence Number=SeqID_110532
MKNQLASNGIVPWCKHPLHEWSSDRHDLGLGTKGGKEDHQRWYARSLRHGDDPGGVVTPAKGDHNGDGKGS

SEQ ID NO: 227311 - protein, 463 aa, Glycine max
  Coding DNA Sequence Number=SeqID_110533
  Gene Ontology: Mol. function=nucleoside-triphosphatase activity; Cellular component=membrane; Biological process=mRNA processing
  Homolog annotation: Hit_ID=Q69TI6; Match level="QueryCoverage=84%, HitCoverage=99%, E-value=1e-141, Identity=67%"; Hit description=RNA helicase-like
  Pfam annotation: Domain name=DEAD; Domain location=40-241; Score= -23.1; E_value=0.0005; Accession=PF00270.19; Description=DEADDEAH box helicase
  Pfam annotation: Domain name=Helicase_C; Domain location=314-408; Score=52.3; E_value=1.6e-12; Accession=PF00271.21; Description =Helicase conserved C-terminal domain
  Pfam module annotation: Pfam domain module=DEAD::Helicase_C; Domain location=40-241::314-408
MEPVDATMPSVQRGSFSNRQTQFSERRQKIIQQRKSLPIAPVEKRLVEEVRKHDVLIIVGETGSGKTTQIPQFLFDAGFCCDGRVIGITQPRRVAAVTVAKRVAEECGVELGQKVGYSVRFDDATSGLTRIKYMTDGLLLREALLDPYLSKYSVIIVDEAHERTVHTDVLMGLLKSVQLARSSSVSGGQGLNFGNKNMNKLFEKENDQSGIFLKKPRHEKYAPLKLIIMSASLDARAFSEYFGGAKAVHIQGRQFPVDIFYTRDAETDYLDASLITIFQIHLEEGPGDILVFLTGQEEIESVERLISEKLPQLPQESQKLLVVPIFAALPSEQQMRVFAPSPSGFRKVILATNIAETSVTIPGIKYVIDPGFVKARSYDPGKGMESLIIIPTSKSQALQRSGRAGREGPGKCFRLYPEREFEKLEDSTMPEIKRCNLSNVILQLKALGVDDILGFDFIDKPSR

SEQ ID NO: 227312 - protein, 69 aa, Glycine max
  Coding DNA Sequence Number=SeqID_110534
MVQIERTFICVDAGALVEEPTKWFLPYKNASEGKSSNVECCHLGGFCKIKEGNRVSEKPLVAVRLGFNI

SEQ ID NO: 227313 - protein, 299 aa, Glycine max
  Coding DNA Sequence Number=SeqID_110535
MDARLEKVDEDLAEMKSSMELMRKEAADNQSKLIELMTWSLGSMGNRVNTGGKGEGSHKEKDPKESRVHDLLEMPTSEMAKSRGQRLDEDEMEEFRKSEKKVELTALVSLAQICMENGTIHFFNSLLLDYENLTWEDLKHELLERYEWVSEGSVFEQFTSLRQTGTMEKYIYRFKSLVVQVPRLLDGRVDMRGGGSGFGLVQKTHGTNTGHGVIRGVGFQGGTNGPCPNEKELSLAHEWAKRASTAKRSFSAFSTTEESGKASISRPRAKREISALSVVVVFSQAQCTTGAKLKSTYSR

SEQ ID NO: 227314 - protein, 137 aa, Glycine max
  Coding DNA Sequence Number=SeqID_110536
MKNKALATTTKICSNPNQETDHWGQYVTCAWLHGLKGLHDPRSYGPIIWCANITLMVKKFLTHGISLLNLVQLGPSALAANGLHNGSLVQCRFSSRVFGMDKRYWFIPAYSEEDIRRMAVLQGLEYPSTPDFNAQDF

SEQ ID NO: 227315 - protein, 429 aa, Glycine max
  Coding DNA Sequence Number=SeqID_110537
  Homolog annotation: Hit_ID=O80383; Match level="QueryCoverage=49%, HitCoverage=42%, E-value=2e-67, Identity=62%"; Hit description=98b
  Pfam annotation: Domain name=HMG_box; Domain location=180-246; Score =69.3; E_value=1.2e-17; Accession=PF00505.9; Description=HMG (high mobility group) box
  Pfam annotation: Domain name=HMG_box; Domain location=65-132; Score =61.0; E_value=3.9e-15; Accession=PF00505.9; Description=HMG (high mobility group) box
  Pfam module annotation: Pfam domain module=HMG_box::HMG_box; Domain location=180-246::65-132
MVSNEEHGLKILDFWGENSGPMTWRLTLAEVRHVLGLLVDFKLEAIAAVKLYKNYIIIKGCSEKKRPSPPYILWMKDQRNEIKKVNPEAGFKEISTMLGVKWKTVTAEEKKPYEGIYHAEKEAYLQVIAKEKHETESMRLLEDEQKQRTAMELLEQYMQFKQEAEKDGKKNKKEKDPLKPKHPMSAYFLFTNDRRAALAAENKNFLEVPKITFEEWKNMTEEQKRPYEEMAKKNKEQYALEMEAYKQKKDEEAGHFMKEEEDHMKASEETQQGQVSRSCVVYCLGVVIIEILTARFPSQYVSNGKGSRNWLAEMEQLLLIGAACTESNPQQRLDMAEAIRRIMEIKFECASIDNVKAVKAILRSYEMVFGLRINFGSSQFGDVATYHSARGQREGSRVCLPWEEDARSRHQRLFEENVGKNQKGVVYEL

SEQ ID NO: 227316 - protein, 198 aa, Glycine max
  Coding DNA Sequence Number=SeqID_110538
  Gene Ontology: Mol. function=RNA-directed DNA polymerase activity; Cellular component=chromatin; Biological process=chromatin assembly or disassembly
  Pfam annotation: Domain name=rve; Domain location=48-187; Score=59.8; E_value=9e-15; Accession=PF00665.16; Description=Integrase core domain
MKDERNASSGDVSTSRTSQSLTDLSYALKMASSSLSVLCQGLLQPLPILERVWEDIYLDFITGLPRSKGHEGILVVVDRLSKYSHFIPLKHPYTVRSIANVFVKEVVRLHGIPNSVISDKDPLFMSLFWSEFFKMQGTTLKMSTTYHPQTDDQTEPKEWVTWIPWAEYWFNTTYHESIGTTPFEVIYGREPPKIVRSI

SEQ ID NO: 227317 - protein, 100 aa, Glycine max
  Coding DNA Sequence Number=SeqID_110539
MAAALDSKRENAVGHSSNSQQQDSTTPQIAQLLLSYPNFVWGPLFDSMQPLLDRLEGVQIATRPTWAFQEVPPKGGAFWRKQPSSPGRAGWQASPSFPYK

SEQ ID NO: 227318 - protein, 117 aa, Glycine max
  Coding DNA Sequence Number=SeqID_110540
MQSNIYTGLDETYLEQESFDGEEDNEKEKTTRRRRNIPRCGGKGEEPQSCHDARRARKLRWRRRQCEGDETYLGMVAKEKKQRLVTMLECDEHDAQMQNRDLQGRRRLEEEEESAKA

SEQ ID NO: 227319 - protein, 180 aa, Glycine max
  Coding DNA Sequence Number=SeqID_110541
  Homolog annotation: Hit_ID=Q1S4V6; Match level="QueryCoverage=46%, HitCoverage=11%, E-value=2e-09, Identity=34%"; Hit description =Ribonuclease H
MIDSDQCSRCGSKSESIMHVLMDCEEIQKFWFQFVSQDCWANFFGVGLHDWLLFNLDKFLMQAPISKWSSFFDLMIYYLWRDRNDVVFNNKSNIQSTLIQQILSQLRNIVRDIQTSLWPADWNASLVHSYREANRAADFLANLGHRAIFVVSVIDTFPPTLRLILSDDARGVVFKRSIAL

SEQ ID NO: 227320 - protein, 59 aa, Glycine max
  Coding DNA Sequence Number=SeqID_110542
MGKVGSHTSNQLWLCQFQINGPGGGVRLGGGVRLGGWFESLCGAWEGVTTVVVELVIFF

SEQ ID NO: 227321 - protein, 210 aa, Glycine max
  Coding DNA Sequence Number=SeqID_110543
  Homolog annotation: Hit_ID=Q1T1Y0; Match level="QueryCoverage=44%, HitCoverage=24%, E-value=9e-10, Identity=41%"; Hit description =Ankyrin
  Pfam annotation: Domain name=DUF1723; Domain location=52-101; Score =46.2; E_value=1.1e-10; Accession=PF08330.1; Description=Protein of unknown function (DUF1723)
MDNAYHVVARVWTGELASHGRKVEKFGRSALKIEDIMVATTLSSLITCLLETSDKGLLYAFAKRWHKETSSLHLPIGNATITLDDVVSLLYVPITGAFHTFDAIDVEEAVTSDYMKWFYRISHLFMSPSQLKDPPRHPPVVQDDTFILLDPPMLPVLLATMPQPPVPTTTDANMPRHAMIAESLEHMINMRMVTARTNAYTLTEHCLRLA

SEQ ID NO: 227322 - protein, 140 aa, Glycine max
  Coding DNA Sequence Number=SeqID_110544
  Homolog annotation: Hit_ID=Q1SQF8; Match level="QueryCoverage=36%, HitCoverage=13%, E-value=3e-08, Identity=55%"; Hit description =Cyclin-like F-box
  Subcellular localization annotation: CTP_CleavageSite=42; ConfidenceScore=5.11e-01
MQRAYASLCKEKSSSTKVLKTRKYENVSAQSLSLVVKLTYARCMLFNAGKCREFVVHAKTMQTASSIGAFAVAVTRGEYAIATSGFHGVASPIGDFAMQGGVASQTGEFQAQGAGFSAFSGFLVGRLFQLAGAGVQATGK

SEQ ID NO: 227323 - protein, 77 aa, Glycine max
  Coding DNA Sequence Number=SeqID_110545
MATGEYTGSSPQKWHLQSPFFLLHSTAIKLQEAKDSIDEEDPRPTSCTWSYIMWYQEHLCLGDVLLLPLSFCLVNSL

SEQ ID NO: 227324 - protein, 145 aa, Glycine max
  Coding DNA Sequence Number=SeqID_110546
MAVPDSKSNSVLGVFYDVGERVKRSKGIIGSQKVINEVTWSSEGRKCGDHSAWKGLRTLEMECVVEEDPERDPDSGDQSWSSAKPENNLGFTRSPHLSPSMKGQKLKSLKIKSDENQLRSIDLEAKHEFDGLITRVCPKQTVNKV

SEQ ID NO: 227325 - protein, 272 aa, Glycine max
  Coding DNA Sequence Number=SeqID_110547
  Homolog annotation: Hit_ID=Q00TI8; Match level="QueryCoverage=38%, HitCoverage=38%, E-value=3e-15, Identity=37%"; Hit description=[S] KOG4533 Uncharacterized conserved protein
MNNYPFGSQAPKSFPAYPRTEFDLESGTAIKRTRKPKNSPFHLLRMIKSFGNRFHHFFKLHPLMGLFLALSFLLTLVMILSLYGTQYGVQSGGYVKSDMGFDDYPFSKLQNLVMVAGHSIYTSSSCGKIEKEDSWFLESYQKNPGQAATFVTHIHEGIEVVARDDSALLLFSGGETRRDAGPRSEAQSYWAVADSKGWFGELWRRNRIELSDCTGIHPLRRFIAGIRRVARKHYQSRGNRIELPDCTVIVLVNHPLRRFIAGRGRVIPSLIN

SEQ ID NO: 227326 - protein, 163 aa, Glycine max
  Coding DNA Sequence Number=SeqID_110548
MVPSGIPKMMNYALWKDDRKWILNEGGFSGSEGRATYRSYTSYKTTYEFVSKKPVGTNPKEGSMMDFATGRTKCHAKSFVLMPKEELYIKDQWARQFGEEVEAHEDQGHHWENKILNHLSPRPDVLIEIQPVLILDLHDTCDVLYAYDLHDIVLGDGAKSLSF

SEQ ID NO: 227327 - protein, 73 aa, Glycine max
  Coding DNA Sequence Number=SeqID_110549
MSASQFGGECAYCNSLAVEESEYAFMDVIESNSLEIGSTNVDSDSSEMELDMGDEMTTLSMMKNKQEQQQKMQ

SEQ ID NO: 227328 - protein, 128 aa, Glycine max
  Coding DNA Sequence Number=SeqID_110550
  Gene Ontology: Cellular component=integral to membrane
  Homolog annotation: Hit_ID=Q00TI8; Match level="QueryCoverage=70%, HitCoverage=35%, E-value=2e-10, Identity=37%"; Hit description=[S] KOG4533 Uncharacterized conserved protein
  Subcellular localization annotation: CTP_CleavageSite=60; ConfidenceScore=5.11e-01
MATLMSYTLLALFFPYTFVACLQSNLLNLGIRFAHLHRSAISFPESRFFYAGTPATSNAKAAALKGEELVRTQFQVDPYGCRGSLYHKKLKRDPFHRSIPYPNGCPEIEGLFRYCGPTPYPGALPWAQ

SEQ ID NO: 227329 - protein, 380 aa, Glycine max
  Coding DNA Sequence Number=SeqID_110551
MYLEGVKARVVLFGNRDERAKRACALSLFIATAKRTLCPKPECHFDEAKLSTPCCTKLQLSSMASKKRKAPSTPTQARFDRSRNVVVYYTEFDEFKEELERRHWDEKLTDFADSSIDIAIVKEFYANLYDPEDKSPKQVSVRGHLVKFDENTLNTFLKTSVILEEGENLCTYSRFALLRPNPQELAAKLCIPGKGFELNADGAKLIYGIIMKMDMNLGYLISHQISLIAQHDTSRLGFPALITTLCKARGVQSDSRSLQNLSPAINLAYIKKNCRNLDDPTVTFRGPIPPIQTPVIPPASTQIPLPAPISAGLSDFVFTPQMLHSMLQSLHRGCTHGSEGGDFYRPDPKAIPAPIPDDAIPSAPASKLGQPISQDSPIAQ

SEQ ID NO: 227330 - protein, 97 aa, Glycine max
  Coding DNA Sequence Number=SeqID_110552
MEKPKEELVKKEDLLSRLKPIQDELCLVHLKLTKHRFTKVAYQKNKYFLYFYAKDIVEKTGRLCSEESRPDGEKTNNSRQRKTQKDYKRGYQKGSRN

SEQ ID NO: 227331 - protein, 73 aa, Glycine max
  Coding DNA Sequence Number=SeqID_110553
MEKNTNTRLKDLNETEDKDVSHLQRKRKVKVDNAAPSDKEPIIAFVVSRKMKTRANSSISEKEVDFTFSFSGN

SEQ ID NO: 227332 - protein, 149 aa, Glycine max
  Coding DNA Sequence Number=SeqID_110554
MQKVNEQVESNAAKVVEVILICQPEPASNSDKAERRNSNASKSGHGETKRRNKNGTTSLCYTTKIGESAKYKQSIQSAIATQFANLPQMLLQNLQQAQQNMLGVVIQPPPIIQQQPTPSILLAPIEGKPSSPTSTPPVQPPPPPSTNQE

SEQ ID NO: 227333 - protein, 68 aa, Glycine max
  Coding DNA Sequence Number=SeqID_110555
MELKREIEKSISLCERRWKRQSYRVAYIIGNGETLIRYLKAHLLTYPKWPCPSIIVNYTGPNLVSPSK

SEQ ID NO: 227334 - protein, 188 aa, Glycine max
  Coding DNA Sequence Number=SeqID_110556
  Gene Ontology: Mol. function=kinase activity
  Homolog annotation: Hit_ID=Q5Z7P9; Match level="QueryCoverage=95%, HitCoverage=34%, E-value=1e-28, Identity=41%"; Hit description=MAP kinase activating protein-like
MGVAAVVHLYVFPAEPYKKGERCVRNVAVMDDYASLGSPLDPEEVQDSQRSTRTWLGAHNNEREKRPMKFTQSVCDVVVGSGEILSASFMFQIVDDMKFTVSHVVEPVERGIAKINKTFHQISENVKRHEEQRTRNTKDDCDLVPLRSRMSEFSDVHDIMGEGSVSDSGMSSGKRHHFQSKEASNHQK

SEQ ID NO: 227335 - protein, 71 aa, Glycine max
  Coding DNA Sequence Number=SeqID_110557
  Gene Ontology: Mol. function=kinase activity
  Homolog annotation: Hit_ID=Q6ESQ4; Match level="QueryCoverage=68%, HitCoverage=10%, E-value=6e-11, Identity=59%"; Hit description =Putative MAP kinase activating protein
MWHQNLGVDSTGTVSLTVFSASIFVLVALVLSMYLVFEHLAAYNQPEEQKFLIGLILMVPVYALESVRDTK

SEQ ID NO: 227336 - protein, 305 aa, Glycine max
  Coding DNA Sequence Number=SeqID_110558
  Gene Ontology: Mol. function=kinase activity; Cellular component =integral to membrane
  Homolog annotation: Hit_ID=Q5Z7P9; Match level="QueryCoverage=77%, HitCoverage=44%, E-value=5e-68, Identity=54%"; Hit description=MAP kinase activating protein-like
  Pfam annotation: Domain name=DUF300; Domain location=42-304; Score =188.5; E_value=1.6e-53; Accession=PF03619.7; Description=Domain of unknown function
MDEHSLLQHPNSLQAGSKIVWPFTIAFIQELKNDLSQRDATHFHSSTPCGCWGTWLFLGSSDVCMVQFLSVLNSDAAFNSEIIRECYEAFALYCFERYLIACLGGEEKTIQFMENMSLTESSIPLLKEAYAYGVVEHPFPLNIFLEDWNLGPEFYQSVKIGIVQYMILKMICALLAIILESFGVYGEGKFEWKYGDMKIILASPPICLRFMENWLLTWYPYLALVLNFSQTWALYCLVQFYAVIKDKLKPIKPLAKFLTFKSIVFLTWWQSVAVAFLFYMGAFRGSLAQELKTRIQDYIICIEHS

SEQ ID NO: 227337 - protein, 117 aa, Glycine max
  Coding DNA Sequence Number=SeqID_110559
  Subcellular localization annotation: CTP_CleavageSite=56; ConfidenceScore=5.48e-01
MWDFTSHLYSNNLPLMCDTYPHGSLPLKRKSFSPMSISMVQPGPLGPSRFFLQKAVAFGGSNLARLGELGDKLLPYFAINRGRSGEENGSAFLALRIHLKLLRKIVSVKKIQAEALP

SEQ ID NO: 227338 - protein, 88 aa, Glycine max
  Coding DNA Sequence Number=SeqID_110560
  Gene Ontology: Mol. function=transporter activity; Cellular component= membrane; Biological process=transport
  Homolog annotation: Hit_ID=Q46817; Match level="QueryCoverage=98%, HitCoverage=19%, E-value=3e-38, Identity=90%"; Hit description =Hypothetical protein ygfQ
  Subcellular localization annotation: CTP_CleavageSite=31; ConfidenceScore=5.11e-01
MPVTEISVNSRPIRKTAPSATGTLMCWPSTRLNAVKAVREMAQPIAIGRLAHSPMMREPKLATRQVATNTAVGEKPALPSMPGTTMTE

SEQ ID NO: 227339 - protein, 98 aa, Glycine max
  Coding DNA Sequence Number=SeqID_110561
MVMVTRDDWGDEEMAMTVSQNASEGERVCEIEHAGGKERLMVALHNHSDHLFLVSDPHLQHTLPHGTTNSVPNLLELNAFYSPNSCKMELKQIETLDL

SEQ ID NO: 227340 - protein, 70 aa, Glycine max
  Coding DNA Sequence Number=SeqID_110562
  Pfam annotation: Domain name=zf-GRF; Domain location=37-70; Score =5.2; E_value=0.0071; Accession=PF06839.3; Description=GRF zinc finger
MTNMEIGIDMSLLSVSLRSGAMERSSSSYTSEARSCVFCLCNIEAPLVTSWTEENPGRHFYGCGLDEGGR

SEQ ID NO: 227341 - protein, 90 aa, Glycine max
  Coding DNA Sequence Number=SeqID_110563
  Homolog annotation: Hit_ID=Q9LUY5; Match level="QueryCoverage=46%, HitCoverage=7%, E-value=3e-07, Identity=69%"; Hit description =Similarity to damage-specific DNA binding protein 2
MWLSRPRLRTDGLIHENDCMVYSASSNGTISCTDLETVISSSPVIRNPDGWQGSANKWSANSVRTAVGEQFDAITAAREGLPVLFRRGTL

SEQ ID NO: 227342 - protein, 124 aa, Glycine max
  Coding DNA Sequence Number=SeqID_110564
  Gene Ontology: Mol. function=nucleic acid binding; Cellular component= nucleus; Biological process=DNA integration
MALVAHFDLELHPMDVKTGFLNEDLEENVYMDQPMGFLVEGMKYMENIVDRCIYLKGIKDHMVTYRRFDHFEVIGYLDSDFVGCVDTRKSTLGFVFLLAGGTISWKSAKQFVVSTSTMEVGFVA

SEQ ID NO: 227343 - protein, 63 aa, Glycine max
  Coding DNA Sequence Number=SeqID_110565
  Subcellular localization annotation: CTP_CleavageSite=51; ConfidenceScore=5.38e-01
MASLLHQTLLIETNNVLRSKFLPKKHERGTSSVCPASNSHRTRMRVRLRCNTMSVSSAVTRHG

SEQ ID NO: 227344 - protein, 888 aa, Glycine max
  Coding DNA Sequence Number=SeqID_110566
  Gene Ontology: Mol. function=RNA-directed DNA polymerase activity; Cellular component=chromatin; Biological process=chromatin assembly or disassembly
  Pfam annotation: Domain name=Chromo; Domain location=481-530; Score =41.5; E_value=3e-09; Accession=PF00385.14; Description='chromo' (CHRromatin Organisation MOdifier
  Pfam annotation: Domain name=PPR; Domain location=604-638; Score=2.6; E_value=3.7; Accession=PF01535.11; Description=PPR repeat
  Pfam annotation: Domain name=PPR; Domain location=666-700; Score =24.5; E_value=0.00038; Accession=PF01535.11; Description=PPR repeat
  Pfam annotation: Domain name=rve; Domain location=355-534; Score =15.5; E_value=0.0003; Accession=PF00665.16; Description=Integrase core domain
  Pfam module annotation: Pfam domain module=Chromo::PPR::PPR::rve; Domain location=481-530::604-638::666-700::355-534
MEDDELLDEKIEVIKENKVITVTSNQRDKAQQPMNALSASTYQTMRPRSWGELESITPLPVTMENGTQLEALYVCRHFLPQLQQTQFTFDARNGVFYGRCEEFQNIFQEPTQIPPRRAGFYHKIPLKEESIPFNMRPYRYSIIHKDIVDKLVEEMLNQGIIWRLNQQAVKDKFPIPLIEDLMDELKGSSIYSKLDLCSGYHQVRMEEGEDRASALLPPHEKSTWAILFPKKGRFVQNFGSISKPLNDMLKKDCFQWSIESKDAFHYLQQALISTPILALPNFSKPFVVEADASGSGVGVVLMQEKHLIAYISKALGPKQLAMSIYEREFLAIVYAIQKYKPDLAASPNLLQPLPIPHWVWNVISMDVIEGLPHSHSKQAIFVVVDRLSKYACFLALAYPYTDLDIAQLFLDHIVKLHGWPTTITCDRDPIFVSGTWSELVQLHGTSVNKSMTYHPQTDSQTEVVNKPQPLPTNSTMSFKKAEPEAILDRKMVKRGRVATTKVLIKWKGLPVEHATWENYSYIESPVLGSTNSWRTYLPEMPLKTTFLWNTILSTTPRLATWTLRADAIHMFLQMVPPGISDQALDVGKKVHSFIVKLGSSGVILMANSLLNMYAKCGDSIMAKVVFYWMRLKDTSTWNTMIYMHMQVGQFDLALALFDQMTDPNIVTWNSIISGYCRQGYDIKALETFPFMLKSSSLKSNKFTLQSILSACVNPESLKLGKQIHAHIVRADVDITRWLLKNCFLLIPIALANTLSTCGKWDVAAKDSLHPQRDAIYHMISKIWKEIKKMGFIPDTNFVLHDLEQEVKEQILRHHSEKLAIAFALINTPVHTTLRIIKNLRVRWFLLLSGLLIEEIVEFHVLKGMIGGMIESIKLTDEVSYYQIGHVQE

SEQ ID NO: 227345 - protein, 142 aa, Glycine max
  Coding DNA Sequence Number=SeqID_110567
  Gene Ontology: Mol. function=NADPH-hemoprotein reductase activity; Biological process=electron transport
  Homolog annotation: Hit_ID=Q1STX7; Match level="QueryCoverage=38%, HitCoverage=7%, E-value=4e-17, Identity=74%"; Hit description =Flavoprotein pyridine nucleotide cytochrome reductase; Flavodoxin/nitric oxide synthase
MEAFGSLAGNGKEKMKKNHFPEETDIVLHRSRTRIRVRCEFDAGHTDEVPPFNGAGLSAEEDGDLLGVIVNFDFGKLLDDAFRRLERLGLGGGGSAPDEDDDTADEDDEEGGEEHEEVTGVIHALGFGGEEWGVAGGGVVER

SEQ ID NO: 227346 - protein, 378 aa, Glycine max
  Coding DNA Sequence Number=SeqID_110568
  Gene Ontology: Mol. function=RNA binding
  Homolog annotation: Hit_ID=Q1T290; Match level="QueryCoverage=88%, HitCoverage=85%, E-value=6e-55, Identity=42%"; Hit description =Cyclin-like F-box
  Pfam annotation: Domain name=F-box; Domain location=31-78; Score =36.9; E_value=6.8e-08; Accession=PF00646.23; Description=F-box domain
MEGKETEGMLKMTTDKRQQKRSRSDREEERDRLSELPDCVVLHIMEFMDTKYAVQTCVLSKRWKDLWKRLTYLGFNTTLFNNVVKFNKFVSRVLSGRDGSVSLLNLEFTRRGMAEPKLFNRLMKYAVLHNVQQFTVSLNLSFRQSFEFRPYIFSCESLTFLKLSFNSFDTSIVALPGSLNMPALKSLQLEAVSFTARDNDYAEPFSTCNVLNTLILDGCSLHKDAKFLSISNSSLSSLTISGSFEGGAYKIALSTPNLSSLTVTGHNNHTISSACNLSFLEEVTIDTLGYTLFPNTDLLIISWLQVLTNVRILRLYSGTLLTILRDISNPVSVSTQPPCFVQLKSLILENQPSADISFEQLKRAVEYLLQNSPQRRID

SEQ ID NO: 227347 - protein, 116 aa, Glycine max
  Coding DNA Sequence Number=SeqID_110569
  Gene Ontology: Mol. function=hydrolase activity, hydrolyzing O -glycosyl compounds; Cellular component=vacuole; Biological process =carbohydrate metabolic process
  Homolog annotation: Hit_ID=O49012; Match level="QueryCoverage=72%, HitCoverage=35%, E-value=2e-31, Identity=71%"; Hit description=Beta -1,3-glucanase 3
MSVSAILLLVGILSSIEVLEFTAAAPLVAPIVGICYGINGNNLPSKQEVVDMFKSRGIPRMRIYSPDEEIIQALRGSRIELVMDVAGDTIQSLTDPNVAADWVHRYITSYSQDVNF

SEQ ID NO: 227348 - protein, 33 aa, Glycine max
  Coding DNA Sequence Number=SeqID_110570
MKQNLENKVKRQIVDIMEELSASESPTNSSAQV

SEQ ID NO: 227349 - protein, 251 aa, Glycine max
  Coding DNA Sequence Number=SeqID_110571
  Homolog annotation: Hit_ID=Q88EL2; Match level="QueryCoverage=40%, HitCoverage=50%, E-value=3e-16, Identity=45%"; Hit description =Phosphoglycerate mutase family protein
  Pfam annotation: Domain name=PGAM; Domain location=150-229; Score =23.3; E_value=3.5e-05; Accession=PF00300.12; Description =Phosphoglycerate mutase family
DNLADSIVLCDAYFSSADCEFMQLVLAECPDAKLTVLTSMKGVSHEEFSQDLFLSRWKLLSDDDPPDTEIIAIAGYDNKGQILIHDRWLISGDAALRLGTSFNSLGMGKLSELSPVVAEGCPAVLEEIAKYKAKNRLVNGVRAQTRRGKMLVMVRHAQSMANAGFVTADPESIALTALGEEQARALAMTWSAAPDRIFTSPFFRARQTSQPLAERFKLVVAPLGVQEFTYLSPERCVGTSAADRKQWVEDY

SEQ ID NO: 227350 - protein, 142 aa, Glycine max
  Coding DNA Sequence Number=SeqID_110572
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSMECTLSRWRMQSWEGSEESESTVKQLHHFGCSGLQVMNTQFLNWV

SEQ ID NO: 227351 - protein, 55 aa, Glycine max; identical to SEQ ID NO: 204898
  Coding DNA Sequence Number=SeqID_110573

SEQ ID NO: 227352 - protein, 131 aa, Glycine max
  Coding DNA Sequence Number=SeqID_110574
MMMSGLFVKRFNEFLRNKGNQRRSNINPKKKGEDSSLAPKFYECDQLGHLRFDCLIFKRRMEKSDKRNFKEKKACITWEDNDMDSSSDSENEIINLDLMAKDYESGEEVFMMPKRIHLITIVIIKKGENVN

SEQ ID NO: 227353 - protein, 58 aa, Glycine max
  Coding DNA Sequence Number=SeqID_110575
MTCAPEPMAESARSEVACSARSEGVPTGAKSMIRFAHDRRKELGRMRWQSLGYNHASG

SEQ ID NO: 227354 - protein, 81 aa, Glycine max
  Coding DNA Sequence Number=SeqID_110576
MAYTLATISSMIKVSPHGDLPCINIKCRVELAHYCLIEEEKDASYANVTRKVVARFIKKEIICRYGLPRKIITDNATNLNN

SEQ ID NO: 227355 - protein, 120 aa, Glycine max
  Coding DNA Sequence Number=SeqID_110577
MGKLKPKGERSLDRSDHVSCILQIYINFSSALLVLCVKVVGKRIAYIALRGTSDPLLSSSHSCCAVVFSMEMLCVELKFSIVKYFTILKTNEHAEMKTPLGPVHAAKLKFQLLWHQQQQQ

SEQ ID NO: 227356 - protein, 357 aa, Glycine max
  Coding DNA Sequence Number=SeqID_110578
  Gene Ontology: Mol. function=zinc ion binding; Cellular component =nucleus; Biological process=regulation of transcription
  Homolog annotation: Hit_ID=Q1S7P1; Match level="QueryCoverage=99%, HitCoverage=100%, E-value=1e-58, Identity=43%"; Hit description=Zinc finger, Dof-type
  Pfam annotation: Domain name=zf-Dof; Domain location=57-119; Score =136.3; E_value=8.5e-38; Accession=PF02701.6; Description=Dof domain, zinc finger
MSANCEKMVAIPPTTNQWPQVDDHKVLMGSNGGSSNNNNNKVLEKPGQDQLVQQQQQQQEAPKCPRCDSSNTKFCYYNNYSLSQPRHFCKACKRYWTRGGTLRNVPVGGGCRRNKRVKRPLITTNPSSAAIDTAASNNSSNSSSAPLQPPIDTASTSNHINPLFYGLPSSSSDVNLPLFSRFGSRISSSGFDLQLNNALGLGFSSGVLSNEASDNNGYRNWFGSNNTLLSSYTSTTSTTTPAMSSLLSSSLLQQKFMTDGVDSTNTFQHGLGLTPLEQLQMASDHSSEAGMVALKDVKVELGQNNRLEWNNGAACQSQIQHVGLYDPSLYWNNSAATALGVWNDQAANIGSSVTSLI

SEQ ID NO: 227357 - protein, 66 aa, Glycine max
  Coding DNA Sequence Number=SeqID_110579
MELILNIDCGGEEMKCYGNRYVWECHGLVLMSRKEKPMGLLFAIQVAIEMGLQQVCFESDCNKWTN

SEQ ID NO: 227358 - protein, 495 aa, Glycine max
  Coding DNA Sequence Number=SeqID_110580
  Gene Ontology: Mol. function=DNA binding; Cellular component=nucleus; Biological process=regulation of transcription, DNA-dependent
  Homolog annotation: Hit_ID=Q2HTS2; Match level="QueryCoverage=99%, HitCoverage=93%, E-value=1e-111, Identity=59%"; Hit description =Lissencephaly type-1-like homology motif; WD40-like
  Pfam annotation: Domain name=WD40; Domain location=204-242; Score =19.1; E_value=0.016; Accession=PF00400.22; Description=WD domain, G -beta repeat
  Pfam annotation: Domain name=WD40; Domain location=246-284; Score =38.9; E_value=1.8e-08; Accession=PF00400.22; Description=WD domain, G-beta repeat
  Pfam annotation: Domain name=WD40; Domain location=289-328; Score =23.3; E_value=0.00085; Accession=PF00400.22; Description=WD domain, G-beta repeat
  Pfam annotation: Domain name=WD40; Domain location=332-367; Score =7.8; E_value=4.5; Accession=PF00400.22; Description=WD domain, G -beta repeat
  Pfam annotation: Domain name=WD40; Domain location=375-412; Score =33.8; E_value=6.2e-07; Accession=PF00400.22; Description=WD domain, G-beta repeat
  Pfam annotation: Domain name=WD40; Domain location=415-453; Score =12.0; E_value=1.5; Accession=PF00400.22; Description=WD domain, G -beta repeat
  Pfam annotation: Domain name=WD40; Domain location=457-495; Score =22.6; E_value=0.0014; Accession=PF00400.22; Description=WD domain, G- beta repeat
  Pfam module annotation: Pfam domain module=WD40::WD40::WD40::WD40::WD4 0::WD40::WD40; Domain location=204-242::246-284::289-328::332 -367::375-412::415-453::457-495
MNFLDSVVDSPDGFLLEWWSIFYEVFNSRQGKDLETGPGSSSKVPMMTHNARNNAPPRIPQISMSEQRTPQFQVNSSFNNMMAQPAVCVIPSTMYNKEEHLGYLPENVEPSLHDVIKNNLTFLSGISSNYPPQDVLSKQAQKQVFKDSRVGMSVERDIPRDPLDDAILAQAIAGTSKNQTSTVPENSSKCNTRKISETESRDKDKQVGCLHSSKSKVLSSHFSSDGKVLASAGHEKKVFIWNMENFDCVTTTETHSLLVTDVRFRPGSTIFATSSFDRSVRLWDAARPTSSLLKLTGHAEQVMSLDFHPRKVDLLCSCDSNDVIRLWNINQGVCMHITKGGSKQVRFQPSFGKFLATATENNIKIFDVETDSLLYNLEVTFEGHVNDVLSICWDKNGNYVASVSEDTARIWSSDGKCISELHSTGNKFQSCVFHPEYHNLLVIGGYQSLELWSPSESSKTWAVPAHKGLIAGLADSSENEMVASASHDHCVKLWK

SEQ ID NO: 227359 - protein, 135 aa, Glycine max
  Coding DNA Sequence Number=SeqID_110581
  Homolog annotation: Hit_ID=Q6L3K2; Match level="QueryCoverage=36%, HitCoverage=18%, E-value=4e-17, Identity=72%"; Hit description=Dof domain, zinc finger family protein
MDYKEPQDLRVKEMQRIPNNPKSVLDATLSTRNFAITTTIVCHGLVTFPNHAGGPGLKVMLDFLDSLLMWNKCSNKKPRNAAERSRDAGYDSAEARGKADEMSKEQAQEVKESTKEYAQDAEGREGKSRVCKREG

SEQ ID NO: 227360 - protein, 317 aa, Glycine max
  Coding DNA Sequence Number=SeqID_110582
  Gene Ontology: Mol. function=zinc ion binding; Cellular component =nucleus; Biological process=regulation of transcription
  Homolog annotation: Hit_ID=Q1S7N0; Match level="QueryCoverage=87%, HitCoverage=82%, E-value=6e-48, Identity=44%"; Hit description=Zinc finger, Dof-type
  Pfam annotation: Domain name=zf-Dof; Domain location=34-96; Score =135.7; E_value=1.3e-37; Accession=PF02701.6; Description=Dof domain, zinc finger
MEQRVGEGGGMNKQPRDSRVKEIQQGDAQVHAQAPQQPQKCPRCDSLNTKFCYYNNYSLSQPRYFCKTCRRYWTQGGTLRNVPVGGGCRKGKRAKTSNSSSSSENINSSFRSLPLQQPQGMVVQTQAPPLTSVVKAKDPSSVVASPFYQSGGYLSSLAAMHSLNPSSSHPFDQSLNVIAGSDALRSSNLGLLSGFNVQRPIGQICPPYLYHQMGSDEREMVSLYEQGLVNPSSSSMANTNTNTNGSGVSQHDWPQSFINNNVSNRASDASLWSTISTTIGGNSERTSTSGVGVDVGAGSSSFVTNQWPNLPGYGPPP

SEQ ID NO: 227361 - protein, 102 aa, Glycine max
  Coding DNA Sequence Number=SeqID_110583
TFFEAGLLLSNPARLGELRSPGRAGRQPPPPFSYKKAEGGCSKDPSAPWLCISAVLGEKNCFREENPSRGASVTLPRCFRKQIREGFRPFFIVLHPFFVLQR

SEQ ID NO: 227362 - protein, 79 aa, Glycine max
  Coding DNA Sequence Number=SeqID_110584
MANQEEWVPFADILALLIFGVVLFPNVDGLVDLAAIDAFLAYHHSKESLVEVAQSTGFLDGRKERREFSSHVGTTQTFR

SEQ ID NO: 227363 - protein, 78 aa, Glycine max
  Coding DNA Sequence Number=SeqID_110585
MFALKHHQRFNVAKQDEVHGSDNDDDDGDDHGDDDDGEDVKGGMVNGDEESELGSNTVIKLSRNMNNVKALAIFLLKW

SEQ ID NO: 227364 - protein, 99 aa, Glycine max
  Coding DNA Sequence Number=SeqID_110586
MGVATCTQHYCWGTQQTVKWRNCPSAIILPEEGSSGKFPEIIFPESFRKNNLCLPEILTDNFRKNVIRNVSGRSFFRKNSSVFRKKLLPEVFRKKLLPE

SEQ ID NO: 227365 - protein, 536 aa, Glycine max
  Coding DNA Sequence Number=SeqID_110587
  Gene Ontology: Mol. function=protein serine/threonine kinase activity; Cellular component=membrane; Biological process=protein amino acid phosphorylation
  Homolog annotation: Hit_ID=Q39886; Match level="QueryCoverage=91%, HitCoverage=99%, E-value=0.0, Identity=87%"; Hit description=Protein kinase
  Pfam annotation: Domain name=Pkinase; Domain location=157-444; Score =183.8; E_value=4.2e-52; Accession=PF00069.15; Description=Protein kinase domain
  Pfam annotation: Domain name=Pkinase_Tyr; Domain location=157-441; Score=195.6; E_value=1.2e-55; Accession=PF07714.7; Description =Protein tyrosine kinase
  Pfam module annotation: Pfam domain module=Pkinase::Pkinase_Tyr; Domain location=157-444::157-441
MGEDGYSWIRRTKFSHTVCHRLDPARLGSIPISVQSEQKSRPAASKAQRHPITNKQRSLSPLPETYLSEAFREARHEQKRFSTPNPRREKRIMGKLLNKDSRETKESSSKSPSHSPNRQVKSKNRKDSAWTKLLDNGGGKITAVETAEEWNVDMSQLFFGLKFAHGAHSRLYHGVYKEEAVAVKIIMVPEDDENGALASRLEKQFIREVTLLSRLHHQNVIKFSAACRKPPVYCIITEYLAEGSLRAYLHKLEHQTVSLQKLIAFALDIARGMEYIHSQGVIHRDLKPENVLINEDNHLKIADFGIACEEASCDLLADDPGTYRWMAPEMIKRKSYGKKVDVYSFGLMIWEMLTGTIPYEDMNPIQAAFAVVNKTFLNDQHGRVVQTKLLTIGHSFGLQLDKNSRPVIPSNCPPAMRALIEQCWSLQPDKRPEFWQVVKILEQFESSLASDGTLSLVPNPCWDHKKGLLHWIQKLGPLHQNSGPCYSDSFVRVTNPYAAMLLPLRGVLFLLLVVGGGGLWFLLVSVLLLSWVILFE

SEQ ID NO: 227366 - protein, 593 aa, Glycine max
  Coding DNA Sequence Number=SeqID_110588
  Gene Ontology: Mol. function=protein serine/threonine kinase activity; Cellular component=cell surface; Biological process =protein amino acid phosphorylation
  Homolog annotation: Hit_ID=O49445; Match level="QueryCoverage=96%, HitCoverage=83%, E-value=1e-157, Identity=50%"; Hit description =Receptor protein kinase like protein
  Pfam annotation: Domain name=Lectin_legB; Domain location=2-170; Score=166.3; E_value=7.7e-47; Accession=PF00139.10; Description =Legume lectin domain
  Pfam annotation: Domain name=Pkinase; Domain location=261-529; Score =127.6; E_value=3.4e-35; Accession=PF00069.15; Description=Protein kinase domain
  Pfam annotation: Domain name=Pkinase_Tyr; Domain location=261-529; Score=101.3; E_value=2.8e-27; Accession=PF07714.7; Description =Protein tyrosine kinase
  Pfam module annotation: Pfam domain module=Lectin_legB::Pkinase::Pkina se_Tyr; Domain location=2-170::261-529::261-529
  Subcellular localization annotation: CTP_CleavageSite=28; ConfidenceScore=5.01e-01
MAPFEDTLPGHGLVFIFTPVTGIQGTSSAQHLGLFNLTNNGNSSNHVFGVEFDVFQNQEFDDIDANHVGIDINSLKSYVSHDAGYWPDGADKSFKELTLNSGENYQVWIDYEDSWINVTMAPVGMKRPSRPLLNVSLNLSQVFEDEMFVGFTSATGQLVESHKILGWSFSNEKFSLSDELITTGLPSFVLPKDSIFKSKGFVAGFTVGVFFVICLLVLLALFLIQRKREKERKRMEMEDWELEYWPHRMTYEEIEAATKGFSEENVIGVGGNGKVYKGVLRGGVEVAVKRISHENDGLREFLAEVSSLGRLKQRNLVGLRGWCKKDVGNFLLIYDYMENGSLDKRVFDCDESKMLSYEDRIRILKDVAFAVLYLHEGWEDKVVHRDIKASNVLLDKDMNGRLGDFGLARMHSHGQVASTTKLVGTVGYMAPEVFKTGRASTQTDVYMFGILILEVLCGRRPLEEGKPPLVEWIWQLMVQGQVECALDERLRAKGEFNVQEMERVMHLGLLCAYPEPKTRPTMRQVVNVLEGKNEVEDSEIENMDTYLLQQLKSRDILSEYSQYFSYTSHPTFQDIRLSSSMSLTWSESVVEGR

SEQ ID NO: 227367 - protein, 106 aa, Glycine max
  Coding DNA Sequence Number=SeqID_110589
  Gene Ontology: Mol. function=protein serine/threonine kinase activity; Biological process=protein amino acid phosphorylation
  Homolog annotation: Hit_ID=O49445; Match level="QueryCoverage=61%, HitCoverage=10%, E-value=3e-07, Identity=47%"; Hit description =Receptor protein kinase like protein
MKEVEKGYTREEFGFLVGIFLLYKARPTENLCWWVSVRIRESTVALPKSNTSEELKPLKTKSMAHVELKRKRIERRIDGRWCVCLCLIMSLAENKQRGESEKDLRM

SEQ ID NO: 227368 - protein, 509 aa, Glycine max
  Coding DNA Sequence Number=SeqID_110590
  Gene Ontology: Mol. function=acyltransferase activity; Cellular component=integral to membrane; Biological process=biosynthetic process
  Homolog annotation: Hit_ID=Q8VWP9; Match level="QueryCoverage=98%, HitCoverage=97%, E-value=1e-165, Identity=55%"; Hit description =Fiddlehead-like protein
  Pfam annotation: Domain name=ACP_syn_III_C; Domain location=408-492; Score=14.2; E_value=4.8e-07; Accession=PF08541.1; Description=3 -Oxoacyl-[acyl-carrier-protein (ACP)
  Pfam annotation: Domain name=Chal_sti_synt_C; Domain location=352 -494; Score=-4.5; E_value=0.0042; Accession=PF02797.6; Description =Chalcone and stilbene synthases, C-te
  Pfam annotation: Domain name=FAE1_CUT1_RppA; Domain location=108-397; Score=586.5; E_value=2.4e-173; Accession=PF08392.2; Description =FAE1Type III polyketide synthase-lik
  Pfam module annotation: Pfam domain module=ACP_syn_III_C::Chal_sti _synt_C::FAE1_CUT1_RppA; Domain location=408-492::352-494::108-397
MSKDREEFSTEIVQRGVENSGPNAGFLSFSVKVKPRLPDFLSSVNLKYVKLGYGYLISHRLYLLLAPPLLAAFIARIGKFTWQDLYEKYGFIEILFISGLLGLMLYFYIDLTPGSTYLLDFSCFRPSDECKISKAEFIELAKKSGNFNDTAIEFQERVLKKSGIGDETYLPKRVFHPGYRNSLNDGRQEVSMVMFGAIKDLLAATKVKPKDIRILIVNCGILNTTPSLSSMIVNHFKLRHDIHSFNLGGMGCAAGITAIDLAKDLLDAYPRTYALVVSTEAVSSTWYSGNDIGMLLPNCFFRMGAAAIMLSNFHLDRWCAKYELKQLVRTHKGMNNRSYKSIHQREDSEGRKGISVSKDVIEVGGHALKANITTLGPLVLPVSEQLHFFTNLIFKKRKTKPYIPDYKLAFEHMCILATSKKVLDEIQKNLELTEEYMEASRKTLERFGNTSSSSIWYELAYLELNSRIKRGDRVCQIALGAGFMCNSVVWKALRNVGRPKQSPWIEDDS

SEQ ID NO: 227369 - protein, 151 aa, Glycine max
  Coding DNA Sequence Number=SeqID_110591
MDIDYAIRKDEPHAITDESRRWERFSRLSVMFIKTKILVGIRGFVDQHEKVLDLLKAIDDQFITSDKALASTLIMKFSSLQLTSVKGEEERLVMEMGKSALLQLLVGGTKQLSLDLIRRGMKKGRMKKNCLRFQKWLEKKGYAKPKETSGK

SEQ ID NO: 227370 - protein, 270 aa, Glycine max
  Coding DNA Sequence Number=SeqID_110592
  Gene Ontology: Mol. function=phosphoprotein phosphatase activity; Cellular component=membrane; Biological process=signal transduction
  Homolog annotation: Hit_ID=Q1LL38; Match level="QueryCoverage=99%, HitCoverage=66%, E-value=1e-51, Identity=44%"; Hit description =Serine phosphatase
  Pfam annotation: Domain name=SpoIIE; Domain location=132-270; Score= -24.0; E_value=0.015; Accession=PF07228.3; Description=Stage II sporulation protein E (SpoIIE)
MTRPFFRELYDRKSCIAFMDKQPLVIDAETELDRVAQQVVASGDKSVTDGFIVTEQGRYIGIGLGIDLIRTVSDLQAQQHQQILQSIDYARVIQDAMLDRSRQQMAQQLSDWCLHWQPRDGVGGDYYAFHRDEHGWLALIADCTGHGIPGAFMTVILHAALERALQHNHRTPSALLQALNRHIKQTLGQLNASQQTSLSNDGCDAIALRLETASHQLSWASARMHAVLQPVQGKPPRCRPIASALATPIHRTTIAGRSSSAHCSPAMCCW

SEQ ID NO: 227371 - protein, 339 aa, Glycine max
  Coding DNA Sequence Number=SeqID_110593
DDEYADFQEKIARRRWTSLVTPMAKFDPDIVLEFYANAWPMEEGVRDMRSWVRGQWIPFNADALSQFLGDPLVLEEGQKCEFSQRRNRADGFDEEAIAQLLCIPGQDFARTAAGRRVQIMCTSMTTLTQMWMTLLLSNVLPNDHNSDLPLSKCQLVYAILTQMSVHVAQLIADAIYLFAGMPPTRHPLDPDKSNRALGFPTLITGLCQSFRVPVTPSKVIRPPITRAFIEKYCTPRQAADAPPPPHQADPAGALAWSGIYNTWFASRRPTTGGNQQSQGFAPFACPTPDQFRTEVAWPGDWPEAQAGEAPAEAPGDAEEARMDEEMTDLLGFLGGSGAT

SEQ ID NO: 227372 - protein, 177 aa, Glycine max
  Coding DNA Sequence Number=SeqID_110594
  Gene Ontology: Mol. function=transition metal ion binding; Biological process=cytoskeleton organization and biogenesis
MQNNGVSLRVESQHFTTVHDDKPCVASMPYFGVIKEIWEVNYVKFSVCVFKCKWVDSNIGVRTDDFGFTLVDMKNFAYKNEPFIMAEQAKQVFYVQDPCDERWSVVLHEKTIGVNIKDDDLTLDTCLIPFSTQMLSNVNREEEINDVLTNRNDHDEGELINIHRMWDPLESTCRHAS

SEQ ID NO: 227373 - protein, 386 aa, Glycine max
  Coding DNA Sequence Number=SeqID_110595
  Gene Ontology: Mol. function=hydrolase activity, acting on acid anhydrides, in phosphorus-containing anhydrides; Cellular component =intracellular; Biological process=nucleobase, nucleoside, nucleotide and nucleic acid metabolic process
  Homolog annotation: Hit_ID=Q2P4Y0; Match level="QueryCoverage=99%, HitCoverage=56%, E-value=1e-156, Identity=72%"; Hit description=ATP -dependent helicase
RGAKPARRRIGQAFGQVTQCLLGPIERTRLDQRVRIVQAQARGDVVEATANGQRGRGENPRRAAALAMLAQRAGHIHRRTLAAETPRGELIPEHIGGTGSLRRIGIEIEGGLIIAQPALEPRHSFARPRMTGVQARRRFPQRLQCLLQRHQAGHHRIESIAHLWHRQRAPLRTTWRQPLHRRTQRQQRLLQLVDRFLQGRLRTAHAACFGQAVAAQLLPRAHAEAFAEELRGQLGQLMRLVDDKGLRPRQQLTEAILLQCQVGQQQVMVDHHHVGRLRTLARTHHETVIPERAIGTQTVVDGGGDHRQQRRVIGQAFQFGDVAELRAAGPGQDALELRGLLGAGKPRFTPRLLQSVAAQVIRASFQQARCAGRRPAPGAHAAGRGW

SEQ ID NO: 227374 - protein, 105 aa, Glycine max
  Coding DNA Sequence Number=SeqID_110596
  Gene Ontology: Cellular component=chloroplast
  Subcellular localization annotation: CTP_CleavageSite=68; ConfidenceScore=5.20e-01
MVGAGLKKDLRVSRVVPGGSLNAFLFLLIGVISQRLAMRNVAKGKRIRGATPSSPPRRNYEITPRTPSASRGRGPTIEPCSKKRNALAIRSQLDSKGRRRAITHS

SEQ ID NO: 227375 - protein, 95 aa, Glycine max
  Coding DNA Sequence Number=SeqID_110597
  Gene Ontology: Mol. function=RNA-directed DNA polymerase activity; Biological process=RNA-dependent DNA replication
  Homolog annotation: Hit_ID=Q1SAS4; Match level="QueryCoverage=97%, HitCoverage=5%, E-value=2e-21, Identity=44%"; Hit description=RNase H, putative
MEVVLPVEVEIPSLKRRMKNIFDKRMPSCKFYEGDLVLKKVSHVQKDLQGKWGLNYEGPFMVKKAFLDGTLILTNLDGEEFPSPMNSDVVKQYYT

SEQ ID NO: 227376 - protein, 132 aa, Glycine max
  Coding DNA Sequence Number=SeqID_110598
MDETPEASNAVIAYEIVHHDKELASKQSTTSNEATLREKGEPDVVIVYSTISRPTPLNYAPPADFKLSMQNAITTQFSNLGVVLLQNLQRDQMSMLGAIVASKPTPIPVPPTLKPTPPPPPTQPPPPSPAQD

SEQ ID NO: 227377 - protein, 154 aa, Glycine max
  Coding DNA Sequence Number=SeqID_110599
MSQAVINDNERDIVIGTLHSDLTSFNQSINIIISVASDKAVIDLHTTMQTKTMRCANLCRHLYKLGMTLCLNLYHVLLFPSQEKGALDAEEQIQKAHALSNGRVGKIVMTDTTKQLTSVVLELGGKLCYDGRGCYNMLCLVDKTLHFGTSKEKL

SEQ ID NO: 227378 - protein, 68 aa, Glycine max
  Coding DNA Sequence Number=SeqID_110600
MEQHKQKKHHEHAGNNAEEERAGQQVASRRTRRRSGTKKNGLRNAAQKEEEAVGFGCTNVFKNRAGIF

SEQ ID NO: 227379 - protein, 188 aa, Glycine max
  Coding DNA Sequence Number=SeqID_110601
MASLMTRGDQYGHLHPLSKTRCLSTETTLVSLHHPETRPIWSSAPFVEDSMSIDRDYFSLPSSSRDGKSNDSQRPIWSSVPFVEDLMSIDRDYFSLPSSSRDSKSHDTQRPIWSSAPFVEDSMSIDRDYFSLFSSSRDSKSDDTQRLIWSSALFVEDSMSIDRDYFSLPSSSRDDMSDDTQRPIWFML

SEQ ID NO: 227380 - protein, 82 aa, Glycine max
  Coding DNA Sequence Number=SeqID_110602
MASKSRCNSHLQESLYKDIKVQLEFFARKEKQYKGHRPEDILLKVTITWCYVDQVEGATVGLKPREAFRKNTQGFLMRFKEY

SEQ ID NO: 227381 - protein, 108 aa, Glycine max
  Coding DNA Sequence Number=SeqID_110603
  Subcellular localization annotation: CTP_CleavageSite=53; ConfidenceScore=5.60e-01
MLSLGSIFFNNISNSVKLLSLHPNLVFKFTKASTADNQVKVVHPTYNANIGVSQRALRGRARTRLSGALSKGGKMRGVATNVYLWKTSGKPKETGQNENSKFGSCIYA

SEQ ID NO: 227382 - protein, 86 aa, Glycine max
  Coding DNA Sequence Number=SeqID_110604
MCLSHIAASGGLEPSKGISRLRLDRVLTMGEQERDDERLRVMFYSGPTMGAKCTYQNPELGHVRVDVAKVGSRTLHERSGARGPCL

SEQ ID NO: 227383 - protein, 340 aa, Glycine max
  Coding DNA Sequence Number=SeqID_110605
  Gene Ontology: Mol. function=RNA-directed DNA polymerase activity; Biological process=RNA-dependent DNA replication
MATCKYLNAPRAFGSGPSILIPHMEKGQGELRLWRFLGGMHGKSGNSWHRLHLFVKSKSFALSVDHVYGGSFKHLLNDSLEVPNLFGVGKLGEHVCFGVVFFGLAMSASYSAWLFEALRLSLGACSRVTLSRPFRMIPAPLPFTLVAPSTPGHHPSRELRLFQNLLDGVVHFDYHLMTLKELMLLFLLHKGRANNFVNYQKDRRCSYGLLESQEGLFAGTWTGILAYRSVSGLLGRWSGNTSLVHVIFTEFPKDFFQVYHLLDYALRFDNHVIQIYLDVSSNLLFKDSVHQSLVCSAYIFKAEGHDLVTKIGTFSDECRFLLIWSEHPDLVVSRVSVPEA

SEQ ID NO: 227384 - protein, 342 aa, Glycine max
  Coding DNA Sequence Number=SeqID_110606
  Homolog annotation: Hit_ID=Q1RY91; Match level="QueryCoverage=46%, HitCoverage=5%, E-value=4e-42, Identity=77%"; Hit description=CCR4 -Not complex component, Not1
  Subcellular localization annotation: CTP_CleavageSite=50; ConfidenceScore=5.28e-01
MQPQAWSYLLYSTVSFKLCRHCHCLSKSRQPATSLVVPPSLRPLCGFVIRHQLVTHLSLGIALRYVLDALCMPMFLFGSLALEQFLDRLIEWPQYCNHILQIFHLCNTHSEIVSFIELALARISSGHLDVDGASHASVISNHHSTQATIGHVEGKNPIINTCHLISSSVALVLYNLGSNICHYSFNKDVKISWMIVTKLMLVHLLMHSTDHEVALIVHMAYLSYILYELFSLGAILTVFFCDIVMSHCTWHNVIESSRVTTKHVFATLSFIVEIFIFLYVGMDALDIEKWQIASGQGEGVVINMQLLLWKSRDRDRSDGGAKEVCLFNNYLNTKLIFGLGCN

SEQ ID NO: 227385 - protein, 236 aa, Glycine max
  Coding DNA Sequence Number=SeqID_110607
  Gene Ontology: Mol. function=zinc ion binding; Cellular component =intracellular
  Homolog annotation: Hit_ID=Q6H889; Match level="QueryCoverage=98%, HitCoverage=99%, E-value=1e-95, Identity=71%"; Hit description =Putative zinc-binding protein
  Pfam annotation: Domain name=PLATZ; Domain location=20-130; Score =266.7; E_value=4.6e-77; Accession=PF04640.4; Description=PLATZ transcription factor
GHQKPAWLEALYAQKFFVGCSHHENAKKNEKNICCLDCCTSICPHCLPSHRFHRLLQVRRYVYHDVVRLEDLQKLIDCSNVQPYTINSAKVVFIKKRPQNRQFKGSANYCTSCDRSLQESFIHCSLGCKVDFVLKHYKDLSPYLRTCKSLQLGPDFLIPQEMGDDETTRSTIVDCDEPMSSSSGSESMGMACSEIVRKRRSGWNVCARSMNNKVSDEDMVTSISRRKGIPHRSPLC

SEQ ID NO: 227386 - protein, 69 aa, Glycine max
  Coding DNA Sequence Number=SeqID_110608
MAHKWLNIRGVDEESLVKTSKRSRERYQKASLFEFSHKGNLTPIVRQSVKIRDMLEVERKHCCTIRKVP

SEQ ID NO: 227387 - protein, 149 aa, Glycine max
  Coding DNA Sequence Number=SeqID_110609
  Gene Ontology: Mol. function=chitin binding; Cellular component =extracellular region; Biological process=chitin metabolic process
  Homolog annotation: Hit_ID=UPI0000612705; Match level="QueryCoverage =83%, HitCoverage=79%, E-value=5e-11, Identity=26%"; Hit description =UPI0000612705 related cluster
MTGPLNELISCFLIRVDPWVLEPITFRGLHVLAFRGLNALTIRGLHVLTNRGLHTLTFRGLHVLAIRRLHVLTFRGLHVLVFRGLHVLAFRGLHALTFRGLHVLTLEDYTSSPLEDCTSSSSKGCLPSPSEDYASSPLEDYTSSPLEGY

SEQ ID NO: 227388 - protein, 132 aa, Glycine max
  Coding DNA Sequence Number=SeqID_110610
  Gene Ontology: Mol. function=oxidoreductase activity; Cellular component=membrane; Biological process=fatty acid biosynthetic process
  Homolog annotation: Hit_ID=Q3KDH5; Match level="QueryCoverage=96%, HitCoverage=51%, E-value=2e-47, Identity=74%"; Hit description=Short- chain dehydrogenase/reductase SDR precursor
  Pfam annotation: Domain name=ADH_zinc_N; Domain location=6-132; Score= -8.2; E_value=0.028; Accession=PF00107.16; Description=Zinc-binding dehydrogenase
  Pfam annotation: Domain name=KR; Domain location=11-130; Score=-63.3; E_value=0.0011; Accession=PF08659.1; Description=KR domain
  Pfam annotation: Domain name=adh_short; Domain location=8-127; Score =32.8; E_value=3.8e-08; Accession=PF00106.15; Description=short chain dehydrogenase
  Pfam module annotation: Pfam domain module=ADH_zinc_N::KR::adh_short; Domain location=6-132::11-130::8-127
MNLILQDKIALVTGGTSGIGLATAQELAAQGARVFITGRRQAELDAAVASIGATATGIRADAAQLSDLDAVYAQIARQAGRLDILFANAGGGDMLPLGAITEEHFDRIFSTNVRGVLFTVQKALPLLSDKAS

SEQ ID NO: 227389 - protein, 301 aa, Glycine max
  Coding DNA Sequence Number=SeqID_110611
  Gene Ontology: Mol. function=transcription factor activity; Biological process=regulation of transcription, DNA-dependent
  Homolog annotation: Hit_ID=Q3KDH6; Match level="QueryCoverage=98%, HitCoverage=99%, E-value=5e-81, Identity=49%"; Hit description =Transcriptional Regulator, LysR family
  Pfam annotation: Domain name=HTH_1; Domain location=4-63; Score=62.1; E_value=1.8e-15; Accession=PF00126.17; Description=Bacterial regulatory helix-turn-helix protein, lysR family
  Pfam annotation: Domain name=LysR_substrate; Domain location=87-296; Score=146.9; E_value=5.6e-41; Accession=PF03466.10; Description=LysR substrate binding domain
  Pfam module annotation: Pfam domain module=HTH_1::LysR_substrate; Domain location=4-63::87-296
MDQLLAIRAFARVVEAGNFTRAANSLDMPNATLSKLVQELEAHLGVRLLQRTTRRVTVTAEGRDYYERALRIVRDLEDIDCAFNSVTTKPHGQLRIDIGGSTARDVLLPALPDFVARFPDITLDLGVSDRTVDLISDNVDCVVRGGPLSDSSLVARHLGNAQMITCATPGYLRTYGIPAYPQELDNGHRIISYLSPQSGRAFPLRFRHGEERIEVKTAHRVGVNESNAHLAAAVAGLGIIQTFRYAAAADLQAGRLVEILADWRPSDYPFHVVYPQSRHLTQRLRVLIDWLREVFPQRLNG

SEQ ID NO: 227390 - protein, 442 aa, Glycine max
  Coding DNA Sequence Number=SeqID_110612
  Gene Ontology: Mol. function=glucan 1,4-alpha-glucosidase activity; Cellular component=integral to membrane; Biological process =polysaccharide metabolic process
  Homolog annotation: Hit_ID=Q3BWC9; Match level="QueryCoverage=98%, HitCoverage=72%, E-value=1e-113, Identity=50%"; Hit description =Glycosyl hydrolase
  Pfam annotation: Domain name=Glyco_hydro_15; Domain location=71-436; Score=129.0; E_value=1.3e-35; Accession=PF00723.12; Description =Glycosyl hydrolases family 15
MLRTSEDWQIEQRDDEQICATLCTAVDSRSLVALLVTEREPLAVPPLEAIDTRIETSHTAWCDWTRSLSYQGRFAEHVRRSALSLKFLWYSPTGAQAAAATTSLPEGIGGEKNYDYRYAWVRDACLIIKAFVFLGALEDCKAAFSWLSKTIIRHGTALRTCYTLEGNEVPAERFVPLRGYHHSQPVRVGNNARDQLQLSMYGDMLATAELFIRAGHVLDLATSRMLGALANHCADLWRQKDSGIWELPEQQHYTHSKMACWLALDRAVALAEARHIEPTWLKRWQRERDRISSWIEAHCWNEEKQAYVFYPDSNGRLDAALALVHPYGSRVNPARMQATYRAIEQELGHGSAMLYRYSGTEQEESTFIACSFWLVEAWAALGECTRAENAMQQILVKLCQRGNVETFNEMFDVRSDEWRGNMPQGLSHLALICAAQALTDHG

SEQ ID NO: 227391 - protein, 93 aa, Glycine max
  Coding DNA Sequence Number=SeqID_110613
  Subcellular localization annotation: CTP_CleavageSite=36; ConfidenceScore=5.77e-01
MASPPASPPPPLPFALPPPPPSDTSTSPSTVKRTRKASHLRSLSTRPPGAERPVVHVDPATGKADGPHRKKLRTYLGIVARDKVDVTYENWKE

SEQ ID NO: 227392 - protein, 177 aa, Glycine max
  Coding DNA Sequence Number=SeqID_110614
MEERLCAIEGGGNYAFADMTELCLVPDMVIPPKFKVPNFDKYKGTTCPKSYLKIYCRKMGAYAKDEKLLRHFFQESLAGEVITWWSDLVAQIAPPMMEREMIIMIVDTLPMFYYEKMIGYMSSSFADLVFAGIRIEVDLRRGKFDYAATASSSNRRPGMSGGNKKKGETHAVIVVPT

SEQ ID NO: 227393 - protein, 149 aa, Glycine max
  Coding DNA Sequence Number=SeqID_110615
MAPPKEIMTLIYHSGLIVDDPVQGSTYQCTTPIFFYASRSITFTQFIRKINNRLPTRATEQVAQLLFRVPISIHLGQTRFISTQLFDNDDLRGAMETIIQNPQLNSAKFYVVTELIPQPQPSSPQPSCPQLQLPPPQQLPYNNIDLNNP

SEQ ID NO: 227394 - protein, 175 aa, Glycine max
  Coding DNA Sequence Number=SeqID_110616
  Subcellular localization annotation: CTP_CleavageSite=78; ConfidenceScore=5.37e-01
MWSSAPFPEMSSSSGGDFLKSHKLSRTMSKSLAFVDHTAFRYHDPRAGSPRRHLPVIRTSSFSDPKSEFLIGGYVGARASLLSTTPLFVTMTQELVARGDTFRLSAPRRSVTPSVIDEQRPMWSSAPFPEMSSSSGGDFFKSHSYPELRRSEFLIGGYVGARALLLSAAPKALSY

SEQ ID NO: 227395 - protein, 100 aa, Glycine max
  Coding DNA Sequence Number=SeqID_110617
  Homolog annotation: Hit_ID=Q1SM20; Match level="QueryCoverage=92%, HitCoverage=24%, E-value=1e-16, Identity=41%"; Hit description =Nucleic acid-binding, OB-fold
MARIPDKIRSIDGSKETLKLAVRITDLWFVGTPNKSEQAEMVFVDSEGDQIHAICKSDHLKSWKADLKENCTYVMHNFKVVKNDGQFRVCEHKYKLFLLE

SEQ ID NO: 227396 - protein, 92 aa, Glycine max
  Coding DNA Sequence Number=SeqID_110618
MNPKRIKVIPEWPTPPSVDERINEFQEPLDLRSNPFQGGGNDAILPPRALDKRLQEHWAKDAREGPRVLMSLRVRYPRNIGLFSPCILGHLD

SEQ ID NO: 227397 - protein, 133 aa, Glycine max
  Coding DNA Sequence Number=SeqID_110619
MTKLGLCVPTDTTVSEWQRGADNRKVSPRIIMTKLGLCVPTDTTVSEWQRGADNRKVSPRIIMTKLGLCVPMDTTVSEWQRGADNRKVSPRIIMTKLGLCVPTDTTVSEWQGVRITVRGADNRKVSPRIMCAE

SEQ ID NO: 227398 - protein, 176 aa, Glycine max
  Coding DNA Sequence Number=SeqID_110620
MVQKKNKELRGSNNGPIGGYCRWLKAHMQGLDWLLSLRTTKGVEVEAPKEDEEVQALRRSLSQRLCKTETNMLAIVSKYQEELNLATTHEHKVADEYTRVYAEKEARGRVIDSLHQEATMWMDRFALTLNGSQELPRLLAKAKAMADTYSALEEIHKLLSYCQHMVDLMAHIIRNH

SEQ ID NO: 227399 - protein, 54 aa, Glycine max
  Coding DNA Sequence Number=SeqID_110621
VAWVCVSHRERRSIYGHVGFPTRLTTMKPHLEFFSFGDALLLIVLIATMYYLSG

SEQ ID NO: 227400 - protein, 97 aa, Glycine max
  Coding DNA Sequence Number=SeqID_110622
  Subcellular localization annotation: CTP_CleavageSite=49; ConfidenceScore=5.42e-01
MRVHCNQASRRPSMITDSPPLLMFPRTRSPVESPTVATYPSAGGRRVTRGMHVPRKEYARSRHQRLFEENVGKTGKDAIYELLSERLGSCIYARGRY

SEQ ID NO: 227401 - protein, 98 aa, Glycine max
  Coding DNA Sequence Number=SeqID_110623
MVKLRNILLTLKEYNVNSYTTIKQVYNARNSYHFSIRGAQRSIKNNSRVQDKNQEEFKTQEESLETRIKIQGSRSQESRSRFKTQDSRFKNEEKTQSR

SEQ ID NO: 227402 - protein, 70 aa, Glycine max
  Coding DNA Sequence Number=SeqID_110624
MGKAEEVQEQMEADMEAMKEQMATMMEVMISMKKIMEANAVAVATTSVVAKVNPTSPSGINQMNHPTSDM

SEQ ID NO: 227403 - protein, 208 aa, Glycine max
  Coding DNA Sequence Number=SeqID_110625
  Homolog annotation: Hit_ID=Q9MD97; Match level="QueryCoverage=22%, HitCoverage=88%, E-value=7e-09, Identity=86%"; Hit description =Hypothetical protein rps12
MDVDKILPSSSTLGWHSLKVKGELKISVDPGIPDIGQPFELLLNPRAGKRQPGELNILVARGKESKSDSRSSGERNGSSLNRENGVVGELYKCRAARRSSRECCTLDGESPVAESITSLRSDPSSMGHVESRVNQQGPPCKAKYSWVTDSEVAVAWLRETTGAVAKASLHRAIVTAYGPEPGSEPTDVEESADELWLGVKCHSNPELA

SEQ ID NO: 227404 - protein, 151 aa, Glycine max
  Coding DNA Sequence Number=SeqID_110626
  Gene Ontology: Mol. function=sugar porter activity; Cellular component=integral to membrane; Biological process=transport
  Homolog annotation: Hit_ID=Q7CGZ0; Match level="QueryCoverage=100%, HitCoverage=39%, E-value=8e-53, Identity=68%"; Hit description=MFS transporter
MALLTAKLPRKRTLILLMIIFIIGNVLCALAYTYNLLMLARVITALCHGAFFGIGSVVAASLVAPSRQASAVALMFTGLTLANVLGVPLGTWFGQLFGWRATFWGVAIIGILAFIALIVSLPTNKDEKPVHLASEISALANGKLWLSLLMT

SEQ ID NO: 227405 - protein, 297 aa, Glycine max
  Coding DNA Sequence Number=SeqID_110627
MVAHCRYPNGLPGNAASTQQGDRVMRWIIALAIGGLSGCSVGHYEYSSEAARRVDMTVTGIPTVLGMGALGTTIPLTREYSLTAAHVAKYSLYRVKAWHPECDIAVVYHANKEANLPPQFRNSHIGDNVNLYGYSFISALPVASSGKNLINTTLSNDWNKASCVVVAANAGVVKGMSGGAVYNASDDTLAGVIVGYSSRIDDNKSGKTLLGARWCPHPGPLPPGEGENHSGPLPQGDGENHSGPLPQREGENHSGPLPQGEGENHSGPLPQGEGENHSGPLPPGYRQVPSPHGRGLG

SEQ ID NO: 227406 - protein, 357 aa, Glycine max
  Coding DNA Sequence Number=SeqID_110628
  Gene Ontology: Mol. function=oxidoreductase activity; Cellular component=periplasmic space; Biological process=electron transport
  Homolog annotation: Hit_ID=Q74RZ7; Match level="QueryCoverage=99%, HitCoverage=47%, E-value=1e-160, Identity=74%"; Hit description =Putative biotin sulfoxide reductas2
  Pfam annotation: Domain name=Molybdopterin; Domain location=51-357; Score=2.3; E_value=8e-11; Accession=PF00384.12; Description =Molybdopterin oxidoreductase
MKTRVPHLAHWGAFTAVTENQRLIACEPFFADADPSPMIHTLPELVYSDKRIRQPMVRRSWLKSRENSDRTLRGREDFVAVDWDTALDLVAEENRRVRDRYGASGIFNGSYGWSSAGRVNHARTLIRRFYFQGGGGVDQQGNYSWGAAQFFLPYVIGTYMPLTGRVTDWPQVVEHAEIFVAFGGLALKNAQVASGGAGEHSLKPALQQLSAKGTPIINISPMRDDCPAFVNAEWIPIRPNTDVALMLALGYEITRRNAIDEAFLASHCTGWPQLRAYLLGESDGVAKTPAWASAITGIPAARIALLAQQLAGKRSFITCAYAVQRAHRGEQPYWMMIALSSMLGQPGLPGGGFSFGH

SEQ ID NO: 227407 - protein, 294 aa, Glycine max
  Coding DNA Sequence Number=SeqID_110629
  Gene Ontology: Mol. function=catalytic activity; Cellular component =cellular_component; Biological process=macromolecule biosynthetic process
  Homolog annotation: Hit_ID=Q2L348; Match level="QueryCoverage=100%, HitCoverage=34%, E-value=1e-118, Identity=74%"; Hit description =Cyanophycin synthetase
MEVSRIRALRGPNLWSKNTAIEAIVSCADAECSIDNLPDFEARLRARLPQTGLLRPEGHQGAVSIAHVLQIVALTLQAYAGCPVTFGRTSSTIEPGVFQVVVEYSEEEVGRLAMDLAQQLVQAALDDAPFDLADALKRLRELDEDVRLGPSTGSIVNAATARNIPYRRLTQGSMVQFGWGSKQRRIQAAETDLTSAISESIAQDKDLTKMLLDAAGVPVPLGRSVTTAEDAWAAAQELGGPVVVKPRDGSQGRGVAVNIETRERVIQAFEVAEEISSEVIVERYIPGHDFRLLV

SEQ ID NO: 227408 - protein, 104 aa, Glycine max
  Coding DNA Sequence Number=SeqID_110630
  Gene Ontology: Mol. function=catalytic activity; Biological process =macromolecule biosynthetic process
  Homolog annotation: Hit_ID=Q7VXL3; Match level="QueryCoverage=90%, HitCoverage=10%, E-value=1e-32, Identity=74%"; Hit description =Cyanophycin synthetase
MAVARAMMSVLLDPAADEIDGGAGEGFVGLQQHEVARGDAGQLALDGLAVVRLVDDLLYPAALFQSLAQQRARLAGGTLAGDGGVVVQHHAVEGVAQQPALLDQ

SEQ ID NO: 227409 - protein, 48 aa, Glycine max
  Coding DNA Sequence Number=SeqID_110631
MRMRAHTAFLRQITKQTEKNAMCSDLGHVAPLPRKKPSRSFMSSSIRD

SEQ ID NO: 227410 - protein, 46 aa, Glycine max
  Coding DNA Sequence Number=SeqID_110632
MDTYLCVIGDSINGVQRGWGHKSLFEDSPSKCGGGGATVRYGLISK

SEQ ID NO: 227411 - protein, 104 aa, Glycine max
  Coding DNA Sequence Number=SeqID_110633
  Gene Ontology: Mol. function=ribonuclease H activity; Biological process=DNA integration
  Homolog annotation: Hit_ID=Q1SAS4; Match level="QueryCoverage=98%, HitCoverage=7%, E-value=6e-31, Identity=75%"; Hit description=RNase H, putative
MTVSYKDWHEMFPFALHGYRTSIRTSTGATPYSLVYGMEAVLPFEVAGHEPWAPVSTKDKERVRQEGPFIMKRAFSRRALVLTNMDGEELPSPVNSDVVKRYYA

SEQ ID NO: 227412 - protein, 108 aa, Glycine max
  Coding DNA Sequence Number=SeqID_110634
MWAINCQYKEKLNLPASHEQRIEGEHAKVSALQAEKEARERVIDSLHGEAMMWMDRFAFTLNGSQELPRLLAKAKAMEDMYSATEEVHGLFDYCQHMIELMSHIIRNH

SEQ ID NO: 227413 - protein, 70 aa, Glycine max
  Coding DNA Sequence Number=SeqID_110635
MSEIEEVQEQMKADMEAMKDQMTSMMEAMLSMKRMMENNAAAVAATSATAEADPTQPSALNQANQAIPNM

SEQ ID NO: 227414 - protein, 141 aa, Glycine max
  Coding DNA Sequence Number=SeqID_110636
  Gene Ontology: Mol. function=RNA-directed DNA polymerase activity; Biological process=RNA-dependent DNA replication
MAEKGKLDHIEERLGAVEGGESYAFADMVELCLVPDIAIPPKFKVPDFNKYKGTTCPKNHLKLYWRKMKAYTKDEKLLMHFFQESLTREAVTWYTNLEPSQVHSWKDLMVSFIRQYQYNSDMAPDRTQLQNLCKREHESFI

SEQ ID NO: 227415 - protein, 88 aa, Glycine max
  Coding DNA Sequence Number=SeqID_110637
  Gene Ontology: Mol. function=DNA binding; Biological process =transposition, DNA-mediated
  Homolog annotation: Hit_ID=P24218; Match level="QueryCoverage=52%, HitCoverage=12%, E-value=2e-16, Identity=80%"; Hit description =Prophage DLP12 integrase
MVRHRALTVSGSNSSGCLCPSELAFRLVMLFSDISTEMGGWESIEMVQRYAHLAPNHLTEHARQIDAIFGSRVPNLSHGEILKAEGGS

SEQ ID NO: 227416 - protein, 123 aa, Glycine max
  Coding DNA Sequence Number=SeqID_110638
MRMTSRKKEILSFFDPEHREWVTGTIGAPPFDVSGVAYLLSGMNSFKSRHHMESARRTLEAMVNDGLLEKITSYEQRQDSTQSGAGKGVWCNCSRYGLIGQCLVMRDRDGSDNYIEGEFDRVN

SEQ ID NO: 227417 - protein, 331 aa, Glycine max
  Coding DNA Sequence Number=SeqID_110639
  Homolog annotation: Hit_ID=Q5G8W8; Match level="QueryCoverage=28%, HitCoverage=8%, E-value=1e-13, Identity=43%"; Hit description=Gp21
MYRVGEGGKPEIFKASNGSQYMIPGDSGKVISNKDIAGAGGNGGVSLEVNFNITTTNGIDDATQKQMIQQMEIVALKVAREQSTRDGGFLQKRIKKQMPDSTKEQASRDKGGKWKKGASGNPGGRSSKAAELRRVLESGADDAVKTIMDAAKEGDMAACRLILDRVVPPSKPVYQPVSFELDDSDLPAAARSVIKAIAAGELPADQGKMILDGLANMAKIIEITELAERATIGAQTTSSGPDEIWLIGVSPDGSREVKIMGNLLARLNRLEKAMTPKDGDVQVISTLMDELAGNAPAGACQKVIDRLSARGHNFPQSSELRALLVGAGDEI

SEQ ID NO: 227418 - protein, 223 aa, Glycine max
  Coding DNA Sequence Number=SeqID_110640
  Homolog annotation: Hit_ID=Q5G8X2; Match level="QueryCoverage=97%, HitCoverage=98%, E-value=8e-18, Identity=29%"; Hit description=Gp17
MTPLKEIGECLVIDGDDEYFFRPSLIAMSSIGEPGEIVSTFHALHSDEVTPLLRRAYDAYSTIPDWVLKHAKGPELTKPALYAAMDVLTACCNHDVSPLVGVLVPSKIKKRTFLHRPGKMPATDMVIFAQALITHGIIGKAKVRRLQRNESSQTTSEFNAVEYINAARTHLGMSREEAEKLTMTEFQMLLAAKFPEQKGFTKEEYDAVADDYLARKAKRLANG

SEQ ID NO: 227419 - protein, 144 aa, Glycine max
  Coding DNA Sequence Number=SeqID_110641
  Gene Ontology: Mol. function=ribonuclease H activity; Biological process=DNA integration
KMTVSYKDWHEMLPFALHGGSPVIKNLGGIQIKGIGKRVKNAFDKKVRTRWFSEGDLVLKKVSQALKDNRGKWAPNYEGPFVIKRAFSGGALMLTNMDSEGLPSPVNFDGFLMQSYPARALARRLQVDWARDPRKGPRVLMSLR

SEQ ID NO: 227420 - protein, 176 aa, Glycine max
  Coding DNA Sequence Number=SeqID_110642
MIESFQQQQQMSVLELYVEKDVAGDDDDYLASNSYVEEFFDEDDSDDGISDTDDEVTNIVEPASIVHPTEGVPQIQNPFWNDAMHYNNINWSHPDEEDICGLDMPMTFNVGQELYVGMDFDSKDAVKNALKQYVMKVHQTFKVVETKSHKYIVCCPNNTEESPCPFYMRAILSQKN

SEQ ID NO: 227421 - protein, 125 aa, Glycine max
  Coding DNA Sequence Number=SeqID_110643
  Gene Ontology: Mol. function=peroxidase activity
  Homolog annotation: Hit_ID=Q277Z0; Match level="QueryCoverage=96%, HitCoverage=35%, E-value=5e-39, Identity=62%"; Hit description=Dyp -type peroxidase
  Pfam annotation: Domain name=Dyp_perox; Domain location=1-120; Score=- 60.6; E_value=2.2e-09; Accession=PF04261.3; Description=Dyp-type peroxidase family
MDAWKRLSTDEQEKVIGRSKENDIEMSDSVKPSNSHIALANIEGENGEELKIVRDNMPFGNPSTNEFGTYFIAYASTFTTVKKMLTNMFIGDPAGNYDRILDFSTAKTGTLFFAPTRDMLDDFSG

SEQ ID NO: 227422 - protein, 101 aa, Glycine max
  Coding DNA Sequence Number=SeqID_110644
MWVQIASRRGPSRMFLQKAVTSGGSNLTRLGELGGKLLPYFPINRGRSEGEKCSTLLCRKSKPRRFRNVSVGDFAKIFNRSSTFFVRSSSFFDLQPISSRN

SEQ ID NO: 227423 - protein, 154 aa, Glycine max
  Coding DNA Sequence Number=SeqID_110645
  Gene Ontology: Mol. function=DNA binding; Biological process=DNA integration
  Homolog annotation: Hit_ID=Q53JA7; Match level="QueryCoverage=99%, HitCoverage=79%, E-value=5e-31, Identity=38%"; Hit description =Integrase core domain, putative
MPQQPMLFCEVFDVLGIDFMGPFPISFGFVYILLAIDYVSKWVEAKANRANDAEVVVDFVRSNLFCRTAYKAPIGISPYRVVFGKTCHLPIEIEHRACNFSIDQAGEERKLQLSELDEIWLEAYENSKFYKEKTKKFHDSLIAKKDFVVGQKVL

SEQ ID NO: 227424 - protein, 72 aa, Glycine max
  Coding DNA Sequence Number=SeqID_110646
MRRRKWRKELEYLEPRSVVGFYLKNLCASLMVPAFEKNFRNFNQLKGKRMKKDEFWALWEVIWIRNQSRDAL

SEQ ID NO: 227425 - protein, 211 aa, Glycine max
  Coding DNA Sequence Number=SeqID_110647
MGSFTDSAWEWNLSWRRPLFDNEVASTQNTTFWWESLSWIGTSGAYPINPRLHFLQHNNGMKGRKKYNRWKCWWVALNWSIWQHRNKIIFTNAPFNGSNLLEDALFLAWTWFRTMEKNFTMHFNYWSSNLPAEKALSFEHPRLFQHPSNNNVCWVFFEPDFQEQCRGFCGFKRGECGFSGSVGGSVGLSKDNVGVEGAVSGSFQAGGEREE

SEQ ID NO: 227426 - protein, 111 aa, Glycine max
  Coding DNA Sequence Number=SeqID_110648
  Gene Ontology: Mol. function=enzyme inhibitor activity
  Homolog annotation: Hit_ID=Q1RYM4; Match level="QueryCoverage=90%, HitCoverage=57%, E-value=8e-11, Identity=40%"; Hit description =Pectinesterase inhibitor
MNSLALCSLCLFLIAQSPWLTNATVFGDGSDLIGQICNENPEKKIECTNILRADPTVLGAKNLLQLSEAILNLAVNKTEKAEDFLKGLANTTDVPAIANCALYYENAVERV

SEQ ID NO: 227427 - protein, 233 aa, Glycine max
  Coding DNA Sequence Number=SeqID_110649
MAFLGETSSQTIVNSRLAFIYPNGSIIHNDTGVYFQTSTPVPIRVPNRCDFASLKTRIHNTLQLSDKQFLDEIHYRKPFTDTGNQIRFECIKLINDDDVNTMLMCNDQFSCVGPIELLCTVGRTPDGIINLLERTMPRIHDAILYYNGKWNMPPQNKFVGCAFTGKNPKKFQIPSTCTIDELKNLIKQVAPKGIPPLGIHESQTVRRLFFRQPARFEYSYSVTTYEIHAPDHQ

SEQ ID NO: 227428 - protein, 271 aa, Glycine max
  Coding DNA Sequence Number=SeqID_110650
  Gene Ontology: Mol. function=nucleoside-triphosphatase activity; Cellular component=membrane; Biological process=cobalt ion transport
  Homolog annotation: Hit_ID=Q8U6S7; Match level="QueryCoverage=90%, HitCoverage=45%, E-value=1e-60, Identity=50%"; Hit description=ABC transporter, nucleotide binding/ATPase protein
  Pfam annotation: Domain name=ABC_tran; Domain location=30-212; Score =132.3; E_value=1.3e-36; Accession=PF00005.17; Description=ABC transporter
  Pfam annotation: Domain name=SMC_N; Domain location=9-215; Score= -128.9; E_value=0.036; Accession=PF02463.9; Description=RecFRecNSMC N terminal domain
  Pfam module annotation: Pfam domain module=ABC_tran::SMC_N; Domain location=30-212::9-215
  Subcellular localization annotation: CTP_CleavageSite=71; ConfidenceScore=5.31e-01
MSSLLTLQDVSFVTADGRTLFESVNFSVTAGRIGLVGRNGVGKSTLLRIMSGMLLPTNGSVTATGSIGMLRQNIGGGDAETLADLLEARTGFDILARVEQGVASESDLDEADWLLPQRFTDALQGLGLPDMAPDTPLSALSGGQQTRAALAALIFHKPDLILLDEPTNNLDRAGRVAVADLLTAWRGAAVVVSHDRELLQSLDMIAELSPDGLQAIRRQLGFLSGEEGRGARDGGTRSSYSAARGQAGRTQGSGRSRKTGSQRRARSQVAR

SEQ ID NO: 227429 - protein, 81 aa, Glycine max; identical to SEQ ID NO: 155956
  Coding DNA Sequence Number=SeqID_110651

SEQ ID NO: 227430 - protein, 50 aa, Glycine max
  Coding DNA Sequence Number=SeqID_110652
MANNPARAQKKENPQKGSKESSLNQLSIVAGLDIGGVHKFEESADGYSKM

SEQ ID NO: 227431 - protein, 258 aa, Glycine max
  Coding DNA Sequence Number=SeqID_110653
  Gene Ontology: Mol. function=ferrochelatase activity; Cellular component=chloroplast; Biological process=heme biosynthetic process
  Homolog annotation: Hit_ID=UPI000068CF9C; Match level="QueryCoverage =84%, HitCoverage=69%, E-value=2e-63, Identity=58%"; Hit description =Ferrochelatase
  Pfam annotation: Domain name=Ferrochelatase; Domain location=36-257; Score=11.3; E_value=1.3e-12; Accession=PF00762.10; Description =Ferrochelatase
MLQLREKKHMKNFLLILRTLGAATESDHQLLIKGIKAVNDVKEYLDEFLMDERVIDYRWIFRALLVRGIILNTRPAKSAEAYKTVWTDEGSPLIVITEKIQKKLQKLVDVPVEIGMRYAQPSIEAGIQKLVDQGVSEIVLFPLYPQYAMSTTETVIEKAEEVRKKTFPTVKINYIQPFYDRDIYINCLAESIKEKLPENFDALQFSYHGVPERHIYKTDPSHTYISAIRPLKLLLQKWDYPKKKPLFHFSPDWERISG

SEQ ID NO: 227432 - protein, 106 aa, Glycine max
  Coding DNA Sequence Number=SeqID_110654
MVEASGNRLPACVIDYTEEWVTGNRLPACVIDYTEEWIVMAAQLIRDRVEMECLEGAWETLEGNTRCRFRGTIRFTATSLVHPDEPARTLQRTVEWTAPWISFVYF

SEQ ID NO: 227433 - protein, 137 aa, Glycine max
  Coding DNA Sequence Number=SeqID_110655
  Gene Ontology: Mol. function=RNA-directed DNA polymerase activity; Cellular component=intracellular; Biological process=RNA-dependent DNA replication
MKPEMSLKIKEEVKKQFDAGFLAVARYPEWVANIVLVPKKDEKITANFALFSFMNEFSGYNQIKMASEDMENTMFVTLWGTFCYKVMSFGLKNVRATYQRAMVALFHDMMHKQIEVYVDDMIAKSRIEEEHFVNCES

SEQ ID NO: 227434 - protein, 104 aa, Glycine max
  Coding DNA Sequence Number=SeqID_110656
  Subcellular localization annotation: CTP_CleavageSite=67; ConfidenceScore=5.18e-01
MFVVQYLGSSRSWTSCSHSSKPGVDSRGRAEPHLAVGRSSLLGRVQTGLKGGGMKDSDLTGDSSLARANQSMGICKGTPSNLYDGAPWRRRRCRSRQPDRPINK

SEQ ID NO: 227435 - protein, 154 aa, Glycine max
  Coding DNA Sequence Number=SeqID_110657
  Gene Ontology: Mol. function=DNA binding; Biological process=DNA integration
  Homolog annotation: Hit_ID=Q8LM60; Match level="QueryCoverage=54%, HitCoverage=8%, E-value=3e-15, Identity=38%"; Hit description =Putative retroelement
MAFVSQVEPRNIDEALCDEHWLMEMHEEMNQFKRNDMDVKSIFLNGRIEQEVYADQPPGFVDHEHLDYVYKLKNAPYGLKQAPRSWCYSLGTNKGVFLKLPANFVKTVEARLQEDFDDANSQAYPRPTQEDFDFKKDLSSWIIQVNIKQSKIFK

SEQ ID NO: 227436 - protein, 148 aa, Glycine max
  Coding DNA Sequence Number=SeqID_110658
YIYLGLTENKRGYISCGSVLVEGTSTRVSKRTREGHSIQQGGADDHDWSLRVNRLTCLWLTKARITMRCLHVPSDLPSLDDEGADNHEGGADDHDWSLRVNRLACLWLMKARITMRCLHVPSDLPSLDDEGADNHEVSPCVIGLAVSG

SEQ ID NO: 227437 - protein, 48 aa, Glycine max
  Coding DNA Sequence Number=SeqID_110659
MFVFNNALKGLDDTQQSKSKPPTKWIVVKYFTDHRPFEPERLKALRIQ

SEQ ID NO: 227438 - protein, 51 aa, Glycine max
  Coding DNA Sequence Number=SeqID_110660
MEETCGIPDEIYLEWARFVKIIPMSLGDKRKLFIQRQESIRKDVEWAFGVL

SEQ ID NO: 227439 - protein, 388 aa, Glycine max
  Coding DNA Sequence Number=SeqID_110661
  Gene Ontology: Mol. function=transmembrane receptor activity; Cellular component=membrane; Biological process=defense response
  Homolog annotation: Hit_ID=Q2HS00; Match level="QueryCoverage=93%, HitCoverage=33%, E-value=1e-104, Identity=58%"; Hit description=TIR
  Pfam annotation: Domain name=NACHT; Domain location=216-367; Score= -21.9; E_value=0.0029; Accession=PF05729.3; Description=NACHT domain
  Pfam annotation: Domain name=NB-ARC; Domain location=182-388; Score= -62.2; E_value=2.6e-06; Accession=PF00931.13; Description=NB-ARC domain
  Pfam annotation: Domain name=TIR; Domain location=27-154; Score =156.8; E_value=5.8e-44; Accession=PF01582.10; Description=TIR domain
  Pfam module annotation: Pfam domain module=NACHT::NB-ARC::TIR; Domain location=216-367::182-388::27-154
MVEQQIISVVGSSSSSSLMVSSKKYDVFLSFRGEDTRMNFTSHLHEALKQKKVETYIDYQLEKGDEISPALIKAIEDSHVSIVILSENYASSKWCLEELSKILECKKKQGQIVIPVFHNIDPSHVRKQNGSYEKAFAKHEGEAKCNKWKATLTEVANLAGWDSRNRTESELLKDIVGDVLRKLTPRYPNQLKGLVGIEDNYEKVESLLKIGSSEVITLGIWGMGGIGKTTLASAFYAKLSHEFEADCFLVNVRENAKRHGLEALSQKLFSELLENENHCFDAPFLVSQFVMRRLGCKKVLIVLDDVATSEQLEYLIKDYDLLGQGSRVIVTTRNKQIFRQVDEVYEVKELSFHNSLQLFCLTVFDEKQPTHGYEDLSSRAISYCKGIP

SEQ ID NO: 227440 - protein, 90 aa, Glycine max
  Coding DNA Sequence Number=SeqID_110662
MTECDDQHFHRDYRVWFSVEEKEKGKMKEKEKLYTCQNPIVRMNNCKWDRPSQEWCKDPQIKMNGNGMEKQEREETPLQGEDESRRSSPP

SEQ ID NO: 227441 - protein, 557 aa, Glycine max
  Coding DNA Sequence Number=SeqID_110663
  Gene Ontology: Mol. function=protein binding; Cellular component =membrane; Biological process=defense response
  Homolog annotation: Hit_ID=Q2HUN2; Match level="QueryCoverage=88%, HitCoverage=41%, E-value=7e-62, Identity=36%"; Hit description=TIR; Disease resistance protein
  Pfam annotation: Domain name=LRR_1; Domain location=100-122; Score =6.0; E_value=21; Accession=PF00560.23; Description=Leucine Rich Repeat
  Pfam annotation: Domain name=LRR_1; Domain location=124-143; Score =7.6; E_value=11; Accession=PF00560.23; Description=Leucine Rich Repeat
  Pfam annotation: Domain name=LRR_1; Domain location=145-164; Score =3.6; E_value=62; Accession=PF00560.23; Description=Leucine Rich Repeat
  Pfam annotation: Domain name=LRR_1; Domain location=166-188; Score =3.6; E_value=62; Accession=PF00560.23; Description=Leucine Rich Repeat
  Pfam annotation: Domain name=LRR_1; Domain location=189-211; Score =14.9; E_value=0.29; Accession=PF00560.23; Description=Leucine Rich Repeat
  Pfam annotation: Domain name=LRR_1; Domain location=231-252; Score =6.7; E_value=16; Accession=PF00560.23; Description=Leucine Rich Repeat
  Pfam annotation: Domain name=LRR_1; Domain location=254-275; Score =12.0; E_value=1.6; Accession=PF00560.23; Description=Leucine Rich Repeat
  Pfam annotation: Domain name=LRR_1; Domain location=277-296; Score =2.2; E_value=1.1e+02; Accession=PF00560.23; Description=Leucine Rich Repeat
  Pfam annotation: Domain name=LRR_1; Domain location=298-319; Score =10.8; E_value=2.7; Accession=PF00560.23; Description=Leucine Rich Repeat
  Pfam annotation: Domain name=LRR_1; Domain location=3-29; Score=1.4; E_value=1.6e+02; Accession=PF00560.23; Description=Leucine Rich Repeat
  Pfam annotation: Domain name=LRR_1; Domain location=77-98; Score=6.3; E_value=19; Accession=PF00560.23; Description=Leucine Rich Repeat
  Pfam annotation: Domain name=LRR_3; Domain location=54-73; Score =30.9; E_value=4.6e-06; Accession=PF07725.3; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_3; Domain location=100-122::124-143::145-164::166-188::189-211::231-252::254 -275::277-296::...
  Pfam module annotation: Domain location=298-319::3-29::77-98::54-73
MINLRFLIIHDSCRTNRFHVYFPNGLESLSSKLRYLRWDEFHVESLPSSFCAEQLVELRMLRSKVKKLWDGVQNLLNLKTIDLDDSRDLIEIPDLSMAENLEKVSLFGCESLHQLHPSILSLPKLRYLILSGCKEIESLNVHSKSLNVLRLRGCSSLKEFSVTSEEMTHLDLSQTAIRALLSSMLFLLKLTYLYLSGCREIESLSVHIKSLRVLTLIGCSSLKELSVTSEKLTVLELPDTAIFALPTSIGHLLSLKELDLCGTNIELLPASIKILSMLKVLWLNDCRKLVSLQELPPSLSELYLNDCCKLVSLPELPPSVKEVSAFNCISLETDITQDLVLQHMLQSRIPYIHQQYLYNPAYFDDGYFIFPLGDHVTDLCRFRTAESSITIPSLPKSQLRGYVSVIILSKGPVSDHQFSCSIHRDDILIGSDRRRFIGCENLISDHVLFWYHNASKFCGTGEVYDPFSNMTFIFADINGNKDTIKGCGVFPVYGTESGFKLVSSSSNEIFDNESEPRAKEVGVESCNNENEENCEQLFRTKRRRTACDNLPAITSSV

SEQ ID NO: 227442 - protein, 228 aa, Glycine max
  Coding DNA Sequence Number=SeqID_110664
MYKDNWTQLWPVGSKIYPEIHENPRAFFRSSSPILLEPLAHGSSDWSLPREDCITFLRERRAQLREGEYTEFQEKVARRQWTQLTKPMGKYDSKIVMEFYANALPTEEGVMDKRSQVWGQWISYDEDVINQFLGHPLVLEEGQHCEYTERKSQAANHRGQVQLNDSFYQFTLHQQRQDPNPYPWPTPEQFRVTVAWPGDKPNFQARLGPTKVPGDGDEDMVDVMDFFL

SEQ ID NO: 227443 - protein, 130 aa, Glycine max
  Coding DNA Sequence Number=SeqID_110665
  Gene Ontology: Mol. function=calcium ion binding; Cellular component =plasma membrane; Biological process=G-protein coupled receptor protein signaling pathway
  Homolog annotation: Hit_ID=Q7DMP0; Match level="QueryCoverage=83%, HitCoverage=99%, E-value=5e-52, Identity=86%"; Hit description =Calmodulin-2/4
  Pfam annotation: Domain name=efhand; Domain location=102-130; Score =43.2; E_value=8.8e-10; Accession=PF00036.22; Description=EF hand
  Pfam annotation: Domain name=efhand; Domain location=42-70; Score =38.9; E_value=1.7e-08; Accession=PF00036.22; Description=EF hand
  Pfam module annotation: Pfam domain module=efhand::efhand; Domain location=102-130::42-70
MDFILSGFLTFVTFCGYFCCCITTKELGTVMRSLGQNPTEAELQDMINEVDADGNGTIDFPEFLNLMARKMKDADSEEELKEAFHELRHVMANLGEKLTDEEVDEMIREADVDGDGQINYEEFVKVMMAK

SEQ ID NO: 227444 - protein, 170 aa, Glycine max
  Coding DNA Sequence Number=SeqID_110666
  Gene Ontology: Mol. function=hydrolase activity, acting on ester bonds; Biological process=arginine catabolic process to glutamate
  Homolog annotation: Hit_ID=Q5PHC2; Match level="QueryCoverage=98%, HitCoverage=56%, E-value=4e-56, Identity=69%"; Hit description =Succinylglutamate desuccinylase
  Pfam annotation: Domain name=AstE_AspA; Domain location=3-170; Score=- 50.6; E_value=0.0072; Accession=PF04952.5; Description=Succinylglutama te desuccinylase  Aspar
MACAGIWICIPLFAARCIRALGCCRHARSRGAKIFSAGLARPGWRRCCERFAALACTLELGKALPFGDNDLTQFSATQRALSRLLVGDLAVEEATAPLRYRVVQQITRHSDQFQLHMSGETLNFTPFSAGTLLAEDGETRYVVEKAQEYVLFPNPGVAPGLRAGLMLERL

SEQ ID NO: 227445 - protein, 63 aa, Glycine max
  Coding DNA Sequence Number=SeqID_110667
MKKITALFVASTLALGAANLAHAADTTATTQTDSKPMMHHKGMPGHHDMMFKDLNLTDAQKQQ

SEQ ID NO: 227446 - protein, 228 aa, Glycine max
  Coding DNA Sequence Number=SeqID_110668
  Homolog annotation: Hit_ID=UPI00006A17C9; Match level="QueryCoverage =38%, HitCoverage=98%, E-value=4e-09, Identity=33%"; Hit description =UPI00006A17C9 related cluster
GLHVLTFRGLHVLPFSGLHILAFLGLHALTFSGLHVLAFRGLHALAFRGLHVIAFRGLHALAFIGLHICAFRELKEEAIAQPLCIPGQDFTRAAAKRRVRIMHTNITTLTQIWMTLLLSNILPSDHNADLPLRKYQLTPSGPGGVQQGPGVSNSCYGPLSVLPGAHPPPARSCHCDIGIVPARHPVDPEKSNRVLGFPALITGLCQFYGVPVAPNKVIRPPINRTFIK

SEQ ID NO: 227447 - protein, 277 aa, Glycine max
  Coding DNA Sequence Number=SeqID_110669
MPYTVTRPHSFAIRQTQSLVERRDLRCLLHLLSSRGDEPDDIWGYRMVIRTFCHPEAMSPMTCGGANEPVDAQRLTSSPAPFVAQGQTSSLARRDLCHLLHLLSSQGNEFDDMRGYRMVIRTFRHPEVARPMTCRGANELVDAQRLTSSPAPFVNQGQTSTLTCRHLRHLLHLLSSRGNEPDDKQGYRMVIGTFCHPEATSLMTCGGANEPVDAQRLASSPAPFIAKGQTSSLTRRDLRRLLHLLSSQGYELDDMRGYHMVIRTFRHPEAARPMTCG

SEQ ID NO: 227448 - protein, 158 aa, Glycine max
  Coding DNA Sequence Number=SeqID_110670
  Gene Ontology: Mol. function=potassium-transporting ATPase activity; Cellular component=membrane; Biological process=potassium ion transport
  Homolog annotation: Hit_ID=Q2NW73; Match level="QueryCoverage=79%, HitCoverage=66%, E-value=8e-35, Identity=62%"; Hit description =Potassium-transporting ATPase C chain
  Pfam annotation: Domain name=KdpC; Domain location=1-156; Score =210.9; E_value=3e-60; Accession=PF02669.6; Description=K+ -transporting ATPase, c chain
  Subcellular localization annotation: CTP_CleavageSite=74; ConfidenceScore=5.37e-01
MSQLRPAIVLLVLLTLLTGASRSVRRSASLGHFWGRPSATSDVPYNAQASGGSNLAASNPALDKAVAERVAALRAANPQASAAVPVELVTASGSGLDPDISPEAALWQAPCVAAARNMTLKDVEALIARNTERPLLPFIGEETVNVLRLNMALDDLQG

SEQ ID NO: 227449 - protein, 69 aa, Glycine max
  Coding DNA Sequence Number=SeqID_110671
MPTPDQFRAEVACPEIARGPSRRGTPEAPGDGEEALEDEEMADLLDFLGGSGDTVNAVKIFPDAQNGLG

SEQ ID NO: 227450 - protein, 190 aa, Glycine max
  Coding DNA Sequence Number=SeqID_110672
MKPRNIQGADISNSSLHIISYVVFLRRTTYQFISMKLPFYPKLVKAFYSNLEIQEDSLISEVYGIKMVIDQSLFFDLTQLSSDGVPFEGSVDDEWKFDFSVSDARQMVCTNQADMTVRLLSGSLAFECRIMHYLIMRILLPRSSNLTQVSEEDLIIMWVFLTGRQIDWAHLVRYCMHKACDQMLHSHILI

SEQ ID NO: 227451 - protein, 36 aa, Glycine max
  Coding DNA Sequence Number=SeqID_110673
MSVETALGTKGKCEVILELKKLELNMHYVTRIASCN

SEQ ID NO: 227452 - protein, 141 aa, Glycine max
  Coding DNA Sequence Number=SeqID_110674
MTGRLLVGSLTFDFRIMHFIIAHLIRYRMHKALRTNAPLPYPHLVTLFLHHFKIPLEDEPFVQVKRSFVISAGAVISFGYRKDDDGQWVRKQDLPQPIPDEYTLSPPPQRVDSSSLLNDVLSELHSLRAFVGDRFDAMDTR

SEQ ID NO: 227453 - protein, 194 aa, Glycine max
  Coding DNA Sequence Number=SeqID_110675
  Gene Ontology: Mol. function=two-component response regulator activity; Cellular component=membrane; Biological process=two -component signal transduction system (phosphorelay)
  Homolog annotation: Hit_ID=Q9XET9; Match level="QueryCoverage=88%, HitCoverage=23%, E-value=5e-56, Identity=62%"; Hit description =Ethylene receptor homolog
  Pfam annotation: Domain name=Response_reg; Domain location=51-167; Score=98.5; E_value=2e-26; Accession=PF00072.14; Description =Response regulator receiver domain
  Subcellular localization annotation: CTP_CleavageSite=55; ConfidenceScore=5.14e-01
MQMMQGNIWISTNSLGLAQGMTLLLKFQIGSSHGRFTLAPTDFSNSQFRGLKVVLADDDDVNRTVTKKLLEKLGCQVTAVSSGFECLGAISGSGNSFKIILLDLHMPEMDGFEVARRIRKFQSHNWPLIIAFTASAEEHIKERCLQVGMNGLIRKPILLREIADELGTVLQRAEIDIKAIICIVLDICKQLVSS

SEQ ID NO: 227454 - protein, 124 aa, Glycine max
  Coding DNA Sequence Number=SeqID_110676
MGLRKRLRMENCTKQSLRIAPNSKDFLEGGVFGEEAGCFGLFLFAHAKVKKSKVVFQWGLLSWEPNLDIWGETNLGVKVSISGRASILFHKARVTMMIRKQRAKLVMATARWALKHPVYGIVIL

SEQ ID NO: 227455 - protein, 111 aa, Glycine max
  Coding DNA Sequence Number=SeqID_110677
  Gene Ontology: Mol. function=helicase activity
  Homolog annotation: Hit_ID=Q2R1R7; Match level="QueryCoverage=98%, HitCoverage=7%, E-value=3e-20, Identity=53%"; Hit description=AT hook motif-containing protein, putative
MMFAFTSVGIKFDKSINHSRGPPTIRIQGQPCHRIGNMLPIPGKEPKFAQLYIFDTKNEVRNRINAISPHNQIQEHIVSQLSEMLDEYNVHAKISGWREIDCKMLKWIISS

SEQ ID NO: 227456 - protein, 77 aa, Glycine max
  Coding DNA Sequence Number=SeqID_110678
MSVKNIVRRLGVHDKTNQTLVRRPVRIILFCENALTMWDRHRLIGALKSSVFTLKAYTPKSPSELLPPDSGPIQKTF

SEQ ID NO: 227457 - protein, 169 aa, Glycine max
  Coding DNA Sequence Number=SeqID_110679
  Homolog annotation: Hit_ID=Q4WFN2; Match level="QueryCoverage=80%, HitCoverage=16%, E-value=5e-18, Identity=42%"; Hit description=HET domain and ankyrin repeat protein, putative
  Pfam annotation: Domain name=Ank; Domain location=13-45; Score=38.5; E_value=2.2e-08; Accession=PF00023.20; Description=Ankyrin repeat
  Pfam annotation: Domain name=HET; Domain location=55-162; Score= -11.3; E_value=1.3e-05; Accession=PF06985.2; Description=Heterokaryon incompatibility protein (HET)
  Pfam module annotation: Pfam domain module=Ank::HET; Domain location =13-45::55-162
MARGADLAAQDMFGETALHYAAENGYFEVVKILVEAGSDVQRRDSSRRTPLDCAKMRKRRKYAEVIEYLERPDIHQIVGSKPRPLSPMDSQQFWIDAICINQDDIAERNAQVAIMSMIYTKSSGVFVWLGVDDESTMRAAEATHLPSQEGMDMWTRRRALQNKDLMRLP

SEQ ID NO: 227458 - protein, 175 aa, Glycine max
  Coding DNA Sequence Number=SeqID_110680
  Homolog annotation: Hit_ID=Q1T493; Match level="QueryCoverage=59%, HitCoverage=19%, E-value=3e-07, Identity=25%"; Hit description =Nucleic acid-binding, OB-fold, subgroup
  Pfam annotation: Domain name=Rep_fac-A_C; Domain location=1-122; Score=-50.0; E_value=0.0031; Accession=PF08646.1; Description =Replication factor-A C terminal domain
MDNHSWCYPACAQCHRKTNIQTGPFTCGCGKDNDQPILRYRVEVMVTQNNESENFLLWDRECAELIGQTADGVNRVKIEDDDLDLNASPQALDKLLGHVLAFKVRIQSRFKNLVVLKYSKDLDLINAVLEMLPDSEVFFSDIYFSRCCHDDMIHEFDYHQLIYGADMFQNRSFQC

SEQ ID NO: 227459 - protein, 129 aa, Glycine max
  Coding DNA Sequence Number=SeqID_110681
MKMHPQLDSLKYVLVNPSSIRLKPSRGIPVILIRIEYADMLIQPFMPQPSKAYVKALEAELLRTREALRQALEDMKYVEENAKTQHLVTNFFYKKDTSYKSPKKNTFSPLRTNFDSNFDSSIEILANGL

SEQ ID NO: 227460 - protein, 119 aa, Glycine max
  Coding DNA Sequence Number=SeqID_110682
MDRIEPVTGAEFLILDDRGKISQDRRYKDYLDKSKIRSARNTQIKKQSISTVSSLPLPAPFHEHAEIGHAMDHFHLQRHLSTLSKPRPAHVLSNNTFAQSLSSVPNDVKEEGLDFEERG

SEQ ID NO: 227461 - protein, 78 aa, Glycine max
  Coding DNA Sequence Number=SeqID_110683
MAEEFVKSFVHQDGVIVITLDHPKAFSAMAEEFVKGFVHQDGISIITNGEKHESTIGAVFFSQALAVNDVRQFKGGTY

SEQ ID NO: 227462 - protein, 341 aa, Glycine max
  Coding DNA Sequence Number=SeqID_110684
  Homolog annotation: Hit_ID=Q1RTB4; Match level="QueryCoverage=97%, HitCoverage=86%, E-value=2e-19, Identity=27%"; Hit description=IMP dehydrogenase/GMP reductase
MIEVFVKAIASLTQYYDQLLRCFTFGDFQLVPTVEKFEEILGCLLGGRKPYLFFGFYPSMARIAKAKTLADQGEWPSFIDVLALLVFGVVLFPNVDGLVDFAAIDAFLAYHHSKESPVVAILVDAYDTFDRRCEKSGPRIVTACAPRKGRQTGRFPNIPMMGMRGCINYNPVLAIRQLGYPMRGAPSEESITPFIARGFNDPNAKILQGVYKAWGTVQRKDKKLRGSSNGIIGDYHKWLKARTQELDWLPKLKVSSKEEAETLEESEEVQALKAELEKAQAVKEKFKTTTIKVQKECDELRDINVATAEALEQETKRARKEEYGRNKFRGALWGSNSELKL

SEQ ID NO: 227463 - protein, 62 aa, Glycine max
  Coding DNA Sequence Number=SeqID_110685
MDPDINVRLYHGFRGWKFFPRITLSLGRLFKKKIKKDLEHPEDSPNFVEWEKSDYNSDLRMN

SEQ ID NO: 227464 - protein, 54 aa, Glycine max
  Coding DNA Sequence Number=SeqID_110686
MGFYTSLGALLLSGCLNGVVLTCDAVSSTVVQSCKVGNLTELSPRCHAHPEFRA

SEQ ID NO: 227465 - protein, 94 aa, Glycine max
  Coding DNA Sequence Number=SeqID_110687
MAEAVTQFMSRQQKSFVEAAAQEKSPLKEHEEQAQQQWEKYSTVKNQQENILQSDNLPHQLIDKKGRQAEHEETLSAILSLITNTFLEMSFQII

SEQ ID NO: 227466 - protein, 558 aa, Glycine max
  Coding DNA Sequence Number=SeqID_110688
  Gene Ontology: Mol. function=RNA-directed DNA polymerase activity; Cellular component=chromatin; Biological process=chromatin assembly or disassembly
MADHGTRKTTTDRLEEAITRLTNSQASLSDRYMNLSGKVDSILDHLRLHDSSRNTANTTNHHNPQLASLYLDGATLSWYQWMFNNGFITSWEEFLQALESRFAPSFYDDPKGALFKLTQKGTINKYLMKFERLANRVVGLPPPFLLSCFISGLCPDIRDEVMALQPISLLQATALAKLQEEKLRDRVMSNPRNLYQPKRPPPLTPSPTTKAKPPYVQRTPTEIAFQREKGLCYNCDEKWNTNHRCKGQVMLLIADEQSPNTDVSISKLEETHPTAIDNNIEPSVDSNCSHISLHAFSTHNFLQLRIAQFLKLPVQSTHPLQVLVGNGSTLDCNQGHPFFVSFHLLQISAADAVLGDNWLKKLGPITTNYASRIMNFTHQGQEVSLTTDATIGLEPVSPAQLKRFIQTGSTSAFYQLNVRPITKTEPAPAQHPFPSIQHLLLRYHHLFQTPSRLPPPRQVVHHITLHPATAPINVRPYRYPHFQKNEIERQVSDLLSAGLIRPSSSPYSSPVLLVKKKDGTWRLCVDYRALNAVTIRDQFPVPTIDELYALATPSLPLP

SEQ ID NO: 227467 - protein, 331 aa, Glycine max
  Coding DNA Sequence Number=SeqID_110689
  Gene Ontology: Mol. function=RNA-directed DNA polymerase activity; Biological process=RNA-dependent DNA replication
MGDPHFVQVQNTHSFPPYGLPPNYTPPNVAHAPDENVNNSTPILIESQQPQSDHAHVSQPMEETHDVPHHNLADFDPYPGHAIEGQAFGVGRVPIAKVEREKFNHIEERLRAIEGSGDYTFVDMAEFCLVPNMVIPLKLKVSDFDKYKGATCPKNHLKMYCRKIGAYAKDEKLLMHFFQESLTEATVTWQHQYNSNMAPDRMQLQNMCKKGHESFKEYAQRWRDLAAQVVPPMMEGEMITMIVDMLLMFYYEKMVGYTPSSFGDLVYAGERNEVGLKRGKFDYPALMNGKPGANGESKKEGGNHVVTSIHTWPNFPPAQQYQYSANIIPSL

SEQ ID NO: 227468 - protein, 188 aa, Glycine max
  Coding DNA Sequence Number=SeqID_110690
  Gene Ontology: Mol. function=phosphoglycerate mutase activity; Biological process=fructose 2,6-bisphosphate metabolic process
  Homolog annotation: Hit_ID=Q1GXF8; Match level="QueryCoverage=99%, HitCoverage=100%, E-value=2e-42, Identity=46%"; Hit description =Phosphoglycerate mutase
  Pfam annotation: Domain name=PGAM; Domain location=2-149; Score =115.4; E_value=1.7e-31; Accession=PF00300.12; Description =Phosphoglycerate mutase family
MKLTLVRHTSLQIAEGICYGQSDIDVSINFASELSQLKQKLIHEQVDAVYSSPLQRCSKLAHALGFDGILHDERLKELHFGDWEMQSWNDIPRELFDVWAQNYAELAPPNGETFAGLQQRGIDFLQEIQARHSGQHVLVVTHGGMIRALIAHVLNMQLKGLFRFHVDYASLTRLDLSGAIPKVEFVNR

SEQ ID NO: 227469 - protein, 82 aa, Glycine max
  Coding DNA Sequence Number=SeqID_110691
MAVENSSETHDMPDLLLVFCDVRLKFNPEQAQTKIQSEEYRISPSVPCRRMCIGVRDEQQACKLFPTCFSSKNWITLGLRFR

SEQ ID NO: 227470 - protein, 599 aa, Glycine max
  Coding DNA Sequence Number=SeqID_110692
  Homolog annotation: Hit_ID=Q5XWK4; Match level="QueryCoverage=59%, HitCoverage=91%, E-value=1e-67, Identity=42%"; Hit description =Expressed protein-like
  Pfam annotation: Domain name=DUF616; Domain location=217-531; Score =691.2; E_value=7.8e-205; Accession=PF04765.4; Description=Protein of unknown function (DUF616)
MSGGSLGIRSGSYGSLEKQQQQLQNNGVSLIQSARKPTKTLKEKDRFFLWIFKFAGRKKVGMLCLFTISAAVFIWVLNQCMPRVLLKVEEESMFCDSHDFGFDIKFGLLSDEDSQEGNSVHNISVNGNMSIGVSPSLIAGANIKGFTTISVLPPPPPSYFLGYTLPSGHPCNTFTLPPPPADKKRTGPRPCPVCYLPVDEAIALMPKFPSPSPVLKNLAFIYEETLSRDGEFGGSDFGGYPTLRQRNESFDIRESMSVHCGFVRGTKPGRNTGFDMDEDDLLEMEQCHGVVVASAIFGNFDEINEPTNISDYSKETVCFLMFVDEETEKYLRISGRLGTRKKIGLWRIIVAHNLPYTDPRRTGKIPKLLLHRMVPNAHYSIWLDGKLELVVDPYQILERFLWRKNATFAISKHYRRFDVFVEAEANKAAGKYENASIDFQIEFYKNEGLTPYTEAKLPLISDVPEGCVIVREHVPISDLFTCLWFNEVDRFTSRDQISFSTVRDKLLSRVDFHFLMFLDCERRNFVVQKYHRDILERLVAPVAIALSPPPPLETLPEKVARRGPGRRGRDRRPGSRRHRKVVAGGRDINMEANYTVLFV

SEQ ID NO: 227471 - protein, 613 aa, Glycine max
  Coding DNA Sequence Number=SeqID_110693
  Gene Ontology: Mol. function=oxidoreductase activity, acting on single donors with incorporation of molecular oxygen, incorporation of two atoms of oxygen; Cellular component=chloroplast; Biological process=fatty acid biosynthetic process
  Homolog annotation: Hit_ID=Q9SMW1; Match level="QueryCoverage=99%, HitCoverage=67%, E-value=0.0, Identity=59%"; Hit description =Lipoxygenase
  Pfam annotation: Domain name=Lipoxygenase; Domain location=2-597; Score=740.4; E_value=1.2e-219; Accession=PF00305.9; Description =Lipoxygenase
MTDEKYESPINSSVESYVPRDEAFEGVRKEALDVEKLKGATRNLIPFIRTCITKCGNFKQLSDVQQIYKRKHVDKMKPENVTTTKWPLPMNMMSKIQNDVEEYFKFDTPRIINGGNCCCIKDEELGRQALAGINPLSIKRLETFPPVSDLDPSIYGAQKSALKEEHIISHLDGMPVQQAMAEKKLFMLDYHDAYLPFLNGINAREDRKAYATRTILYLTRLGTLKPIAIELSLPESKQVLTPPLDATSHWLWQIAKAHVCSNDAGVHQLVHHWLRTHACMEPFIIAAHRQLSAMHPVFKLLKPHLKHTLQINALAREALINEGGIIETDFSSGKYSTEIISAAYKDWWRFDMEALPADLIRRGLAEPDPTHPHGLRLLIEDYPYANDGLLIWFALENLVRTYVNYYYSDRIMVRSDSELQSWYSEVTNVGHADHANASWWPTLSTPSDLTSILTTLIWVASVQHSAVNFGQYPLGGYVPMRSPHMKKLLPKEDDLEYKEFLEDPEGYLLSCLPNMFETTKFLAVVNILSQHSPDEEYMGQRKDLSDWTGDPEIIKAFYEFSMDIKRIEKEIDKRNKDTTRRNRCGAGIPPYELLVASSAPGVTGRGVPNSISI

SEQ ID NO: 227472 - protein, 79 aa, Glycine max
  Coding DNA Sequence Number=SeqID_110694
  Gene Ontology: Mol. function=DNA binding; Biological process=DNA integration
  Homolog annotation: Hit_ID=Q1SXA8; Match level="QueryCoverage=97%, HitCoverage=8%, E-value=7e-19, Identity=60%"; Hit description=Zinc finger, CCHC-type; Polynucleotidyl transferase, Ribonuclease H fold
MMHGNLWSYPRTRRLLELNGYSKTNWTRKLYQMNVKNAFLNGLIQKEVYAEQPPRFESDTFCHHVFKLNKALYGLKQAP

SEQ ID NO: 227473 - protein, 78 aa, Glycine max
  Coding DNA Sequence Number=SeqID_110695
MRITKNQAKIETLGLSKLATIFKDKIQKAKKKDKKKVNDHDDEDYVPEYKGGLGSNSLSKHYENDKHDEFVAINDLEE

SEQ ID NO: 227474 - protein, 174 aa, Glycine max
  Coding DNA Sequence Number=SeqID_110696
  Gene Ontology: Mol. function=double-stranded RNA binding; Cellular component=intracellular; Biological process=RNA processing
  Homolog annotation: Hit_ID=Q9LTQ0; Match level="QueryCoverage=60%, HitCoverage=25%, E-value=9e-19, Identity=50%"; Hit description =Similarity to CAF protein
MASLPSSVDKNLEVWLLPFPLIHMWLQPMNMFARVACGNGEKPIPLGENVLQTNTKLFLKVEIDVDVNRSSDGLDDVGEDLGRLDGSAVSDGVNLELDNIDEALDLVDEALDLVDEGRGVVANVVVEATADGDTGKLLGAVVGGTEGGELAGIKIGVSEKQVATHPLMMARLRT

SEQ ID NO: 227475 - protein, 132 aa, Glycine max
  Coding DNA Sequence Number=SeqID_110697
  Gene Ontology: Mol. function=peptidyl-prolyl cis-trans isomerase activity; Cellular component=nucleus; Biological process =intracellular transport
  Homolog annotation: Hit_ID=Q8RWG8; Match level="QueryCoverage=63%, HitCoverage=38%, E-value=4e-30, Identity=75%"; Hit description=Ran -binding protein 1 homolog b
  Pfam annotation: Domain name=Ran_BP1; Domain location=37-130; Score =32.3; E_value=8.1e-11; Accession=PF00638.9; Description=RanBP1 domain
MSSADLKHKEEEEELVVGDDKDTRAYVAPIVKLQKVAITTGEEDEDPILDLKSKLYRFDKDENQWKERGADTMKFLKHKASGKVRLLMRQSKMLKIYANQLIFESVQFSSIGFIHDCPSFLKPLGEEEEGQS

SEQ ID NO: 227476 - protein, 41 aa, Glycine max
  Coding DNA Sequence Number=SeqID_110698
MYPHMEVQDQGLAATLTQSSSRSQGLRRLPRARERGGDVFN

SEQ ID NO: 227477 - protein, 86 aa, Glycine max
  Coding DNA Sequence Number=SeqID_110699
  Gene Ontology: Mol. function=heat shock protein binding; Cellular component=integral to membrane; Biological process=protein folding
  Homolog annotation: Hit_ID=Q6ATJ1; Match level="QueryCoverage=79%, HitCoverage=28%, E-value=8e-10, Identity=42%"; Hit description =Putative DnaJ protein
MFCPGCSQKEAALSEQNFKKHGREKGISIEETMGDGRKMVLVHIVNISKETIGIGRLKHPSESSGRIINTLKEGVETNHYHIITQF

SEQ ID NO: 227478 - protein, 62 aa, Glycine max
  Coding DNA Sequence Number=SeqID_110700
MRKARVIEKIYLRPTANLMVVRWEPPPLGTLKCNIGATFVEEENSSKFVVLSGRIEGDKQTR

SEQ ID NO: 227479 - protein, 104 aa, Glycine max
  Coding DNA Sequence Number=SeqID_110701
MSDTMSRTSCPKILEVAVQCTKLQDPRCRIQCPGHPARKYWKLLYNAQSCRIHDVGYDIFRKNDRSHPAQGVAAQKRTLLYKHEGCTSSVPSPGLKSYFVIFGT

SEQ ID NO: 227480 - protein, 53 aa, Glycine max
  Coding DNA Sequence Number=SeqID_110702
MNEDKKNWNEKAKTMMEINRKTKEMFNTIHIKDQDFCCKIEGSTRAYLAFARQ

SEQ ID NO: 227481 - protein, 167 aa, Glycine max
  Coding DNA Sequence Number=SeqID_110703
MAGLRDSKMRESETTPQATHKACSEILPRELPGCPFSIQNKFVPWNAELGSKLLRIYAHPGGFVFEIIQVRIKLLDQGYIYVPIHFPGQGFMPASPLELPTELVVFSNVENNVPLRKNVPRVNVQGIPLPSSLRIKSGSIIRLLGPRGSRFPLHGGHLHQKESQEAS

SEQ ID NO: 227482 - protein, 141 aa, Glycine max
  Coding DNA Sequence Number=SeqID_110704
  Gene Ontology: Mol. function=RNA-directed DNA polymerase activity; Biological process=RNA-dependent DNA replication
  Homolog annotation: Hit_ID=Q1SD42; Match level="QueryCoverage=92%, HitCoverage=17%, E-value=5e-10, Identity=27%"; Hit description=RNA -directed DNA polymerase
MVVRWEPPPLGTLKCNIGVAFVKEENSFKLVVFIRDDRGQFVMALSHTSPFKLLIHERKALAMLVALQWLKDLEIDDIIIESDCLQVENEVYNCRSDKSKYGRQANSVTHSLDRALNSQVDPHYFRHVPNCIADFFRIEII

SEQ ID NO: 227483 - protein, 160 aa, Glycine max
  Coding DNA Sequence Number=SeqID_110705
  Homolog annotation: Hit_ID=P43299; Match level="QueryCoverage=32%, HitCoverage=7%, E-value=2e-07, Identity=55%"; Hit description =Protein PROLIFERA
MLLRRTAEKDAVLFGERKSRNTPWRRERSREEPSLCRHGVAREGRRGPSISFAVVVLSEKKPVEDVRHRVKKTMKRELYIKASSKGRPSTIREVKALNIGQLVRISGYIYMEFQLVDGNDDMGVSGDVGLSTYEVQMHQETYEEFQQEVTEFQVQFMFST

SEQ ID NO: 227484 - protein, 63 aa, Glycine max
  Coding DNA Sequence Number=SeqID_110706
MGSSCIGVPLGPFLLCKLVFEHLPNVGYMEGEDYMGGDLLETKWKLLRGTGRALSIKEKLNEL

SEQ ID NO: 227485 - protein, 92 aa, Glycine max
  Coding DNA Sequence Number=SeqID_110707
MRGVVYNLQQFLIQKSAKVDVSLSKLNALSECHPLSEASTRLPDRRNLEGNLSCRHALNASSARSASRLLPSSLSASLALSKNSLTRAKPRK

SEQ ID NO: 227486 - protein, 136 aa, Glycine max
  Coding DNA Sequence Number=SeqID_110708
MARTCNPLKVRACPPLKVRACSPTKVKAHDPLKARTCSPLKLKKKHALRRPYRTCARARVMDEIEKVQEQMKADPEALKEKMATMVEAMMSIKEMVEVSAAYQTHARAKIMGEVEKVQEHMKADMEAMKEQMVGKD

SEQ ID NO: 227487 - protein, 259 aa, Glycine max
  Coding DNA Sequence Number=SeqID_110709
  Subcellular localization annotation: CTP_CleavageSite=24; ConfidenceScore=5.20e-01
MTLASAISSPGTMFTAKQTNHHLSATLGNAVLLEETTQRRQFVFHQSTVTYDTNLAFDVQNIVIFIFFKNLHFDTLVGEKDYETDKPIEDRVHVQGPPGRDPSFSLAKVPPQISRPNSGRQSAFLNNDNDNKGGAAKDDSNDNGAGAGALISLSREGNNTASVVPVLNTSSPVKALVETRSNQGKGADTGKFGRKDVPSCVPSDIKKERTLLRSLVVHNNKRSEGDFVGNLSSKEKSGKKRLRTSNKEVDPSAARECHE

SEQ ID NO: 227488 - protein, 66 aa, Glycine max
  Coding DNA Sequence Number=SeqID_110710
  Homolog annotation: Hit_ID=Q1S7V8; Match level="QueryCoverage=95%, HitCoverage=28%, E-value=4e-11, Identity=50%"; Hit description=HSP20- like chaperone
MKVFSCVLELPFCSDTDMAVEEAPNFFRFMAETDGIGNVRAHTVEIHPGMKKIMVKEGGLVELSLD

SEQ ID NO: 227489 - protein, 74 aa, Glycine max
  Coding DNA Sequence Number=SeqID_110711
  Subcellular localization annotation: CTP_CleavageSite=22; ConfidenceScore=5.15e-01
PNLFTLCRFDSASGAPFPETPRKHSRGSQTLPYLPGALPQRTPLLMPLLVRVPPSGYSWKDVCGGGYGFAMAIS

SEQ ID NO: 227490 - protein, 121 aa, Glycine max
  Coding DNA Sequence Number=SeqID_110712
  Gene Ontology: Mol. function=nucleic acid binding; Biological process= DNA integration
  Homolog annotation: Hit_ID=Q1T010; Match level="QueryCoverage=88%, HitCoverage=10%, E-value=3e-19, Identity=38%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MNAIFRFQEVDEVVKKATHKELKRLDSKARFLIHQCVDATVVGKIAKATTTKEAWDILIKTYGDAEKTKKVLVNGMKACKEALTNQQVVDKVLSSLTPQFDRVVVAIEESKNLDSMKVEDL

SEQ ID NO: 227491 - protein, 90 aa, Glycine max
  Coding DNA Sequence Number=SeqID_110713
MEKRCGMTIICLRMSSGLPPLDDKRAQNDHNLSLRAIGHDRIGMAKRCGMTIICLRMSYDLRVSMIEIVGRPIKARLLLLCILNEELRPT

SEQ ID NO: 227492 - protein, 203 aa, Glycine max
  Coding DNA Sequence Number=SeqID_110714
  Gene Ontology: Mol. function=helicase activity
  Homolog annotation: Hit_ID=Q1SRJ5; Match level="QueryCoverage=91%, HitCoverage=22%, E-value=7e-49, Identity=48%"; Hit description =Probable helicase [imported]-Arabidopsis thaliana-related
MLSDSDNAAQNVNIHNDELKEYLDCRLYHRYISPCEAAWRIFAFPIHGRKPAIERLYFHLPDQHNIIYEDHDDIDDVLSKPTISDSKFLAWMNTNKDFDEARNLTYSQFVSKFVYNKRNRSWQPRKKGYTIGRLIWVPPTTGELFYLRMMFGSCKGPTSFEDIRIVANIQHIEKHVLQWAFYKMTENMLRQSKRPRIGAQPII

SEQ ID NO: 227493 - protein, 61 aa, Glycine max
  Coding DNA Sequence Number=SeqID_110715
LPPEVNFKMEPKTQINYQLLTESREIRSPFFYSEEQRSQTRQRFEPEEEKTLAEFGENNDA

SEQ ID NO: 227494 - protein, 97 aa, Glycine max
  Coding DNA Sequence Number=SeqID_110716
MTKARQKGVRKENRGEACHPAHPGELGCFLLKQLPSRGIFWKAQVDLVAICTPIFTKYISLLFFELHELSSDGAKYLKVVKGGSHPNNGWSPDEIRL

SEQ ID NO: 227495 - protein, 127 aa, Glycine max
  Coding DNA Sequence Number=SeqID_110717
MGCPCVPIPLKIIEATRSNKFKTKGAPKSVKSIKHEPSMGECVDEMSTMVGSSATPSVAFKVGCDKKRTKMDHYIDEFHDELQQYILNIKDVTPNGNCGYRTIATLLGQCEKSWSLIRQDLIQELQI

SEQ ID NO: 227496 - protein, 174 aa, Glycine max
  Coding DNA Sequence Number=SeqID_110718
MEPDTYRVEYELQVLVCKGCYGGVTALVDNHWLVDNSQLSSVEGVFPVSKVVALTSRRVTNPNFVRGLSFMDVLILDSRIAVFDTNPSSPRLASGSLGPWNYLLAKQPARLGELITSGLRGWKVHHLKGIERKEEEREKEEEERRGNEAETLTNRDHDQSLRRFLFRVLRATVD

SEQ ID NO: 227497 - protein, 187 aa, Glycine max
  Coding DNA Sequence Number=SeqID_110719
  Gene Ontology: Mol. function=aminoacyl-tRNA ligase activity; Biological process=tRNA aminoacylation for protein translation
  Homolog annotation: Hit_ID=Q2KWF5; Match level="QueryCoverage=100%, HitCoverage=41%, E-value=1e-68, Identity=74%"; Hit description=Seryl- tRNA synthetase
VEHELRQRAVQAGNETAHEREARARQLGGGIEVQAQRFAQRDVVAGLERQRGRVAIGARGGRQPAAHFDVIVGGLAQRHAGVRQVRHRHQQLVERLLQGGQLFFQLLQALGHGLRFGHDGAGVLALGLELTDLLGQRVAAGLQGFGFGLDRLAARLQLVEPFRVEGHATALEAVYDGLQVFAQQYRV

SEQ ID NO: 227498 - protein, 145 aa, Glycine max
  Coding DNA Sequence Number=SeqID_110720
MMSEIEEVQEQMKADVEAMKEKMTIMMEAMMSMRKMMEATHPSEVDPNHPSGLNQVNPLVSDMIGQGGKALRSMGSPYFVQVQSKHPFLAYGLPPNYTPPNVTHAPDENVDNSTPLPIESQQPQFVHAQVPKPMGRHMKCPETIL

SEQ ID NO: 227499 - protein, 130 aa, Glycine max
  Coding DNA Sequence Number=SeqID_110721
  Gene Ontology: Mol. function=hydrolase activity, hydrolyzing O -glycosyl compounds; Cellular component=cell wall; Biological process= carbohydrate metabolic process
  Homolog annotation: Hit_ID=Q8GTJ0; Match level="QueryCoverage=79%, HitCoverage=46%, E-value=7e-30, Identity=49%"; Hit description =Xyloglucan endotransglycosylase
  Pfam annotation: Domain name=Glyco_hydro_16; Domain location=29-130; Score=14.5; E_value=1.6e-08; Accession=PF00722.11; Description =Glycosyl hydrolases family 16
MASPCFSSIFLLLSIFLLALIQFALCGNFYEDVDNLFGDVRVDIKDKGQSMTLTMDEYSGSGIVSKNEYLFGRFDLKIKLFLGNLTGDPYLLSTNVYADVVGGREMQYYLWFDPTEDFHTYSIDWNPDRI

SEQ ID NO: 227500 - protein, 81 aa, Glycine max
  Coding DNA Sequence Number=SeqID_110722
MKRRKTGLFQSISFEIFESMLCSLQAIPKLDRVTSKPRKYLSIPRSLMLNFASRVKKLQQQQWLQEGSNITAEGKISTDTM

SEQ ID NO: 227501 - protein, 128 aa, Glycine max
  Coding DNA Sequence Number=SeqID_110723
MAIRKCSIGVIQLWDFWHLIKFGESFSLSSLLNQSQTYQGNPCGVYPDLSSFIGSGVIQTSVACIKRSAPTQVHIISDEEITKGKDHEALEGPMTRGRLKQAQHDIETRLVICIAAIDDDFGPEAETL

SEQ ID NO: 227502 - protein, 711 aa, Glycine max
  Coding DNA Sequence Number=SeqID_110724
  Gene Ontology: Mol. function=protein serine/threonine kinase activity; Biological process=protein amino acid phosphorylation
  Homolog annotation: Hit_ID=Q5ZCI1; Match level="QueryCoverage=73%, HitCoverage=97%, E-value=1e-130, Identity=63%"; Hit description =Mitogen-activated protein kinase 10
  Pfam annotation: Domain name=Pkinase; Domain location=13-232; Score =115.0; E_value=2.2e-31; Accession=PF00069.15; Description=Protein kinase domain
  Pfam annotation: Domain name=Pkinase_Tyr; Domain location=13-230; Score=-81.7; E_value=1.8e-07; Accession=PF07714.7; Description =Protein tyrosine kinase
  Pfam module annotation: Pfam domain module=Pkinase::Pkinase_Tyr; Domain location=13-232::13-230
MDFFSEYGDANRYKIQEVIGKGSYGVVCSAIDTHTGDKVAIKKIHDIFEHISDAARILREIKLLRLLRHPDIVEIKHIMLPPSRKDFKDIYVVFELMESDLHQDYVATRWYRAPELCGSFYSKYTPAIDIWSIGCIFAEVLTGKPLFPGKNVVHQLDLMTDLLGTPSLDTISRVRNEKARRYLTSMRKKQPVPFAQKFPNADPLALRLLEKLLAFDPKDRPTAEEALADPYFKGLAKVEREPSCQPITKMEFEFERRRVTKEEIRELIFREILEYHPQLLKDYMNGTERTNFLYPSAVDQFRKQFAHLEENGKNGPVMPLDRKHVSLPRSTIVHSNTVHSKEQTNNAASKNRPTVEEYNKNPRDTEIPVPRSMQGPQRIPLAKPGKVVGPVVPYEHGNIVKDSYDPRSFIRGSVLPTQAVPPAYYYQRSSTGNQERPATEANKSVPLQAKHAQQQCGVNAKMAPDIAINIDTNPFFMTRAGVNKLEQGDQIAIETNMLQPKAHQYGGIGAAAGATAHRKVGPVQYGGAILLEKKTLFRDGAVVVSGDGLCKNESERLKGSASLEKSVSFLWPTKGMNFGYNYHETVDDEIESYLAANGAVSKIEALERENATKKDEIQRLKKEIGGGGSVGAEEPPRREREREYGRARSGGRDEREGWGEREREIEEMKQRIEELEKVKVVEMREKGERVEEGVVACAVAGDGGREWSRCC

SEQ ID NO: 227503 - protein, 277 aa, Glycine max
  Coding DNA Sequence Number=SeqID_110725
  Homolog annotation: Hit_ID=Q3J8J6; Match level="QueryCoverage=58%, HitCoverage=88%, E-value=2e-24, Identity=40%"; Hit description =Hypothetical protein precursor
  Pfam annotation: Domain name=DUF1791; Domain location=75-200; Score =8.9; E_value=3.4e-05; Accession=PF08754.1; Description=Domain of unknown function (DUF1791)
MRPASYIVIAALAGFVGGNVLQLPELVDKVSGKFADQKTEPADFWSTPAIAGYGKIHFVNTPDYNPANTPGLSNKIVFQINRSEGDIHQPNLGLERVARVTNLYYAAGVPLNQLNFVVSINSDAVPAALNNDQFRKAYGSDNPNLKLIDELKKAGVKVTICDQSVAFHQLERDWIDTRVTHTLSSGTTVASLQNEGLLSSFRHPFVMSLSQFAVSLGANEIDLIGTLRGEHVRLTHGGKAGRRFTRHGRARLFRSPSAAARHAGESAGGVGAARLSS

SEQ ID NO: 227504 - protein, 57 aa, Glycine max
  Coding DNA Sequence Number=SeqID_110726
  Gene Ontology: Cellular component=coated vesicle membrane; Biological process=intracellular protein transport
  Homolog annotation: Hit_ID=Q9SB50; Match level="QueryCoverage=89%, HitCoverage=11%, E-value=2e-17, Identity=80%"; Hit description =Clathrin coat assembly like protein
MSGTTITKSVVANEPGGRKRDEIFVDVIEKISVTFNSSGFILTSEIDGTIQIHKPSN

SEQ ID NO: 227505 - protein, 89 aa, Glycine max
  Coding DNA Sequence Number=SeqID_110727
MSSTAIHLLPQIKIHNHNSMMYAPSMHRSWIIKDSKSLMQSYPARALDRRLQEDWARDAREGPRVLTSFRGSTLMERDPGNARDSVPGN

SEQ ID NO: 227506 - protein, 88 aa, Glycine max
  Coding DNA Sequence Number=SeqID_110728
MESDDEVGVEDTRYPILDGYGDGIKFLNSSSIGYECEDKLGSRGWGLGKQYPSPPCPIAMSKVEGGSAMVTCTTGLGALATQSILKQC

SEQ ID NO: 227507 - protein, 963 aa, Glycine max
  Coding DNA Sequence Number=SeqID_110729
  Gene Ontology: Mol. function=homoserine dehydrogenase activity; Cellular component=chloroplast; Biological process=aspartate family amino acid biosynthetic process
  Homolog annotation: Hit_ID=O63067; Match level="QueryCoverage=85%, HitCoverage=99%, E-value=0.0, Identity=98%"; Hit description =Aspartokinase-homoserine dehydrogenase
  Pfam annotation: Domain name=AA_kinase; Domain location=201-484; Score=223.1; E_value=6.1e-64; Accession=PF00696.18; Description =Amino acid kinase family
  Pfam annotation: Domain name=ACT; Domain location=525-586; Score =30.8; E_value=4.8e-06; Accession=PF01842.15; Description=ACT domain
  Pfam annotation: Domain name=ACT; Domain location=607-667; Score =35.7; E_value=1.6e-07; Accession=PF01842.15; Description=ACT domain
  Pfam annotation: Domain name=Histone; Domain location=58-132; Score =65.6; E_value=1.6e-16; Accession=PF00125.14; Description=Core histone H2AH2BH3H4
  Pfam annotation: Domain name=Homoserine_dh; Domain location=781-954; Score=250.2; E_value=4.4e-72; Accession=PF00742.9; Description =Homoserine dehydrogenase
  Pfam annotation: Domain name=NAD_binding_3; Domain location=679-809; Score=111.7; E_value=2.1e-30; Accession=PF03447.6; Description =Homoserine dehydrogenase, NAD binding domain
  Pfam module annotation: Pfam domain module=AA_kinase::ACT::ACT::Histon e::Homoserine_dh::NAD_binding_3; Domain location=201-484::525 -586::607-667::58-132::781-954::679-809
  Subcellular localization annotation: CTP_CleavageSite=33; ConfidenceScore=5.06e-01
MARMKQTARKSTRGKALRKQLATKATHKSAPPTGGVKKPHHFRPSTVALREIQKYQKNTELLIRKLPFQRLVREIAQDFKTNLYFHSSAVSTLQEAAEAYLVVLFEDTNLCTIHPRELPLCPRTEAYLVGLFSSHHPWRRFPPPSLSSPAFHLLTLRSTLTLTARSSNLNAALSSSRALPIHSDVSPNVSLEEKQLPKGETWSVHKFGGTCVGTSQRIKNVADIILKDDSERKLVVVSAMSKVTDMMYDLIHKAQSRDESYTAALNAVLEKHSATAHDILDGDNLATFLSKLHHDISNLKAMLRAIYIAGHATESFTDFVVGHGELWSAQMLSLVIRKNGTDCKWMDTRDVLIVNPTGSNQVDPDYLESEQRLEKWYSLNPCKVIIATGFIASTPQNIPTTLKRDGSDFSAAIMGALFKARQVTIWTDVDGVYSADPRKVSEAVILKTLSYQEAWEMSYFGANVLHPRTIIPVMRYGIPIMIRNIFNLSAPGTKICHPSVNDHEDSQNLQNFVKGFATIDNLALVNVEGTGMAGVPGTASAIFGAVKDVGANVIMISQASSEHSVCFAVPEKEVKAVAEALQSRFRQALDNGRLSQVAVIPNCSILAAVGQKMASTPGVSASLFNALAKANINVRAIAQGCSEYNITVVVKREDCIKALRAVHSRFYLSRTTIAMGIIGPGLIGSTLLEQLRDQASTLKEEFNIDLRVMGILGSKSMLLSDVGIDLARWRELREERGEVANMEKFVQHVHGNHFIPNTALVDCTADSVIAGYYYDWLRKGIHVVTPNKKANSGPLDQVVSEAKEAGYTEPDPRDDLSGTDVARKVIILARESGLKLELSNIPVESLVPEPLRACASAQEFMQELPKFDQEFTKKQEDAENAGEVLRYVGVVDVTNKKGVVELRRYKKDHPFAQLSGSDNIIAFTTRRYKDQPLIVRGPGAGAQVTAGGIFSDILRLASYLGAP

SEQ ID NO: 227508 - protein, 196 aa, Glycine max
  Coding DNA Sequence Number=SeqID_110730
  Homolog annotation: Hit_ID=Q1SB24; Match level="QueryCoverage=52%, HitCoverage=87%, E-value=4e-35, Identity=74%"; Hit description=Rapid ALkalinization Factor
  Pfam annotation: Domain name=RALF; Domain location=109-168; Score =14.0; E_value=0.00071; Accession=PF05498.2; Description=Rapid ALkalinization Factor (RALF)
MENNIISLLSKRFGEVRSISLSLMQLAPFQKGGVIYYNILYIVLLSGEWKEGYIQSKTQNRRMASKSSTIRLVCFCYFMLFSSMHFTSCTVLSLKSHASTCNGSIAECNQEDELLMESEISRRFLEQKRSYISNGALQRDKPVCNGGGSGEAYSKTGGCLPPPSNPQSLTLDYIFMQTSLRLFMNHAFSHNPYVVH

SEQ ID NO: 227509 - protein, 125 aa, Glycine max
  Coding DNA Sequence Number=SeqID_110731
MVWDCEELTLFWDCSVPSHSWAKFFSLGLHEWIQFNLSSLDSGNVNLDWPILFGVATYHLWNDRDFEGNIGKLSVLAPPNRKEVAISWTPPPSLLINVDGSYKASSSKLPMLVLCMIMWETLLSL

SEQ ID NO: 227510 - protein, 101 aa, Glycine max
  Coding DNA Sequence Number=SeqID_110732
  Gene Ontology: Cellular component=cellulose and pectin-containing cell wall
  Homolog annotation: Hit_ID=Q6TF29; Match level="QueryCoverage=66%, HitCoverage=45%, E-value=3e-13, Identity=56%"; Hit description=Rapid alkalinization factor 1
  Pfam annotation: Domain name=RALF; Domain location=34-94; Score=89.3; E_value=1.2e-23; Accession=PF05498.2; Description=Rapid ALkalinization Factor (RALF)
MSQPRFIVMTFPCLALVLLLHTLLPICNGLSVVDLINLSETEVMTKRHIKYISYGTLKRDMVPCDRAGASYYNFHARPANPYNRGCEVITGCARGVQGIKT

SEQ ID NO: 227511 - protein, 269 aa, Glycine max
  Coding DNA Sequence Number=SeqID_110733
  Gene Ontology: Mol. function=sulfate porter activity; Cellular component=integral to membrane; Biological process=sulfate transport
  Homolog annotation: Hit_ID=Q0P7I2; Match level="QueryCoverage=93%, HitCoverage=39%, E-value=1e-92, Identity=67%"; Hit description=Sst1 protein
  Pfam annotation: Domain name=STAS; Domain location=129-243; Score =98.5; E_value=1.9e-26; Accession=PF01740.11; Description=STAS domain
  Pfam annotation: Domain name=Sulfate_transp; Domain location=1-107; Score=-130.3; E_value=0.0051; Accession=PF00916.10; Description =Sulfate transporter family
  Pfam module annotation: Pfam domain module=STAS::Sulfate_transp; Domain location=129-243::1-107
PFSKTAVNYNAGCKTAMANVVQAIIVALALLFLAPLFGFTPLVALSAIIISAMLGLIPFEEVIHLYKVDKFDFVICMVAFLGVILVSMDIGLMLSVGLGILRALMYVARPASCKLGKLPEIGLYRDTKQYKVLTYPGVLVVQLGSPVYFANSLYVKERIMRYIRSEESSTGDVVEHIILDLSGVTAIDTTAIKALDELIIILGKNGIKVLFVNPRLEVMEKLIMSKFVEKIGKESFYLILDDAVMASQYSLRSSRRQIMVKRWFRRIHG

SEQ ID NO: 227512 - protein, 98 aa, Glycine max
  Coding DNA Sequence Number=SeqID_110734
  Gene Ontology: Mol. function=metal ion binding; Cellular component =nucleus; Biological process=regulation of transcription from RNA polymerase II promoter
  Homolog annotation: Hit_ID=Q1SB28; Match level="QueryCoverage=94%, HitCoverage=64%, E-value=6e-51, Identity=97%"; Hit description=G10 protein; Cytochrome c and b562
  Pfam annotation: Domain name=G10; Domain location=1-98; Score=160.0; E_value=6.2e-45; Accession=PF01125.8; Description=G10 protein
MPKVKTNRVKYPEGWELIEPTLRELQAKMREAENDPHDGKRKCETLWPIFKIAHQKSRYIFDLYHRRKEISKELYEFCLDQGYADRNLIAKWKKEEIH

SEQ ID NO: 227513 - protein, 59 aa, Glycine max
  Coding DNA Sequence Number=SeqID_110735
  Homolog annotation: Hit_ID=Q0P7I2; Match level="QueryCoverage=96%, HitCoverage=8%, E-value=6e-19, Identity=75%"; Hit description=Sst1 protein
LGIVVDFFSHATINGFIGGTAVALILQQLKGVFGMKHFSTKSNMVEVVKSIVRNRHELL

SEQ ID NO: 227514 - protein, 57 aa, Glycine max
  Coding DNA Sequence Number=SeqID_110736
MCFFGYHYLNFVIVAYGNGNRHRPWVGPCALGNKRVMAIWMAELTLLEEAETEERDV

SEQ ID NO: 227515 - protein, 319 aa, Glycine max
  Coding DNA Sequence Number=SeqID_110737
  Gene Ontology: Mol. function=transporter activity; Cellular component= 1-2nm peptidoglycan-based cell wall; Biological process=transport
  Homolog annotation: Hit_ID=Q0XEE6; Match level="QueryCoverage=62%, HitCoverage=90%, E-value=1e-79, Identity=74%"; Hit description=ABC transporter permease protein
GAAHDRDADGGDDGAGGTRRHGAGTDAAVVEPRGQRRRGGDRRVLPQPAADPGDLLGVLRHADGAGRAVLGGDHGAGGAGAERVGLQLRDLPRRHQFDPQGPDGGGAGDGHVAPPGHVQGAGAAGGAAHPAGAGQHLDLAVQGHLAGVGDRRQRAGLCLDAGARAELPRAGNADRDGGDLLADGLSAGQAGRLDPPQIRSQGVNEMILEQTADTAGAAVAAAATPAAATAAAASAATRKGADQPPVLVYEHVRKVFGDFVALNDVSLQVNKGEVMCLIGPSGSGKSTLLRCTNALEKIDGGRVLLDGVAVPEAESEVRK

SEQ ID NO: 227516 - protein, 155 aa, Glycine max
  Coding DNA Sequence Number=SeqID_110738
SKKVDTDNHSGISARQRVSKLNMTDLVSAEDDVFRLTDSKKFYTDNHSGISARQRDSKVSMTDLVSAEDDAFRLTDSKKVYTDNHSGISARQRDSKVSMTDLVSAEDDAFHFTDSKKVYTDNHSGISARQRDSKVSMPYLVSAEDDAFRLTDSKK

SEQ ID NO: 227517 - protein, 98 aa, Glycine max
  Coding DNA Sequence Number=SeqID_110739
  Subcellular localization annotation: CTP_CleavageSite=11; ConfidenceScore=5.08e-01
MLLNSNVIHVRVVMLVPMIRTRLFAAARGKSCPGLHSRCVIASLSGCARTAGRPLISGGGPGTDKRKLLALVTGSASLGEASKVKGPYILLRCGYGAH

SEQ ID NO: 227518 - protein, 120 aa, Glycine max
  Coding DNA Sequence Number=SeqID_110740
  Subcellular localization annotation: CTP_CleavageSite=62; ConfidenceScore=5.11e-01
DDPTVTFRGPRKVRGKRFEAPSTSASEAPTPYSSTLPPSSSTEIPVIPPAPTQIPLPTPLFAASTAQEPVTEEPPAPAAEEEITPAQTPQPSPSSAPAPMEIQPSTLDLNEEQPQEKHDV

SEQ ID NO: 227519 - protein, 107 aa, Glycine max
  Coding DNA Sequence Number=SeqID_110741
MRLRRRPLLLLLLNLTLLVIIQIPVGTGLSHVFLLIKNTWSRVGGAAEMPRPGDTKREREKKREGAQIGRVGVFIMKEGDTAKKHNAIWVGSGVKSVKNPYPLLRRP

SEQ ID NO: 227520 - protein, 78 aa, Glycine max
  Coding DNA Sequence Number=SeqID_110742
  Homolog annotation: Hit_ID=Q1T3H7; Match level="QueryCoverage=62%, HitCoverage=7%, E-value=2e-10, Identity=65%"; Hit description=Zinc finger, BED-type predicted; HAT dimerisation
MKQNTNFKGFVCFDVETRWNSTYLMLDAALKHRKTFEEFEMEDMKYDDELQNGDLPLSSNENKLFEMLEQFEQETIPS

SEQ ID NO: 227521 - protein, 80 aa, Glycine max
  Coding DNA Sequence Number=SeqID_110743
MEAMKYQMAAMMEAMLSMKKIMERNAIVSGLPASAPDRTNSIKRLILIKHHPKIPLVRLNSTRTALRHTYSTNLSHPDSS

SEQ ID NO: 227522 - protein, 238 aa, Glycine max
  Coding DNA Sequence Number=SeqID_110744
  Gene Ontology: Mol. function=RNA-directed DNA polymerase activity; Cellular component=mitochondrion; Biological process=RNA-dependent DNA replication
  Pfam annotation: Domain name=rve; Domain location=25-183; Score=9.5; E_value=0.00096; Accession=PF00665.16; Description=Integrase core domain
MIVGLKLVNEIGVNKIRSKIDSKLVTRQVNGDFQAKYTQMQKHYHLTICLLNSFDEYELKHIFKENNGRAYVLSKSASFKKLGQHRTFIQETLFTPSIDKSDIFAKKGYEQFQWQLGIKHLVSFVEHPQTNGQTEVANKVILTKMNKRGCKTKGLWTELPSILWAYHWTPQSTTKETPFKLTYGTYAMIPVEVDEPSTTRAQFEETLNNENLPLEHDMIDEVRNHAQIQEEACKRRAT

SEQ ID NO: 227523 - protein, 300 aa, Glycine max
  Coding DNA Sequence Number=SeqID_110745
  Gene Ontology: Mol. function=hydrolase activity
  Homolog annotation: Hit_ID=UPI0000E696CA; Match level="QueryCoverage =94%, HitCoverage=99%, E-value=4e-84, Identity=52%"; Hit description =Zn-dependent hydrolase
  Pfam annotation: Domain name=Lactamase_B; Domain location=53-235; Score=47.7; E_value=4e-11; Accession=PF00753.17; Description=Metallo- beta-lactamase superfamily
MRISCTIETFLNNRDNSMKSTHLALLSTLFTPAVFAAPLSIDTYNPQEKGIFAVSSTLVSGPKEAVLFDAQFSVKDGEALVEKIRQSGKTLNKIVITSGDPDFYFGLQPLVKAFPNAKVVATQHVVDHIKATKDAKLAFWGPQMKDGAPTELVVPQVLASTTFMVDGEKIDIEQPDSYAAYVWIPSAKTILGGTGVAWGIHVWTADTQTAESRKQWQDTLQAMAAHKPERVIPGHYLGNPPAGSGAIDFTRNYLQRFEKALAAHKDSAGVIRTLKKQYPNLAEESSLELSAKVNTGEMKW

SEQ ID NO: 227524 - protein, 71 aa, Glycine max
  Coding DNA Sequence Number=SeqID_110746
MQHLGGGFGSGFIPIADYGSEFRKGSSRKAVRLLYSEIERPREVSWLKGIDPTIEVIDSNRGLSKGKDRVR

SEQ ID NO: 227525 - protein, 146 aa, Glycine max
  Coding DNA Sequence Number=SeqID_110747
MAATLPLLAIKQDRCALVSIVDAWQMEATVDAIRHRKQRERNHIQIGIWKTFGSNYVLHLGGEVKRGIEFVWVVRRTREQGLEDLDVDDVVKAEAAESHDLVVGASRGAYDKEWLEVRRKKRSHKRWEKVRFIGVWTRGALHLIFF

SEQ ID NO: 227526 - protein, 234 aa, Glycine max
  Coding DNA Sequence Number=SeqID_110748
MAQVGETLHDKINLQRVASEMTFVWPPHKRRALNENIWNGNEVSAFELSVADSVKGQKKKKGKGSKKSKVDPKCWFLTYEMSGGNVLMGKNTPCKLKNLVFMGAMDSKGFSCWVEGGIMKIKWKGKSEIQKQSQKEGQNGLFSNISDFKFASSFGLKCNFSPKQATCLGEWMPSTPCMLKEKIIPAEPKTIEKCRKRVKKKEKRKSGVKALQSCDRGSLPSSFLLLVLCFAQIG

SEQ ID NO: 227527 - protein, 218 aa, Glycine max
  Coding DNA Sequence Number=SeqID_110749
  Gene Ontology: Mol. function=RNA-directed DNA polymerase activity; Cellular component=extracellular region; Biological process=RNA -dependent DNA replication
MRFIELNKATILEWEITWSLKPLRTPSLVIFGSRSRRFDNERIEHALISFPEVKPLWFASLVDYHPKDDEMLNLLAWISQVFYFKDDELAAKTIELLWVIWKTRNDTVFSNKTTIVERALAITNFLSCYKEPQGMNIMQPTQISQPTWKPLDFGPIKVNFDAFVKKSISTGVGLICRDNMGEILAATTMFWPNFFEPSIARTMAFKWSIQIAAHSALP

SEQ ID NO: 227528 - protein, 397 aa, Glycine max
  Coding DNA Sequence Number=SeqID_110750
  Gene Ontology: Mol. function=hydrolase activity; Cellular component =nucleus; Biological process=regulation of transcription, DNA -dependent
  Homolog annotation: Hit_ID=Q9M391; Match level="QueryCoverage=79%, HitCoverage=100%, E-value=6e-85, Identity=55%"; Hit description =Ataxin-3 homolog
  Pfam annotation: Domain name=Josephin; Domain location=17-276; Score =28.9; E_value=2.9e-08; Accession=PF02099.8; Description=Josephin
WFEIANSTTMMEGASNGGMLYHEVQESKLCAVHCVNTVLQGPFFSEFDLAALASDLDRKERQVMLPALASADFESHNVSLDGDFSIQGCLELGLCTACLTLDRMALCCVGCGYANSGFNGRKGMGKRCGVQYGDLNLLTLLALEVWDLQVIPLDSPVAEPAQIDPELENAFICHLQDHWFCIRKVNGEWYNFDSLYAAPQHLSKFYLSAYLDSLKGFGWSIFLVRGNFPKEFPISSSEASNGFGQWLSPEDAERITKSCNSVQAPHPRVNEHQQHYDQFLSHGENEMLLDMEDEDLRAAIAASLMDSSPAVTNAEASTPQNDNHSSKQVATTEATPLNDQHSKQVEPIEATPPVNALSNKHVPAIEACSLNDQNSKEVASTIGDNAQDENQNKEKTA

SEQ ID NO: 227529 - protein, 71 aa, Glycine max
  Coding DNA Sequence Number=SeqID_110751
  Gene Ontology: Mol. function=catalytic activity; Biological process =metabolic process
MNAKRREDMVGVLPERRILMRHGKSQGNRDTAAYIITSDHNIQATTQGMAQALRTCEHLHHVMGSDDCSPD

SEQ ID NO: 227530 - protein, 84 aa, Glycine max
  Coding DNA Sequence Number=SeqID_110752
MKNKKGVVAGVSLSEVLSPLSELGESGGESAKHLHAQRVINSLSKSFVFSHAKRTQLAQWKIAYFDVTGQGSTKNLSFQEDSRF

SEQ ID NO: 227531 - protein, 291 aa, Glycine max
  Coding DNA Sequence Number=SeqID_110753
MVIDQSLFYDLTQLSSDDVPFEGALDDDWKFDFSVHDAHRLVCTNQSDMTERILAGSLALESRILHYLIVRILLPRSSNLAQVSEEDLIVMWAFHIGRQIDWAHLVRYRMHKALRLNAPLPYPHLVTLFLQHFNIPIDSEPYVPIKRSFLIGVAVVASFGYRKEHDGSWVKKGVQPNDDEGQLLVEGDSSLLQSILDRFDGLQTYVGERFVALEQQVDMRFDAMDSRITKVEEDVTIIRDCLDLPLPPPDCHHQKGGDCGNKAFQGYFDDAKESRVKQIPKIQDSRIKIQE

SEQ ID NO: 227532 - protein, 44 aa, Glycine max
  Coding DNA Sequence Number=SeqID_110754
MTTAMLSALISRLVRDLDIDALSDSSVTLKLHVAMDAHLAQLMS

SEQ ID NO: 227533 - protein, 80 aa, Glycine max
  Coding DNA Sequence Number=SeqID_110755
  Homolog annotation: Hit_ID=Q1SQ35; Match level="QueryCoverage=50%, HitCoverage=39%, E-value=2e-08, Identity=65%"; Hit description=Pol -related
MDMLVKVDKFLEGVEDMLGKVDKFTFPANFVIMDMEEDGELKSKWSIPFDIKKVKPYSAIIVEDPSTDKSQIVNGQRLKP

SEQ ID NO: 227534 - protein, 158 aa, Glycine max
  Coding DNA Sequence Number=SeqID_110756
MEVYKTEQRPLQDEQKQVWWRHFGRQFKSKIGVTGIPQQRPARSRSPDEAQGLGFATSAVRSVYQFRHTPSSLENIPQDAPLCQLSFHLLCAILTGKASISKVLLVFVRVGKRVSIVFVGSMPERFMGADCKSADESQRWFKSSSAQSRCASHTFRAQ

SEQ ID NO: 227535 - protein, 130 aa, Glycine max
  Coding DNA Sequence Number=SeqID_110757
  Subcellular localization annotation: CTP_CleavageSite=28; ConfidenceScore=5.02e-01
DMRGYLMVIHNFGQPGANEPVDERGLTSSSAPFVVLPRKVTCGVTLWLPAPFVNPGQTSRLTRREGKRARWRAETSIIFYTVATYPSAGGRRVTRGMRVPRKEYARSRYQRLFEENVGKTGKGAIYELLS

SEQ ID NO: 227536 - protein, 98 aa, Glycine max
  Coding DNA Sequence Number=SeqID_110758
MGHESFKRIRPNVERPGSSSGTSMMEKKMMTMIVDTLPVFYYEKMVGHSPSSFDDMVVTNERIKVGLKRGKSDHHALINAKKKLGQMKRVRMREKPML

SEQ ID NO: 227537 - protein, 124 aa, Glycine max
  Coding DNA Sequence Number=SeqID_110759
  Homolog annotation: Hit_ID=Q1SB87; Match level="QueryCoverage=44%, HitCoverage=18%, E-value=1e-17, Identity=70%"; Hit description =Cyclin-like F-box; Galactose-binding like
MGVFIITNTPPKPFGKPSEVKPKGESINISRKWERYLPIHFKPPYLLQKCHSVKPENHLRLRPVYRTNQAYRYRRPRGGARYQLLFPLVRVNFELGVIMVIAVSCVKLLSAHNSTQHTSRKHKV

SEQ ID NO: 227538 - protein, 75 aa, Glycine max
  Coding DNA Sequence Number=SeqID_110760
  Homolog annotation: Hit_ID=Q9LVD5; Match level="QueryCoverage=98%, HitCoverage=46%, E-value=2e-31, Identity=77%"; Hit description =Arabidopsis thaliana genomic DNA, chromosome 5, P1 clone:MJB24
VECPKYPGFCITRQKKEYPFIEIFHSPTQAANQGRVADPNITKYNVKVLPFNYDVSAYGFREFFKQHGIRASDPK

SEQ ID NO: 227539 - protein, 119 aa, Glycine max
  Coding DNA Sequence Number=SeqID_110761
MDVETTDCFALFHDIAPLSKRNAQSRVDFLVSTHLTKSESEYPITSSAKRSSHAQRTLWAQCRSWAKRSFSVLSVTRESGRAQESRPHAKHEISSLSETFVSCQAQRTTNAKPKSTYSC

SEQ ID NO: 227540 - protein, 111 aa, Glycine max
  Coding DNA Sequence Number=SeqID_110762
MVVVVVIMTMKVTLMMVVMIAMLMVMVMSVVTMVAMTVEVVVVVLVVAPSGGGDNNEDDGHGGGDGDGDDCSDNKKYHMSNMGNETYMTIFMINKQIQSFSGLIILKNDNS

SEQ ID NO: 227541 - protein, 46 aa, Glycine max
  Coding DNA Sequence Number=SeqID_110763
MAVKEGDTVLLPEYGGTEVKLDNKDFAYMMPRRFISCYKVDPFRSK

SEQ ID NO: 227542 - protein, 60 aa, Glycine max
  Coding DNA Sequence Number=SeqID_110764
MKSEGSLFLVKNPYDVMKAYNYSCHVHGAWQSSLNLTRCLGEMDCWRPIDASANNDPMLR

SEQ ID NO: 227543 - protein, 50 aa, Glycine max
  Coding DNA Sequence Number=SeqID_110765
DSSESESMDTSWASRKPSTEMLPLGLHHREGHVRCVILNSGSSVAMLSGS

SEQ ID NO: 227544 - protein, 72 aa, Glycine max
  Coding DNA Sequence Number=SeqID_110766
MSWVAICAPKSKGGLGLRKMMEANLAFMIRAIWQLSSYEMSLCSRNILEGLLELLENKECAHWKAKYVSGWI

SEQ ID NO: 227545 - protein, 43 aa, Glycine max
  Coding DNA Sequence Number=SeqID_110767
MKIEDPKGGIQKGMNELDWESKPWRISQALRPVGMLISCGQES

SEQ ID NO: 227546 - protein, 200 aa, Glycine max
  Coding DNA Sequence Number=SeqID_110768
  Gene Ontology: Mol. function=protein dimerization activity; Cellular component=nucleus; Biological process=regulation of transcription, DNA-dependent
  Homolog annotation: Hit_ID=Q1SGY6; Match level="QueryCoverage=92%, HitCoverage=33%, E-value=7e-43, Identity=69%"; Hit description =Transcriptional factor B3; Auxin response factor; Aux/IAA_ARF _dimerisation
  Pfam annotation: Domain name=B3; Domain location=39-140; Score=48.2; E_value=2.8e-11; Accession=PF02362.12; Description=B3 DNA binding domain
MTMHADAKTDEVYSQMTLQPLNLVLTKTVFVVRPKGGILASRAGHPNGASTHGGFSVPRRAVEKVFPPLDFSQQPPAQELIARDMHGNEWKFRHIFRGQPKRHLLTTGWSVFVAAKRLVVERILKIKTWLWLGLQVGWDESTTGDRQPRVSLWEIEPLTTFPMYPSRFPLRLQWPWPLGLPSFHGERLVTYRGNFYYLET

SEQ ID NO: 227547 - protein, 77 aa, Glycine max
  Coding DNA Sequence Number=SeqID_110769
MYFITRVQLGMGDFLDEMLTMMSQTKSNENGEESFEELQQLFEDMFQAYIGLDGGPSLASSDSSTSSSYMTYSESSS

SEQ ID NO: 227548 - protein, 147 aa, Glycine max
  Coding DNA Sequence Number=SeqID_110770
  Homolog annotation: Hit_ID=O04237; Match level="QueryCoverage=42%, HitCoverage=16%, E-value=2e-15, Identity=66%"; Hit description =Transcription factor
  Pfam annotation: Domain name=HABP4_PAI-RBP1; Domain location=66-133; Score=9.4; E_value=0.00092; Accession=PF04774.5; Description =Hyaluronan  mRNA binding family
MAHHGAYECGYYVMHWMWNIIVGQLKTNWTLWFNDGTSLDINIMATLRKKWAEYFVKLRSIQLNETAKNFGDEKKNPSDEDDVAANGNKENPTNEAEQKEPENKEMTLKEYEKVLEERRKAFHTLKTEEKKGGDKDKRRETLDKEDK

SEQ ID NO: 227549 - protein, 1125 aa, Glycine max
  Coding DNA Sequence Number=SeqID_110771
  Gene Ontology: Mol. function=nucleic acid binding; Cellular component= intracellular; Biological process=DNA integration
  Pfam annotation: Domain name=rve; Domain location=484-647; Score =165.5; E_value=1.4e-46; Accession=PF00665.16; Description=Integrase core domain
  Pfam module annotation: Pfam domain module=RVT_2::rve; Domain location=808-997::484-647
MEPTTHHACATTQQMPTKWIMDFGATHHLTNDLDNMHLANSYHGQDQLIVGDDTTLPITYTALKHKGKHGLEKRLFIMQNNGSGIATSQLPIFKGINYQFWSLKMKTLFKSQELWGFVEDGFEDAQPLEPDQQLREKRKKDSKALFMIQQALDDEIFPRIASATTSKMAWDTLKKEYLVLMTDKESVQEYLSRVSTVVQQMRSYGETMTNEHVVGKVLRSLTSKYDHVVATIKESKDMADYTFDELMGSLQAHVERVNRNGEKKEEKAFHVKGESSNKEKTWQLSGRGHKEASCWKKQEDEQKGDQKSNFVENEQKLFLAQSAADNDVGGGVWYVNSGCSNHMSSAKSMFKELNESLKSKVRLGEAKQLEVEGRATIAIKTEQGNAKLLYDKSKAVVVKIVMGRNKMFPLDLSGSVSKALTVKGDDDAKLLHLRYGHLNMQGLKLLSSKDMVQRLPKIGDLELYEGCLYRKQSKGSFPSGRACRASESLELLHTDLCGPMQTVSLGGSKYFLLITNDYSRMSWVYFLKAKSEAFENFKIFKAMVEKQFGLCVKALRTDRGGEFLSNEFITFCEEQGIRRELTAPYTPEQNGVAERKNKTVVEMTRTMLKARGVPNNFWCEAVATVVYILNVSPTKAVMNMTPFEAWRGKKPSVSHLRVFGCTTYALVDLRSKLDDKSVKCVFIGYAAQSKAYRLYNPLIGKIMVSRNVVFDENAGWNWEQRESCDNIQQKIVGTDSSGEDSIVPTNDQQSPSRPTSPLSSNHSSSSSSSPSLSSSSNDSAPRRYMTLADLYANYDFALMAANPTSFDEAKDENETWKLVDLPEEKNVIGLKWVFKTKFNTNGSIQKHKAMLVAKGYAQKEGIDFEETFSPVARFETARVVLALAAQWKFDVFQLDVKSAFLNGDLQEKVFVEQPLGFVKDGEEGKRSENEPTLYVKKEGLNGFIVVCLYVDDIIYFNSSQKLLNEFKASMMEQFEMTNLGLLQYFLGLEVKTPMNPNEKLQKKDGTGKADEKLFKSHVGGLNYLTHTRPDIAHSVSVVSRYMRSPTKQQLGAAKRILKYVAGSTRFGILYEHVSEFKLVGYTDSDWAGSLDDKKSTSGSVFSFGLGAITWSSKKQDTMALSSSEA

SEQ ID NO: 227550 - protein, 85 aa, Glycine max
  Coding DNA Sequence Number=SeqID_110772
  Gene Ontology: Mol. function=nucleic acid binding; Biological process= DNA integration
  Homolog annotation: Hit_ID=Q1SIQ0; Match level="QueryCoverage=99%, HitCoverage=28%, E-value=3e-14, Identity=65%"; Hit description=Zinc finger, CCHC-type
MEMLIHGVSALRVASESLVEIHDSSMCLVGMPFAKGVPCLLGCLNVVEHVDPGVSSTCNQSERVRHELVPSTKPIKSYHTRRALI

SEQ ID NO: 227551 - protein, 155 aa, Glycine max
  Coding DNA Sequence Number=SeqID_110773
MEYVDVTRVGAETLFEKPLGFLLSEDGVRLGNGGSERGNDDGGGCFLGAKHGVVTAKGKKESEVAIKSERRRKWIREWEMGKALEDWLSMRISGCFEALKAVFGLWILLFDKVIMVCKFCDVVFSSGRFMVVAWSFCGVVVGGGGNLRIEILVTG

SEQ ID NO: 227552 - protein, 306 aa, Glycine max
  Coding DNA Sequence Number=SeqID_110774
  Gene Ontology: Mol. function=transporter activity; Cellular component= mitochondrial inner membrane; Biological process=mitochondrial transport
  Homolog annotation: Hit_ID=O24391; Match level="QueryCoverage=90%, HitCoverage=98%, E-value=1e-138, Identity=60%"; Hit description =Mitochondrial uncoupling protein
  Pfam annotation: Domain name=Mito_carr; Domain location=117-212; Score=108.3; E_value=2.2e-29; Accession=PF00153.17; Description =Mitochondrial carrier protein
  Pfam annotation: Domain name=Mito_carr; Domain location=21-111; Score= 64.8; E_value=2.9e-16; Accession=PF00153.17; Description =Mitochondrial carrier protein
  Pfam annotation: Domain name=Mito_carr; Domain location=217-304; Score=116.0; E_value=1.1e-31; Accession=PF00153.17; Description =Mitochondrial carrier protein
  Pfam module annotation: Pfam domain module=Mito_carr::Mito_carr::Mito_ carr; Domain location=117-212::21-111::217-304
MVVTVDFDCCDMMKGMHMMHSLLFVLFLKVCTIPLDTAKVRLQLQKQAATGDVVSLPKYKGMLGTVATIAREEGLSALWKGIVPGLHRQCLYGGLRIGLYDPVKTFYVGKDHVGDVPLSKKILAAFTTGAFAIAVANPTDLVKVRLQAEGKLPPGVPRRYSGSLNAYSTIVRQEGVGALWTGLGPNIARNGIINAAELASYDQVKQTILKIPGFTDNVVTHLLAGLGAGFFAVCIGSPVDVVKSRMMGDSSYRNTLDCFIKTLKNDGPLAFYKGFLPNFGRLGSWNVIMFLTLEQTKRFVKSLELS

SEQ ID NO: 227553 - protein, 361 aa, Glycine max
  Coding DNA Sequence Number=SeqID_110775
  Gene Ontology: Mol. function=nucleic acid binding; Cellular component= chromatin; Biological process=DNA integration
  Homolog annotation: Hit_ID=Q1T010; Match level="QueryCoverage=68%, HitCoverage=22%, E-value=1e-80, Identity=53%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVVESIPLGSLKISVRNVAFNMNITIAAYLLNNCPTKRLKEKDRASNSQNPTVSIQLQDVHLEYEQNIRESSDEIEATTNKKSTLEELEAIERNHTWELTKLHLHKKAIDQKPGVDYTKEFAPVRLEIVRLVIALASRNGWALFHMDVKSTFLNGFLDQMVYVTQPPDFEIKGKERMVYKLNKALYGLKQAPKAWNKRIDSFLIQNEFTKCTMEYGVYVKRKTEGILLICLYVDDLLVSGSNSEEIEKFKTKMMTEFENSDLGKLKYVVDVLKRFNMIECNQATTPIEVNLKLDVASDNDEEVDPTLFKQLIGCLRYLCNSRPDIAFSVRQEKHFKLHIQVLRGTNFMVFYEATSGGTLKM

SEQ ID NO: 227554 - protein, 88 aa, Glycine max
  Coding DNA Sequence Number=SeqID_110776
MFMVKAIPSRSINTLLESIFSDTKQRCCLESTFSGTNLGRKSRGNKPQNQIRLQVARYGEDETMMTSQQNTGGAMTGSQKYTGEHLRE

SEQ ID NO: 227555 - protein, 190 aa, Glycine max
  Coding DNA Sequence Number=SeqID_110777
  Subcellular localization annotation: CTP_CleavageSite=7; ConfidenceScore=5.09e-01
MKSKKEKGSAKGGSSNKGKQTTRSPSPPPSTKATPWFLEEHYEVSYKYNYVKEFIKPMFLNLEWLKTQWLIFPKLLEYHGLNKLVEMKGTFYLELVKVFYTTTHIDGETGYLYAKVKGKTIVTTPEVWEDIVGWSLEGMLVNDKGKGKERFGTSPLLLEHKLLGKMKLNWVSVVVDNMMNTKRIGSFKCP

SEQ ID NO: 227556 - protein, 86 aa, Glycine max
  Coding DNA Sequence Number=SeqID_110778
  Homolog annotation: Hit_ID=Q1SEJ7; Match level="QueryCoverage=90%, HitCoverage=5%, E-value=2e-09, Identity=41%"; Hit description =Integrase, catalytic region; Zinc finger, CCHC-type; Peptidase aspartic, catalytic
MNDENERRVTVGPFTPILNIDPSLELVSVLPHKLTQVSHSLDRYSSSRYDPSHTSLIDTLSSIFVLTCYSQAINDACWVKAMQDEP

SEQ ID NO: 227557 - protein, 69 aa, Glycine max
  Coding DNA Sequence Number=SeqID_110779
MARNSTSIEFDNKLSPDDSVDEYVRIGESTTIKCSTTFVKGVNKIFRDEYLRRPNNNNINRLLQIGEAT

SEQ ID NO: 227558 - protein, 254 aa, Glycine max
  Coding DNA Sequence Number=SeqID_110780
  Homolog annotation: Hit_ID=Q1SKD7; Match level="QueryCoverage=96%, HitCoverage=61%, E-value=4e-07, Identity=22%"; Hit description =Ankyrin
MAYRKRKSTASKPQAHYDTRRFHSLDAWNRYTDNILGRNILPERNVQIYHTEFDEFKVELERRNLHKRLANLQDGSIDVAMVKEFYANLYSTEEEAPKQARVRGHLIKIDADSLNEFLQTPVVLEEGESLPIYSRFCRLRTNPQEIEARLCIPHKGLVLNAKGQPWKLLRKDLTTLAQTWSVFSYSNLAPTSHTSNLNMDRARLVYGLVTNMDMNIGALISGQISSIAQSNSSRLRFPALITTLCRARGVTSDI

SEQ ID NO: 227559 - protein, 112 aa, Glycine max
  Coding DNA Sequence Number=SeqID_110781
MGEIKEVQERMKADMEAMKEQMATMMEVMMSIKKIMEVNAAAIATTSTVAEVREAKNWEVQASSILCKFKTSTPSSHMACLPTIYHPTWCTLPMRMSITSHPYSLRANNVTP

SEQ ID NO: 227560 - protein, 53 aa, Glycine max
  Coding DNA Sequence Number=SeqID_110782
  Gene Ontology: Mol. function=oxidoreductase activity; Cellular component=vacuole; Biological process=response to oxidative stress
  Homolog annotation: Hit_ID=Q5JBR5; Match level="QueryCoverage=68%, HitCoverage=11%, E-value=8e-11, Identity=83%"; Hit description =Anionic peroxidase swpa5
MKVEANEACTNSGIRLQSLLNSIAHDRRHIGACARIEDEVAIGYYLEVPTRLN

SEQ ID NO: 227561 - protein, 140 aa, Glycine max
  Coding DNA Sequence Number=SeqID_110783
NALNEIAAEVEHLCYLGNNPFSCGCVMRSTHGLPRGWLCEAEVSIKEEVETISKRFEELDVNTKGAPKKSMKRRQISTKHDLSYWEYVDAFHSVQSSNSSVKHSASSSKPPKPTRIIPMLDQFAPFIQGFIHNVVDVKAD

SEQ ID NO: 227562 - protein, 541 aa, Glycine max
  Coding DNA Sequence Number=SeqID_110784
  Gene Ontology: Mol. function=glutathione synthase activity; Biological process=glutathione biosynthetic process
  Homolog annotation: Hit_ID=Q1GYA5; Match level="QueryCoverage=57%, HitCoverage=98%, E-value=1e-109, Identity=64%"; Hit description =Glutathione synthetase
  Pfam annotation: Domain name=DAO; Domain location=320-541; Score =86.9; E_value=6.3e-23; Accession=PF01266.14; Description=FAD dependent oxidoreductase
  Pfam annotation: Domain name=GSH-S_ATP; Domain location=122-298; Score=374.2; E_value=2e-109; Accession=PF02955.7; Description =Prokaryotic glutathione synthetase, ATP-binding domain
  Pfam annotation: Domain name=GSH-S_N; Domain location=2-118; Score =135.7; E_value=1.2e-37; Accession=PF02951.5; Description=Prokaryotic glutathione synthetase, N-terminal domain
  Pfam annotation: Domain name=RimK; Domain location=119-299; Score= -31.9; E_value=7.5e-05; Accession=PF08443.2; Description=RimK-like ATP-grasp domain
  Pfam module annotation: Pfam domain module=DAO::GSH-S_ATP::GSH-S _N::RimK; Domain location=320-541::122-298::2-118::119-299
MMKLLFILDPLDALVTYKDTSLAMMRAAQARGHELWVCEQHDWQLQHDVVTVDAQTFAFNIDGSWKTSDKSTVSPADFDAVLMRKDPPFDNEYLYSTYLLELAQQQGARIINDPASIRGWNEKLSVARFPQFAPPFIVTSQQDKILAFLSEHGDIIVKPLDGMGGSGIFRLRKDDPNIYAILETLTQFQTQTIMIQRYIPDIVKGDKRILVINGEPLPYALARIPKTGETRGNLAAGGKGLAQPLSPRDKEIAETVGKILKQHGLFLVGLDVIGDYLTEVNVTSPTGMVEIAAQSKDWTPSCDPAMMMIEALEQLEYVMRVLVLGSGVIGVTSAYYLALKGFDVTVIDRQPAVGLETSFANAGQISPGYSAPWAGPDVPFKALKWLFQRHAPLSLRPDFSLWQLQWIAHFLRNCSLERYELNKSRMVNLAEYSRDCLRALRVSTGIQYEQRSRGTLQVFRTQKQLDAEAKDIAVLSRMGVPFQHVDPEGCARIEPALTTVKDQLLGGLHLPDDETGDCQLFTTQLAAEATKLGVQFRQNTH

SEQ ID NO: 227563 - protein, 75 aa, Glycine max
  Coding DNA Sequence Number=SeqID_110785
  Subcellular localization annotation: CTP_CleavageSite=44; ConfidenceScore=5.21e-01
MRRYPSSYPYKRFLSSWPVKSGGRRGYRMVFHTFRQPGANEPVDAQRLTSSSTPFVIQGQRVGWFLLSSSGDIQA

SEQ ID NO: 227564 - protein, 300 aa, Glycine max
  Coding DNA Sequence Number=SeqID_110786
MCAVVILDPWVISRQTLHPKKSRKGTVEGMLGSSFGKLNLGDSFAGTEEEAANTKEVTCYNTLHDDRRHRNHIEGKYLNGGAKVAADQTFIGEEEGHVTQSLSPSLSGQIQQGIGPGCIKGPISTQGGCNKEDIHPVELLGVQAVQNKKEGGLSNDLGPILKTDGCHKKESLPVIQSIKETPDKYSKVYFRQQNSLFKARLSQIEEKHPQLQDGIQALADQLANQDKVKNQSYVDSERRLKSIIECSDKVLQEAQQLWHLGENLGMETVTDNLHFLHSYASMECRDRNEAKELGNRKPLK

SEQ ID NO: 227565 - protein, 222 aa, Glycine max
  Coding DNA Sequence Number=SeqID_110787
GEDDKVCEKYRISKEKWTQSCQSCRDPSWEDVQKMEQTIQKQNTTPHVLSSGGFLGGAGLWTSGCTDFCHWVTRTPGSCPCYWRRPRVADTKDQRTVGGVDHSTINDVLQLDALSDVVVDAITVLLDWLLLEEFMRVKVGVEKVQDADAHIHVPIQEDKQVAEGMTKPVDMSDPNIDPLYLMTLTILQLFLKPLQNAGNTFASDGLMAVSQSREGEDRREAE

SEQ ID NO: 227566 - protein, 185 aa, Glycine max
  Coding DNA Sequence Number=SeqID_110788
  Homolog annotation: Hit_ID=Q84VH5; Match level="QueryCoverage=68%, HitCoverage=18%, E-value=2e-40, Identity=69%"; Hit description =Envelope-like protein
MAQKKSTPITPTTSRRSKVAIPSKKRKEISSSDSDDDVELDVPDIKKAKTSGKKVPGNVPDAPLDNISFHSIGNIERWKFVYQRRLAVERELGRDALDYKEIMDLIKAAGLLKTISNFYKFKNRKFIKWSNALNDLSFNKNISCKKDKNNLTKHFVHKELHRSDFLIAIKEYIGARETPSSTAKR

SEQ ID NO: 227567 - protein, 65 aa, Glycine max
  Coding DNA Sequence Number=SeqID_110789
MIIHDLVLVMFVNIAASMGVVATGPSRVSEGKVHGCAFQRRKDARSRHQRLFVENVGKTERNRSK

SEQ ID NO: 227568 - protein, 187 aa, Glycine max
  Coding DNA Sequence Number=SeqID_110790
  Homolog annotation: Hit_ID=Q40538; Match level="QueryCoverage=19%, HitCoverage=66%, E-value=2e-08, Identity=84%"; Hit description =Nicotiana tabacum (clone 5) activating factor DNA sequence
MASSNPNANNARRILHLMKTLNGRMSGNVLVRRGAEEPWLPLYCSIHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 227569 - protein, 55 aa, Glycine max
  Coding DNA Sequence Number=SeqID_110791
MKKLFDDMYEMPPRKLFAKRFRRDAATEGTSAAPEFDNHRFRSAELQQRFEAIKG

SEQ ID NO: 227570 - protein, 75 aa, Glycine max
  Coding DNA Sequence Number=SeqID_110792
MKVEQIFACHHISEERKVPLAALNFQGERRIHGDTLVEYWNDLKSALRKRHIPSYYEKACRVRFQLSARGILWTK

SEQ ID NO: 227571 - protein, 165 aa, Glycine max
  Coding DNA Sequence Number=SeqID_110793
ENDRSHPAQAVAAQKRTLLYNHGGCTSSAPSPGLKKLISIVQRGISGVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 227572 - protein, 61 aa, Glycine max
  Coding DNA Sequence Number=SeqID_110794
  Gene Ontology: Mol. function=catalytic activity; Biological process =metabolic process
  Homolog annotation: Hit_ID=Q1SI48; Match level="QueryCoverage=88%, HitCoverage=13%, E-value=1e-15, Identity=77%"; Hit description=AMP -dependent synthetase and ligase
MWYLWSQFCIMDYEHAGVGAIEFIICHSEVSIALAEEKKIPELFKTFPNATKYLKRSNSEL

SEQ ID NO: 227573 - protein, 135 aa, Glycine max
  Coding DNA Sequence Number=SeqID_110795
  Gene Ontology: Mol. function=carboxypeptidase activity; Cellular component=membrane
  Homolog annotation: Hit_ID=Q69TY0; Match level="QueryCoverage=69%, HitCoverage=27%, E-value=9e-18, Identity=54%"; Hit description =Putative MtN21
MLIERVRVRNDIIIQGLTILAPVDSPNTDGIDPVQFGSAGMFIFAMDSIKKGMSHYVFIVYRNAIASVSLAPFAFVLERKVRPKMTFRNNVGPVHRPLGHEIHVGIFPICCYELRSLCYFCDGCHSKICLLPLNL

SEQ ID NO: 227574 - protein, 107 aa, Glycine max
  Coding DNA Sequence Number=SeqID_110796
MAFQLAFKTKETMLDPYHSFLTPKMVEALSFTQDLLKGEPSPVFTNEDFEEIEKFEEIEKFEEGVVLSMFASSHYKKNDLYLQTKTVTISKKSVGKCLDLRESLEHT

SEQ ID NO: 227575 - protein, 59 aa, Glycine max
  Coding DNA Sequence Number=SeqID_110797
SLETENEASLKELWKAPVADDESDEHNDGDNDEDYFIEAFGKRRHRRAPFGGGDSNCGA

SEQ ID NO: 227576 - protein, 285 aa, Glycine max
  Coding DNA Sequence Number=SeqID_110798
  Homolog annotation: Hit_ID=Q13ML1; Match level="QueryCoverage=61%, HitCoverage=32%, E-value=2e-42, Identity=43%"; Hit description=Rhs element Vgr protein
  Pfam annotation: Domain name=DUF586; Domain location=1-28; Score= -12.2; E_value=0.086; Accession=PF04524.3; Description=Protein of unknown function, DUF586
GYGGVQIPRVGDEVVVDFINGDPDRPIITGRVYNDASMPPWALPAAATQMGFMSRTKDGSVDNANALRFEDKAGAEQAGVKGDVICLTGNSRSDKVVNNFIISAGNTLRLECGESAIELSKDGSVNIIGNNFNFTAKQNAQINTLGGELHLNPAGGSNAIDPPGSSHQSEIQQEVDTWDATLPLITTEDVSRDKALGALVGLAVGDAVGTTLEFKKRDSEHVADMIGGGPFQLKPGEWTDDTSMALCLAETYLSENRMHTDVLRKYLLKWYLDGENSSNGRCFDI

SEQ ID NO: 227577 - protein, 81 aa, Glycine max
  Coding DNA Sequence Number=SeqID_110799
MLFAIQVHTPPLLGFAKNCLWREKYASHEALQNGGFNPFSFSLTFGNSIRAIRGKIEESQKIARDAVIAVGRHVIPLRSKG

SEQ ID NO: 227578 - protein, 92 aa, Glycine max
  Coding DNA Sequence Number=SeqID_110800
  Gene Ontology: Mol. function=nucleic acid binding; Biological process= DNA integration
MDYGIEYSGFLVVLERYSDANWISDLDDTKSTSDYVSTLGVTYTLKTYCGKATTKERTNFHRLCEARRKLSKSSDKTPREKYDIRNIEGNET

SEQ ID NO: 227579 - protein, 76 aa, Glycine max
  Coding DNA Sequence Number=SeqID_110801
MILDASTGGTMMSKSLEEVVVIIDSIVASDYQSVHDRALTQRKGPSNNTYGGSSIKGTQQQQAQPDRMSKMEDTLT

SEQ ID NO: 227580 - protein, 101 aa, Glycine max
  Coding DNA Sequence Number=SeqID_110802
MVPSTFRVGLPSKTLCEVSTSTKTYGTINDWESFLELNVVSRSHVICKTTSSSVNYTSNNTRGFSSYLCSPSPTSCWLLLPQPPAYPPLKSPFLPPLPPLL

SEQ ID NO: 227581 - protein, 106 aa, Glycine max
  Coding DNA Sequence Number=SeqID_110803
MPRQNEFVGYSFIGKNPKNFDIPSGCTMDELKDLIKQVAPQEIPPYGIHETQTRNGERKRERRHHFKEKMSLEEAHHHRRPSIRAWRKKEMNEGRGREEHEILCSK

SEQ ID NO: 227582 - protein, 52 aa, Glycine max
  Coding DNA Sequence Number=SeqID_110804
MLINLSGKNSILTEQSTHSGPEEDAQCGSSGWVVTEGGWAGGGTSEDVGNKG

SEQ ID NO: 227583 - protein, 77 aa, Glycine max
  Coding DNA Sequence Number=SeqID_110805
MDEDQWTYDNTMSEEIDMDYENKQECDDVLPWARSVAHENGFVAVIMRNKKFVRRDTGSRKCGCPFKLRGKPVIGGE

SEQ ID NO: 227584 - protein, 103 aa, Glycine max
  Coding DNA Sequence Number=SeqID_110806
MWILEILQALKMKASEGTLTQAQPITLHLNTLGQHADLAQSHLYGLLHDHMPLVADTIEPTQPMVEMLEERFKVVEGSNYGRTEAADLCLVLDVIIPLKFKAP

SEQ ID NO: 227585 - protein, 339 aa, Glycine max
  Coding DNA Sequence Number=SeqID_110807
  Gene Ontology: Mol. function=RNA-directed DNA polymerase activity; Cellular component=intracellular; Biological process=RNA-dependent DNA replication
MDRQLMQIGYFESDVSVVDSILNFPKSLVVHYAKCTTSLAFSGPKIITIQVLKAFPYKDNKAVPWRYEVKVCVDGSDEKQSKNASSEATNIRNVVGIGSMTRSGRIYYPSESRTKPYKETNGEEVVRSSEEQRKEISDEEACEFLKLIKQNEYIVMDQLNRTPTKISFLSLMLNSEPHRKKVLLKILNDAHVIHDISKEKFEGIVGNVSASNYLTFTNEEMPVEEAGHNKALHISMKCMDHVLARVLFDNGSSSHREVIGEISLPIQIGLITFEVVFHMMDIAPMHSCLLGRPWIHGDLLASKPSSIPYIEATKEALETSFQGLEIANAIYAKEGKATT

SEQ ID NO: 227586 - protein, 384 aa, Glycine max
  Coding DNA Sequence Number=SeqID_110808
  Gene Ontology: Mol. function=RNA-directed DNA polymerase activity; Cellular component=intracellular; Biological process=RNA-dependent DNA replication
MTKEDEEKTTFITPWGTFCYKVMSFGLKNIGATYQRTMVTLFHDMIHKEVKVYMDDMITKLKKAEDHVVHIQKLFERLRKIKLRLNPAKYTFGIKSGKLLGFIVNQRGIEVDTDNVRAMLEMPPPYTEKEIRGQHDGCGRKEHAIHYLSKKFIGFKGRALEDYLAHQPIEDYQSMQCEFPDEGIMEMFGNKDLSKERRWIMWFDGASNIMGHGIGVILLSPKKQYIPITIRLCFNSTSNIAEYATCEWETRDAKLIPYQTRIKELVKQFDEITFELIPCEDNQLADALATLSSMFKLSKDKDMPLIRIQHHDQPTYFHLVEEDVLYKKNHDMVLLRCVDVIEVQKIFREVHEGSFGTHTNGYTMARKILKARYYWLTMETNCYN

SEQ ID NO: 227587 - protein, 169 aa, Glycine max
  Coding DNA Sequence Number=SeqID_110809
MSGLSSSVEYICQVDFGLVASARSILGLNVGARPFSRMNDGVESASASLASVRLKCWCWVDSRLCYWCWVNSRLWLLVPIRFRALIVGVGLVPGFDLVLGQFQALTVGVRSVLGLVVGVGSIPGFKDRMLMLDRLVVETEMIVPGKYWLKEKGLVNFVTKGTYATPLKV

SEQ ID NO: 227588 - protein, 81 aa, Glycine max
  Coding DNA Sequence Number=SeqID_110810
MDPYSQFGRRGRRGGGQRSWRKRSGGADSKQEQPFSVKIHDIHACEEGHHGVSDGSGMKSQRSYNGVSQEEELILDLGWGR

SEQ ID NO: 227589 - protein, 832 aa, Glycine max
  Coding DNA Sequence Number=SeqID_110811
  Gene Ontology: Mol. function=protein kinase activity; Cellular component=nuclear pore; Biological process=protein amino acid phosphorylation
  Homolog annotation: Hit_ID=Q9LRN0; Match level="QueryCoverage=89%, HitCoverage=97%, E-value=0.0, Identity=70%"; Hit description =Arabidopsis thaliana genomic DNA, chromosome 3, P1 clone:MUJ8
  Pfam annotation: Domain name=ABC1; Domain location=303-402; Score =13.5; E_value=1.6e-06; Accession=PF03109.7; Description=ABC1 family
  Pfam annotation: Domain name=APH; Domain location=217-485; Score= -14.7; E_value=0.064; Accession=PF01636.13; Description =Phosphotransferase enzyme family
  Pfam module annotation: Pfam domain module=ABC1::APH; Domain location= 303-402::217-485
  Subcellular localization annotation: CTP_CleavageSite=56; ConfidenceScore=5.18e-01
SPPWSLAPSAHTKHFIEFILLFVFVPKSQPPLRVSLSRTAEAKKREERREKRITVGSAMDAASQLVSCGIDPFPRATSPSPRHRRKSNLLNLRQRSSRVFAVSAEPKPAPPKTAVNGANSRPPPTRAVNGVSTRIGDVSKEIKRVRAQMEEDEQLATLMRGLRGQNLRDSLFAEDDVELRLVEVDESSEFLPLVYDPASISAYWGKRPRSVATRIVQLLSVAGGFLSRIAWDVINKKVKENEVARAIELREIVTSLGPAYIKLGQALSIRPDILSPVAMTELQKLCDKVPSFADDVAMALIEEELGQPWQNIYSELSSSPIAAASLGQEPGFGSSEVSSGKLNSCEQRLKVSIDVVGLVDEWAARFFEELDYVNEGENGNRFAEMMRKDLPQAKWIDGEKLSQSTENDVGELVNVGVICYLKQLLDTGFFHADPHPGNLIRTPDGKLAILDFGLVTKLTDDQKYGMIEAIAHLIHRDYPAIVKDFVKLGFIPDGVNLEPILPVLAKVFDQALEGGGAKNINFQELASDLAQITFDYPFRIPPYFALIIRAIGVLEGIALVGNSEFAIVDEAYPYIAQRLLTDESPRLRDALRYTIYGKSGVFDAERFIDVMQAFENFITAAKSGGGEDMNGNMAELGILTTSQSEYLLSGFQSVMPQSPQPVQTRAALAFLLSDRGNFFREFLLDEFVVSKYLTNIIAGGMQIVKGIDAVTREQLVRTMSLLGVQNATPVFSMVPTVGPFKPAALIPTITEEDEVILNNVRMVVEFLTAGSSLSRTSDQALNIPQIIQELLPVLPGISVKVLPERKRNANPKEEEINVAVEAKIYPKGMTTR

SEQ ID NO: 227590 - protein, 92 aa, Glycine max
  Coding DNA Sequence Number=SeqID_110812
MNDFNLKMVENNLPFHVANFLRQAKFDLVILEFLGGVITECKGLIHQLHKNTMKIGKGWKRYYKYNKLQKTEKILFTFDAAMGKVVRVTKVN

SEQ ID NO: 227591 - protein, 110 aa, Glycine max
  Coding DNA Sequence Number=SeqID_110813
MYVAITPYCHPHQCIRPLRPGRIGARRESRHGLCSIANYVLHLSYPSPLHANKNFGCSACYRRPHVTCHNPWGSTSLSKLNYYEDFHVYLGLEELRYDQEFLWTLVEYDG

SEQ ID NO: 227592 - protein, 108 aa, Glycine max
  Coding DNA Sequence Number=SeqID_110814
  Homolog annotation: Hit_ID=Q8RZ63; Match level="QueryCoverage=49%, HitCoverage=10%, E-value=5e-08, Identity=59%"; Hit description=ABC transporter-like protein
VALLDYGQVKDLPDQLRLAYANLVLAIANGDPLRAAESYRRTLTDLEGETYDIARRSRVNKCAREGRVVRNLERGRGRMRTKNNCREVGQSGGELGERLRENENKEQL

SEQ ID NO: 227593 - protein, 92 aa, Glycine max
  Coding DNA Sequence Number=SeqID_110815
  Homolog annotation: Hit_ID=Q9ZP54; Match level="QueryCoverage=90%, HitCoverage=8%, E-value=1e-12, Identity=49%"; Hit description=Poly [ADP-ribose] polymerase 1 (EC 2.4.2.30) (PARP-1) (ADPRT 1) (NAD(+) ADP-ribosyltransferase 1)
MSNILQTEWKCKIDGICGMFHAKVNKDTKCLVVGGSLNYEAEVRKARVIYRRMKIPIVREDYLIDGLARKKRLPFDMYKVEMIGEASSMVTI

SEQ ID NO: 227594 - protein, 347 aa, Glycine max
  Coding DNA Sequence Number=SeqID_110816
  Gene Ontology: Mol. function=hydrolase activity, acting on ester bonds; Cellular component=nucleus; Biological process=lipid metabolic process
  Homolog annotation: Hit_ID=Q0R4F7; Match level="QueryCoverage=98%, HitCoverage=97%, E-value=1e-122, Identity=61%"; Hit description=GDSL- lipase 1
  Pfam annotation: Domain name=Lipase_GDSL; Domain location=28-327; Score=199.1; E_value=1.1e-56; Accession=PF00657.12; Description=GDSL- like LipaseAcylhydrolase
MNIGLVVIVAVVLWSGVAAAQAQRVPCYFIFGDSSADNGNNNQLWSNARANYLPYGIDSSVGPTGRFSNGKTTVDVIAELLGLAGFIRPYASAGARDIFYGVNYASAASGIRDETGQQLGSRISLRGQVQNHIRTAYQMLNSLGDVNRTLTYLGRCIYSIGVGGDDYLNNYFMPQFYPTSRQYTPEQYANLLLQSYAQLLEVLYNYGARKMVLFGISPIGCTPYALAQSSPDGRTCVERLNSATQLFNTGLRSLVDQLNNRIPNARFIYVNVYGVRVTNVGCCRVASNNGQSTCVPLQTPCLNRNEYLYWDASNPTETANTIIARRAYNAQSTSDAFPIDINRLAQI

SEQ ID NO: 227595 - protein, 147 aa, Glycine max
  Coding DNA Sequence Number=SeqID_110817
  Gene Ontology: Mol. function=hydrolase activity, acting on ester bonds; Biological process=lipid metabolic process
  Homolog annotation: Hit_ID=Q8LD01; Match level="QueryCoverage=77%, HitCoverage=38%, E-value=6e-42, Identity=59%"; Hit description =Lipase/hydrolase, putative
MDPNAIILSLGDKVLRQILKEKTTIGIRPKLEGCSPNALAVWPRTAHMLTDARFIYTNVYGIFQDVLSNPSSYGFRVTNAGCCGVGRNNGQVTCLPLQTPCRNRNAFLFWDAFHPTEAANTIIGRRAYNAHSASDAYPVDINRLAQI

SEQ ID NO: 227596 - protein, 87 aa, Glycine max
  Coding DNA Sequence Number=SeqID_110818
  Gene Ontology: Mol. function=sequence-specific DNA binding; Cellular component=nucleus; Biological process=regulation of transcription, DNA-dependent
  Homolog annotation: Hit_ID=Q2TUV5; Match level="QueryCoverage=77%, HitCoverage=27%, E-value=7e-25, Identity=82%"; Hit description=MADS -box protein
MEIDLHNNNQLLRAKIAESERNHHNMAVLPGGSNYDSMQSSQQQFDSRGYFQVTGLQPNNQYARQDQMSLQLVLYVVLLVTKGDDGE

SEQ ID NO: 227597 - protein, 98 aa, Glycine max
  Coding DNA Sequence Number=SeqID_110819
  Gene Ontology: Mol. function=sequence-specific DNA binding; Cellular component=nucleus; Biological process=regulation of transcription, DNA-dependent
  Homolog annotation: Hit_ID=Q2TUV5; Match level="QueryCoverage=53%, HitCoverage=21%, E-value=1e-09, Identity=64%"; Hit description=MADS -box protein
MVKDKFKSFTKGRLIVKTLINDLNYCPDFDDFNYIVKATIERYKKASSDSSGAGSASEANAQFYQQEADKLRQQISNLQNNNRQVECLFHALGQEKSH

SEQ ID NO: 227598 - protein, 277 aa, Glycine max
  Coding DNA Sequence Number=SeqID_110820
  Gene Ontology: Mol. function=protein-tyrosine kinase activity; Cellular component=cytoplasm; Biological process=protein amino acid phosphorylation
  Homolog annotation: Hit_ID=O49409; Match level="QueryCoverage=93%, HitCoverage=56%, E-value=1e-90, Identity=64%"; Hit description =Protein kinase-like protein
  Pfam annotation: Domain name=Ank; Domain location=102-134; Score =11.0; E_value=0.81; Accession=PF00023.20; Description=Ankyrin repeat
  Pfam annotation: Domain name=Ank; Domain location=36-68; Score=4.6; E_ value=6.8; Accession=PF00023.20; Description=Ankyrin repeat
  Pfam annotation: Domain name=Ank; Domain location=69-101; Score=38.7; E_value=2e-08; Accession=PF00023.20; Description=Ankyrin repeat
  Pfam annotation: Domain name=Pkinase_Tyr; Domain location=154-274; Score=-137.3; E_value=0.00048; Accession=PF07714.7; Description =Protein tyrosine kinase
  Pfam module annotation: Pfam domain module=Ank::Ank::Ank::Pkinase _Tyr; Domain location=102-134::36-68::69-101::154-274
MESKNPARFTLGKQSSLAPERHNKEAELQNDGEVVDQGVRLMYSAFEGDVDGICEALEFGVSVNYKDIDNRTALHVAVCEGFTDVVDLLLQKGAEVDPKDRWGSTPLADAIFYKKNDVIKLLEKHGAKLLMAPMHVNHAREVPEYEINPKELDFTNSVEITKGTFCIALWRGTEVAVKKLGEDVISDEEKVKAFRDELALFQKIRHPNVVQFLGAVTQSSPMMIVTEYLPKVFCPTISWTMVFGALLGNWDGDLRDFLKRKGALKPSTAVRFALDIA

SEQ ID NO: 227599 - protein, 71 aa, Glycine max
  Coding DNA Sequence Number=SeqID_110821
MECSLHHQLAPYVPILVASGLTQQTFAKGDQCKADKDCYPYCSHRPDCPTLCLGGYCLCNCLPTEVHIQQN

SEQ ID NO: 227600 - protein, 74 aa, Glycine max
  Coding DNA Sequence Number=SeqID_110822
MAIYMFLLQVSDRDVNLFWSFLRCQFDWDTNTMLCNKFIVLAITITKRVQPVQGRILRYTSCVDLAPCTSNKVC

SEQ ID NO: 227601 - protein, 108 aa, Glycine max
  Coding DNA Sequence Number=SeqID_110823
  Homolog annotation: Hit_ID=Q9SJN0; Match level="QueryCoverage=41%, HitCoverage=10%, E-value=3e-08, Identity=58%"; Hit description =Abscisic acid insensitive 5
MAFKAFDFLQFAVLFQELAPLSTHMSLQQPNQEVPLQELETTFSQLSKQNLILSLTLDEFYCKNGKSLRSMNMDDFLSSIWNSDDNNQVNSPLPTLDEAAKGKSVLAT

SEQ ID NO: 227602 - protein, 549 aa, Glycine max
  Coding DNA Sequence Number=SeqID_110824
  Gene Ontology: Mol. function=transporter activity; Cellular component= membrane; Biological process=oligopeptide transport
  Homolog annotation: Hit_ID=Q1SL67; Match level="QueryCoverage=98%, HitCoverage=90%, E-value=0.0, Identity=78%"; Hit description=TGF -beta receptor, type I/II extracellular region
  Pfam annotation: Domain name=MFS_1; Domain location=1-486; Score=5.4; E_value=0.00018; Accession=PF07690.6; Description=Major Facilitator Superfamily
  Pfam annotation: Domain name=PTR2; Domain location=60-474; Score =326.3; E_value=5.5e-95; Accession=PF00854.12; Description=POT family
  Pfam module annotation: Pfam domain module=MFS_1::PTR2; Domain location=1-486::60-474
MIGFENLGTFSLAVNSVPYFSGIMHYSIPDAANMLTNYMGTGYILAIPVAVLADTWIGRYRSVLISGVFEFLGLALLTAQAHYPSLKPPLCNIYDITAHCETPSGGQEALLFIGLYLLAFGSAGVKAALPSHGADQFDEKDPREARLMSTFFNTLLLAICLGGAFSLTFIVWIQINKGWDWGFGIGTIAIFLGIVLFAAGLPLYRFRVGQGTNAFIEIIQVYVATIRNRNLPLPEDPIELYEIEQDKEAAEEIEFLPHRDTLRFLDRAAIQIKQGVQSEKPPSPWKLCRVTQVENAKIVLGMTPIFCCTIIMTLCLAQLQTFSIQQGYTMDTTFTKHFHIPPASLPIIPISFLIIIMPIYDFIFVPVMRKITGIPTGVTHLQRIGVGLVLSCISMAVASIIEVKRKRVARDNNMLDAVPILMPPLPISTFWLSFQYFIFGIADMFTYVGLLQFFYSEAPKGLKSTSTCFLWSSMALGYFASTIVVKCVNGATKHITSSGGWLAGNNINRNHLNLFYLFLSIVSLINFFIYLIVSMRYKYRSQPGGNSKK

SEQ ID NO: 227603 - protein, 313 aa, Glycine max
  Coding DNA Sequence Number=SeqID_110825
  Homolog annotation: Hit_ID=Q9FK74; Match level="QueryCoverage=83%, HitCoverage=100%, E-value=7e-75, Identity=53%"; Hit description =Arabidopsis thaliana genomic DNA, chromosome 5, P1 clone:MRA19
  Pfam annotation: Domain name=DUF1264; Domain location=71-280; Score =394.5; E_value=1.6e-115; Accession=PF06884.2; Description=Protein of unknown function (DUF1264)
MTTQSLYNQPRKHPCMSTWNQKLNPRSPSSAYIYDSHASEKITESILQRLTMASTDKSPDPTPAKGPDPTPGKPMSVGQHVIDKSAMMVQSLDPIKQMSQHVCSFAIYSHDMSRQIETHHYCSRLHQNFIQCAVYDSDESKARLLGVEYIVPADVFEAFPPEEQKLWHSHAYEIKSGLLVNPRVPEVVAMPELENLAQTYGKFWCTWQVDRELHVFSRGKVFVKNGNAGDRLPMGAPALMMSPQAASPGLVRAELVLERDAKYNFSSKSLKSSRLEIPEPEMINPLADYWKQHGKGFVIDIEETEMKLRPPFP

SEQ ID NO: 227604 - protein, 209 aa, Glycine max
  Coding DNA Sequence Number=SeqID_110826
  Homolog annotation: Hit_ID=Q1SL66; Match level="QueryCoverage=98%, HitCoverage=36%, E-value=3e-87, Identity=79%"; Hit description =Aldehyde oxidase and xanthine dehydrogenase, a/b hammerhead; Membrane attack complex ...
  Homolog annotation: Hit description=component/perforin/complement C9
  Pfam annotation: Domain name=MACPF; Domain location=37-206; Score =123.0; E_value=8.2e-34; Accession=PF01823.10; Description =MACPerforin domain
MAKYFNERSGITGHIPLGSFNSMFNFTGCWMADAAATKSLAMVGYFIPLVEVKLNKLNLVLTDEVKHAVPYSWDPTSLASFIENYGTHIVTSATVGGRDVVYIRQHQSSSLSASDIETYVKDIGDDRFHNVKHFSGPGPLKYKEKDVTVIFRRRGGDDLEQSHTKWVETVKLAPDVINMNFTPIVSLLEGVPGIKHLARAIDLYLQCEF

SEQ ID NO: 227605 - protein, 289 aa, Glycine max
  Coding DNA Sequence Number=SeqID_110827
  Homolog annotation: Hit_ID=Q1SL66; Match level="QueryCoverage=95%, HitCoverage=46%, E-value=1e-134, Identity=86%"; Hit description =Aldehyde oxidase and xanthine dehydrogenase, a/b hammerhead; Membrane attack complex ...
  Homolog annotation: Hit description=component/perforin/complement C9
MNQKTEGKSWRNDKPPIEDLQYFLDFQITQVWAPEQNNLQRKEPVCQSLQFSLMGPKLFVSPDQKTRVVFRSSTTKVTVGRKPVTGLRLSLEGSKQNRLAIHLQHLVSLPKNLQPHWDTHMAIGAPKWHGPEEQDSRWFEPIKWKNFSHVSTAPIEYTETSIGDLSGVHIVTGAQLGVWDFGAKNVLHLKLLFSKVPGCTIRRSVWDHNPSAPVAQRPDGASSSLMKKTSEDKKEDSSIHIGKLAKIVDMTEMSKGPQDIPGHWLVTGAKLGVEKGKIVLRIKYSLLNY

SEQ ID NO: 227606 - protein, 102 aa, Glycine max
  Coding DNA Sequence Number=SeqID_110828
MGSSQKPSLKKRFYQVKIKSLEVTSLRELGQLMGQLQQQAFRKAYGRPVYPLQGHRSCVEKGKANWDQLLASMEGRLLICSLARRKEESGFYLHAKDVQMFP

SEQ ID NO: 227607 - protein, 246 aa, Glycine max
  Coding DNA Sequence Number=SeqID_110829
  Gene Ontology: Mol. function=structural constituent of ribosome; Cellular component=intracellular; Biological process=translation
  Homolog annotation: Hit_ID=Q1MAL9; Match level="QueryCoverage=94%, HitCoverage=95%, E-value=1e-78, Identity=57%"; Hit description =Conserved hypothetical exported protein precursor
  Pfam annotation: Domain name=DUF1223; Domain location=8-227; Score =461.2; E_value=1.3e-135; Accession=PF06764.2; Description=Protein of unknown function (DUF1223)
MPLKFPLSICLLGTLLVTSAQAQQAVKGVVELFTSQGCASCPPADEALRKMIQKGDVVGLSYHVDYWNYLGWTDSLASKENTERQYGYMRALGRNGVYTPQAILNGRDHVKGADVRGIYDRLDSFKHEGKGLNVPVSSKFAGDEVEIDIGAGSGKADVVVAYFTREQTVDVQKGENQGKKMSYWHSVYDVQTVGMWDGSPMTVKLPASVVAKVKKGGCAVLLQTANASGDPAAIVGASILLGNETP

SEQ ID NO: 227608 - protein, 74 aa, Glycine max
  Coding DNA Sequence Number=SeqID_110830
MSEIEDVQEHMKVDMEAMKGQMATMMEGMMSMKTNDGEVDPTHSSSLNQVNPPVSDMVGQGGEALGSTGSPHVV

SEQ ID NO: 227609 - protein, 128 aa, Glycine max
  Coding DNA Sequence Number=SeqID_110831
MGVTFKQNILQQARLYRTMNGKLKVNNTATWNGSFYHLSDKDGASGSLKQSIFSSTASLYFNEPGNIKSVFSEKFQKMIPVRKITSGKYRIDLPNGNSTTYTYSNGICTLVEADTDFANLKFVLDQNR

SEQ ID NO: 227610 - protein, 67 aa, Glycine max
  Coding DNA Sequence Number=SeqID_110832
  Subcellular localization annotation: CTP_CleavageSite=43; ConfidenceScore=5.04e-01
MSSGNNAPAQTKNPNADSQNLNLQQVSAPVNVQEKLSPNKNVRIEADGKTYKVIVDRWESDSLVAHP

SEQ ID NO: 227611 - protein, 219 aa, Glycine max
  Coding DNA Sequence Number=SeqID_110833
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q6QZN8; Match level="QueryCoverage=98%, HitCoverage=27%, E-value=3e-49, Identity=48%"; Hit description=DNA -directed DNA polymerase
MNSLYGRFGINPQSTKTEMCNKSKRDRIFRRPEFIDDVFIREDLYMVSYLTNPGKGPSYWDPPKNSAVQLAAAITAGSRIYMYKYISREDCLYTDTDSIVLGNPLPEEDVSSSVLGKFKLEDKILEGFFLAPKCYSYTTEESDGNKKVYKYKGPGRNVITPEWYKEQYADPSQSLIKKVTYQFRPDWKELSVKKKESTTTLRTLSNSKRIPFFNEKGKY

SEQ ID NO: 227612 - protein, 242 aa, Glycine max
  Coding DNA Sequence Number=SeqID_110834
MASGKRKSIGSRPTAQYDTWRFRSLDAWNRYTNNVLGRNILPERKVELYHTEFDDFKTELERRNLHKCLTNLVDGSIDVALVKEFYANLYSSEGPSPKQARVRGHLVKIDVDSLNTFLETPVVLEEGETLPIYSRYCRLPSDPREIKATLCIPGRGFILNVEGHPGRILAQVWSVLSYSNLAATSHTSDLIMDRARLIFGLVSRMDMNIEALIFGQMTSIAQSNSSRLGFLALITTLCRARG

SEQ ID NO: 227613 - protein, 102 aa, Glycine max
  Coding DNA Sequence Number=SeqID_110835
  Subcellular localization annotation: CTP_CleavageSite=16; ConfidenceScore=5.19e-01
MKNLEGNLSRRHVLSVSSTRSASRLSPSRLSASLALSDYSLTHAKRKNGAKRNVEHLIIACLWLDHPCVCTVKGFSIERCIVSLELDRAGLGYRMSGHRAVI

SEQ ID NO: 227614 - protein, 127 aa, Glycine max
  Coding DNA Sequence Number=SeqID_110836
MASQPKQVRVRGHLIKFYADSLNTFLETLVVVEQRGILPSYSKFARLRLDPQELAARLCLPGRGFVLNVEGLSWKLLRKDLTTLAQTWSVLSYSNLAPTSHTSNLNLDRDKFHSLLNPTPRGLDFQP

SEQ ID NO: 227615 - protein, 90 aa, Glycine max
  Coding DNA Sequence Number=SeqID_110837
MRKLTKPPIISPKTPYPRNLREKEVHPNLNFRSPTRSHALHDPENALLSRFGAEMSTKGWSFVGVSMENGGEGKSNVRKRESCLKKMRAE

SEQ ID NO: 227616 - protein, 216 aa, Glycine max
  Coding DNA Sequence Number=SeqID_110838
  Gene Ontology: Mol. function=protein transporter activity; Cellular component=membrane; Biological process=protein secretion
  Homolog annotation: Hit_ID=Q1GY37; Match level="QueryCoverage=94%, HitCoverage=67%, E-value=8e-70, Identity=65%"; Hit description =Secretion protein HlyD
  Pfam annotation: Domain name=HlyD; Domain location=7-211; Score= -18.1; E_value=0.019; Accession=PF00529.10; Description=HlyD family secretion protein
MCCPHRPMHYQHALAEATALTQQRKSLWEMKKQQSARRAHLDDEVISRENREDTDLGAMAAKAEYEAAVAQVEKIKLDLERTVVRSPVDGWVSNLLVRPGDFAQVGAAKLAVIDQHSFWVYGYFEEHKLSMINVGDQAEIQLLGSHTKLKGHVESIAHGITDRDNPTDIRLLANVNPTFNWVRLAQRIPVRIHLDQIPAAMPLVAGMTCSVVIRHG

SEQ ID NO: 227617 - protein, 78 aa, Glycine max
  Coding DNA Sequence Number=SeqID_110839
MGLRIKVENGELANNARQSIRGAPDSLAINLRGSKLVGGGCMIDNQFMGLRIKVENGELANSARQSICGALDSLVEDA

SEQ ID NO: 227618 - protein, 61 aa, Glycine max
  Coding DNA Sequence Number=SeqID_110840
MVVDCGSGRHQKWMITMNNGDCHLKAGDEVIFFYNIDQHLWEVLYRKQVTWDDTEDEADSP

SEQ ID NO: 227619 - protein, 95 aa, Glycine max
  Coding DNA Sequence Number=SeqID_110841
  Subcellular localization annotation: CTP_CleavageSite=30; ConfidenceScore=5.00e-01
MHNRDSGGITLETSSTKTSVLADRPSSNFSANTEKNPKEKCKAIMTRSRMAIQADEGRAEEKVGGYKQQLTAEPALEPVSDFVELKEVVEDEDDQ

SEQ ID NO: 227620 - protein, 201 aa, Glycine max
  Coding DNA Sequence Number=SeqID_110842
  Gene Ontology: Mol. function=chitin binding; Cellular component =extracellular region; Biological process=chitin metabolic process
  Homolog annotation: Hit_ID=UPI000044A8F0; Match level="QueryCoverage =68%, HitCoverage=99%, E-value=5e-20, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDTSEPYIGAMKGTMREPQANLGVGPKFLTSNVQSCEFGMIDPLDESITCFLIRVDPWVLVLITLRGLHVLALRGLHVLAIRGIQVLALRGLHVLAFRGLHVLDFRGLHVLTLRGLHALAIRGLHALTFRGLHAHRLQRAAHPCLQRATCPHLQRATRPRLQRTPRPRLQRTARPRLQRSARPCFQRATCPYLQRDTRPRL

SEQ ID NO: 227621 - protein, 279 aa, Glycine max
  Coding DNA Sequence Number=SeqID_110843
  Gene Ontology: Mol. function=chitin binding; Cellular component =extracellular region; Biological process=chitin metabolic process
  Homolog annotation: Hit_ID=UPI000044A8F0; Match level="QueryCoverage =90%, HitCoverage=99%, E-value=5e-36, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
FRGLHVLTSRGLHVLAFKGLRVHAYIKLHVLAYRGLHILTFRALHALTYRGLHAVTFRGLHVLAFRGLHRLHVLAFRKLHVLAFRGLHALAFRGLHILAIRGPYILAFRGLHSLTLRGLHALSFRGLHVLAIRGPHLLTFRGLHALAFRGLHVLSFRGLHTLAFRRLHVFTFRGIHVLAFRGLHVRTFRGLHALAMRGLHSLTFRGLHTLAFRGLHVLTFRGLHVLAFRRVHALAFRGLYALAFRGLHVLAFRGLQPSPLESYMPLPLENYTPSLAEDY

SEQ ID NO: 227622 - protein, 145 aa, Glycine max
  Coding DNA Sequence Number=SeqID_110844
  Gene Ontology: Mol. function=electron carrier activity; Cellular component=extracellular region; Biological process=response to biotic stimulus
  Homolog annotation: Hit_ID=Q1RSY2; Match level="QueryCoverage=98%, HitCoverage=100%, E-value=1e-39, Identity=50%"; Hit description =Allergen V5/Tpx-1 related
  Pfam annotation: Domain name=SCP; Domain location=33-141; Score=53.1; E_value=9.5e-13; Accession=PF00188.16; Description=SCP-like extracellular protein
MMSPCNVILSIFFLVCTRTPLLSLAQNTPQDFLDVHNQARAEVGVGPLSWNHTLQAYAQSYANKRIPDCNLEHSMGPFGENISEGYAEMKGSDAVKFWLTEKPYYDHHSNACVHDECLHYTQIVWRDSVHLGYSPPGNIEGERPY

SEQ ID NO: 227623 - protein, 78 aa, Glycine max
  Coding DNA Sequence Number=SeqID_110845
MTRLELLALNGYDSGVIDILIRSLCNIGWCIVGRQAIWWEGMLALDLHEMGATRTPQCFASLAYHIRDWTIYLIEARW

SEQ ID NO: 227624 - protein, 78 aa, Glycine max
  Coding DNA Sequence Number=SeqID_110846
  Homolog annotation: Hit_ID=UPI00006A2901; Match level="QueryCoverage =40%, HitCoverage=20%, E-value=2e-10, Identity=96%"; Hit description =UPI00006A2901 related cluster
  Subcellular localization annotation: CTP_CleavageSite=11; ConfidenceScore=5.40e-01
PNPSTVKKTARAASAARAGRRVPVGGQIGNGPFGASSPGVEQSTQNCALNVKVKKFNQARVNGGSNYDSLKVAKCLVI

SEQ ID NO: 227625 - protein, 48 aa, Glycine max
  Coding DNA Sequence Number=SeqID_110847
MELGRRGNGGLLNPSQDEEQKVSFLKNFIVPLAQASNQLAWANEVTLA

SEQ ID NO: 227626 - protein, 189 aa, Glycine max
  Coding DNA Sequence Number=SeqID_110848
  Homolog annotation: Hit_ID=Q1SKD7; Match level="QueryCoverage=54%, HitCoverage=26%, E-value=4e-07, Identity=31%"; Hit description =Ankyrin
MASKKLPAKRSRKDAAGEGSNAAPQVDMNSDGHRFWSEEHQRRFEAIKGWSFLKERRVRLRDEEYAEFQEEIVRRQWAQLVSPMAKYDPEIVMEFYANAWPTEDGEELGLGLRRGGHQPVVVRSGAGLCPKRRGETAGLHHPDSGITPSRHPVDPKKSNRALGFPALIMGLCQFYGVPITPTKLIRPPI

SEQ ID NO: 227627 - protein, 72 aa, Glycine max
  Coding DNA Sequence Number=SeqID_110849
MAISRKQTHSVFVLCPYFRNLMGGTKGTTSDNISLKRKTLDEASLSLSESEIQHDHRSTSTSYVSMDPGIGP

SEQ ID NO: 227628 - protein, 299 aa, Glycine max
  Coding DNA Sequence Number=SeqID_110850
  Gene Ontology: Mol. function=RNA-directed DNA polymerase activity; Biological process=RNA-dependent DNA replication
VNVEGCWIHEPGRVKEETRLFFKRRFQEPERERLRLDGVRFKSIDQQHNALLVARFKEDEVRAAIRNCDTLIPKVNDPQGLNDYRPISLIGCINKIVAKVLSNRLKKVLPCIIDEHQSTFMEGRQLLHSVVVASKAVEEAKRRNKSCLVFKVDYEKAYDSRGLRQGDPLTPFLFNIVAEGLPSLMREAQEQKPYEGIKIGKDEADISLLQYGPKERGHQIGEAATMGGIEWKIGSGTKVKLWEDAWLTDGKSLAEKYSRIYSISQQQQNSIQQMGIATAGGWEWLDPCGVTQWEVLTKS

SEQ ID NO: 227629 - protein, 527 aa, Glycine max
  Coding DNA Sequence Number=SeqID_110851
  Gene Ontology: Mol. function=DNA-directed RNA polymerase activity; Cellular component=mitochondrion; Biological process=transcription
  Homolog annotation: Hit_ID=Q8L6J5; Match level="QueryCoverage=76%, HitCoverage=40%, E-value=1e-142, Identity=62%"; Hit description=DNA -directed RNA polymerase 1B, mitochondrial precursor
  Subcellular localization annotation: CTP_CleavageSite=55; ConfidenceScore=5.70e-01
MWTNLAKRASSTLRNNFRVSSLSPRFCKPQTCKTFQGFPEVGVSQSKFVFHEGFSCSSSWSWSWMVLGRGHASVAEAIESTDTEDDYDEVQKLLEEMAKAEHKVDSSSYKYKLLKRRQIESETEAWAEAAREYGELLEDMRDKKLAPNLPYMKSLFLGWFEPLRNAILADQDLCKDSKCRMSHAPYFNDLPADMMAVVTMHKLMALLMTNANGVGTARVIQAACQIGEAVENEARIYQFMKREKENKSSHLAPVEQSGKLTEENGEMEQKQSRLRKRVAGLMKKQKKLQAMGIIGRQDDWKTWGQEAQVKVGSRLMQLLIETAYIQPPTNQIGDGPPDIHPAFRHTLRTLSNESQRETRRYGVIECDPLVQNGLEKSARHMVIPYMPMLVPPINWTGYDKGAYLFLPSYVMRVHGAKQQREAVKRAPKSQLDPVFEALNTLGNTKWRVNKRVLCVIDQIWANGGRLADLVDRENTWKVSVVHRFLDIRQLQEPSQTFFRDFFCESRAHFRSGTLIPYEKIREFSECA

SEQ ID NO: 227630 - protein, 212 aa, Glycine max
  Coding DNA Sequence Number=SeqID_110852
  Gene Ontology: Mol. function=nucleoside-triphosphatase activity; Cellular component=membrane; Biological process=defense response
  Homolog annotation: Hit_ID=Q7WDY9; Match level="QueryCoverage=98%, HitCoverage=94%, E-value=4e-96, Identity=71%"; Hit description =Probable ATP-binding ABC transporter protein
  Pfam annotation: Domain name=ABC_tran; Domain location=45-171; Score =81.6; E_value=2.5e-21; Accession=PF00005.17; Description=ABC transporter
MSAVSLENVSKIYSPRRSGWSKLTGRASGAGFQALNDVSLNIEHGEFFGLLGPNGAGKTTLISILAGLAHATSGRATVCGYDVVADYKSARRALGVVPQELVYDPFFTALVHRPPVIVLDEPTAGVDVDLRRTLWEFISRLNKAGHTIMLTTHYLEEAEALCGRIAMLKGGRIVALDTTQALLARVGGVDLEDAFVRIMHQDDALQPEEISQ

SEQ ID NO: 227631 - protein, 412 aa, Glycine max
  Coding DNA Sequence Number=SeqID_110853
MCRKGIESGLSMFHTLEKWSPSLRAGFKLVWVMCWGIPLHAWDPETITKIVQGIGEVMDVDEDVGELHRLDRAEISCGSHSCNCNRGDYKESSEEISSEWSDLGFNIQSEEDQEDGKTPASNNVSDAEGDARAMDCGMQLLSAGYYPHSATTVDTTEQQEGDKENSRKQNMAAESNHIGEAGIGLKEVVMWEGNSKDKKATTSTISASTSRSWNDSRNTDQHGGKGPEHKSEEGKQRSDATFKMEKKVTGNGYIYLEGTWAGDGGKVTIINIYSPNFNCIRRQSERVGVCERSQNGGSMKEFNDWIIDLDVDDVPSVGRKFTWKIKNYKGNYKRSYGGQQDQFYPRSRWIIVVNSGPAAIAAEHGGAVRVAEIAAAIAAGRSGAAPIRDGHVCSDTVSGRGRYRGGAWRSGA

SEQ ID NO: 227632 - protein, 225 aa, Glycine max
  Coding DNA Sequence Number=SeqID_110854
  Homolog annotation: Hit_ID=Q84LK6; Match level="QueryCoverage=45%, HitCoverage=10%, E-value=1e-49, Identity=89%"; Hit description=RpoT1
  Pfam annotation: Domain name=RNA_pol; Domain location=1-197; Score= -138.8; E_value=1.5e-05; Accession=PF00940.10; Description=DNA -dependent RNA polymerase
MDIVGGNFLGLSPHIIAAELRGHEKFTEKVTNRGLGRCQIVADEWEYQKVAHAPVKKRHVAMDNGGLGGVLVVRGRQLWGCGRVGVMVKRQRTAFPPNFVHSLDGSHMMMTAVACKKAGLNFAGVHDSYWTHACDVDEMNRILREKFVELYDAPILENLLESFQKTFPALNFPPLPERGDFDLQEVLGPIAWNLYIYMYIYMHGIVKAPTMEKKEVCEARTGLPN

SEQ ID NO: 227633 - protein, 73 aa, Glycine max
  Coding DNA Sequence Number=SeqID_110855
MILLILKKLIFNAVTKEFGHGKIVLVQFPLFLFFLILPHHQFAALIFLKLGAAAVNLVGGDQPADVYSGIAAR

SEQ ID NO: 227634 - protein, 551 aa, Glycine max
  Coding DNA Sequence Number=SeqID_110856
  Gene Ontology: Mol. function=galactose oxidase activity; Biological process=cell wall catabolic process
  Homolog annotation: Hit_ID=Q10NU0; Match level="QueryCoverage=95%, HitCoverage=94%, E-value=1e-179, Identity=59%"; Hit description =Glyoxal oxidase, putative, expressed
  Pfam annotation: Domain name=DUF1929; Domain location=439-550; Score =105.2; E_value=2e-28; Accession=PF09118.1; Description=Domain of unknown function (DUF1929)
  Pfam annotation: Domain name=Glyoxal_oxid_N; Domain location=40-284; Score=509.3; E_value=4.2e-150; Accession=PF07250.2; Description =Glyoxal oxidase N-terminus
  Pfam module annotation: Pfam domain module=DUF1929::Glyoxal_oxid_N; Domain location=439-550::40-284
MTTKTTSLLLLHVILLATAEAAAAGGHWKVLQQSIGIVAMHMQLLHTDTVVIFDRTDFGLSNLSLPDGLCRHDAAEMAVKTDCTAHSLEYDVSSNTFRPLFLQTNVWCSSASVASDGTLIQTGGFNDGEKKVRTFSPCPTTAATCDWLELPSDTLSARRWYSTNHLLPDGRQIIIGGRRQFNYEFFPKTHTRAKNAYSLPFLVQTNDPHEENNLYPFVFLNVDSTLFIFANNRAILFDFTKNAVVRTFPTVPHGDPRCYPSTGSAVLLPLRNPYSEAEVLVCGGAPRGSYNEAKKGNFLGALNTCARIKITDPDPKWVIETMPKARVMGDMILLPNGNVLIINGAGSGSAGWEFARDPVLNPVVYNPDKSTGSRFEILVESNTPRMYHSTAILLRDGRVLVAGSNPHIGYNFSNVMFPTELSVEAFYPPYLESGYDDVRPRIVFPESEARTKVTYGEKVKVRVQVAGGSLVRSLVRVTVSAPPFNTHSFSMNQRMLVLEPINVTNIVGGPTPTYEIEVTTPGSPVLAPPGYYLLFVVHQEIPSQGIWIQIL

SEQ ID NO: 227635 - protein, 559 aa, Glycine max
  Coding DNA Sequence Number=SeqID_110857
  Gene Ontology: Mol. function=protein dimerization activity; Cellular component=nucleus; Biological process=regulation of transcription, DNA-dependent
  Homolog annotation: Hit_ID=Q0GPE5; Match level="QueryCoverage=96%, HitCoverage=99%, E-value=1e-134, Identity=55%"; Hit description=BZIP transcription factor bZIP11
  Pfam annotation: Domain name=bZIP_1; Domain location=399-463; Score =35.8; E_value=1.5e-07; Accession=PF00170.11; Description=bZIP transcription factor
  Pfam annotation: Domain name=bZIP_2; Domain location=399-453; Score =19.9; E_value=0.0072; Accession=PF07716.5; Description=Basic region leucine zipper
  Pfam module annotation: Pfam domain module=bZIP_1::bZIP_2; Domain location=399-463::399-453
  Subcellular localization annotation: CTP_CleavageSite=42; ConfidenceScore=5.45e-01
MEGVDQSNMNRNSCVFGSSSSSSSGGALRPPNRLNSNVMLINQMGVTENQKPYGIPPSHPNTNISPSSAYPQFFASQSQSNSVSQRLSSPNLSPASSHSRSLSQPSFFSLDSLPPLSPSPYKEPSFSDSISTDVSAEESLANSHAPLPNRGHALQLGHSLPPRKGHRRSSSDSPLGIADFIQSVPQSVSSKTWSDRENLASRGGNSGFEKPIQLVLKEPMKDMDCVDGFGGEPMVGRKEDDALDDLFSAYMNLDNIDGLNFSGMEDKDLDSRTSGSKTVESSDNEVESHAYGKVIGAQGAISRCSEERREGVKRSSNGDVAPGSRHRRSFSLDSSIGNFHIGDELPKLPPSQNRFGQHSPSSSIDGKTSETSMEFGNGEFSSEELKKIKENDKLAEIAMADPKRAKRILANRLSAARSKERKMRYISELELKVQTLQTETTTLSTQFTKLQMNNSELKSENNEYKLRIQALEQQSQLKDALNETLDAEVRRLRCTVAELGGESLLSSRMAQQLAISQQVFQLKEQQHPNQLRHVQVHNTHSQEQTQTQSQRHNGKATAY

SEQ ID NO: 227636 - protein, 1080 aa, Glycine max
  Coding DNA Sequence Number=SeqID_110858
  Gene Ontology: Mol. function=ATP-dependent helicase activity; Cellular component=nucleus; Biological process=mRNA processing
  Homolog annotation: Hit_ID=Q38953; Match level="QueryCoverage=98%, HitCoverage=88%, E-value=0.0, Identity=80%"; Hit description =Probable pre-mRNA-splicing factor ATP-dependent RNA helicase
  Pfam annotation: Domain name=DEAD; Domain location=553-710; Score= -13.0; E_value=7.1e-05; Accession=PF00270.19; Description=DEADDEAH box helicase
  Pfam annotation: Domain name=HA2; Domain location=941-1031; Score =119.4; E_value=1e-32; Accession=PF04408.13; Description=Helicase associated domain (HA2)
  Pfam annotation: Domain name=Helicase_C; Domain location=786-880; Score=54.8; E_value=2.8e-13; Accession=PF00271.21; Description =Helicase conserved C-terminal domain
  Pfam annotation: Domain name=S1; Domain location=247-320; Score=57.8; E_value=3.6e-14; Accession=PF00575.13; Description=S1 RNA binding domain
  Pfam module annotation: Pfam domain module=DEAD::HA2::Helicase_C::S1; Domain location=553-710::941-1031::786-880::247-320
MAVDNPEDGLKKLEYLSLVSKVCTELESHTGTGDKVLAEFITELGRSSENVEEFDAKLKENGAEMPDYFVRTLLTIIHAILPPKSKDSKKEKDSVSGKTTKFKALAIADNRDRAKELQKELESEAREKQKPEIEEDDGYRDRRDRRRDRYGRNRDEEDVRRDYSRRGRDRDDEDDRRDYGRRGRDRDDEDDRRDHGRRGRDKHDRDRDRDRDRYERHRRDEHQEDGHGRENGDEDGNRKGSRHGSGELELYAVYKGRISRVMETGCFVQLDDFRGKEGLVHVSQMATRRITNAKDVVKRDQEVYVKVISVSGQKLSLSMRDVDQHTGKDLLPLKKSSEDDAMRMNPQDSKGGPAARTGLSGIRIVEEDDAGSSRRPLKRMSSPERWEAKQLIASGVLSVSEYPTYDDEGDGLLYQEEGAEEELEIELNEDEPAFLQGQSRYSMDMSPVKIFKNPEGSLGRAAALQSALIKERREVREQQQRTMLDSIPKDLNRPWEDPMPESGERHLAQELRGVGLSAYDMPEWKKDAYGKTITFGQRSKLSIQEQRQSLPIYKLKKELIQAVHDNQVLVVIGETGSGKTTQVTQYLAEAGYTTRGKIGCTQPRRVAAMSVAKRVAEEFGCRLGEEVGYAIRFEDCTGPDTVIKYMTDGMLLREILVDENLSQYSVIMLDEAHERTIHTDVLFGLLKQLVKRRPELRLIVTSATLDAEKFSGYFFNCNIFTIPGRTFPVEILYTKQPESDYLDAALITVLQIHLTEPEGDILLFLTGQEEIDFACQSLYERMKGLGKNVPELIILPVYSALPSEMQSRIFDPAPPGKRKVVVATNIAEASLTIDGIFYVIDPGFAKQNVYNPKQGLDSLVITPISQASAKQRAGRAGRTGPGKCYRLYTESAYRNEMSPTTIPEIQRINLGMTTLNMKAMGINDLLSFDFMDPPSPQALISAMEQLYSLGALDEEGLLTKLGRKMAEFPLDPPLSKMLLASVDLGCSDEILTIIAMIQTGNIFYRPREKQAQADQKRAKFFQPEGDHLTLLAVYEAWKAKNFSGPWCFENFVQSRSLRRAQDVRKQLLTIMDKYDIYLFF

SEQ ID NO: 227637 - protein, 58 aa, Glycine max
  Coding DNA Sequence Number=SeqID_110859
  Homolog annotation: Hit_ID=Q5NT78; Match level="QueryCoverage=81%, HitCoverage=5%, E-value=3e-12, Identity=68%"; Hit description =Potassium channel TORK1
MSCCLGSNNEHFILESKKADLALKVNSASFNGDMYQLRGLIRAGVDPNKEDYDGRSPL

SEQ ID NO: 227638 - protein, 111 aa, Glycine max
  Coding DNA Sequence Number=SeqID_110860
MWRLCLITYMFIKAPNLIAEPRKGRVERTEVKKTFWKGCRTQLGEGAGSNSRLTYDPHEIYLLASTSYSLLPKFTSQAQFAAKKLVLAYWAMELGCLIITPEIFTRLKALI

SEQ ID NO: 227639 - protein, 50 aa, Glycine max
  Coding DNA Sequence Number=SeqID_110861
MAWNHQGSGGVSSSYPSAAAAGSSGSGSWAAEAPPPLEGEGWAPGQATCA

SEQ ID NO: 227640 - protein, 163 aa, Glycine max
  Coding DNA Sequence Number=SeqID_110862
  Gene Ontology: Mol. function=protein dimerization activity; Cellular component=nucleus; Biological process=regulation of transcription, DNA-dependent
  Homolog annotation: Hit_ID=Q8GT89; Match level="QueryCoverage=100%, HitCoverage=17%, E-value=9e-72, Identity=79%"; Hit description =Hypothetical transcription factor
MASVEEKIKTGGGMIVGGQTLAAEMKLLKEMQEHSGVRKTLNSELWHACAGPLVSLPQVGSLVFYFPQGHSEQVAASTRRTATSQIPNYPNLPYQLLCQVQNVTLHADKETDEIYAQMTLQPLNSEREVFPISDFGHKHSKHPSEFFCKTLTASDTSTHGGFS

SEQ ID NO: 227641 - protein, 145 aa, Glycine max
  Coding DNA Sequence Number=SeqID_110863
  Gene Ontology: Mol. function=sequence-specific DNA binding; Cellular component=nucleus; Biological process=regulation of transcription, DNA-dependent
  Homolog annotation: Hit_ID=Q533S8; Match level="QueryCoverage=45%, HitCoverage=27%, E-value=9e-28, Identity=94%"; Hit description=MADS box protein AP1a
  Pfam annotation: Domain name=SRF-TF; Domain location=9-59; Score =120.0; E_value=6.5e-33; Accession=PF00319.9; Description=SRF-type transcription factor (DNA-binding and dimerisation domain)
MGRGRVQLKRIENKINRQVTFSKRRAGLLKKAHEISVLCDAEVALIVFSHKGKLFEYATDSWCDSILLLVKLIFESRPQSMSWFINTYLHIARCHAHFEAQVLSRPFTYHSLEARMLHPFLFNRGLVCLSLSAADGCSFLDERCT

SEQ ID NO: 227642 - protein, 174 aa, Glycine max
  Coding DNA Sequence Number=SeqID_110864
  Gene Ontology: Mol. function=sequence-specific DNA binding; Cellular component=nucleus; Biological process=regulation of transcription, DNA-dependent
  Homolog annotation: Hit_ID=Q533S8; Match level="QueryCoverage=99%, HitCoverage=74%, E-value=1e-67, Identity=76%"; Hit description=MADS box protein AP1a
  Pfam annotation: Domain name=K-box; Domain location=13-112; Score =166.1; E_value=9.1e-47; Accession=PF01486.8; Description=K-box region
MEKILERYERYAYAERQLVANDSESQGNWTIEYTRLKAKIDLLQRNHRHYMGEDLGSMSLKELQSLEQQLDTALKQIRTRRNQLMYESISELQKKEKVIQEQNNMLAKKIKEKEKVAAQQAQWEHPNHGVNASFLLPQPLLNMGGNYREEASEVGRNELDLTLEPLYSCHLGCF

SEQ ID NO: 227643 - protein, 76 aa, Glycine max
  Coding DNA Sequence Number=SeqID_110865
  Homolog annotation: Hit_ID=P56777; Match level="QueryCoverage=43%, HitCoverage=6%, E-value=5e-07, Identity=94%"; Hit description =Photosystem II P680 chlorophyll A apoprotein
MVLELLFRDVFAGIDPDLDAQVEFGAFPKTWRSNYKKTVMSPQYGGLITSTSPHVLQMDLLVVARVAQRQYIRHTQ

SEQ ID NO: 227644 - protein, 81 aa, Glycine max
  Coding DNA Sequence Number=SeqID_110866
MLQNFTDCALTLPFDSRHVTELHGLPNDGCQVPRSGQAKVASHQTDGHRTKLEYDKRHVMIVLTSFSLWVDELCRVEWHDR

SEQ ID NO: 227645 - protein, 94 aa, Glycine max
  Coding DNA Sequence Number=SeqID_110867
MSPQALETSQSLKVSSNAPQDSFLFKLIMLAQPGGSSGALSELILAEHIIDNSSASRIFHALSHDLLRSADGSPRQRIGLASGSKSALPPNLPN

SEQ ID NO: 227646 - protein, 145 aa, Glycine max
  Coding DNA Sequence Number=SeqID_110868
MVVEYRGVHVRPSVGDLREEKYHSEGYIYLKIICDYAQNAVETTFLATAICKCGGNEEKGKTLYNAYRLNGQRLSVCMTTWTMCRNLPISGKATRGLMGASSKGRRRTESPQMFIQGKHRENQNVWSMNFKCERFGSCFYAQGRY

SEQ ID NO: 227647 - protein, 293 aa, Glycine max
  Coding DNA Sequence Number=SeqID_110869
  Gene Ontology: Mol. function=protein serine/threonine kinase activity; Cellular component=membrane; Biological process=protein amino acid phosphorylation
  Homolog annotation: Hit_ID=Q1SH45; Match level="QueryCoverage=68%, HitCoverage=45%, E-value=1e-60, Identity=54%"; Hit description =Protein kinase
  Pfam annotation: Domain name=DUF26; Domain location=124-178; Score =36.1; E_value=1.2e-07; Accession=PF01657.8; Description=Domain of unknown function DUF26
  Pfam annotation: Domain name=DUF26; Domain location=225-279; Score =52.5; E_value=1.4e-12; Accession=PF01657.8; Description=Domain of unknown function DUF26
  Pfam module annotation: Pfam domain module=DUF26::DUF26; Domain location=124-178::225-279
MVISLCLPIVLTSHEVEDILTQGLIRPYFEFIIKLSKTRVLHDGNTTKHVRSICYAFLLLLSFRPLITKAQTPIYAGSYCQNTTQPPLSSAYQTNLNRIVTWMSSDAATSKGYNYTSIGNNSPAYGLYDCHSDVVGYFCQLCVSTAAREVRLRCPNRISAVVWYDSCILRHTQHGITYFGTKNISNMEEIQKGEDFVRSLIRKATVETNQLYYMEGFNVSSSQRRYGWVQCSRDLSNEGCRQCLEAMLAEYPKCCEQKLGWMVWCQSCLIRYEDHIFYQLNQKVAPSVGTGSR

SEQ ID NO: 227648 - protein, 194 aa, Glycine max
  Coding DNA Sequence Number=SeqID_110870
  Gene Ontology: Mol. function=helicase activity
  Homolog annotation: Hit_ID=Q9LTU4; Match level="QueryCoverage=63%, HitCoverage=8%, E-value=1e-19, Identity=44%"; Hit description =Helicase-like protein
MALADVINTQQTAMTSQVDRGKLSTISAGYVDLRNASETCAYYQATMWKNILYSQLFSKIKEMLDEYSMFAKSFRLTEERYDNYQIKNLNLQLIADRKKNGRIYNLPTVSKVVAIIVDDVSQPISRDIILEKQSGRLQRINELHPSYLGLKHPLMFPCGEDGYCSDINHRDLDDSHQRKRNRLTNIAPCGAFRP

SEQ ID NO: 227649 - protein, 84 aa, Glycine max
  Coding DNA Sequence Number=SeqID_110871
  Subcellular localization annotation: CTP_CleavageSite=67; ConfidenceScore=5.33e-01
MDSINKSTKWRCAKEKTSSKPQNPNIVGQGGARRCEHPYSPPTLKSSTTTTTGVGVTTSETTRSMVRETARAAVRDTGRVTRRD

SEQ ID NO: 227650 - protein, 167 aa, Glycine max
  Coding DNA Sequence Number=SeqID_110872
MWLIRYCVNSLTRSGSTIWTISWVANQSASRRDGGSDEDPEVAKFKEQAYAPSEDSRQYEEFNTRTEETNDNIDYNTDMEVNEPEIDTTTQNTSSAKENGQRKRGVSAQDPTSITACVAKLKDLPGLERGSELFYKATKLMKKRANKITFVALEEPELQLGWIKSET

SEQ ID NO: 227651 - protein, 242 aa, Glycine max
  Coding DNA Sequence Number=SeqID_110873
  Gene Ontology: Mol. function=pyridoxal phosphate binding
  Homolog annotation: Hit_ID=Q9FGL6; Match level="QueryCoverage=95%, HitCoverage=67%, E-value=2e-35, Identity=52%"; Hit description =Arabidopsis thaliana genomic DNA, chromosome 5, P1 clone:MJM18
MRRRIMKFLNISDNDYFMVFTTNRTSAFKLVADSYPFQSSKKLLTVYDYENEAVEAMISCSEKRGAKAHSSTCKTKRRCLDQVDSLGLIMITNRRRYLINWLVNSMMKLKHPNAEGGPALAFNVFDWKGEKVEPVLVQKLADRNNISLSYGFLHHVWFADKYAEDKGKVLQTKEGRVQGVTTNKKKDRDELGVTMVTAALSFLANFEDVYKLWTFVARFLDADFVEKERWRFTTLNQKTIEV

SEQ ID NO: 227652 - protein, 1905 aa, Glycine max
  Coding DNA Sequence Number=SeqID_110874
  Gene Ontology: Mol. function=oxidoreductase activity; Biological process=electron transport
  Homolog annotation: Hit_ID=Q336Y0; Match level="QueryCoverage=72%, HitCoverage=75%, E-value=0.0, Identity=51%"; Hit description=Amine oxidase, flavin-containing family protein, expressed
  Pfam annotation: Domain name=Amino_oxidase; Domain location=833-1304; Score=340.0; E_value=4.1e-99; Accession=PF01593.14; Description =Flavin containing amine oxidoreductase
  Pfam annotation: Domain name=DAO; Domain location=825-1284; Score= -20.8; E_value=0.00012; Accession=PF01266.14; Description=FAD dependent oxidoreductase
  Pfam annotation: Domain name=Pyr_redox; Domain location=825-904; Score=-2.5; E_value=0.024; Accession=PF00070.17; Description =Pyridine nucleotide-disulphide oxidor
  Pfam annotation: Domain name=SWIRM; Domain location=582-673; Score =66.6; E_value=8e-17; Accession=PF04433.7; Description=SWIRM domain
  Pfam annotation: Domain name=Shikimate_DH; Domain location=800-925; Score=-27.4; E_value=0.081; Accession=PF01488.10; Description =Shikimate  quinate 5-dehydrogenase
  Pfam annotation: Domain name=Thi4; Domain location=794-958; Score= -121.8; E_value=0.0042; Accession=PF01946.7; Description=Thi4 family
  Pfam module annotation: Pfam domain module=Amino_oxidase::DAO::Pyr _redox::SWIRM::Shikimate_DH::Thi4; Domain location=833-1304::825 -1284::825-904::582-673::800-925::794-958
MDGEDIRSGTKKKRSKKEIGFDDDDEPIGSIFKLKRSKKKGSGGSSDAAVVREKEDLGGMDDNDTLASFRKRLKGPKRDQGSGVTRGASPALHVSDEDLVALGPKGKDEKVVVPVPGDEDMQMQGCSDQQHMEDSLSAIFNKAQFSSTRKSRGRGSRQKRGIQNVDSEGFVETVDSVVGSRSGSAFGSKLVGGNVESADALPQASEPVVASVVDDQKCGDDCFQEEAVKGNRNLDIPDGPSQSSNVCHGYRQQLSCVQVGDISCHSDQKVGLQESVLSDGLNKLPTTSHDVSLSKVGEGKRGFTEIGESENRLTDEQAKVCNSASEPDVSTSAGEKNVLTSCHTEPLIKSTENILNENNNMVARKVFQESSCNGALKLSGCHMEVDGGGKSETEIVSDRNFCDYSSSDTKAEVQDFVLGFSPKTNNVTVSGSLSSMVSNEANKAELTAHSNHPEKPLEACNIPKDYTASILKCSSVLDPIQSDGSSLQSSIPDENGNSAEYCAPASDFADNEGKISSIPRAVRKAKMRKHGDMTYEGDADWEILIDDQALNESQVMTDGDRTLRARLKHDSSLNTGEDSENVAVVAVSAGLKARKVGPIEKIKFKEILKRKGGLKEYLDCRNQILSLWNRDVTRILPLAECGVSDTHSEHGSPRFSLIREVYAFLDQYGYINVGIASQKENVGSSARHCYRLVKEKGFEESLAASMADPEDGVSFLVGQTKMSDTSNEINNGLTKDCDDLTTEAAEGMRHANEMKTDLSNMTHQAERKKIDYQENDSSVPSSNFPDCRLTSQVAEEKINDSTSIKSALDALVGDHLQSDLDPRKRVIVIGAGPAGLTAARHLQRQGFAVTVLEARSRIGGRVFTDHSSLSVPVDLGASIITGVEADVATERRPDPSSLICAQLGLELTVLNSDCPLYDIVTGQKVPADMDEALEAEYNSLIDDMVLVVAQKGEQAMRMSLEDGLEYALKIRRMARSESSEETEQNNSADSPFDSKKDSTVEKKFGEEILSPQERRVMDWHFAHLEYGCAALLKDVSLPYWNQDDVYGGFGGAHCMIKGGYSSVAESLGEGLTIHLNHVVTNVSYGIKEPGQNNKVKVSTANGNEFFGDAVLVTVPLGCLKAETIQFSPPLPQWKCSSVQRLGYGVLNKVVLEFPSVFWDDAVDYFGATAEERSSRGHCFMFWNVRKTVGAPVLISLVVGKAAIDGQSLSSYDHVNHALKVLRKLFGEDSVPDPVAYVVTDWGRDPFSYGSYSYVAVGASGEDYDIIGRPVDNCLFFAGEATCKEHPDTVGGAMMSGLREAVRIIDILSSGNDYIAEVEALEAARGQLDTERDEVRDIIKRLDALELSNIMYKNSLDGAQILTREALLKEMFNNTKTTAGRLHVAKQLLTLPVGNLKSFAGSKEGLAILNSWILIRNFMIHISMQDSMGKDGTQLLRHCLRLLVRVSTDLLAVRLSGMGKTVKEKVCVHTSRDIRAIASQLVNVWLEVFRKEKASNGGLKISRQTTAVDLSKRKSVKDSASGKPPLSTYHGTIENKGGLLNPTSAGSNSASTAHVKKLHSKQGRQPAAYDSRHEVSSSRSKGSIDTVVAEKEDNLCTVSEEEQAAIAAAEAARAKALAAAEAYASAEARCNTLLQLPKIPSFHKFARREQTSQNDEYDSRKRWPGGVYGRQDCISEIDSRNCRVRDWSVDFSAACVNLDNSRMPVDNLSQRSHSNEIASHLNFREHSGESVAGDSSIYTKAWIDTAGGIAIKDHHAIERWQSQAAAADSYFSNPTIHLKDEEDSNACSKLPSWKHDGIANESSISQVTVSKEAQKGHSRGADHIKQAVVDYVASLLMPLYKARKLDKDGYKAIMKKSATKVMEQATDAEKAMAVREFLDFKRKNKIRSFVDVLIERHMTTKPDMKS

SEQ ID NO: 227653 - protein, 84 aa, Glycine max
  Coding DNA Sequence Number=SeqID_110875
  Subcellular localization annotation: CTP_CleavageSite=77; ConfidenceScore=5.47e-01
MWADGLSHLARPTVFGELAGLVPFQSLPFFTQTSLSPHSVFSRAQFAVAKAPSCLVRHLGVLHHRLIVEGFLSHRVVAHAAAVT

SEQ ID NO: 227654 - protein, 95 aa, Glycine max
  Coding DNA Sequence Number=SeqID_110876
  Gene Ontology: Mol. function=protein kinase activity; Biological process=protein amino acid phosphorylation
  Homolog annotation: Hit_ID=Q1S7R4; Match level="QueryCoverage=87%, HitCoverage=12%, E-value=6e-15, Identity=55%"; Hit description =Protein kinase
MKNLWLCFSYLFPAAIILVLLTPSAVAQLSPSEGRILFQVQKLLEYPQALEGWNRWTNLCFFPSSHSLKIVCSNGHVTELTIIGIICCIYFSYTN

SEQ ID NO: 227655 - protein, 49 aa, Glycine max
  Coding DNA Sequence Number=SeqID_110877
  Gene Ontology: Cellular component=cytoskeleton; Biological process =phagocytosis
  Homolog annotation: Hit_ID=O80516; Match level="QueryCoverage=62%, HitCoverage=11%, E-value=7e-09, Identity=80%"; Hit description =Expressed protein
MDALRALWSAAFPEEELHGLISEQWKDMGWQGLMWGEKSNKQQFSRNPL

SEQ ID NO: 227656 - protein, 143 aa, Glycine max
  Coding DNA Sequence Number=SeqID_110878
MDKSLKVGEDEWRERERRSMGFCASNKKTKTVIYKPVFELRKHYFDDVALVNTVVVGAALSRDWNNTLVTSKDLVARPSKSNNTLVTQLIVTHLSPFLGHHHSFVTPTYSGHRDSGHSFRGGAPLAYRDSGHPFPCVFAQTKP

SEQ ID NO: 227657 - protein, 73 aa, Glycine max
  Coding DNA Sequence Number=SeqID_110879
MCSEVKQFFYIAAKARNDVESAPYYIADVGPVVESAPYYISSDVDTDVENKFSNSLLMSSQYSKVILLHRWFG

SEQ ID NO: 227658 - protein, 198 aa, Glycine max
  Coding DNA Sequence Number=SeqID_110880
MTDKRKVLGKNNEETRSYFTWNLEMERILADVLRDQRNLGNKGDEGWKDNVKNRIKLLWRSWYGIVSDILGQSGFDWDGTKHMITVENENAWNEYCTSHKSAKPFRFKVLQNWDDIVDLCAKDRATGHGAETAMDADEAMSRETNEVEFMGLGATAIDLEEPSSNTKEKRQGSTSSGTHPHKRKMKDGRKRRNNSFFG

SEQ ID NO: 227659 - protein, 51 aa, Glycine max
  Coding DNA Sequence Number=SeqID_110881
MGSKIYPKVHENPRTFFSSSSSIILESLAHDSGHSSSNTFWLMRSDVRITQ

SEQ ID NO: 227660 - protein, 163 aa, Glycine max
  Coding DNA Sequence Number=SeqID_110882
  Subcellular localization annotation: CTP_CleavageSite=61; ConfidenceScore=5.55e-01
MSTLLGGFFHRLPTNLSGHKVMNMKCSVTSGLKFLIWTTRRPNLSINLQSDSSSSCCRLARAAKVGSIEVIQAEEHIQVFIQVGGPVIMFQVERFPTKRVQFTLGVLVNCVAEGRFLPWLHSGHQMYFLKFGADLTSGLSAVIIHSSDSLDGGLAGILHLMLN

SEQ ID NO: 227661 - protein, 89 aa, Glycine max
  Coding DNA Sequence Number=SeqID_110883
MSLLLLLPHHILFLHLLLVSISLLVAKEEKVKATDDSLSEAVWLSEASSSFSGWETLEEDKLEICAPSAQPARLVRMLSLLTLSAPKLT

SEQ ID NO: 227662 - protein, 299 aa, Glycine max
  Coding DNA Sequence Number=SeqID_110884
  Gene Ontology: Mol. function=RNA-directed DNA polymerase activity; Biological process=RNA-dependent DNA replication
MMFDRLDKSVRKEKLALGSTHTSRTRDKNRTHVSLFQGEQGITYKGVTSNPNKSKKMNPLNRLKKRHLHAIKDLDVNYVNIQSLRSLPPIAFTNRDFKGINPINQDNHMVVSIVIANFMVSKVPIYQGSYPGKRVETRGYMDLMTTFCLGKLSWSFTIRYLVVDANTSYFALIGRKTLNELEAIVSTPHLKMKIPTLIGEIVTIKVGQKQAQQCYAVSLKVASYPPIRESSKPHSPFGGSNSQVMSIVEEFPIRTLTLYKTTRGNPDDTFDVDPGDDTIDKGLKPIEDIFMLQLGPKPG

SEQ ID NO: 227663 - protein, 99 aa, Glycine max
  Coding DNA Sequence Number=SeqID_110885
  Homolog annotation: Hit_ID=Q9AUE0; Match level="QueryCoverage=45%, HitCoverage=2%, E-value=2e-09, Identity=62%"; Hit description =Callose synthase 1 catalytic subunit
MKSFTSCLQNWLIGTISKKAFIGPSQKLTDFDMASYSFPSSERFCLMPMSYLENKEEDKDSIVIFLLDMLEIVSKDIMDEDIEGLLDSSHGGSYGKDER

SEQ ID NO: 227664 - protein, 73 aa, Glycine max
  Coding DNA Sequence Number=SeqID_110886
  Subcellular localization annotation: CTP_CleavageSite=31; ConfidenceScore=5.40e-01
MSPPPLGPHSHSQTYLKLSGRLPFQALIRPRAQPRSVVLSGWLAKPVDWLSERLKISTSQTRPINLKLRENDY

SEQ ID NO: 227665 - protein, 331 aa, Glycine max
  Coding DNA Sequence Number=SeqID_110887
  Homolog annotation: Hit_ID=Q1STP5; Match level="QueryCoverage=65%, HitCoverage=35%, E-value=8e-16, Identity=31%"; Hit description=IMP dehydrogenase/GMP reductase
  Pfam annotation: Domain name=DUF1723; Domain location=30-79; Score =35.3; E_value=2.1e-07; Accession=PF08330.1; Description=Protein of unknown function (DUF1723)
MTKFMRPTLEIEGLVAESGLSPLIACSLDTGDRGLMFAFVECWYKETSSFHLSVRELTITLDDMASLLHLPIIEVFHNFEQLHVDDTIDMLVELLKSGTYAWGAATLVHMYDNLNVASKSTMRQLAGYMTLLQCWIYDHFLSIGFALAIKDYDERRPRACRWASGKALLVLTYRRHLDRLAPDVVCRIPYGDHHSFRKFEFGYIQTIPPHPIAPSTSLEEMDARWMQFSDYIAPVWQICVVPNHCLLDYIEWFYMISHSFMTPAQPADPPRVTLVQQYDTFVEPNVHQQSVATAAPDEADVDVHCPGHAVDGYVAIADKLERLLNLSILTE

SEQ ID NO: 227666 - protein, 541 aa, Glycine max
  Coding DNA Sequence Number=SeqID_110888
  Gene Ontology: Mol. function=protein serine/threonine kinase activity; Cellular component=mitochondrion; Biological process =protein amino acid phosphorylation
  Homolog annotation: Hit_ID=Q1SH45; Match level="QueryCoverage=93%, HitCoverage=100%, E-value=0.0, Identity=64%"; Hit description =Protein kinase
  Pfam annotation: Domain name=DUF26; Domain location=198-252; Score =39.0; E_value=1.6e-08; Accession=PF01657.8; Description=Domain of unknown function DUF26
  Pfam annotation: Domain name=DUF26; Domain location=87-141; Score =64.0; E_value=4.9e-16; Accession=PF01657.8; Description=Domain of unknown function DUF26
  Pfam annotation: Domain name=Pkinase; Domain location=347-541; Score=- 6.3; E_value=3.4e-08; Accession=PF00069.15; Description=Protein kinase domain
  Pfam annotation: Domain name=Pkinase_Tyr; Domain location=347-539; Score=-29.8; E_value=1.2e-10; Accession=PF07714.7; Description =Protein tyrosine kinase
  Pfam module annotation: Pfam domain module=DUF26::DUF26::Pkinase::Pkin ase_Tyr; Domain location=198-252::87-141::347-541::347-539
MDATLLNVKSVYSFAVLLLLSIKSLDTKAQSPNYMGDDCHNTTQKPLSGEYQTNLNSILSWLSTDAATSKGYNHYSFGNNTSGNHAVYGLYDCRGDVVGYFCQFCVSTAAREILQRCPNRVSAFIWYDFCMLKYSNENFFGNVTVDPSWHVVGTKDVSSAEEIQKGEDFMRSLIRKATLVTNQLYYMGGFNLSSSQRRYGLVQCSRDLTNDGCRQCLETMLAQISKCCEKKLGWFAGSASCLMKYDDSMFYLFHNQSSTVPEAYRKIAKQGIKMSKILIISFSVIGSITLLCFSVYCFWCRSRPRKDGLIPHTVRLSSYQNVQTEETLNPDLPTIPLITIQQSTDNFSEASKLGEGGYGPVYKGILPDGRQIAVKRLSQASGQGSEEFKNEVMFIAKLQHRNLVRLLACCLEENEKILVYEYLSNASLNFHLFDLCMETSQRVLVRAQVVVSMVEIYCILSEDDEKKKQLDWKLRLSIINGIARGILYLHEDSRLRVIHRDLKASNVLLDHDMNPKISDFGLARAFSKGQKQANTNRVMGT

SEQ ID NO: 227667 - protein, 670 aa, Glycine max
  Coding DNA Sequence Number=SeqID_110889
  Gene Ontology: Mol. function=protein serine/threonine kinase activity; Cellular component=membrane; Biological process=protein amino acid phosphorylation
  Homolog annotation: Hit_ID=Q1SH44; Match level="QueryCoverage=95%, HitCoverage=96%, E-value=0.0, Identity=58%"; Hit description=Protein kinase
  Pfam annotation: Domain name=DUF26; Domain location=202-256; Score =44.3; E_value=4.2e-10; Accession=PF01657.8; Description=Domain of unknown function DUF26
  Pfam annotation: Domain name=DUF26; Domain location=91-145; Score =60.8; E_value=4.6e-15; Accession=PF01657.8; Description=Domain of unknown function DUF26
  Pfam annotation: Domain name=Pkinase; Domain location=352-623; Score =145.3; E_value=1.6e-40; Accession=PF00069.15; Description=Protein kinase domain
  Pfam annotation: Domain name=Pkinase_Tyr; Domain location=352-623; Score=124.9; E_value=2.3e-34; Accession=PF07714.7; Description =Protein tyrosine kinase
  Pfam module annotation: Pfam domain module=DUF26::DUF26::Pkinase::Pkin ase_Tyr; Domain location=202-256::91-145::352-623::352-623
MEGKLLNVRSIYSFLFLLLLSFKPHVTKAQSPNYVGDDCQNTTQQKALSSAYKTNLNSVLSWLSTDAATSKGYNHNSFGNNTSGGDASDAVYGLYDCRGDIVGYFCQFCVSTASREVLQRCPNRVSAIVWYDFCILRYSNENFFGNVTVYPSWHAVRPKIVSSKEEIQKGLDFMRGLIRKATVETNLLYFMDGFNLSSTQRRYGLVQCSRDLTNDGCRECLEAMLAHVPKCCEQNLGWQVLAASCLIKYDDYIFYLFRTQASDTQTAKQRGASKSRIILIIGLSVLGAVALLCFSVYCFWFRKRTRRGRGKDGRIPDTIHQSSYHNVQTEETLNTDLPTIPLITILKSTDNFSEASKLGEGGYGPVYKGILPDGRQIAVKRLSQASGQGSEEFKNEVMFIAKLQHRNLVRLLACCLEGHEKILVYEYLSNASLDFHLFDERKKRQLDWNLRLSIINGIAKGLLYLHEDSRLKVIHRDLKASNILLDDEMNPKISDFGLARAFEKGQNQANTKRVMGTYGYMSPEYAMEGLFSVKSDVFSYGVLVLEIICGKKNSGFYLSECGQSLTLYAWKLWCAGKCLELLDPVLEESCIESEVVKCIHIGLLCVQEDAADRPTMSTVVVMLASDKMPLPKPNQPAFSVGRMTLEDASTSKSSKNLSINDVTVSNILPR

SEQ ID NO: 227668 - protein, 337 aa, Glycine max
  Coding DNA Sequence Number=SeqID_110890
  Gene Ontology: Mol. function=protein dimerization activity; Cellular component=nucleus; Biological process=regulation of transcription, DNA-dependent
  Homolog annotation: Hit_ID=Q2HUH2; Match level="QueryCoverage=84%, HitCoverage=87%, E-value=9e-74, Identity=57%"; Hit description=CAMP response element binding (CREB) protein
  Pfam annotation: Domain name=bZIP_1; Domain location=249-313; Score =50.6; E_value=5.2e-12; Accession=PF00170.11; Description=bZIP transcription factor
  Pfam annotation: Domain name=bZIP_2; Domain location=250-304; Score =48.9; E_value=1.8e-11; Accession=PF07716.5; Description=Basic region leucine zipper
  Pfam module annotation: Pfam domain module=bZIP_1::bZIP_2; Domain location=249-313::250-304
MGSQGGAVQEPKTTTTTTTPFVRQGPLYNLTLDEVHNQLGNLGKPLGSMNLDELLKSVWSAEASGGEASGLDFGVGGGDANMQHGEAAAFGSSLNPHVSLTLSRDLSRKTVHEVWRDMQLKKVTNRDKKIQERQATLGEMTLEDFLVKAGVIAEALPTTKDRAMSGVDSNGASSQHGHWLQYQQLPSSVQQPNVMGGYVAGHAIQQPFQVGVNLVLDAAYSETPASLKGALSDTQTLGRKRGVSGIVVEKTVERRQKRMIKNRESAARSRARRQAYTQELEIKVSRLEEENERLRRLNSHLFMACGLPSWQESVWLKCLLLEKISSGQSLSLVYYWL

SEQ ID NO: 227669 - protein, 108 aa, Glycine max
  Coding DNA Sequence Number=SeqID_110891
  Subcellular localization annotation: CTP_CleavageSite=63; ConfidenceScore=5.05e-01
MAHKLRQEFSISKAKKFRSFSLTLTLLFLPFSSTIEASIKAPNFTHHFYSKSQKEAIFGVVKRTSTLWDFKFQSGTWRYVAGVRRPWGRQVGCYCPKPSLTNPDPTRA

SEQ ID NO: 227670 - protein, 235 aa, Glycine max
  Coding DNA Sequence Number=SeqID_110892
  Homolog annotation: Hit_ID=Q1SXA8; Match level="QueryCoverage=64%, HitCoverage=9%, E-value=2e-07, Identity=28%"; Hit description=Zinc finger, CCHC-type; Polynucleotidyl transferase, Ribonuclease H fold
  Pfam annotation: Domain name=zf-CCHC; Domain location=173-190; Score =28.6; E_value=1.9e-05; Accession=PF00098.13; Description=Zinc knuckle
MDKSLKIGEDEWRENERKAMKFCASNEERMIAHFESIHIDLWDMVENGNHIPYDNELNEIPRSQWTEEQKLKFLLNFKAPNDEGIKKEKSLAINCQKIKKTSLSKEQVSRSLFKALKAKNSFDEESKEESDEDEVAFISQKIHKMWKNKGESRWKNSSKSTLNEKKDKDKSSIVCYECKKLGHFKFECPEQDKSQDKKKYYKTKEKKGLMSPCKDLDDTSSNEEEANLCLMADSL

SEQ ID NO: 227671 - protein, 94 aa, Glycine max
  Coding DNA Sequence Number=SeqID_110893
  Subcellular localization annotation: CTP_CleavageSite=64; ConfidenceScore=5.07e-01
MVASSTFFYITSSANRAFRDSKQHYLDFLETPCQPRQLTSHAQQASSSSSHFLLKGVKVLVEVEVMEEVKTEVEGLVKTEVEGLVKMKIKGLES

SEQ ID NO: 227672 - protein, 177 aa, Glycine max
  Coding DNA Sequence Number=SeqID_110894
MVVSLFLTHLLLAIDLQEAKNSIDKEDPRPTSSTWSYIITSSNFTCFESDKLGHIKFECSIFLKKQQGGEKETKCHSKKKKFYTTWDENASRTSKSTVSTFDSKTDLDENFDKLLDAFNEMHEEAQKLSQANNSLKGKLRCDVDKIVSSQKELSSLKLKNEVLEKPLENSSCSDKTI

SEQ ID NO: 227673 - protein, 212 aa, Glycine max
  Coding DNA Sequence Number=SeqID_110895
  Pfam annotation: Domain name=Transposase_23; Domain location=125-195; Score=3.7; E_value=0.00045; Accession=PF03017.5; Description =TNP1ENSPM transposase
MAYKKKTSQMTSDAAKEIGDMIDSLEEQISQRSFVAHGRQDVLIALIRRQEHHGCVHATVVSVTIKHYFRPASKDFHTSSSMSQMQSQMQSQGLSLPPEFEVGLSVARFSTKESCVDPSGQDPKIGDSDKCGLYVDDSPPLLVVVGRVDKESTTFHNIPLGNDQLKVSVEEVRDADARIPVPTQEVQLVGQTLNTFLAWLAYLVKPFSQQDK

SEQ ID NO: 227674 - protein, 56 aa, Glycine max
  Coding DNA Sequence Number=SeqID_110896
  Subcellular localization annotation: CTP_CleavageSite=20; ConfidenceScore=5.27e-01
MPQVARPNDGTSSVDSSSVNEAATVSRRVFSPSAVLGMQWKLGSPFQNQNDVLKYE

SEQ ID NO: 227675 - protein, 94 aa, Glycine max
  Coding DNA Sequence Number=SeqID_110897
MFLLVILDAEGTESRGPLLETMLPETRGLLIYKELRTEFGPGMDDAMAGGLNKLGMGTFIETGVAKFSVGVVAVGLTILLLGGGVPATISELLS

SEQ ID NO: 227676 - protein, 52 aa, Glycine max
  Coding DNA Sequence Number=SeqID_110898
MAIKGIKRPWVSWCRGFLNTKEGLSLCGSDFVKGVFTKESGKISSGLLEDWK

SEQ ID NO: 227677 - protein, 371 aa, Glycine max
  Coding DNA Sequence Number=SeqID_110899
  Gene Ontology: Mol. function=acid phosphatase activity; Cellular component=outer membrane-bounded periplasmic space; Biological process=proteolysis
  Homolog annotation: Hit_ID=Q8U788; Match level="QueryCoverage=99%, HitCoverage=56%, E-value=1e-148, Identity=74%"; Hit description =Serine protease
DGGFPSGHTNAAYLAAIAYAYAVPERFSELLTAASQLGESRIVAGMHSPVDVIGGRITATAIAAAVLQDPKNAEVKKAAHYDLQAYFVKRLPQGQSLIQFAHSAGLESDPYADAAKNQADYRRRMTYSFSRNTAGGHAPMVVPKGAEVLLETRLPYLNAAQRRAVLFSTGIKAGYPLLDDSNGWGRINLVAAAGGYGAFDGDVEVTMDAAAGGFNAADRWTNDITGAGRLVKSGSGALTLGGHNSYGGGTILREGTLVASSADALGTGGVLVSGGTLSLGGETDLVIGGDYAQSGGTLAVDPKKAALRIKGNAVLDGATLKLAFDGGAPAAGTRFEVISANGLTGTFATIDAGNVKVRPVYTGSALSVVVE

SEQ ID NO: 227678 - protein, 130 aa, Glycine max
  Coding DNA Sequence Number=SeqID_110900
  Gene Ontology: Mol. function=transporter activity; Cellular component= membrane; Biological process=transport
  Homolog annotation: Hit_ID=Q2K8C7; Match level="QueryCoverage=73%, HitCoverage=12%, E-value=1e-16, Identity=44%"; Hit description =Iron(III) ABC transporter, permease protein
MAGARRGAAGAVRRLRLIARQRAQPVAAAVQRAGRDLPDCGRARDWLQRLELAVAGKSLRRAAAGTASDGRWRASAADRVFAAVLVCAGRTRRAERRCLCGGVAGAADCAGQHLRTLSGAQHVCGVGAGR

SEQ ID NO: 227679 - protein, 109 aa, Glycine max
  Coding DNA Sequence Number=SeqID_110901
MAADLPQCRRAGFITPQVKQPAAIEKACFQAVPRQQQQRDGAQQQRARQTAIIGVHVLPQCGIIAPSLALSEPANRRQRQRPAMRHYCALAPISLSQRLSSALRLAESP

SEQ ID NO: 227680 - protein, 78 aa, Glycine max
  Coding DNA Sequence Number=SeqID_110902
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q9M6E8; Match level="QueryCoverage=100%, HitCoverage=12%, E-value=7e-35, Identity=87%"; Hit description=9-cis- epoxycarotenoid dioxygenase
MVETALVSHERQHPLPKTADPRVQIAGNFAPVPEHPAHQSLPVTGKIPKCIEGVYVRNGANRLYEPVAGHHFIDGDGM

SEQ ID NO: 227681 - protein, 485 aa, Glycine max
  Coding DNA Sequence Number=SeqID_110903
  Gene Ontology: Mol. function=gluconolactonase activity; Biological process=metabolic process
  Homolog annotation: Hit_ID=A0B3A3; Match level="QueryCoverage=61%, HitCoverage=95%, E-value=1e-117, Identity=68%"; Hit description=SMP -30/Gluconolaconase/LRE domain protein
  Pfam annotation: Domain name=2-Hacid_dh_C; Domain location=1-157; Score=246.8; E_value=4.6e-71; Accession=PF02826.9; Description=D -isomer specific 2-hydroxyacid dehyd
  Pfam annotation: Domain name=SGL; Domain location=208-461; Score =85.3; E_value=1.9e-22; Accession=PF08450.2; Description=SMP -30GluconolaconaseLRE-like region
  Pfam annotation: Domain name=Str_synth; Domain location=306-382; Score=2.9; E_value=0.00073; Accession=PF03088.7; Description =Strictosidine synthase
  Pfam module annotation: Pfam domain module=2-Hacid_dh_C::SGL::Str _synth; Domain location=1-157::208-461::306-382
MRDGHWDKAQHKSLELEGRTLGLVGLGAIGSRVARIGQAFGMQVLAYDPYAQTLPAGCEAVESLDELYSRADVVSLHCPLTDRNHQMINAAALARFKPGAILVNTARGGLIDDQAVATALQNGTLRAAGLDSFTSEPLNAPHLWQSLNNVIITPHIGGVSDNAYVRMGTGAGGGIMTVLTVPEVRELTLFSRLPEAFRRPDAGNVWAAANRGGQLTDSFLEGPVWHPSGCLYVTDIPYGRIFRVDMSGNWELVVQYDGEPNGMKLTDPDTLIITDYRNGLMKLSISSATITPWLTRRNSESFRGVNDLTPDSRGNLYFTDQGQTGLHDASGRVYRLSPDGRLDLLLDNCPSPNGLVLSPDEKILYVAMTRGNCVWRVPLLADGSVSKVGLFFTSHGPSGPDGLTINQRGELLIANPGLGRVWRLNDLAEPEEILLSPLGRSTTNLCFGGADLNQLFITESVSGSILTCTQNTPGRALPAIDTSFL

SEQ ID NO: 227682 - protein, 237 aa, Glycine max
  Coding DNA Sequence Number=SeqID_110904
  Gene Ontology: Mol. function=DNA binding; Cellular component =intracellular; Biological process=regulation of transcription, DNA -dependent
  Homolog annotation: Hit_ID=A0B3A6; Match level="QueryCoverage=98%, HitCoverage=99%, E-value=4e-83, Identity=67%"; Hit description =Transcriptional regulator, IclR family
  Pfam annotation: Domain name=HTH_11; Domain location=11-64; Score =11.8; E_value=0.0046; Accession=PF08279.2; Description=HTH domain
  Pfam annotation: Domain name=HTH_IclR; Domain location=8-95; Score =112.4; E_value=1.3e-30; Accession=PF09339.1; Description=IclR helix -turn-helix domain
  Pfam annotation: Domain name=IclR; Domain location=124-222; Score= -6.5; E_value=0.00086; Accession=PF01614.9; Description=Bacterial transcriptional regulator
  Pfam module annotation: Pfam domain module=HTH_11::HTH_IclR::IclR; Domain location=11-64::8-95::124-222
MGNEGVNAVEKALSLLDCFKPGEESLSLTALSQLSGYHKTTVYRLMNSLERMGYVVRSDSGVYTLGPRLLYLGKLYEQSFHLASVVQPELQALATATNESASWYVLDNGQRLCLFRAESSDGLRHTRLPGTIFPLDNSAISKVLRFWGMNENLFDALPSLPIFSSGARDPHIAAFAVPVFAENDRLTAALALTGPVSRLTLNRKDEELGVLMREAAARLSAKLGARKAFCDAVYAAK

SEQ ID NO: 227683 - protein, 129 aa, Glycine max
  Coding DNA Sequence Number=SeqID_110905
  Gene Ontology: Mol. function=methyltransferase activity
  Homolog annotation: Hit_ID=A0B3A5; Match level="QueryCoverage=74%, HitCoverage=41%, E-value=2e-30, Identity=69%"; Hit description =Dimethylmenaquinone methyltransferase
  Pfam annotation: Domain name=Methyltransf_6; Domain location=25-128; Score=1.4; E_value=9.7e-08; Accession=PF03737.6; Description =Demethylmenaquinone methyltransferase
MSVSANNLINRNIERVSALSVSQAAAFQAAILADVAGRRGTLHGRVKPLSPQMKVAGPAITVEVRPGDNLAIHAALAIAQPGDVLVVDGKGDISCALLGEIMATQAEASGIAGIIIDGAVRDADALAQG

SEQ ID NO: 227684 - protein, 81 aa, Glycine max
  Coding DNA Sequence Number=SeqID_110906
  Subcellular localization annotation: CTP_CleavageSite=46; ConfidenceScore=5.18e-01
MLLPSVVHVPSTFEFGAMFHDCLSVDPQGNPPFSPFFGAPSMLLPSAVHVSSTFELGAIFHDCLSADAQGNPPFSLFFGAP

SEQ ID NO: 227685 - protein, 205 aa, Glycine max
  Coding DNA Sequence Number=SeqID_110907
  Gene Ontology: Mol. function=transition metal ion binding; Cellular component=chromatin; Biological process=cytoskeleton organization and biogenesis
  Pfam annotation: Domain name=Transposase_21; Domain location=52-205; Score=41.5; E_value=3.8e-18; Accession=PF02992.5; Description =Transposase family tnp2
MPQVWSIRYKVKDDDECGSDENAKKGPLVKVLWYPPIILRFKHLFANGDDAKDLTWHTDGRNCDGMFHHLEDSFEWKKINHFYPYFVKETRNLRLELAIDGMNPFGSLSTKPRQLRNDINVYRSPLIEDLRKWWDEGVDMFDGNQNKTFKLCAMIFCTINDFLACENLSGYNVLEQVEDINTIFGKTKKKLTSKTCMWKKRFGFI

SEQ ID NO: 227686 - protein, 51 aa, Glycine max
  Coding DNA Sequence Number=SeqID_110908
  Gene Ontology: Mol. function=oxidoreductase activity; Biological process=response to oxidative stress
  Homolog annotation: Hit_ID=Q45NL3; Match level="QueryCoverage=88%, HitCoverage=39%, E-value=1e-13, Identity=82%"; Hit description=L -ascorbate peroxidase
MDLWKAVEKAKKLRGFIAEKRCAPLMLCLAWHSAGTFDKGTNTGGPFEHCY

SEQ ID NO: 227687 - protein, 464 aa, Glycine max
  Coding DNA Sequence Number=SeqID_110909
  Gene Ontology: Mol. function=oxidoreductase activity; Biological process=metabolic process
  Homolog annotation: Hit_ID=Q0X8K7; Match level="QueryCoverage=50%, HitCoverage=90%, E-value=1e-83, Identity=69%"; Hit description=Short- chain dehydrogenase/reductase SDR
  Pfam annotation: Domain name=Epimerase; Domain location=91-335; Score= -48.8; E_value=0.0058; Accession=PF01370.11; Description=NAD dependent epimerasedehydratase family
  Pfam annotation: Domain name=adh_short; Domain location=89-250; Score= 18.8; E_value=3.2e-07; Accession=PF00106.15; Description=short chain dehydrogenase
  Pfam module annotation: Pfam domain module=Epimerase::adh_short; Domain location=91-335::89-250
MNALTLPEPIAAYFAAEHDPEALGRCFTTKAILKDDGHTLTGVNAIKAFLAEASAKQPDPADLPFRTATRPDCSAGDHCMSFDLQLGGLRAVVTGGTLGVGAAVVRTLAEAGARVMTSARSLPARPVEGVAYVAADLSTAEGTGIFAQAVLQAWDGADILINVLGGSKTPGGGFAAISDAHWFAELNLNLMPAVRLDRALLPAMLAQRAGVIIHVSSIQRMLPLPESTTAYAAAKAALTTYSKSLSREVTAKGVRVLSVAPGWIETEASREFAERIAAEAGTDYEGGKRLVMDWLGGIPVGRPAAPQEVADLITRRPAATAQKESPAHAEAFLCPRFLRSCAPQHQLSCTATCKQTISSPMVQSIALQWMSVHSIRPAPPTGLTRRDALRIAVAGSIGLGAATIAGTLPASAATAPLKGNLKHSVARWTFPQLSVAQLCATVKDIGFAAIDLVGPEDWPTLKAH

SEQ ID NO: 227688 - protein, 79 aa, Glycine max
  Coding DNA Sequence Number=SeqID_110910
  Subcellular localization annotation: CTP_CleavageSite=63; ConfidenceScore=5.35e-01
MERYFQHLVRQQAANHRGRCRSMSVSTSSASVSKAKVSLLLRALLQISSGLSCMPGDWLSPGRGGARRGSQRCRGGPHG

SEQ ID NO: 227689 - protein, 187 aa, Glycine max
  Coding DNA Sequence Number=SeqID_110911
  Gene Ontology: Mol. function=nucleic acid binding; Biological process= transport
  Homolog annotation: Hit_ID=Q8H6Q8; Match level="QueryCoverage=48%, HitCoverage=2%, E-value=1e-18, Identity=50%"; Hit description=CTV.20
  Pfam annotation: Domain name=MP; Domain location=6-180; Score=48.2; E_ value=2.8e-11; Accession=PF01107.9; Description=Viral movement protein (MP)
MDDWNIPEIPQDQLYVPETIKDKHKFDYIIKTVENNIPLGQDIGEEFHLLSKNSIYEHSRKYKYLHIGCVQVVIKPLIDMGIDATVLMCLRDIRHNKFEDSLIGTVETSLGQGPIYFNCYPNKTVSLMDRNILDSLFLNIHFHGLDMKEGSILATLIYRIQYKVMNTCASRVLLQPQKGEQPYLSLI

SEQ ID NO: 227690 - protein, 95 aa, Glycine max; identical to SEQ ID NO: 218991
  Coding DNA Sequence Number=SeqID_110912

SEQ ID NO: 227691 - protein, 521 aa, Glycine max
  Coding DNA Sequence Number=SeqID_110913
  Pfam annotation: Domain name=DUF1828; Domain location=50-140; Score= -3.7; E_value=0.023; Accession=PF08861.1; Description=Domain of unknown function DUF1828
FPAAGEPDFDRRFRASAQRPPNRTDPMSNFLEASGWTVLPAGEHAIRAISPMTLGLDGQHAAFFIAHPDESTFYLTDACETAMHASSYGIDLAAKRIDILNETPGVSLAHFDRDGAIVASGPNEQLQEALWDAVKLAMALSFQCAKWMPKFSQLRFRAQVGRALTAGVGVNRMVKGARAKGSSGHTADFAFAVRAAGSTALTYIEPIALKAGKKMDWTQVYQTHGKMSDVKMADARNSRMVILEDGASAEELKKAVTILEQSASVLTLAKTRDWRAAVDDFAAVQDGGMHRFARTEDKTTFGKAWHGIFVAAFQHGASLDHHDRCDENGAARQRLDFIARAPGHHGRQPPDATPAASTRPGDFPKAVAKAHYPAPASPWPAGSPARSSPGPAGTCGYADRPAPAASPPAPGRSAACAAAPRPGPSDRPPWPAPCPGRAPRTSNAARAPKQHARDVGLNLWQSMCAVRRTIHAIVDGIEFGLHFARSVIDVDAQFRRDRQGAAESVQGQRRQGHLLYRANAR

SEQ ID NO: 227692 - protein, 274 aa, Glycine max
  Coding DNA Sequence Number=SeqID_110914
  Gene Ontology: Mol. function=DNA-directed RNA polymerase activity; Cellular component=chloroplast; Biological process=transcription, DNA-dependent
  Homolog annotation: Hit_ID=Q8HVY4; Match level="QueryCoverage=96%, HitCoverage=45%, E-value=1e-143, Identity=85%"; Hit description=DNA -directed RNA polymerase beta' chain
  Pfam annotation: Domain name=RNA_pol_Rpb1_2; Domain location=52-194; Score=245.1; E_value=1.4e-70; Accession=PF00623.11; Description=RNA polymerase Rpb1, domain 2
MCQEKLVQEAVDTLLDNGIRGQPMRDGHNKVYKSFSDIIEGKEGRFRETLLGKRVDYSGRSVIVVGPSLSLHRCGLPREIAIELFQTFLIRGLIRKHFASNIGIAKSKIREKEPIVWEILQEVMQGHPVLLNRAPTLHRLGIQAFQPILVEGRAICLHPLVCKGFNADFDGDQMAVHVPLSLEAQAEARLLMFSHTNLLSPAIGDPISVPTQDMLIGLYILTSGNRRAYQQKRINFDSPLWLRWRLDQRIISSREVPIEVHYESLDHIDGWYLR

SEQ ID NO: 227693 - protein, 44 aa, Glycine max
  Coding DNA Sequence Number=SeqID_110915
MKIKEHKLSAKKVHEEAQQRKSHAKRMITVTLAKPKFRLAREIA

SEQ ID NO: 227694 - protein, 62 aa, Glycine max
  Coding DNA Sequence Number=SeqID_110916
  Subcellular localization annotation: CTP_CleavageSite=38; ConfidenceScore=5.33e-01
MELTPLDLPYPSPCLLSTSVGRNPKKRYGFLPPRGHPRISSNSSTFGTNSKSPNVKHLKGWS

SEQ ID NO: 227695 - protein, 102 aa, Glycine max
  Coding DNA Sequence Number=SeqID_110917
MQQGHAVILIARFPDPNYGVKTGSPQCGVSTENNGGLWWLMVAVSDREKAWNAGNGFGRKKGEEMAFFLSYLDYKAQNVQVSNAFGNGNVTHTPDIFSKIPT

SEQ ID NO: 227696 - protein, 241 aa, Glycine max
  Coding DNA Sequence Number=SeqID_110918
VHNIPIVVDHSLFYSLTKLPSQGVPFEGTLVDNWKFDYSSHDAHRIVCNDQADMTVRLLVGSFTFDCRIMHYIIVRILLPRSSNLAQASEEDLILLWALQTGRQIDWAHLVRYRMHKALRVNAPLLYPHLVTLFLHHFNVPLDDEPYVKVKRSFSIGAGVVTSFDLPPPIPDERTPSPPPQRDASSSLLTKVLTKLSDLRAFVGEHFDAMDTRLDGMDTRITKLEDDMSFIRRCFNPPADS

SEQ ID NO: 227697 - protein, 94 aa, Glycine max
  Coding DNA Sequence Number=SeqID_110919
MVAIIPARIPQPPFSQGYNSNATCAYHGGVLGHSIEHCMTLKHKFLSLFLATRSLQKTVIDTSEPYIGAMRGTMHEPQANLGGDKKFSPGRLKT

SEQ ID NO: 227698 - protein, 183 aa, Glycine max
  Coding DNA Sequence Number=SeqID_110920
ICTPEADPQELAAKLCIPGKGFELNADGQPLKILRKNLTTLAQTWSVLSLSNLIPTSHTSDVTLDRARLIYGIIMKMDMNVGYLISLTAQHDTSRLGFPALITALSKARGALSTTPSEVLAPSSSTLPPSSSTEIPVIPPALIQIPLPPPLSIGLADFIFTPQMLQSMLQSIHRGQSIIMQSL

SEQ ID NO: 227699 - protein, 66 aa, Glycine max
  Coding DNA Sequence Number=SeqID_110921
  Homolog annotation: Hit_ID=Q8RT62; Match level="QueryCoverage=69%, HitCoverage=45%, E-value=2e-09, Identity=65%"; Hit description =Putative capsular protein
MTKSIGKRNGGDRRHQLLQTHQIVQTLLRIEIYGAIERIVAGKVFRRARQNVVIFAQQRFGVVHRK

SEQ ID NO: 227700 - protein, 98 aa, Glycine max
  Coding DNA Sequence Number=SeqID_110922
  Gene Ontology: Mol. function=sugar porter activity; Cellular component=intracellular; Biological process=phosphoenolpyruvate -dependent sugar phosphotransferase system
  Homolog annotation: Hit_ID=Q7N3G3; Match level="QueryCoverage=73%, HitCoverage=71%, E-value=7e-17, Identity=56%"; Hit description=PTS system, cellobiose-specific IIB component
  Pfam annotation: Domain name=PTS_IIB; Domain location=29-98; Score =69.2; E_value=1.3e-17; Accession=PF02302.8; Description=PTS system, LactoseCellobiose specific IIB subunit
MVKRLCRAAARDKDDASRNIHKGDETMKNIVLCCAAGMSTSMLVQRMKEAAQKKGIEVSIKAVPVAEFKDNLAEADIILLGPQVKYEQAKLQALADPV

SEQ ID NO: 227701 - protein, 383 aa, Glycine max
  Coding DNA Sequence Number=SeqID_110923
  Gene Ontology: Mol. function=signal transducer activity; Cellular component=membrane; Biological process=signal transduction
  Homolog annotation: Hit_ID=UPI0000E6995B; Match level="QueryCoverage =96%, HitCoverage=70%, E-value=2e-43, Identity=31%"; Hit description =pas:GGDEF, putative
  Pfam annotation: Domain name=Cache_1; Domain location=29-109; Score =17.4; E_value=0.00074; Accession=PF02743.8; Description=Cache domain
  Pfam annotation: Domain name=GGDEF; Domain location=225-379; Score =128.9; E_value=1.5e-35; Accession=PF00990.12; Description=GGDEF domain
  Pfam module annotation: Pfam domain module=Cache_1::GGDEF; Domain location=29-109::225-379
MEGDESRTFDPKTRPWFIRQAEASTFSLYTTPYLDYFTHHPTVTVYRPVISPQGRLKGSLAFHMDLTSMGYALRQIVSPVQGEFFVVQRDGKVVIHPDTGALFKTYVSAELMDKMTSAEGQLYDEEHKAWYYYYSFTNPDWFVIFRVTDATLDDLTRYETDIVAWGFALAAIVIVLFGLYLRHASRTVLMNIINAIKTGDVKRAPRLEAMLSKAIESNKQRELTYVRQATIDALTGCKNRRAFDSDIAALMNDHQPFALALVDIDNFKSINDTWGHLNGDIVLRNVAREGIQILQPQEISLYRYGGEEFAVIFPAEHIDNALTILESWRLNVASRTWREEGLTVTFSAGLGEWNMEPLEKLVVSVDEALYKAKQQGKNRIVRA

SEQ ID NO: 227702 - protein, 136 aa, Glycine max
  Coding DNA Sequence Number=SeqID_110924
VKKGAQPHDDEGHLPVGEDSSLLQSILDRFDGLQTFFGERFDALEQQVDMRFDGMDSRITKGCHHQKRGDCRSKLHDNESSSFDDDKKPKRMMSRLSQQVQEIKKIQDSREVDFKIQEKTSRRIKIQEKMNSQGKY

SEQ ID NO: 227703 - protein, 172 aa, Glycine max
  Coding DNA Sequence Number=SeqID_110925
MTRRLLVGSLAFESRILHYLIVRILLPRSSNLAQALRLNAPLPYPHLVTFFLQNFNIPLDFEPYVPIKKSFLIGASVIASFGYIKEHDGSWVKKGARNVGEEGHEGEDSSLLSKIMEKFDGLQTFVGEMFDTLELQVDMRFNEMESRMTKFKEDVSYIRSSFDLPPPPPPSS

SEQ ID NO: 227704 - protein, 55 aa, Glycine max
  Coding DNA Sequence Number=SeqID_110926
MKKRKILASGTAQDALNVKTCTPTKRESDALSVNTGTCTKRVERAKRECSTEGDP

SEQ ID NO: 227705 - protein, 89 aa, Glycine max
  Coding DNA Sequence Number=SeqID_110927
  Subcellular localization annotation: CTP_CleavageSite=39; ConfidenceScore=5.05e-01
MSSDSPSLDDKGVGPYGSPACHRTRRLWMAKVQMTTLVSACQRARLPLVDKWCETIWFPRMSSDSPSLDDKGADDNVSLCVSTGSLASG

SEQ ID NO: 227706 - protein, 115 aa, Glycine max
  Coding DNA Sequence Number=SeqID_110928
MESKVARRSAYYFIAQLNNIKERGKWSPLITNTKPQASRIWGYGRVYDPYKPISSSRNSLSPHKHKHASPCMIRLSQLPIPCIKGYALAIIILEDKYKAGLEECKNNLHGRFLLT

SEQ ID NO: 227707 - protein, 56 aa, Glycine max
  Coding DNA Sequence Number=SeqID_110929
MDDAMLKRSFGHYTRVIVDVDLEGQLRLIGHMIATCKRCVQEPKHGVEEDRQQKVF

SEQ ID NO: 227708 - protein, 82 aa, Glycine max
  Coding DNA Sequence Number=SeqID_110930
DVTHRPRLFWFFRRFPRINVGGDSAHFPFLEDAPVSPRVVLPPKEVSGAERAILDALSPGISLSTATTDWREDQGIHTPIRH

SEQ ID NO: 227709 - protein, 119 aa, Glycine max
  Coding DNA Sequence Number=SeqID_110931
  Homolog annotation: Hit_ID=P09029; Match level="QueryCoverage=36%, HitCoverage=12%, E-value=1e-12, Identity=79%"; Hit description =Phosphoribosylaminoimidazole carboxylase ATPase subunit
LPLVHLHWYDKEVRAGRKVGHLNLTDSDPARLTAALNALFCGVPLTLALSHRERGLYGAIFQLDAHLNILKLQARTAPSPVGEGIMRCDFLFNAHLNVLKCKITHTGSIGPLSRGRGLG

SEQ ID NO: 227710 - protein, 206 aa, Glycine max
  Coding DNA Sequence Number=SeqID_110932
  Gene Ontology: Mol. function=sodium:dicarboxylate symporter activity; Cellular component=membrane; Biological process=transport
  Homolog annotation: Hit_ID=Q8D139; Match level="QueryCoverage=76%, HitCoverage=19%, E-value=2e-66, Identity=77%"; Hit description =Putative oxidoreductase
  Pfam annotation: Domain name=FtsX; Domain location=62-204; Score =20.3; E_value=0.00018; Accession=PF02687.11; Description=Predicted permease
MEVELADRLGVRLGDRLTFSGDTQQFSATITSLRKVDWESLRPNFLFIFPPGALDQQPQTWLTSFRMANDPALLAQLNRAFPTLSLLDVGSMLKQIGQVLAQVSQALEIMVILVTVCGVLLLLAQIQVGMRQRRQELVVYRTLGASQRLLRGTLWCEFALLGVVAGIAAALGAEAALWGLQRGLTLPDALTPALSHGRGGRSSPYA

SEQ ID NO: 227711 - protein, 800 aa, Glycine max
  Coding DNA Sequence Number=SeqID_110933
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q7N0Q7; Match level="QueryCoverage=70%, HitCoverage=70%, E-value=0.0, Identity=54%"; Hit description=Copper -transporting P-type ATPase
  Pfam annotation: Domain name=E1-E2_ATPase; Domain location=501-723; Score=284.1; E_value=2.6e-82; Accession=PF00122.10; Description=E1 -E2 ATPase
  Pfam annotation: Domain name=HMA; Domain location=312-373; Score =57.5; E_value=4.4e-14; Accession=PF00403.16; Description=Heavy-metal- associated domain
  Pfam annotation: Domain name=NfeD; Domain location=10-143; Score =32.4; E_value=1e-06; Accession=PF01957.8; Description=Nodulation efficiency protein D (NfeD)
  Pfam module annotation: Pfam domain module=E1-E2_ATPase::HMA::NfeD; Domain location=501-723::312-373::10-143
MELIAHPHWFWLTLGGLLLAAEMLGTNGYLLWSGVAAVLVGIIEWLFPFSWTSQGMLFAALTLLCVFFWYRWMRFRESAQQPNTLNQRGSQLIGQHLTLDSALKDGVGAGRFAGGHTGDRDRRVRHHAADSAAFATLLMTAARQVIDDGTFGTVIARAGCSQFQQTRAHRVQLFNMRRDLIRLLQGARFNIGTVARRVIKQRDQFATLLEREAHLPRLAQKIELIQVVRAITAIAVVTADVEQAEVTQQEARVTGAASASDLIATVEQAGYHATLKNEASSPKPDPLPAQEPQPEALTTESQPAEENLAVHHLLIGGMSCASCVSRVEQALQKVPGVSQARVNLGERSALVLGDAVPSALVSAVDEAGYSAEVIEDEQTRRERQQVSAQQAMRRFSWQAALALIVGVPMMVWGMLGDHMMLNDSNQTLWRVLGAVTLAVMALAGGHFYRSAWRSLRHATATMDTLVALGTGAAWIYSMSVALWPAFFPPQARHLYFEASVMIIGLINLGHALEQRARQRASQALERLLDLTPAQACVITAEGEKPLPLSEITPGMTLKLVTGDRVPVDGEVSRGEAWLDEAMLTGEALPQSRRPGDKIYAGTLVQDGSLQFTARATGSHTTLARIINLVRQAQSSKPEMGRLADRISAVFVPVVVAIALLSGAVWYVVGPQPQLAYTLVIVTTVLIIACPCALGLATPMSVIAGVGRAAELGVLVRDADALQRASEVDTIVFDKTGTLTQGTPQVSEVLLYSDWDRQQVLQAAAQLELGSGHPLAKAIVAAAPTVSDARVAQFRTIRGKG

SEQ ID NO: 227712 - protein, 254 aa, Glycine max
  Coding DNA Sequence Number=SeqID_110934
  Homolog annotation: Hit_ID=Q1RF81; Match level="QueryCoverage=40%, HitCoverage=75%, E-value=2e-34, Identity=69%"; Hit description =Hypothetical protein ybaZ
  Pfam annotation: Domain name=DNA_binding_1; Domain location=155-240; Score=115.5; E_value=1.6e-31; Accession=PF01035.11; Description=6-O -methylguanine DNA methyltransfera
  Pfam annotation: Domain name=HHA; Domain location=66-111; Score=71.5; E_value=2.7e-18; Accession=PF05321.2; Description=Haemolysin expression modulating protein
  Pfam module annotation: Pfam domain module=DNA_binding_1::HHA; Domain location=155-240::66-111
MEGKKMDEYSPKRHDIAQLKFLCENLFDETMESIPRIFNGGNVQQNAYLICLPKSALISSNPAIPFSIRVRPNKYELPDDELAVFYSAADHRLAELTMNKLYDKVPGSVWKQAKECRYGAVPHCAQGRRQNPADSRNRMLKWRFSRRRGASVSEQSNFSERVWQIVAAIPAGKVTTYGDVALLAGSPRAARQVGGVLRRLPPGSKLPWFRVINRHGRISLQGDDLFRQRDALEAEGIEVSDAGEIELAKYRWEY

SEQ ID NO: 227713 - protein, 295 aa, Glycine max
  Coding DNA Sequence Number=SeqID_110935
  Pfam annotation: Domain name=C1q; Domain location=148-293; Score= -40.0; E_value=0.068; Accession=PF00386.12; Description=C1q domain
  Subcellular localization annotation: CTP_CleavageSite=63; ConfidenceScore=5.68e-01
MSSTLSYSQTGNVGINTTTPGSTLTVNGSFAATYRSVTASGNVAPTDYYLAYSSNTNGTLTLPAAITGSGNFAGRTYHFKNTGTAVLSIAANGAELIDNQTGAGVGTVNVPAGYYAFFISKGTTTGTTWELILLSSSDSLPAATTSYPFSTVSTTSRQDLTASTGPYIRREINYPQGTVINTGNVLNISNGRFTAPSNGYYMFYGSTQFDNGNIPGTPSFDWVVLYLMKNYAVSTDNILVQSFQPAPGTLTGRNVSCITYLNKDETVSMAAAAGVTGSPIYQVVVSSFYGYKIAN

SEQ ID NO: 227714 - protein, 69 aa, Glycine max
  Coding DNA Sequence Number=SeqID_110936
MPASTIDIDNDSDDNDNNNNYDDRSDASDHHGGSCNGGGNNDDEGHEGGVRCRYGGCNDIHSGGNNNHD

SEQ ID NO: 227715 - protein, 169 aa, Glycine max
  Coding DNA Sequence Number=SeqID_110937
SRGVASDSLVFERLSSIINLAYIRKNCWNLVDLTITIRGARRARARPAWPGTQPPLHREDEGLTAQVPQQREDESSETSTPEPLIRRKRVVETQEVVATLEKSLEATSEPSEPVTDTTSFQQAADLSTPEDQTTPVLFPNTSPPATPVLHLTDEEDVQTQDTQDRSQDF

SEQ ID NO: 227716 - protein, 65 aa, Glycine max
  Coding DNA Sequence Number=SeqID_110938
MWDGGEDIKPRYLGDDMGITLHAWDVESIKKIVTGIGEVVDIDDDVEDIHPRTEHECSSKHQSNP

SEQ ID NO: 227717 - protein, 103 aa, Glycine max
  Coding DNA Sequence Number=SeqID_110939
MVKTINTKSHGESERHLTIANSSDVVVVIDSNGDGGSVVVFGGNSFDGDGGEVNGGGSDDSHDDVVVVGGGSVVADGDGGCAMIAMERTMSNIESVHSFKIKN

SEQ ID NO: 227718 - protein, 170 aa, Glycine max
  Coding DNA Sequence Number=SeqID_110940
  Gene Ontology: Mol. function=cobyrinic acid a,c-diamide synthase activity; Biological process=cobalamin biosynthetic process
  Homolog annotation: Hit_ID=Q1RBK6; Match level="QueryCoverage=49%, HitCoverage=36%, E-value=4e-21, Identity=58%"; Hit description =Putative dethiobiotin synthetase
MARDVIAGVGHHIGRMLAMMVNIFNPQQILIGSPLNQAADVLFPAVSSTIRQQALPAYRLTPARLKFALTQALAWDKSLNCLLCSAQHTPEGLRNKDAVLLQQASGLTLNYSDVNPVTLEEDEISTSPAQRIDYPLLNRGLAGLQDRAARVVVEGTGGWRSLMNDLRPLS

SEQ ID NO: 227719 - protein, 158 aa, Glycine max
  Coding DNA Sequence Number=SeqID_110941
MENKDTYIPFSIRGNHSDGEVVTSISSGDLVAWCEPLLGSILPIGFASGNMIKLSWMNNAFQQLPNDANDVAFAQHAQAHILSFIGGLLMQDTSGFRDLSSENIGGCMFLLLSWVWDWITCISPCVEEYTNDEAHTRLRFPLTRITNELCYMIGGLVP

SEQ ID NO: 227720 - protein, 93 aa, Glycine max
  Coding DNA Sequence Number=SeqID_110942
MDMWNDRHYPITCSQYMQWYILRTICHISPHELPPSEETRNNGDDEGDGYEDNNNNDVGSLWTTNDGDDTTTRETQPVTSWKFLPGIFENDVF

SEQ ID NO: 227721 - protein, 47 aa, Glycine max
  Coding DNA Sequence Number=SeqID_110943
MAGTPHIQLNMIVDEGNNKRNQLNNKKKEDQDATRDNLHVEHQPTNL

SEQ ID NO: 227722 - protein, 425 aa, Glycine max
  Coding DNA Sequence Number=SeqID_110944
  Gene Ontology: Mol. function=transferase activity, transferring hexosyl groups; Cellular component=integral to membrane; Biological process=metabolic process
  Homolog annotation: Hit_ID=Q8S342; Match level="QueryCoverage=97%, HitCoverage=91%, E-value=1e-130, Identity=53%"; Hit description =Putative anthocyanidine rhamnosyl-transferase
  Pfam annotation: Domain name=UDPGT; Domain location=9-424; Score= -152.0; E_value=0.0058; Accession=PF00201.9; Description=UDP -glucoronosyl and UDP-glucosyl transferase
MARTEEKLHIVMFPWLAFGHLIPNLELAKLIAQKGHNISFVSTPRNIERLPKLSPNLASFIKFVKLPLPKVDKLPENAEATTDVPYDVVQYLKKAYDDLEEPLTRFLESSKVDWLFYDLIPFWAGTVASKLGIKSAFYSICTPPCMGFLGPPSVLMGEDPVRTKLKGFTVTPPWISFPTTVAYRYFEMMRNSDAVSDNDSGISDMYRFGAVIKNCDIVVIRGCTEFEPEWFQVLENIYQKPVLPVGQLINREFEGDEDNITTWQWMKDWLDKQPCGSVVYVAFGSEAKPSQDEVTQIALGLEESKTRFFWVLRVQRGPWDPDVLRLPEGFEERTKGRGIVCTSWAPQLKILSHVAVGGFLTHSGWTSVVEAVQNEKPLIFVGREEDGVFGFLGTNVMGRITSDAIANSIRLVMVEDGRKGLQGED

SEQ ID NO: 227723 - protein, 104 aa, Glycine max
  Coding DNA Sequence Number=SeqID_110945
  Gene Ontology: Mol. function=transferase activity, transferring hexosyl groups; Biological process=metabolic process
  Homolog annotation: Hit_ID=Q8S342; Match level="QueryCoverage=98%, HitCoverage=21%, E-value=2e-37, Identity=69%"; Hit description =Putative anthocyanidine rhamnosyl-transferase
MARTEEKLHIVMFPWLAFGHLIPNLELAKLIAQKGHNISFVSTPRNIERLPKLSPNLASFIKFVKLPLPKVDKLPENAEATTDVPYDVVQYLKKAYDDLEEPLT

SEQ ID NO: 227724 - protein, 259 aa, Glycine max
  Coding DNA Sequence Number=SeqID_110946
  Homolog annotation: Hit_ID=Q1S0F5; Match level="QueryCoverage=52%, HitCoverage=35%, E-value=6e-08, Identity=29%"; Hit description=IMP dehydrogenase/GMP reductase
SVWRKGQRPWKIKVNGLSFIDILALLIFGVVLFPNMEGLVDLAVIDAILAMYDTFDRGCEKSDARIFCCALALYVWLVSHPFLQEGRPVYPLQGHRSCVEKGKANWDQLLASMEGGCINYNLVLAIRQLGYPMRGVPSDESITPFIARGFGDHNARDRELRGSSNGIIGGYHKWLRVRTQGLDWLPNLKTVRDDEVKASEESDEVQALKAELERARVVEEKFKSIAIKLKPWNEEVKGIITGQRHDLRRGERNHHGSKA

SEQ ID NO: 227725 - protein, 159 aa, Glycine max
  Coding DNA Sequence Number=SeqID_110947
  Gene Ontology: Mol. function=phosphogluconate dehydrogenase (decarboxylating) activity; Cellular component=cytoplasm; Biological process=pentose-phosphate shunt
  Homolog annotation: Hit_ID=UPI00005F8DB8; Match level="QueryCoverage =92%, HitCoverage=51%, E-value=6e-57, Identity=70%"; Hit description =COG0451: Nucleoside-diphosphate-sugar epimerases
MQPALQLGQHPARRRDRPQRRLFAQRAGGFSVHRGGTGEDHARHAEGHRAVHQHAHRIEIVLAAFDGAARGQRHHQRIHAQQRFQIVRIALQLRRQLQLIAFDAAHPRGLDAVRRGFAADHVIPAAHQRQRQRHAQPTQTNNGYLFHPLPLLKIAAPYP

SEQ ID NO: 227726 - protein, 74 aa, Glycine max
  Coding DNA Sequence Number=SeqID_110948
MKAKSWRNLQWLSARKNPEEDELSSLLSVPLQVIKHTASAHPLSETSALSQNPLMHAKRSISVLSTQARTRPPI

SEQ ID NO: 227727 - protein, 86 aa, Glycine max
  Coding DNA Sequence Number=SeqID_110949
MGEGIPTRGVPRSLLESVSSIYANACKESSAIKTLKTIVDRKNDQGPPKWIEVNIHVQSEGYECDYYVMHWMWNIVSWSLKNDWSM

SEQ ID NO: 227728 - protein, 121 aa, Glycine max
  Coding DNA Sequence Number=SeqID_110950
MDLSTTEEEYMAKAEVIIDKIVKKQAPRGKQLHTQSNFQWRRCPSPPDGILHGGGIVLRRRDGVLCGGSVVLCLCDGVFRGGGAVLRCRDGALLSGFCVSVAEVQNSKSQDRIEVNEMTNE

SEQ ID NO: 227729 - protein, 80 aa, Glycine max
  Coding DNA Sequence Number=SeqID_110951
  Subcellular localization annotation: CTP_CleavageSite=51; ConfidenceScore=5.24e-01
MRLMSQACFSILLLILFLFKISSSTANGYAKSQSFRTQPLSNLSPFKGKSRQNTGEGDGEAVLGDEKRIIYTGPNPLHNR

SEQ ID NO: 227730 - protein, 917 aa, Glycine max
  Coding DNA Sequence Number=SeqID_110952
  Gene Ontology: Mol. function=RNA-directed DNA polymerase activity; Cellular component=chromatin; Biological process=chromatin assembly or disassembly
  Pfam annotation: Domain name=Chromo; Domain location=827-877; Score =18.0; E_value=0.0073; Accession=PF00385.14; Description='chromo' (CHRromatin Organisation MOdifier
  Pfam annotation: Domain name=rve; Domain location=525-681; Score =125.2; E_value=1.8e-34; Accession=PF00665.16; Description=Integrase core domain
  Pfam annotation: Domain name=zf-H2C2; Domain location=466-507; Score =7.1; E_value=0.041; Accession=PF09337.1; Description=His(2)-Cys(2) zinc finger
  Pfam module annotation: Pfam domain module=Chromo::RVT_1::rve::zf -H2C2; Domain location=827-877::12-181::525-681::466-507
MLTTGIIQPSHSPFSSPILLVKKKDGTWRCCVDYRALNAVTVKDRFPMPTIDELLDDLGRASWFSKLDLRQGFHQIRMAEEDAHKTAFRTHQGHYEFLVMPFGLCNAPSTFQAAMNDALQPFLRRFVAVFFDDILVYSPDLSSHVSHLEAVLSALADREFLLKQSKCSFAQRELNYLGHIISSQGVAPDPDKIAAMLEWPLPTCSTSLRGFLGLTGFYRKFVKGYAAIAAPLNSLLRKDKFAWSPDAHQAFRQLQQAMTETPVLANPNFFIPFTLETDASGTAMGAVLLQEGHPIAYYSKALCPRLQRASAYVRELHAITSAVRKWRHYLLGNSFIILTNHKSLKDLMSQTIQTPEQQTYLCKLLGFDYTIKYKPGAANVVADALSRISPAEATCLTLTAPHFLFLQNLRQALLLDPQYVALLQDIRDHPTNHPDITTHQDLLFRHGRVWIPFATPFTRVLLEEFHSSPLGGHTGVTKTLHRLRQNFDWPHLKDDVRRYVAQCATCQQTKYDTKKSAGLLQPLPIPSQVWEDLSLDFVTGLPLSQGYTVILVVVDRFSKAAHFGALPTHHTAYKVAVLFLDMVCRHHGFPRSLVSDRDPIFISNFWRELFRLSGTKLRMSTAYHPQTDGQTEVLNRTLEQYLRAYVHDQPSRWYRFLSLAEWSYNTTLHSSTGMTPFEVVYGKPPPTVAHYLQGHSSNDAVDSLLTTRVQLHAQLTRRLQRAQELMKTTADRHRRDLSFEVGDWVYVRLRPYRQTSIAPKYSKLAKRFYGPFQISARIGPVAYKLALPASSRIHPVFHVSLLKLHQGPSPASPGTLPELSTDNHPIVNPFAILDWKLDSSVTPPVKRVLVQWDDLPPEETSWESWDELKVLHNLADKVVFDEGGVDSNTATADQHQHIDTSRPKRECKKPAYLRDFV

SEQ ID NO: 227731 - protein, 386 aa, Glycine max
  Coding DNA Sequence Number=SeqID_110953
  Pfam annotation: Domain name=DUF1645; Domain location=105-308; Score=- 36.1; E_value=0.0056; Accession=PF07816.2; Description=Protein of unknown function (DUF1645)
  Subcellular localization annotation: CTP_CleavageSite=53; ConfidenceScore=5.07e-01
MVDMMDISFSNEFCYMSACSFSQEMCFYSAPTSPSRLKLRAPFGSQTGPTTPRAATHEDDADSNVNEFEFETSRRFNVSVGDLDTETNQKDENLFGDSLQTMAFADELFCDGKVLPLMPPLKLPPRMQQNGDGSIMSTHSSTLTSPRSPGSVLRLRFSRQSLWNDDFDPFMVALEKVREEKRGNPSARHGLRRTRSLSPFRSFNKKSEKNVGISKSSQLESHCCDTAQLVCELNKEPLKQVSGRINVLSEPKGLMFAKQVRLVGVSNDTTTLERTSVSKVATETKKDEGKRGGFWRRNKRENIKKFLFGTSNMWKANAHHKLEDKIAAQEKQPLVRKLDMKSVKATESTQWDKDPRTGELTKMRLVCHRPLPRFFLCLGYEEGKVK

SEQ ID NO: 227732 - protein, 74 aa, Glycine max
  Coding DNA Sequence Number=SeqID_110954
MVMSDTVVAMERFSLKGILSVVERFLVTNLAVVLTLVVINKRRRHRRWGSSGKGNCLRFQSYVPQHRDHSGLTT

SEQ ID NO: 227733 - protein, 355 aa, Glycine max
  Coding DNA Sequence Number=SeqID_110955
  Homolog annotation: Hit_ID=Q1S6Z6; Match level="QueryCoverage=86%, HitCoverage=52%, E-value=4e-94, Identity=57%"; Hit description=Las1 -like
MAQGIQVKVERYLLKALSSSELEENADDASIGLTTQNVLADWMLVILKLCNKPELLLNLLKEVLDMIESQEDMKYKEDNPNMGVSHSRTEFRLSSLFAWLVGILSKVPSAAANMPKRVLHELLRRCLLVSQLCNKQLVDSALQLAELMNDSYLMEKVRKFSLISLSNLESADDESPLLTSKNIFQFEESMLEAAKKLELVKQQIMKNKKPMAMDCDTEKSQTWTLAKSWNPCPIGMLPRAVGSSGCLPVLNIIDDEKQNQNQVSEKEENWKLIPHGSKRDASLDLLQLDNSTVKKMRETKEFSELNNELPLQGGKGCLMVGGVRKKLTEEELLVIESSDYPVEPSTFTYFGNVFA

SEQ ID NO: 227734 - protein, 414 aa, Glycine max
  Coding DNA Sequence Number=SeqID_110956
  Gene Ontology: Mol. function=RNA-directed DNA polymerase activity; Cellular component=chromatin; Biological process=chromatin assembly or disassembly
MPEHHTRQVTTDKLEEAVKTLSQDNSALNNKIDTIHASLTAKIDALFDRFATIAVNSPQPPPPTPVHSSSSSHRHHMKLEVPRFDGHDPLGWIFKISQFFDYQGIPENERLTVASFYMEGPALSWYQWMCRNGFFPSWPTMLQALESRFAPSFYDDPQGALFKLQQTGTVSEYLTEFERLANRTMGLPPSCLLSCFVSGLIPELRREVQALRPLSLPHATELARLQEDKLLDRRRGQRSSSTTLPPKTGHPQPSNSTRVPIKRLTSEELAVRREQGLCYHCEEKWSHGHRCRPRLHLFIADDDLEPPADFNTGDTPNPITADLEITPQISLNAMEGTPAPQTFRLLGQLRRHQVIILIDGGSTHNFIQSRLARFLALSTVPTATLRVMVGNGNTLECNTQSLQTWSWASSDLSN

SEQ ID NO: 227735 - protein, 276 aa, Glycine max
  Coding DNA Sequence Number=SeqID_110957
  Gene Ontology: Mol. function=sequence-specific DNA binding; Cellular component=nucleus; Biological process=regulation of transcription, DNA-dependent
  Homolog annotation: Hit_ID=Q1ST32; Match level="QueryCoverage=90%, HitCoverage=98%, E-value=1e-98, Identity=74%"; Hit description =HSF/ETS, DNA-binding
  Pfam annotation: Domain name=HSF_DNA-bind; Domain location=23-213; Score=162.4; E_value=1.1e-45; Accession=PF00447.8; Description=HSF -type DNA-binding
MAFTLDRCEDSMVFTMESHKSVPAPFLTKTYQLVDDPRTDHIVSWGDDETTFVVRRPPEFARDLLPNYFKHNNFSSFVRQLNTYGFKKVAADRWEFANEYFRKGAKHLLCEIHRRKTPHHYQQHYHMHDQPPHLLQPEENMCWIDTPPLPSPKPGTDILTALSEDNQRLRRKNLMLLSELTHMKNLYNDIIYFIQNHVSPASYDEQRSRSAILKLLELDSSPNVIRPAKSRITEKSLGTSSDEPNSSVKLFGVPLCGKKRLHPEKHCIEEACVQIN

SEQ ID NO: 227736 - protein, 60 aa, Glycine max
  Coding DNA Sequence Number=SeqID_110958
  Gene Ontology: Mol. function=catalytic activity; Biological process =metabolic process
  Homolog annotation: Hit_ID=Q84P23; Match level="QueryCoverage=86%, HitCoverage=9%, E-value=8e-15, Identity=69%"; Hit description=4 -coumarate-CoA ligase-like protein
MAFVVRQPQSLLDTTKVIDFVAKQVSPYKKIRRVAFVNSIPKNDAGKILRKDLKLALSRL

SEQ ID NO: 227737 - protein, 140 aa, Glycine max
  Coding DNA Sequence Number=SeqID_110959
  Gene Ontology: Mol. function=catalytic activity; Cellular component =peroxisome; Biological process=metabolic process
  Homolog annotation: Hit_ID=Q5N6Y8; Match level="QueryCoverage=82%, HitCoverage=24%, E-value=4e-28, Identity=51%"; Hit description =Putative 4-coumarate:coenzyme A ligase
MTIYRKQPRRADKFAHASCLLRDEGYGLTESAVTRITPEEANRVGATGKLIPSIEAKIVNPETGEAMFPGEQGELWIKGPYVMKGYAGDPKATSETLVDGWLRTDRLKELIKYKGYLVAPAELEELLLSHPDINDAAVIP

SEQ ID NO: 227738 - protein, 283 aa, Glycine max
  Coding DNA Sequence Number=SeqID_110960
  Gene Ontology: Mol. function=protein serine/threonine kinase activity; Cellular component=cytoplasm; Biological process=protein amino acid phosphorylation
  Homolog annotation: Hit_ID=Q1S707; Match level="QueryCoverage=95%, HitCoverage=51%, E-value=1e-144, Identity=90%"; Hit description =EPS15 homology (EH); Protein kinase
  Pfam annotation: Domain name=Pkinase; Domain location=1-117; Score= -51.4; E_value=1.7e-05; Accession=PF00069.15; Description=Protein kinase domain
  Pfam annotation: Domain name=efhand; Domain location=164-192; Score =35.1; E_value=2.4e-07; Accession=PF00036.22; Description=EF hand
  Pfam annotation: Domain name=efhand; Domain location=200-228; Score =35.2; E_value=2.3e-07; Accession=PF00036.22; Description=EF hand
  Pfam annotation: Domain name=efhand; Domain location=236-264; Score =32.2; E_value=1.8e-06; Accession=PF00036.22; Description=EF hand
  Pfam module annotation: Pfam domain module=Pkinase::efhand::efhand::ef hand; Domain location=1-117::164-192::200-228::236-264
MKHTLTWNSSLLTGEMFKDIVGSAYYIAPEVLKRKYGPEVDIWSIGVMLYILLCGVPPFWAESENGIFNAILRGHIDFTSDPWPSISPAAKDLVRKMLHSDPRQRLTSYEVLNHPWIKEDGEAPDTPLDNAVLNRLKQFRAMNQFKKVALRVIAGCLSEEEIMGLKQMFKGMDTDNSGTITIEELKQGLAKQGTKLTEQEVKQLMEAADADGNGTIDYDEFITATMHMNRMNKEDHLYTAFQYFDKDNSGYITIEELEQALVEFNMNDGRDMKEIISEVDADN

SEQ ID NO: 227739 - protein, 63 aa, Glycine max
  Coding DNA Sequence Number=SeqID_110961
MEGRTDKGKGDMWKDIGQGGVGVKKGWEEYQREALIGKSLRRVSCFERVKGYGTTQFKGFASC

SEQ ID NO: 227740 - protein, 156 aa, Glycine max
  Coding DNA Sequence Number=SeqID_110962
  Gene Ontology: Mol. function=isomerase activity; Biological process =protein folding
  Homolog annotation: Hit_ID=Q1S708; Match level="QueryCoverage=94%, HitCoverage=52%, E-value=2e-50, Identity=66%"; Hit description=PpiC -type peptidyl-prolyl cis-trans isomerase; Rhodanese-like
  Pfam annotation: Domain name=Rhodanese; Domain location=24-148; Score= 4.9; E_value=0.046; Accession=PF00581.10; Description=Rhodanese-like domain
MACKFAPLPDREESILQDIQPDELHMKIQDPSFLDEAQLIDVREPDEVFWNLPMLLIFILVADLFFLHLNDILNIHRAKASLPGFTVLPLRQFGSWGPEITTKFDPQKDTYVMCHHGMRSLQVAKWLQSQGFRKVYNLSGGIHAYAVQVDPSVPTY

SEQ ID NO: 227741 - protein, 228 aa, Glycine max
  Coding DNA Sequence Number=SeqID_110963
  Gene Ontology: Mol. function=protein serine/threonine kinase activity; Cellular component=calcium- and calmodulin-dependent protein kinase complex; Biological process=protein amino acid phosphorylation
  Homolog annotation: Hit_ID=Q1S707; Match level="QueryCoverage=99%, HitCoverage=42%, E-value=1e-94, Identity=77%"; Hit description=EPS15 homology (EH); Protein kinase
  Pfam annotation: Domain name=Pkinase; Domain location=74-228; Score =38.3; E_value=7.6e-11; Accession=PF00069.15; Description=Protein kinase domain
  Pfam annotation: Domain name=Pkinase_Tyr; Domain location=74-220; Score=-127.2; E_value=0.00012; Accession=PF07714.7; Description =Protein tyrosine kinase
  Pfam module annotation: Pfam domain module=Pkinase::Pkinase_Tyr; Domain location=74-228::74-220
MGNCCSGGTNDTEDKGESNQPTNNNNGGGGGGTTAPATTPPPSSKPNHPPSKHSKPPAIGPVLGRPMEDVKSTYSMGKELGRGQFGVTHLCTHKSTGKQYACKTIAKRKLVNKEDIEDVKREVQIMHHLSGQPNIVELVNVYEDKQSVHLVMELCAGGELFDRIIAKGHYTERAAASLLRTIVQIVHTFHSMGVIHRDLKPENFLLLNKDENAPLKATDFGLSVFYKQ

SEQ ID NO: 227742 - protein, 266 aa, Glycine max
  Coding DNA Sequence Number=SeqID_110964
  Homolog annotation: Hit_ID=Q10QF0; Match level="QueryCoverage=45%, HitCoverage=39%, E-value=9e-35, Identity=58%"; Hit description =Expressed protein
  Pfam annotation: Domain name=CRT-like; Domain location=62-167; Score=- 55.4; E_value=0.031; Accession=PF08627.1; Description=CRT-like
  Subcellular localization annotation: CTP_CleavageSite=9; ConfidenceScore=5.09e-01
MASLCRRLSAAAPAGHFRFHRPAGICAVRYGYSVRRPMRLVAAGTTVGGGAWVTSDDVGGREEKVGPCSYAVEDRRVAEDGGSDAVVGSRNRVVEVAAAAVATVVLGVGNRVLYKLALVPLKHYPFFLAQLATFGYVIVYFAILYIRHHAGIVTDEMLDAPKAPFIVVGLLEALAAATGMAAGAILSGASIPILSQTFLVWQILLSIIFLGRRYKVNQLLGCFLVTIGVVVTVASGAGAGNLLKEGGNYLFGFIPKIEGSHNSELF

SEQ ID NO: 227743 - protein, 66 aa, Glycine max
  Coding DNA Sequence Number=SeqID_110965
MVIALDGAHVRYVGCCVCSWGAKCIDLVGWPIRGGQAWLKNLRVESGAILYLRVESGCEYRIMNVV

SEQ ID NO: 227744 - protein, 91 aa, Glycine max
  Coding DNA Sequence Number=SeqID_110966
MRVEDQKVTINLFEAIKHPVEIPSGEHAFEDLKKENPTKKPKVELKASPTHLKYLFLEGNEAKLVVISNDLSSDEEAQLIKVLRKHKEAIG

SEQ ID NO: 227745 - protein, 73 aa, Glycine max
  Coding DNA Sequence Number=SeqID_110967
VPTSKIFYHLNAIVVSLAVDSDEPENLPWSLGLVYLTSMFLKHLIESAQDGDVKLYLALYDSESIPKNILRGM

SEQ ID NO: 227746 - protein, 289 aa, Glycine max
  Coding DNA Sequence Number=SeqID_110968
FDEFKEELERCHWDEELTDFMDDNIDVAIIKEFYANLYDPEDKSPKQPDPQELAAKLCIPGRGFELNVDGYPLKFLRKNMATLAQTWSVLSFSNLIPTSHTSDVTLDKAKLIYGIIMKIDMNLGYLISHQISLIAQHDTSRLGFPTLRVTFRGPRKARGKRSEAPSTSASEAPTPSSSTVPSSSSTQIPVIPPSMHRGQSIIMQSLQGLGLPSIMSMEEFNAQVAWPGDQPSSSGGGGASAAQEPETEEPPAPAEEQTIPVQTPQPSPSSAPAPEETQTSALDLNEDQP

SEQ ID NO: 227747 - protein, 140 aa, Glycine max
  Coding DNA Sequence Number=SeqID_110969
  Subcellular localization annotation: CTP_CleavageSite=55; ConfidenceScore=5.48e-01
MNSKQLAGSYLLKQQTTIDSQKSTASKVNNRQPQGSAIMQLRERFSSGVELRTAVQAEVANPKNPQRGTSNKTTQLDNSATTNHLRKDTSNNKGHGNANHATESTQKSASQTRIDVNAVDFLFNKFCFLNQILIEVQHFD

SEQ ID NO: 227748 - protein, 207 aa, Glycine max
  Coding DNA Sequence Number=SeqID_110970
  Gene Ontology: Mol. function=protein binding; Cellular component =integral to membrane; Biological process=vesicle-mediated transport
  Homolog annotation: Hit_ID=Q1S712; Match level="QueryCoverage=99%, HitCoverage=92%, E-value=9e-94, Identity=83%"; Hit description =Longin-like
  Pfam annotation: Domain name=Synaptobrevin; Domain location=123-207; Score=80.8; E_value=4.1e-21; Accession=PF00957.11; Description =Synaptobrevin
MGILYALVGRGSVVLAEFSGTTTNASAIARQILEKTPGNNDMHVSYSQDRYIFHVKRTDGLTVLCMADDTAGRRIPFAFLEDIHQKFVRTYGRAVHSAQPYGMNEEFSRILSQQMEYYSSDPNADRINRLKGEMSQLFKHRVRNVMIENIDKVLDRGDRLELLVDKTANMQGNTFRFRKQARRFRSTVWWRNVKLTYVLDLNLSLIS

SEQ ID NO: 227749 - protein, 623 aa, Glycine max
  Coding DNA Sequence Number=SeqID_110971
  Gene Ontology: Mol. function=GTPase activator activity; Cellular component=intracellular; Biological process=signal transduction
  Homolog annotation: Hit_ID=Q10L77; Match level="QueryCoverage=92%, HitCoverage=67%, E-value=0.0, Identity=67%"; Hit description =Pleckstriny domain-containing protein, putative, expressed
  Pfam annotation: Domain name=RhoGAP; Domain location=150-299; Score =155.1; E_value=1.9e-43; Accession=PF00620.17; Description=RhoGAP domain
MTVLHCHPITIQPLWNRLEVLEEAVSALPQRGGEVNLTLGGIDLNNSGSVVVREDKKLLTVLFPDGRDGRAFTLKAETSEDLLEWKTALEQALAQAPSAALVMGHNGIFRSDASDSIEGSFHQWRDKRPIKSLVVGRPILLALEDIDGGPSFLEKALQFLEKYGTKVEGILRQSADVEEVDRRVQEYEQGKTEFGPEEDAHVVGDCVKHVLRELPSSPVPASCCTALLEAYKIDRKEARINAMRCAILETFPEPNRRLLQRILKMMHTIGSHSQENRMTPSAIAACMAPLLLRPLLAGECELEDEFDASGDSSAQLLAAANAANNAQAIITTLLEEYENIFDEENIQRCSMSADSQVENSGSEDSTDDDNIDVKENGYHDAENEVDQETDDDADRIQSGKLSESSGYAGSDLYDYKAFGGDDSDVGSSSSNHAKTENANLNAVPDTPLSEDQNKQRKGSENPVDENDASNLLPSTESYRSMGEILSSMDPGNHLPMPVIESGSGKQTSKASSASFSSKRSTFWGRSNPRKTPSVESVDSSGEEELAIQRLEIAKSDLQLRIAKEARGNAILQASLERRKQALHERRLALEQDKLKMVSNEFSLCITTYARCGLLIVEPLYIDL

SEQ ID NO: 227750 - protein, 223 aa, Glycine max
  Coding DNA Sequence Number=SeqID_110972
  Gene Ontology: Mol. function=methyltransferase activity; Biological process=metabolic process
  Homolog annotation: Hit_ID=Q00TN0; Match level="QueryCoverage=96%, HitCoverage=25%, E-value=7e-38, Identity=36%"; Hit description =Homology to unknown gene
MKGYVVLNRPWAFVQWLEKADIEEEYILMAEPDHIFVNPLPNLAHGTLPAAFPFFYMNSYENVDIIRKFYPEEKGPVTDVEPIGNSPVIIKKSLMEEIAPTWVNISLRMKNDPETDETFGWVLEILAYACPCIKCESCMLSCCMPKLSTPYYLIQGELTYGKIGEWRFDKRYHLLGPPPKNLPLPPPGVPETVVQLVKMVNEATANIPEWDSINNSRGKDDKP

SEQ ID NO: 227751 - protein, 164 aa, Glycine max
  Coding DNA Sequence Number=SeqID_110973
  Gene Ontology: Mol. function=signal transducer activity; Cellular component=endoplasmic reticulum; Biological process=vesicle-mediated transport
  Homolog annotation: Hit_ID=Q10Q55; Match level="QueryCoverage=99%, HitCoverage=100%, E-value=7e-38, Identity=50%"; Hit description=Got1- like family protein, expressed
  Pfam annotation: Domain name=Got1; Domain location=30-119; Score =173.4; E_value=5.6e-49; Accession=PF04178.3; Description=Got1-like family
MVSFEMNDQKKIGLGLTGFGIFFSFLGIIFFFDKGLLVMGNILFVSGVSITIGLKSTMQFFVKRSNFKGTISFGVGFFILIMGWPILGMIVEAYGFIVLFSGFWPTLAVFLQKIPVLDVNDSDILGKEEKQQYLVNAKLKSSDAEFRKKSFKLFDRYRGKRMPV

SEQ ID NO: 227752 - protein, 752 aa, Glycine max
  Coding DNA Sequence Number=SeqID_110974
  Homolog annotation: Hit_ID=Q8W417; Match level="QueryCoverage=98%, HitCoverage=90%, E-value=1e-167, Identity=44%"; Hit description=Cig3
MLQLRYILYNSEFAAASSYYLQAATIWPSSGNPHHQLALLASYSGDELAAIYCYFRSLAVDSPFTTARDNLIVAFEKNRQSYSQFSGDVKALAVNGRGKGEAKLVTKDTGVETSRRKGGASNIQDTYKSFCTCLVRLNGILITHTSLETLTEVLSLLSANLRELLSSGQDEELNFGTDTLQNKLAIVRVVSTIIFTVHNVNKESEGQTYAEIVQHAVLLQNAFTVAFEFMSLVVERCMQLRDPSCSYLLPGILVFVEWLACYPYHAAGNDVDENQATVRSKFWNHCVSFLNKLLSVWSMSIEDDEEETCFNNMSRYEEGETKNRLALWEDFELRGFGPLLPAQTILDFSRKNSIGSDSEKERKARVKRILAAGKALANVVRIDQKMIYFDSKGKKFVIGVQPQISDDFVISSYSGMPNAEDLLKDNMVVDTKVGIGSPDHHQYIEGEEDDEVIVFKPIGAEKRADVVVSSSRAPHEGLESVPTASIGNIKFNVNSTSNPLNDVNHQISLPASVSAMVPQHQQPVQPHSSRWLEEEISLSNSLKGLRFLENGHVMKPDLPFKAAVAISDCAALAVLAIASSGTFTENSVVKTSSTLQAGLKKSPVNRPSRHLGPPPGFSHVPPKQCSEPTVSDLISGNPIMDDYSWLDGYQLPASTNGLGPNGPLTYSQSNSRQVGNNGLSGTVSFPFPGKQIPSTLQVEKQNGWQDFQTSEILKAHHNQQLQSQLLPNGNQYFTPLPDQFQGQSIWTGQYFT

SEQ ID NO: 227753 - protein, 90 aa, Glycine max
  Coding DNA Sequence Number=SeqID_110975
  Subcellular localization annotation: CTP_CleavageSite=48; ConfidenceScore=5.07e-01
MLSQPTLRRKGDARAHGCIFQGRKMRGVATNVYSRKTSEKPKKVWSTKSVKRFGSYFYARGRSMLTNKSKEDRLRHWTLKRFSVIFADKA

SEQ ID NO: 227754 - protein, 491 aa, Glycine max
  Coding DNA Sequence Number=SeqID_110976
  Gene Ontology: Mol. function=oxidoreductase activity; Cellular component=integral to membrane; Biological process=electron transport
  Homolog annotation: Hit_ID=O81211; Match level="QueryCoverage=94%, HitCoverage=48%, E-value=1e-180, Identity=66%"; Hit description =Respiratory burst oxidase protein E
  Pfam annotation: Domain name=FAD_binding_6; Domain location=163-255; Score=-20.6; E_value=0.062; Accession=PF00970.14; Description =Oxidoreductase FAD-binding domain
  Pfam annotation: Domain name=FAD_binding_8; Domain location=161-279; Score=169.9; E_value=6.5e-48; Accession=PF08022.2; Description=FAD -binding domain
  Pfam annotation: Domain name=Ferric_reduct; Domain location=2-120; Score=26.2; E_value=1.7e-05; Accession=PF01794.9; Description=Ferric reductase like transmembrane component
  Pfam annotation: Domain name=NAD_binding_6; Domain location=285-474; Score=270.0; E_value=4.6e-78; Accession=PF08030.2; Description =Ferric reductase NAD binding domain
  Pfam module annotation: Pfam domain module=FAD_binding_6::FAD_binding_ 8::Ferric_reduct::NAD_binding_6; Domain location=163-255::161-279::2 -120::285-474
FSNSLKCQIIAFAIAVGIAVHAGNHLACDFPLLVNSSPEKFSLISSDFHNKRPTYKSLLTGVEGVTGISMVVLMAISFTLATHHFRRNALRLPSPFNRLTGFNAFWYSHHLFGLVYVLLLVHGTFLYLTHRWYQKTTWMYISVPLLLYLAERTLRTRRSAHYTVKILKVSGLPGNVFSLLMSKPNGFKYKSGQYIFLQCPKISPFEWHPFSITSAPGDDCLSVHIRTVGDWTQELKHLLTKEDDKLPSVNCHAKFGELMQLDQRGQPRLLVDGPYGAPAQDYQNFDVLLLIGLGIGATPFISILRDLLNNTRAMDELVVQESNTETSQTTRSDESSNSFTSSNVTPGGSKRSRRTTNAYFYWVTREPGSFEWFKGVMDEVAEMDHKGQIELHNYLTSVYEEGDARSTLITMIQALNHAKHGVDILSGTRVRTHFARPNWKEVFTKIASKHPFSTVGVFYCGMPVLAKELKKLSLELSHKTTTRFEFHKEYF

SEQ ID NO: 227755 - protein, 539 aa, Glycine max
  Coding DNA Sequence Number=SeqID_110977
  Gene Ontology: Mol. function=serine-type endopeptidase activity; Biological process=proteolysis
  Homolog annotation: Hit_ID=Q368E2; Match level="QueryCoverage=98%, HitCoverage=74%, E-value=1e-114, Identity=41%"; Hit description =Hypothetical protein precursor
PNARVFVLDQITDVTTQAKAAIAAAGNDPLARSRALDAFDKAQVAACEADAGFRCRLYSFSGGNTYRLFRNMEIKDVRLVYAPPGSVGKFGGDVDNWMWPRHTGDFSFYRAYVGKDGKPAAFAADNVPYQPKHFLKFADQPLGADDFVMVAGYPGRTNRYALAGEFNETASFTYPTIAKHYNAVLKMIADAGKADADVKVKYAATAASMNNVAKNYLGQLEGFKRIDAAGQKQAEEAAVLAWLKKQGAAGKPALAAHAQLLKHLDTSKSTRERDLFVGQFNNTSAVGAAITLYRLSIERSKPDAEREAGYQERDLTTIEGGLKQMDRRYVVKMDQQLQAYWLEQYVALPAAQRDNEVLNKWLAGSDAAAVKSLVAKLGGTGLGSLDTRLKWFKADRAAFEASSDPAIQYAVAVMPALLKQEEQKKIREGESLTARPLYLQAVADYKKSQGEFVYPDANLSLRITFGNVMGYGKDGVKYTPFTTLEGVAAKETGEDPFDSPKALLDAVKAKRYGGLEDKRIGSVPVNFLSNLDITGWQLR

SEQ ID NO: 227756 - protein, 347 aa, Glycine max
  Coding DNA Sequence Number=SeqID_110978
  Gene Ontology: Mol. function=transporter activity; Cellular component= outer membrane; Biological process=transport
  Homolog annotation: Hit_ID=Q8P7N9; Match level="QueryCoverage=99%, HitCoverage=34%, E-value=1e-149, Identity=73%"; Hit description=TonB- dependent receptor
ADESIVATDADGVVESGLAEEGRFRLGVLAFEEQAVLVVQVEVGDGVDAQAVELRLQVGNSVQIGEVTVDARGRADHWPIETVAAEAAIRIEVIAVLVGVGLGEIERATGLERTAVGGGVVAARAGQDGLRVALARRLGAIEIRIGHGHVVAFTDRTVATAETILLAVLDRHGDIASAVGEIGARGSRHEAAIEAAFARNTLLRAGLEALVVLLHDEVDHAGHGVGAIDGRCAAGDDFNALDPLHRDGVDVDRGAAGIGTDMATAVDQHQGTVVAHAAQVHQAQAGGTDVASGVAEGERRCQLRHLVHQVADGQRAGLADFFGGDGGNRRGCHEARTRDARAGHADP

SEQ ID NO: 227757 - protein, 142 aa, Glycine max
  Coding DNA Sequence Number=SeqID_110979
  Gene Ontology: Mol. function=ATP-dependent DNA helicase activity; Cellular component=intracellular; Biological process=DNA recombination
  Homolog annotation: Hit_ID=Q9ZVG0; Match level="QueryCoverage=98%, HitCoverage=16%, E-value=3e-47, Identity=67%"; Hit description =Putative ATP-dependent DNA helicase RECG
  Pfam annotation: Domain name=Helicase_C; Domain location=1-63; Score =34.4; E_value=4e-07; Accession=PF00271.21; Description=Helicase conserved C-terminal domain
MKSEEKEETLRKFRTGEIHILLATQVIEIGVDVPDASMMVVLNSKMFGIAQLDQLRGRVGHGTRPSKCISVASAASSLNRLKVLEQSSDGFYLANMDLLLWGPGDLLGKKQSGYLPEFPVARLEVDGNILQDAHVAALVIVE

SEQ ID NO: 227758 - protein, 97 aa, Glycine max
  Coding DNA Sequence Number=SeqID_110980
MIYHTKFDEFKTELERRNWHKELTNFLDGSIDVAIVKEFYASLYDPEDKSPKQVRVRGHLIKFDEDALNTFLKTPVIIEEGESLSAYSRFCRLRPDP

SEQ ID NO: 227759 - protein, 95 aa, Glycine max
  Coding DNA Sequence Number=SeqID_110981
MTQSINVKHVLIEASLPVSLHSLGVLDLDLALQVEKPATITDASNNEEKTHYKAWEKSNKICLMLMHISITNNIKSALPKTESAKEFTKSVEECS

SEQ ID NO: 227760 - protein, 795 aa, Glycine max
  Coding DNA Sequence Number=SeqID_110982
  Homolog annotation: Hit_ID=Q1SKH2; Match level="QueryCoverage=92%, HitCoverage=58%, E-value=1e-139, Identity=53%"; Hit description =Calcium-binding EF-hand
EGAVPSNGAVESEVEPSNGAVDSEAESSNVAVESEAESSNVAVESEAESSNGAVESVAEPSNDAVESGAEPSQGAVESEAEPSNGAVESEADPSNGVAESENEPSVDVCETKNDAVNSEAETSSGGLQSEKEASVVSEMKNNAVESEAEHSKGAVECEAQPFVDVSQKKTDTIEGEAELSVKGGLSVEGEGSNQGDEDSRPASDALDGQNVGAEVVEKPFYYLIRVPRYDDDGNMKEKIRNALHQVEEKSKIRDAIRAESQTIKASCKDFDQEFRAAIAAHRAARDLLKSKRQEMDSVQSTMNRLNNAISVGDIDGKIRSMEHMIEHETLPLNKEKQLIREIKQLKQNREELSSNMKRQDQSQQSLENKDDNIEEHFKHLQLLKKEMEVLRNNVLKSDAETKAAKKKYNDECDKLNELLARFRAADDTRQEAYAKLLALKKQLHEKSKNFWEYRDAATKAQELAAGGKKEELQCFCVDEVERIMELWNKNDEFRRDYVRCNTRSTLRRLQTLDGRSLGPDEEPLVMPNAITERASKNIPMVSNTTMEQEKKSPRESVNVKDEPDSKVVAQRTETSQTTKAKKPTKPAPLEKHVARWGDESDEDEDKDKNEEEPVRTKEEEELILKAEKARKEEEEAKLKEKRRLEEIEKAKEALQRKKRNAEKAQQRAALKAQKEAELKEKEREKRAKKKERRKTSSAVTAENTEQESAHTTETLTSVEESDLTEKPAEVTKKPQKPSQFTRQTKVKSVPAALRNRAKRRIQPWMWVLIAVVVVVALFYVGNSSSLRSSLEGFGY

SEQ ID NO: 227761 - protein, 122 aa, Glycine max
  Coding DNA Sequence Number=SeqID_110983
RGGFGDGFGADIENPIPDPEPEFGYRGKSDPDPDPGQLRSSPSKSGRAPRVRAPRIVSTNKALIQDFFKIKPCLTMKGFKSFKAHVIDYQYMIPEHKGWVVSVWLRLCNGFYKDSGNLKWVA

SEQ ID NO: 227762 - protein, 109 aa, Glycine max
  Coding DNA Sequence Number=SeqID_110984
MSEIEEVQEQMKADMEAMKEQMTTMMEAMMSMRKMTEDNTATIFNQVNRPVSDVVGQGDEAKKNAYRPHHNISNFAPVLIENQQPQSDHAHVSQPMGETHEVPQDHTLT

SEQ ID NO: 227763 - protein, 183 aa, Glycine max
  Coding DNA Sequence Number=SeqID_110985
MTCKITTKRDDYYMPLNASQGTILYEIMNVELKDVGLDVPKPLRTRNDGRDQSKYCRYLHAIGHDTVNYFQLKNAIGILTRWGKLDKYARDREGNYKPRYDRLNSDKQIERSRSPNRHQIRGRSRECSSRYRYRTPEREVENYMQTIHQDGYDSKHKSEQLEEKLEESQGTTRDTVNASGLHT

SEQ ID NO: 227764 - protein, 90 aa, Glycine max
  Coding DNA Sequence Number=SeqID_110986
MDILIVPSHNDPLLVKDFINNKKSKLLPYNDGLIGFSSLHIVEAMPSKGTSTRFKENKGGYIPCGSLLVKGFLQGWKRNLKDRRSLGDWM

SEQ ID NO: 227765 - protein, 84 aa, Glycine max
  Coding DNA Sequence Number=SeqID_110987
MVAVLGAPYNNEGCQWREEQLMVGDNILVVTVLLRWFHHGQCASFSCSLPLHDFVIAGLLLMSLVAPLVLDAVQVAMRGLWFGT

SEQ ID NO: 227766 - protein, 69 aa, Glycine max
  Coding DNA Sequence Number=SeqID_110988
MEDRGWEKSKGVEGQMFWGGEEELLVAKLIDVDTRRWDMKMVKEIFLEWESEKIFSMPLRYAQNEDSQF

SEQ ID NO: 227767 - protein, 89 aa, Glycine max
  Coding DNA Sequence Number=SeqID_110989
  Subcellular localization annotation: CTP_CleavageSite=63; ConfidenceScore=5.18e-01
MGVQIATRPTWALQKIPPEGCCFWRKQPCSPGRAGKSEPRLFRNVSVSDFAKVFDRSSTFFIRSSSFFSLQRGLGCDSWRLHWGLFLES

SEQ ID NO: 227768 - protein, 231 aa, Glycine max
  Coding DNA Sequence Number=SeqID_110990
  Homolog annotation: Hit_ID=Q8H6Q8; Match level="QueryCoverage=68%, HitCoverage=6%, E-value=3e-10, Identity=25%"; Hit description=CTV.20
MEKVTPSDPRPAPIIEKIKHDNSRKVEITFNRRNSFSSRIEASRSEYESARRSFSVRTRSIPVGLTRSESHNQFPTVNLQGLDTTSSIPRATYNQEQEDDQNIDKEPQQRWFFQNFKGTNRQQIQDKFYEFVERVKINILFFDWFHAYTIIEDIDYPWKQDIIGDPTTNVITNWQLKDDELIQADLPPATQYQLPNIKDSSNKPVMAIPFKMKDINEEVTYRDIRSLMEPG

SEQ ID NO: 227769 - protein, 118 aa, Glycine max
  Coding DNA Sequence Number=SeqID_110991
RAYIYLGCDTEYKRGYISCGSIQVECTSTWLFKENKEAYIPCGSLLVKDFTRLLEISRTGGCLGTGYRHGPLDPTDCIVPHHASSPRGLLRTTLMGIDRNVSHRTPCPRGLLRTTLMG

SEQ ID NO: 227770 - protein, 92 aa, Glycine max
  Coding DNA Sequence Number=SeqID_110992
MGKFAFPRHHYSGNNDDYIGGNGDGHGGNHIVGGCGDDLDWGLGLCYNKCVIVSVEFVYNVYLILVDGYSLPRRRLRNTVSWSLSLPEFVSL

SEQ ID NO: 227771 - protein, 74 aa, Glycine max
  Coding DNA Sequence Number=SeqID_110993
MEYGGNFVNQLNVGPFKEVRKIQHKTKPLLVCRLTWGCLRVPATMGVIAKVRTIELSGVSPCQSSLDVPHKSWA

SEQ ID NO: 227772 - protein, 266 aa, Glycine max
  Coding DNA Sequence Number=SeqID_110994
  Gene Ontology: Mol. function=RNA-directed DNA polymerase activity; Biological process=RNA-dependent DNA replication
MGRFSKVTLNTKGLHLVVSPHHLITTLRPEPFLNSLCKNPTSDMDELHQMAAKWEENETRLVQGKRSLTTKAPTPPMVDKQKHYHFHQNYDHTTEECTTLKDKIKDLIRDGHLKDFLHKPPATKNSYDHRRNHVRTIEGKIPNVVDMIEEMTIVIQDDDFKGLDPMQEDLMVITMEVDNCMVMKTLINQGSSVDILYWPTFQKLEIPEAEIKPYDDQPIGFSGKGSYNILLERPSRIALRAIVSTPHLAMKFPSIEERITIFIMLR

SEQ ID NO: 227773 - protein, 83 aa, Glycine max
  Coding DNA Sequence Number=SeqID_110995
MKASSLFDFVAVDFSLYSFFAVNIIGARGLTGKTCRLESCLGYMDAKECYLVEGSFGWEERLLADLVIGEIFWLYGNSNVKMK

SEQ ID NO: 227774 - protein, 158 aa, Glycine max
  Coding DNA Sequence Number=SeqID_110996
MASQSSRDQTDIENCFDRALAGFYSAIGKNLESLQPARVILAIVDPALIVVSKRASALIARKSSVLKPPTQFALVIVLSLELSVWIVWGDWIPLRSRRHRDPLSPMDVRIFSPLLLDVQSTLDVSMLLEPVSPSNNTSDRLHGRPAALPHWLLKNCSS

SEQ ID NO: 227775 - protein, 87 aa, Glycine max
  Coding DNA Sequence Number=SeqID_110997
  Homolog annotation: Hit_ID=Q84YP7; Match level="QueryCoverage=89%, HitCoverage=17%, E-value=6e-16, Identity=52%"; Hit description =Putative UVB-resistance protein UVR8
MSYTKIQKERYAVALDSNGFGYCGALGHRDEIEKTTPELLTSLKNQLVVQVCARKRKTFVLVNYGSVYGFGSMGFGSLGFLDRRVSD

SEQ ID NO: 227776 - protein, 67 aa, Glycine max
  Coding DNA Sequence Number=SeqID_110998
MENYCPVLRVVKLTGVRIGGYISFDNTDGGTSRLRSRAQPFATSPIGEPVQVTMILPPPPQLLFLRE

SEQ ID NO: 227777 - protein, 75 aa, Glycine max
  Coding DNA Sequence Number=SeqID_110999
  Subcellular localization annotation: CTP_CleavageSite=66; ConfidenceScore=5.07e-01
MGSALSGVEKSLEISEKNCFGEKNPSRGASVTLSRHFRKQFRGDSSPFFTVLHRSSVFNRRFCRPPQEIVNGPTP

SEQ ID NO: 227778 - protein, 94 aa, Glycine max
  Coding DNA Sequence Number=SeqID_111000
MAQVVEGKVEAQHPKFRQTQVVGGSSMMDKRSSVTRDDLGRNISRDGDGDNIESCQVCGTLRWRWTEVPYIHQLYDVRQMGLWGRANLGNKTVD

SEQ ID NO: 227779 - protein, 68 aa, Glycine max
  Coding DNA Sequence Number=SeqID_111001
MEESHRENNKYNISQSRGSTPGDEEHIGEWRNPIGKITKITFPGEEGPLLTVKNTLENGGIPSGKQQI

SEQ ID NO: 227780 - protein, 183 aa, Glycine max
  Coding DNA Sequence Number=SeqID_111002
MGLNQAPTFKKRFYHVKIKSIEVASLQKLGQRMNQLQRQAFCKTYGMIWDLVMIEVFVEAISSFAQYYDESLRDLGMLARRKKAISLFWVISLHGEDSQSGQNLGTRIGPGEWASFINVLALLVFRVVLFPNVDGLVDLAAIDTFLAYHHSKESPIVAVLADAYDTFDRRCEKSGARIVCCTP

SEQ ID NO: 227781 - protein, 68 aa, Glycine max
  Coding DNA Sequence Number=SeqID_111003
  Subcellular localization annotation: CTP_CleavageSite=29; ConfidenceScore=5.84e-01
MVFGASAAFRNTSVKFPKTLGKSKPRRFRNASVSDSVEILHRSSPFFIRSSFVLRSSTVFFSSVFNVL

SEQ ID NO: 227782 - protein, 124 aa, Glycine max
  Coding DNA Sequence Number=SeqID_111004
FTFIKEFISHRDLMMQTYPPKVLDKRLQEDWARAAKEGLRVLMNPTHPLQASYPRDILGGEAPSSKGYSLMVGASSKLFYLWLPLHLHGGKSPLKDLIEAQRSNLHRSFKCKLPSCGIRASSSK

SEQ ID NO: 227783 - protein, 92 aa, Glycine max
  Coding DNA Sequence Number=SeqID_111005
MKGRRHKYGFNNNEREKAQKKRVVDDETADKHQLDERGTSNNLKVVHSGTKEFKIASNKRDLFLGFSEHQERLRKKLALEEGRIFAANEQVS

SEQ ID NO: 227784 - protein, 240 aa, Glycine max
  Coding DNA Sequence Number=SeqID_111006
  Gene Ontology: Mol. function=protein binding; Cellular component =cellulose and pectin-containing cell wall; Biological process=xylan catabolic process
  Homolog annotation: Hit_ID=Q949G7; Match level="QueryCoverage=99%, HitCoverage=64%, E-value=7e-55, Identity=32%"; Hit description =HcrVf3 protein
  Pfam annotation: Domain name=LRR_1; Domain location=103-125; Score =11.2; E_value=2.2; Accession=PF00560.23; Description=Leucine Rich Repeat
  Pfam annotation: Domain name=LRR_1; Domain location=127-149; Score =12.8; E_value=1.2; Accession=PF00560.23; Description=Leucine Rich Repeat
  Pfam annotation: Domain name=LRR_1; Domain location=199-221; Score =7.9; E_value=9.6; Accession=PF00560.23; Description=Leucine Rich Repeat
  Pfam annotation: Domain name=LRR_1; Domain location=223-237; Score =1.2; E_value=1.7e+02; Accession=PF00560.23; Description=Leucine Rich Repeat
  Pfam annotation: Domain name=LRR_1; Domain location=30-52; Score=8.1; E_value=8.6; Accession=PF00560.23; Description=Leucine Rich Repeat
  Pfam annotation: Domain name=LRR_1; Domain location=54-76; Score =10.5; E_value=3.1; Accession=PF00560.23; Description=Leucine Rich Repeat
  Pfam annotation: Domain name=LRR_1; Domain location=6-25; Score=11.6; E_value=1.9; Accession=PF00560.23; Description=Leucine Rich Repeat
  Pfam annotation: Domain name=LRR_1; Domain location=78-101; Score =11.5; E_value=2; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=103-125::127-149::199- 221::223-237::30-52::54-76::6-25::78-101
MDKPMQLEFLNLASNNLSGEIPDCWINWPFLVEVNLQSNHFVGNFPPSMGSLAELQSLEIRNNLLSGIFPTSLKKTSQLISLDLGENNLSGCIPTWVGEKLSNMKILRLRSNSFSGHIPNEICQMSLLQVLDLAKNNLSGNIPSCFRNLSAMTLVNRSTYPLIYSHAPNDTRYSSVSGIVSVLLWLKGRGDEYGNILGLVTSIDLSSNKLLGEIPREITDLNGLNFLNLSHNQLIGPIPE

SEQ ID NO: 227785 - protein, 195 aa, Glycine max
  Coding DNA Sequence Number=SeqID_111007
  Homolog annotation: Hit_ID=Q7CPZ2; Match level="QueryCoverage=59%, HitCoverage=73%, E-value=7e-42, Identity=74%"; Hit description =Putative oligoketide cyclase/lipid transport protein
  Pfam annotation: Domain name=Polyketide_cyc; Domain location=10-132; Score=103.1; E_value=8.2e-28; Accession=PF03364.10; Description =Streptomyces cyclasedehydrase
  Pfam annotation: Domain name=UPF0125; Domain location=106-189; Score =182.3; E_value=1.2e-51; Accession=PF03658.5; Description =Uncharacterised protein family (UPF0125)
  Pfam module annotation: Pfam domain module=Polyketide_cyc::UPF0125; Domain location=10-132::106-189
MPQISRTALVPFSVEQMYQLVNDVKSYPDFLPGCTGSRVLEAGPTQMTAAVDVSKAGISKTFTTRNTLTDNQSILMSLVDGPFKKLIGGWKRSPRAPKRCIVSANIVVEVAYALPEKQYLQRVKLQAGATVEQAIISSGILALREDIDLAKNKVGIYSRPVKLHDEVHDGDRVEIYRPLIADPKELRRQRAEKQR

SEQ ID NO: 227786 - protein, 46 aa, Glycine max
  Coding DNA Sequence Number=SeqID_111008
  Subcellular localization annotation: CTP_CleavageSite=22; ConfidenceScore=5.41e-01
MDKSLIGGSPSSSPSASSTISSSSTESSTGSSANSSANCGLNAFTF

SEQ ID NO: 227787 - protein, 72 aa, Glycine max
  Coding DNA Sequence Number=SeqID_111009
MSCAGSLSAPLHLTKCTASVHPLSEKGTRLPGYGKPLLVTIGAKTSGKGWMRFRGAGATIGAEATTTPNIDI

SEQ ID NO: 227788 - protein, 131 aa, Glycine max
  Coding DNA Sequence Number=SeqID_111010
MLETKLKGKAQVEAIISLAENWLHGYAKSKVQLCCPILKQEYMSIASCCAQLLWIKNQLEDYNIYESKKHKPKHSTTSNEATSRENDASDVVVVYSTSSSPIPLNYAFPTTVTRDQNQEMIGQAMDSFAKR

SEQ ID NO: 227789 - protein, 645 aa, Glycine max
  Coding DNA Sequence Number=SeqID_111011
  Homolog annotation: Hit_ID=Q1SNK3; Match level="QueryCoverage=95%, HitCoverage=97%, E-value=0.0, Identity=59%"; Hit description=Calcium- binding EF-hand; UBA-like
  Pfam annotation: Domain name=UBA; Domain location=175-214; Score =38.0; E_value=3.3e-08; Accession=PF00627.21; Description=UBATS-N domain
  Pfam annotation: Domain name=UBA; Domain location=239-279; Score=3.4; E_value=1.7; Accession=PF00627.21; Description=UBATS-N domain
  Pfam module annotation: Pfam domain module=UBA::UBA; Domain location =175-214::239-279
  Subcellular localization annotation: CTP_CleavageSite=69; ConfidenceScore=5.39e-01
MDKYCTTDTMSPSAKSKSKSQEKASARGGKEQHKTSPKTSKSPTHGSGTPASAHNPISGTFQTPETSLVASSTQVHDNSHFPKIDDADEHSRSPQGMVSECDSVSNNGSCSGESEESKEKVTVTNSSTQPDSILGCDNDRREKIRLKNERKHQRQRERRAQELHDRCCGYLMSRKLESLAQKLVAMGFSSERATLALMLNDGKLEQSVSWLFEGSEEQSQSKDTTSLISEGNMKIDIRDELAQISALEVKYNCSKQEVERAVVACEGDLQKAENTLRTQNQEFPTTQSKSEDSAQNNSSLVRSQGSPAASVSMQHRGNENDFNHYNRVGGSDSMFPDVETGNVHSLQSNHPNLMTEKRWSGVPGSSLSAMFAMAPSMQAVPPFVKMEGGWPISLANEGRMIQQGVGREPVMMQHPQFTNAKQNSMMSLNSFPSGAAGWYANSIPGADNVRSNGKLLQTQSIRSVSPNHLEQFCQAPYREYSHFLGPVDYSSAGVGGYCKPMGASSSPPPTIPPRHQGSWSTGASSPSLMVPTSLGLFSGHQNAARTFNSHSHMDWNTVGFMPEFDYSSIDWSLNAPSSSVSGGLWLGISSMLRNSYGDRRGSQCMSGLQMARETSSSGGLREWTTPFAGKDIFRVPRQFVTSPPM

SEQ ID NO: 227790 - protein, 118 aa, Glycine max
  Coding DNA Sequence Number=SeqID_111012
  Homolog annotation: Hit_ID=Q1SX80; Match level="QueryCoverage=32%, HitCoverage=9%, E-value=9e-07, Identity=66%"; Hit description =Zinc/iron permease
MGISAMPARRMEMMVTNLRTNAAYSSRHSSIFVPPQLEFIIDSRRGNCRAHYCKMSSPIHHIYGPRHFDRHHLPIFLQFGVILTVATTTASSSQLIHNRKPNGGFKSNSDKINHPHQT

SEQ ID NO: 227791 - protein, 91 aa, Glycine max
  Coding DNA Sequence Number=SeqID_111013
MELWLVDGEGGVYLALGPSGIFWREVALGGSYLARLGELGGNHLPHFCYKMLFGVEGKGFSTLDIQFSLKISEEKKKEGQNPSRGTSIMLP

SEQ ID NO: 227792 - protein, 317 aa, Glycine max
  Coding DNA Sequence Number=SeqID_111014
  Homolog annotation: Hit_ID=UPI000054868A; Match level="QueryCoverage =65%, HitCoverage=27%, E-value=5e-10, Identity=29%"; Hit description =PREDICTED: similar to Targeting protein for Xklp2 (Restricted expression ...
  Homolog annotation: Hit description=proliferation associated protein 100) (p100) (Differentially expressed in cancerous and noncancerous lung cells 2) (DIL-2) (Protein FLS353) (Hepatocellular carcinoma -associated antigen 5... iso
AVSKETRLERLENVDDLMSYQMIFNKHDIRVCYYKHCNEIITNAYEKRDTLYMCTGFNEKSPYPVVVLQTVMNLIWQKQNWMTVFASLLYQLFPSNVDEIGVWSLQEPKTPLLQTSLRAHPPKVKTSLELEQEELEKIPKFKAIPLNKKIFESKGDIGVFCLTKKHVSEPQEFHFATDERIPPPAAMADLFGKLSLNSEPSRNHNPIPRNTTPNPFHLHTEKRGAEKEKKLAMDLLQKQWEEENARIPKANPYPYTTDYPVIPAKPEPKQCTRPKPFQLESLVTHEDEMQKEHKERHIMEKEEAQMRAFKAQPIIKE

SEQ ID NO: 227793 - protein, 64 aa, Glycine max
  Coding DNA Sequence Number=SeqID_111015
MHGHQTGSRRQPHLRPSIFFHEDEKKSAFKVDVLLLPFNFFSNQKLPFMVIKSEVEDNFISFHS

SEQ ID NO: 227794 - protein, 993 aa, Glycine max
  Coding DNA Sequence Number=SeqID_111016
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=88%, HitCoverage=90%, E-value=3e-95, Identity=45%"; Hit description=Chromo
  Pfam annotation: Domain name=Chromo; Domain location=866-920; Score =27.0; E_value=6.9e-05; Accession=PF00385.14; Description='chromo' (CHRromatin Organisation MOdifier
  Pfam annotation: Domain name=rve; Domain location=688-831; Score=3.0; E_value=0.0033; Accession=PF00665.16; Description=Integrase core domain
  Pfam module annotation: Pfam domain module=Chromo::RVT_1::Retrotrans _gag::rve; Domain location=866-920::384-612::84-174::688-831
  Subcellular localization annotation: CTP_CleavageSite=40; ConfidenceScore=5.38e-01
MDLMQRTIDMLIKNQTTTNGGSNSKGRNSSTPVASPSPISINSGVKEISLGFPHFDGHTPVMEWIFKAEKFFNYHNTPNQDRVDIASIHFEKDVISWFQMLQRMETVNTWTELRRALESQFGPLLFDCPMAELFKLQQQGTMADYYLKFMSLAHRFDGLTPEALLNCLISGLNKDIRRDVVAQAPNDLLRVVALAKLYEEKYVTVPITHPIPFSPRYSNLSSSNTHNNVQKNPVKNSLPPLLPTPNNDDAELEFYDSEDIFDSVADNAKVILEDHHLSLNALKGGMGVGTIRFMAYIGKLLVKVLVDGGSSNNFLQPRVAKFLKLPVEPTPFFKVMVGNGNYMEAEGMISKLTIKAQNAKFQLPVLLLPVSVDGYQPVKVKPYRYPHSQKEEIEKFVNGMLEKGIIQPTLNAITIKDTFLIPTIDELIDELYGAVFFSKLDLRSGYHQILLNSKDRHKTAFRTHHGHYEWLVMPFGLTNAPTTFQSLMSDIFKGALRRFVLVFFDDILIFSPSWKDHLSHLEFVLSILKQHQLFARFSKCAFGPLPNSLKQLRGFQGLTGYYRRYVKGYATIATPLTDLLKNDSFKWSASATTALNKLKEIMTSAPVLAIPNFKEPFVLETDASGTGIRAYKPGRENVLADALSKSFSMAWSEVVGVWMTQVATLMKEDAILAALYKQCIEGTMSGTEYTVNNGLLFWKGKMMIPSNEALKHKIIHEFHVSKIGGHEGVTKSVSRIRKEFYWPKMQQDIRDFVKKYSIFQEAKGTTLAMSSAYHPPSDGQTEVLNKTLEMYLRYFVFDHPKTWFEMLPWAQLWYNTFFHHNIGMSPFKAVYGRDPPSVIPYECNLKDPLKSALPLPLTVGESGPMVQPIAVLDSRVLLRDSSQVEQVLIQWEIAGPEEATWEDVTWVKASYPHFNLEDKVVYKGEGNVTCGKQEGKLVRESVTKEGHVADDLHVGVMLMVNTLPDCFSDPSDISFFSIPSLNLSALPNLQVLL

SEQ ID NO: 227795 - protein, 123 aa, Glycine max
  Coding DNA Sequence Number=SeqID_111017
MPMRVNSNGRTELPSNGSTQLVSPLPMAHTHQNLLWWLPNLPTTSIMLPADQEQHGVNFQIDSRSFDDNKDDDKKLKSQDHFMITKMMTFKNEFKIESRTLQGSRGNLISRIKNQESRFKIQE

SEQ ID NO: 227796 - protein, 357 aa, Glycine max
  Coding DNA Sequence Number=SeqID_111018
  Gene Ontology: Mol. function=protein transporter activity; Cellular component=nuclear pore; Biological process=protein import into nucleus, docking
  Homolog annotation: Hit_ID=Q1RYT8; Match level="QueryCoverage=90%, HitCoverage=80%, E-value=6e-86, Identity=46%"; Hit description=IMP dehydrogenase/GMP reductase
MATSSETEPKSFKEASQLDKWIKAMNAEIEALEANHTWILTDFPPNKSAIGCKWVYKVKHKVDGSVERYKVRLVAKGYTQIEGQDCLDTFSTMVKITTVRLLLALAIVNNWHLKHLDVNNAFLHGDLNEEVYMTLPPGSLVALFTSPIQGPISYAMQHLSQFVAHPSSVHQQAAYRILRYLKAELGSSIFFSASSILHLKAFSDSDWAGCIDARRSIIGYSVYVGNSLISWKSKKQATVSRSSSEAEYRALASATYELQWLTHLLNDFGIVYTRLALLFGDNCSAFHIVVNPIFHEHTKHIEIDCHIMREKLHSGLIKLLTIAFAQQLADIYTKALSPGAFNFLRCKLGMSDIHSPT

SEQ ID NO: 227797 - protein, 226 aa, Glycine max
  Coding DNA Sequence Number=SeqID_111019
  Gene Ontology: Mol. function=DNA binding; Cellular component=beta -galactosidase complex; Biological process=DNA integration
  Homolog annotation: Hit_ID=Q2HRM8; Match level="QueryCoverage=80%, HitCoverage=14%, E-value=7e-40, Identity=43%"; Hit description =Polynucleotidyl transferase, Ribonuclease H fold
MFQVQRLVIMAKTLKSLSNSIKHLCLCWLPTIIVLMDHRLTKLDISSQRMIGKVDVVEGLYKLRIPAANSVPKANNNFISIKYVLSCNKEVIDIWHFRLGHPSYDRMQLLKQTYPMLTCDKTFVCDTCHKAKQRKLPFPNSDSYASSPFSLIHVDIWGPCTTTTLNGHKYFLTIMDDHTKFVWIFIMTSKAQTQTHLQAFVSYVERQFNTKVKAIRSDNGAKFIMK

SEQ ID NO: 227798 - protein, 90 aa, Glycine max
  Coding DNA Sequence Number=SeqID_111020
  Homolog annotation: Hit_ID=Q20CD0; Match level="QueryCoverage=89%, HitCoverage=37%, E-value=1e-07, Identity=36%"; Hit description =Fgenesh protein 81
MKKAIARGSKAKQKAKKRQVEEKAIAGVSVTSQLEDTKVSKAKQRRDKRSQQEAEREQRIQAEQSDIISDRVIENKKLENKFLASWLDCL

SEQ ID NO: 227799 - protein, 81 aa, Glycine max
  Coding DNA Sequence Number=SeqID_111021
MSRNGKLVSWPVFLQALKTRFAPSQYEDPTGALFKLTQRGSVTDYLSKFEALANWIVGLPPPFLLSCFIFGLAPEDQRKAY

SEQ ID NO: 227800 - protein, 213 aa, Glycine max
  Coding DNA Sequence Number=SeqID_111022
  Homolog annotation: Hit_ID=Q6DW76; Match level="QueryCoverage=18%, HitCoverage=4%, E-value=2e-10, Identity=84%"; Hit description =Digalactosyldiacylglycerol synthase 1, chloroplast precursor
MIEATLEILSVRGNFMINGAYIHQEGEKWGTPGIPRETHKQLGYKSILPQGSSSLSYYFRNSHHCFRIEQEHCLIAGKELEMVILNLMKWRLLRLTMQVTRLSARKGSHLLQMKLAMIMVACEAKAPDSMKEPSLEKNVEHNEDDVCHKLTTFASMRTLAYDRSGEDDATSITQVFKATENDNDCCSNALQGTSVSDSNLGKTEVLDMFVSGT

SEQ ID NO: 227801 - protein, 70 aa, Glycine max
  Coding DNA Sequence Number=SeqID_111023
MVLWRLAVCAECDSDCHCVRGWVWCLGGGCEFGFMEVSGGLRWCDDVVWVGTEVRGVVDGGMMLMVSWVG

SEQ ID NO: 227802 - protein, 55 aa, Glycine max
  Coding DNA Sequence Number=SeqID_111024
MELMISFELQMNQGTFPVHVQNVGSVIDEGKQKKARKVMFDFIRSFFPQSSKSMV

SEQ ID NO: 227803 - protein, 343 aa, Glycine max
  Coding DNA Sequence Number=SeqID_111025
  Gene Ontology: Mol. function=transferase activity; Biological process= DNA integration
  Homolog annotation: Hit_ID=Q1SXA8; Match level="QueryCoverage=59%, HitCoverage=16%, E-value=5e-21, Identity=30%"; Hit description=Zinc finger, CCHC-type; Polynucleotidyl transferase, Ribonuclease H fold
  Pfam annotation: Domain name=zf-CCHC; Domain location=211-228; Score =9.3; E_value=0.029; Accession=PF00098.13; Description=Zinc knuckle
MEEGFAINKPPQFRGIKYDYWKEHMIADFEYIHIDLLDVEYTKVHNFKSAKQIWDTLAITYEGTSQTYDNYDHIDKILRSLSKKWRPHVTTLRALKNLESMSLEELVGTLKIHEQELQQDEGLRREKSLALKSQKNKKEPLFREQVQRSSSKELKVDDSSYDESEEDLDEDKLTFISFKIHKMWRNESGSKWRSSLRRMAWDKKDKDKSSIVCYECKKLGHLIKKNWMTPHQMKTMKKQTYALAFEGSESDQDDEDQVDGSLDEFAQACKACDTPKEKKSKLCIEIETNAHEKVTLLKNFMELENKPKDLQKDLKELNELRIHKNEERYDLWRECAQAHKDYV

SEQ ID NO: 227804 - protein, 189 aa, Glycine max
  Coding DNA Sequence Number=SeqID_111026
  Homolog annotation: Hit_ID=Q8H767; Match level="QueryCoverage=23%, HitCoverage=12%, E-value=6e-08, Identity=62%"; Hit description =Lysine ketoglutarate reductase trans-splicing related 1
MKTVKVVLIVSCFFPLSINHIIFSHLITFVCTKHPDECCKEIQSVELEESSRDDLEYVDPSDQQAKTITFRFEKNMKDVGVGSMLEAPECPVEWPLQFKYIEVVKEEGLEISQPALDPDSIEIHHRITVKARTKKFSAPPYVSILMHQLSQESTPRIVRIGNNPGYPCGGTHVVKIYLLTLQALNGNYF

SEQ ID NO: 227805 - protein, 104 aa, Glycine max
  Coding DNA Sequence Number=SeqID_111027
  Subcellular localization annotation: CTP_CleavageSite=67; ConfidenceScore=5.33e-01
MTTDSPPLLMFPWTRSPAESPTVATYPSAGGRRGAHGCVFQERKMRGVATNAYSRKTSEKSERCGLRTLSVKGSGVVFMHGEGVGTLNDLLIFRKARNVKALDH

SEQ ID NO: 227806 - protein, 211 aa, Glycine max
  Coding DNA Sequence Number=SeqID_111028
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=3e-30, Identity=31%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLPFRGLHVLTFKGLHVLAFRGLHVLTFKGLRALTFRGIHALAFRGLHVLAFRGLHAFAFKGLHVLAFRGLHALAFRRLHILTLSGLHVLAIRGLHALAFRGLHVLAIRGLHALTFRGLHVLAIRGLHVLTFRGLHAFAFRGLHVLVFRGLHVLAFRGLHALSFKGQHSLGHLPDLEGGLTMRAIPEGGYHSATMYTGAGFHPAAAKR

SEQ ID NO: 227807 - protein, 101 aa, Glycine max
  Coding DNA Sequence Number=SeqID_111029
MFLLTNALKGLNNNQGCKSKETAKWTPVKYFTDPRPLEPERIKAIHIQWARCFLSVKNATLEIHFQHRLFRAFYIGSKTDVESDDVECIIVNIGFQKPMLT

SEQ ID NO: 227808 - protein, 167 aa, Glycine max
  Coding DNA Sequence Number=SeqID_111030
  Gene Ontology: Mol. function=RNA-directed DNA polymerase activity; Cellular component=chromatin; Biological process=chromatin assembly or disassembly
MTMKDHFPIPTIDELLDELGGSCWFSKLDLLQGYHQILKDDNDINKMAFQTHHDHFEFQMQVEYLGHMASAQGVAPIFAKIQAMEQWPRPKSYKAVRSFLGLAGFYRRFIHGYASIMTPLTTLLTRDEFDWQPAAQLAFDQLKATLSSALVLVLPNFSIPFVLEANA

SEQ ID NO: 227809 - protein, 152 aa, Glycine max
  Coding DNA Sequence Number=SeqID_111031
MSTDNPCWMVHVGETQIICSVACTSRVSFPLGAFRKGVGGLLVVVGTMHVSVIDAEQGWESVRGVSCLRSDRVLTMDECERIDKKSWGIFYRGPMESRPAKQRTPMLKGCCNLVDNSQELIDNVRDKHLLKDKRLEITCLLGTAKGQASMLM

SEQ ID NO: 227810 - protein, 145 aa, Glycine max
  Coding DNA Sequence Number=SeqID_111032
  Gene Ontology: Mol. function=chromatin binding; Cellular component =chromatin; Biological process=chromatin assembly or disassembly
  Homolog annotation: Hit_ID=Q1T2D5; Match level="QueryCoverage=89%, HitCoverage=8%, E-value=2e-23, Identity=40%"; Hit description=Chromo
MENFLVNRDATFEIMRKKLAKAQEAMKRSADARRRDITFSSGDWVMVKLTPHRQSSMSQVPYSKLAKRFYGAYQILEKVGKVAYKLDLPTGSHIHLIVHCSILKMFKQSSLCPFLPLPTAAVNNQPMLCPFTIIVGACVMGWPFR

SEQ ID NO: 227811 - protein, 109 aa, Glycine max
  Coding DNA Sequence Number=SeqID_111033
MTLSSWQNKLDKYFTCKTRVMKGETEVTKAIYKSKGETKDIELVEEEQARIGADPSNETSNKSENYKEEARNATQKHKPKKVESVNIDAKAFGDDWKILIALCILKLNH

SEQ ID NO: 227812 - protein, 71 aa, Glycine max
  Coding DNA Sequence Number=SeqID_111034
  Homolog annotation: Hit_ID=Q2QMW0; Match level="QueryCoverage=81%, HitCoverage=12%, E-value=4e-14, Identity=59%"; Hit description =Expressed protein
MKEGSVGIVGSCTKINRPMDFITIVGGQGYSLPADIQYLDARWEIPIVLPLRDCFAQEINMLCRLDGFVVL

SEQ ID NO: 227813 - protein, 102 aa, Glycine max
  Coding DNA Sequence Number=SeqID_111035
  Gene Ontology: Mol. function=ribonuclease H activity
  Homolog annotation: Hit_ID=Q69QB4; Match level="QueryCoverage=84%, HitCoverage=21%, E-value=8e-29, Identity=68%"; Hit description =Putative ABA-responsive protein
  Pfam annotation: Domain name=GRAM; Domain location=27-80; Score=26.9; E_value=7e-05; Accession=PF02893.10; Description=GRAM domain
MGPSFVDVVVGRITQGTKVLAERGYEKIFRQTFEIVPEEQLLKTYACYLSTSARPVMGVLYLSTTKLAFCSDNPLSYQNSPTIWDRHRFKGALKPSVFTPKA

SEQ ID NO: 227814 - protein, 61 aa, Glycine max
  Coding DNA Sequence Number=SeqID_111036
MTQKRKKRSGGGLAEFAVAKKKHFDQCCIRWCRSLFTPTGKAGKMNVSKALFKKAINYWWT

SEQ ID NO: 227815 - protein, 83 aa, Glycine max
  Coding DNA Sequence Number=SeqID_111037
MEINEIFSPTFQACASSDPICIPRFKKAKWLLKCCKESNTIRKYTFNIGYLEYFTSVLKPMLKVPMLNVSITDVNMYMTTSIL

SEQ ID NO: 227816 - protein, 168 aa, Glycine max
  Coding DNA Sequence Number=SeqID_111038
MSEARPKMKQLRRQYGGRPITRLASCSNSLRDLEDPSHHIPSVKTRNVQFHWSALDKGGAGNGKGCMKGKVVETVEDGIDLIGQAGYGFLKAVGSGFAGAVVGHGKSDQLLEQRNIIWLQLISDFYLAPFPQANLLGLIILQISWSCCLPPVPVGVVFWWIANKALTT

SEQ ID NO: 227817 - protein, 73 aa, Glycine max
  Coding DNA Sequence Number=SeqID_111039
  Gene Ontology: Mol. function=metal ion binding; Cellular component =nucleus; Biological process=ubiquitin cycle
  Homolog annotation: Hit_ID=Q940X7; Match level="QueryCoverage=99%, HitCoverage=67%, E-value=5e-17, Identity=64%"; Hit description=RING -box protein 1a
MATLDSDVIVFPAGEASSSGGPSSSTKKLKRFKIKKWNVILSWIILLFVGTISWISVLSVRPTKLAPLARNAL

SEQ ID NO: 227818 - protein, 106 aa, Glycine max
  Coding DNA Sequence Number=SeqID_111040
MPLGLSQSFQPPWLRLGQWRSAKGEREDAWRGARKALGDRVSEKNKVARKWPSALPESPPSGLQDNKRVSVVSVSTPISSITTIIRSRFTLVRICKDSGATPTVRF

SEQ ID NO: 227819 - protein, 645 aa, Glycine max
  Coding DNA Sequence Number=SeqID_111041
  Gene Ontology: Mol. function=protein kinase activity; Cellular component=integral to membrane; Biological process=protein amino acid phosphorylation
  Homolog annotation: Hit_ID=Q1RVJ1; Match level="QueryCoverage=92%, HitCoverage=94%, E-value=0.0, Identity=58%"; Hit description=Protein kinase domain, putative
  Pfam annotation: Domain name=LRRNT_2; Domain location=25-63; Score =37.6; E_value=4.4e-08; Accession=PF08263.3; Description=Leucine rich repeat N-terminal domain
  Pfam annotation: Domain name=LRR_1; Domain location=116-139; Score =18.2; E_value=0.03; Accession=PF00560.23; Description=Leucine Rich Repeat
  Pfam annotation: Domain name=LRR_1; Domain location=141-163; Score =12.1; E_value=1.6; Accession=PF00560.23; Description=Leucine Rich Repeat
  Pfam annotation: Domain name=LRR_1; Domain location=165-186; Score =5.5; E_value=27; Accession=PF00560.23; Description=Leucine Rich Repeat
  Pfam annotation: Domain name=LRR_1; Domain location=187-209; Score =10.0; E_value=3.9; Accession=PF00560.23; Description=Leucine Rich Repeat
  Pfam annotation: Domain name=LRR_1; Domain location=93-114; Score =6.3; E_value=19; Accession=PF00560.23; Description=Leucine Rich Repeat
  Pfam annotation: Domain name=Pkinase; Domain location=339-608; Score =35.9; E_value=1.1e-10; Accession=PF00069.15; Description=Protein kinase domain
  Pfam annotation: Domain name=Pkinase_Tyr; Domain location=338-608; Score=-17.1; E_value=2e-11; Accession=PF07714.7; Description=Protein tyrosine kinase
  Pfam module annotation: Pfam domain module=LRRNT_2::LRR_1::LRR_1::LRR_ 1::LRR_1::LRR_1::Pkinase::Pkinase_Tyr; Domain location=25-63::116 -139::141-163::165-186::187-209::93-114::339-608::338-608
MALRRAYYCLLTLLVFALCFEPLLGDTDAQILMRFKASLSNNNALNNWVNESSLCSWRGLLCNHTDQTFYGLRLHNMSLGGKIDVDTLLELPTLTSFSVMNNTFEGPMPEFKKLVRLRALFLSNNKFSGDIPDDAFEGMTKLKRVFLAENGFTGHIPKSLANLPRLWDLDLRGNSFGGSIPEFQQKDFRMFNLSHNQLEGSIPESLSNKDPSSFAGNKGLCGKPMSPCNEIGGNESRSEIPYPDSSQRKGNKYRILITVIIVIVVVVVASIVALLFIRNHWRKRLQPLILSKQENSKNSVDFRESQSIDVTSDFKKGGDGALNFVREDKGGFDLQDLLRASAVVLGSGSFGSTYKAMILNGPTVVVKRFRHMNNAGKQEFIEHMKRLGSLTHPNLLPLDAFYYRKEDKFLVYDYAENGSLASHLHDRNGSVLNWSTRLKIVKGVARGLAYLYESFPGQNLPHGHLKSSNVVLDHSFEPHLTEYGLVPVMTKSHAQRFMAAYKAPEVNQFGRPNVKSDVWCLGILILELLTGKFPANYLRHGKGGNNSDLATWVDSVVREEWTGEVFDKDIMGTRNGEGEMLKLLRIGMFCCKWSVESRWDWREALAKIEELKEKDSDEEYSSYVSEGDLYSRTMTEDEFSFSVTN

SEQ ID NO: 227820 - protein, 98 aa, Glycine max
  Coding DNA Sequence Number=SeqID_111042
  Gene Ontology: Mol. function=oxidoreductase activity, acting on the aldehyde or oxo group of donors, NAD or NADP as acceptor; Cellular component=mitochondrion; Biological process=metabolic process
  Homolog annotation: Hit_ID=Q9SAK4; Match level="QueryCoverage=50%, HitCoverage=17%, E-value=4e-09, Identity=65%"; Hit description =Succinate semialdehyde dehydrogenase, mitochondrial precursor (EC 1.2.1.24) (At-SSADH1) ...
  Homolog annotation: Hit description=(NAD(+)-dependent succinic semialdehyde dehydrogenase)
MIWLKPERKHLDLLHPERKLSELLMTLMQVAPFGGFKQSGLGIEGSKYGMNEYLESLVNEKDEFHEEEESDKSKDKRRILNALLFSNIDNQWCRVCEF

SEQ ID NO: 227821 - protein, 160 aa, Glycine max
  Coding DNA Sequence Number=SeqID_111043
MVKVGTSYVPINVSFSPKVGPGLPGINRDTRIYLFCEVIFRHSCPSCSATDGVGFPSHDVVKRRPVNCNTTHYRANWSSTAVAAALELVDPPGCRNSIIWLNFTSSGKSEAVLEAGAAGRARLEEAQGARASCPATGRGTGAAMWAPWHLGTLPDMKDVI

SEQ ID NO: 227822 - protein, 116 aa, Glycine max
  Coding DNA Sequence Number=SeqID_111044
MGMSSDTRWEWRLQWRRLFFDAEIDMVAKFMQDIEGLTICPYRHDKWVWRGDKSGSYSMGSLAALVGIDVLDGDSGTSPTKPEGTFPTTLLLQGVGYQQKVMAELVDILNKVHLAP

SEQ ID NO: 227823 - protein, 75 aa, Glycine max
  Coding DNA Sequence Number=SeqID_111045
  Homolog annotation: Hit_ID=O49571; Match level="QueryCoverage=71%, HitCoverage=4%, E-value=5e-13, Identity=53%"; Hit description=DNA topoisomerase like-protein
MGNHPKDGQPVILRLARAGFCVRHRRTIASIPKNVKPSDVTLEKALEYLSGDDVRRSGRPKKGKSKVEVEVIEAF

SEQ ID NO: 227824 - protein, 255 aa, Glycine max
  Coding DNA Sequence Number=SeqID_111046
  Gene Ontology: Mol. function=RNA-directed DNA polymerase activity; Cellular component=chromatin; Biological process=chromatin assembly or disassembly
MWVNWGKQSMQFQLENKWVELQGEGKGVAEQVAFQSLFGKPYHMIEGEPKGLSPQRGKEHAITLMEGQGLVNVRPYRYPHHHKNEIEKQSKSIFKPDNFGEKERRDKVTVPDKFLIPVIDELLDELHGAHYFSKLDMKSSPDWKSHIMHLTAVLDVLKKERLVANRKKCYFSQTTIEYLGHVISKDCVAMDSNKVKSVIEWPVPKNVKRVCSFLRLTGYYRKFIKDYGKLAPRPLTDLTKNDGFKWGDSEQLLNH

SEQ ID NO: 227825 - protein, 102 aa, Glycine max
  Coding DNA Sequence Number=SeqID_111047
  Homolog annotation: Hit_ID=UPI000034F143; Match level="QueryCoverage =60%, HitCoverage=4%, E-value=3e-19, Identity=69%"; Hit description =DNA binding / DNA topoisomerase/ DNA topoisomerase type I/ nucleic acid binding
MTIGFKSNGVHRNCLNWIQLDNVSAGLTEWKGLLRDYWTRFKSYCERTSNVHIHQVEKMLEKKFGDYLFASLPDQSRVCPRRQNRGIIDENRVTVHSGCSFM

SEQ ID NO: 227826 - protein, 108 aa, Glycine max
  Coding DNA Sequence Number=SeqID_111048
  Gene Ontology: Mol. function=transferase activity
  Homolog annotation: Hit_ID=Q1SUM5; Match level="QueryCoverage=77%, HitCoverage=77%, E-value=8e-10, Identity=38%"; Hit description =Polynucleotidyl transferase, Ribonuclease H fold
MALFSRSITILEMIKCNNDDTIFKEYHYFGDGICLSDEHGHFIKAKTLWQLGIPNPQEVDDWDLLQALKWIPNMDVHYIVIELDYKTVIDGLSACSTDFLDFHSFSKM

SEQ ID NO: 227827 - protein, 74 aa, Glycine max
  Coding DNA Sequence Number=SeqID_111049
IDCPFERGDNSCNLILSFANLSGNSLREGTYWVRTSNLPLGSLEAHARCPSLPQCKAFEVPIIVLFSRPRSEEE

SEQ ID NO: 227828 - protein, 93 aa, Glycine max
  Coding DNA Sequence Number=SeqID_111050
MDSCWLEMEVELEAQTREVPDSWIWNRTAEGKFSVASTYVLVSEESPYLSFSEGFSSDGDKEKTVSIYAAFHCSLQMGTITPYIGNCHQLPHI

SEQ ID NO: 227829 - protein, 387 aa, Glycine max
  Coding DNA Sequence Number=SeqID_111051
  Gene Ontology: Mol. function=nucleic acid binding; Cellular component= nuclear pore; Biological process=DNA integration
  Subcellular localization annotation: CTP_CleavageSite=85; ConfidenceScore=5.59e-01
EILPTHPDLSSPVPVAVPNFGSDTSSASSAASVSQPISGSDVSRFDTSLSHSTSQQAQSAASTSHSVAPSSNFDTNADQPSSDVPASSSAPTGSFSSSSGLEPKSVKHALAAPNWLAAMEQEYQALMKNHTWDIVPLPSDRKAVGCKWVFRVKENADGSINKYKAQLVAKVFHQVHGFDFHETFSLVVKPITIRLILTLALTNGWDLFQLDVNNAFLNGVLDETVYMVQPPDPTLYRSVVGALQYATLTRPEISFSVNKALSFIAFSYNLLFPLDHFFLIALCDADCASDVDHHRSTSGSMICLGPNLISWSSRKQQVTARSITEAEYRSIAQTSAELSVAIAHNPVFHSRTKHMEIDVFFVHEAGCPGREWECWKATLIAEPPRLP

SEQ ID NO: 227830 - protein, 96 aa, Glycine max
  Coding DNA Sequence Number=SeqID_111052
MTSKWRRKKDKWRRHFKEKMSQEEARHRSMKNKKVFVAGVSLSKACALSKNHPLSEALSPLSKLGESGGESAKHLGAQCVISSLSESFVFSRTKHA

SEQ ID NO: 227831 - protein, 205 aa, Glycine max
  Coding DNA Sequence Number=SeqID_111053
  Homolog annotation: Hit_ID=Q1SP02; Match level="QueryCoverage=52%, HitCoverage=27%, E-value=5e-08, Identity=30%"; Hit description=IMP dehydrogenase/GMP reductase
MYNNLNDASKSSNKQLARCITLLQCWIYKHFPFIAEAIIAKDYHETKPCACHWISGKALPMSIDNRIVREFEVISCFSGHIRWSLVAVIHRPKRVVQQFRYVQTIPPHSPGSRLCLEDIDDIWMHFLEYLIVPGDLIRHPPIVQDDTYVELDIPQYPMVTIAMEEAPAYAPSHVEQPLHAVACQAIAERLEWLINLRIVTKGIET

SEQ ID NO: 227832 - protein, 121 aa, Glycine max
  Coding DNA Sequence Number=SeqID_111054
  Gene Ontology: Mol. function=nucleic acid binding; Biological process= DNA integration
MKAIEEQFVRSYKSMSSTIMIKLSSMRFDNSKGVQEHLMEMRAITAKLRPLEVEISKFFLVHLILNSLPPEYEEERLKHEAPESAHMGFPNLRNLVGSEQSIYVGNRMSSHVEAIEVLNLF

SEQ ID NO: 227833 - protein, 723 aa, Glycine max
  Coding DNA Sequence Number=SeqID_111055
  Gene Ontology: Mol. function=protein-tyrosine kinase activity; Cellular component=integral to membrane; Biological process=protein amino acid phosphorylation
  Homolog annotation: Hit_ID=Q1SXM9; Match level="QueryCoverage=97%, HitCoverage=90%, E-value=0.0, Identity=64%"; Hit description=Protein kinase
  Pfam annotation: Domain name=LRR_1; Domain location=123-145; Score =9.6; E_value=4.6; Accession=PF00560.23; Description=Leucine Rich Repeat
  Pfam annotation: Domain name=LRR_1; Domain location=147-169; Score =10.8; E_value=2.8; Accession=PF00560.23; Description=Leucine Rich Repeat
  Pfam annotation: Domain name=LRR_1; Domain location=180-202; Score =17.1; E_value=0.064; Accession=PF00560.23; Description=Leucine Rich Repeat
  Pfam annotation: Domain name=LRR_1; Domain location=204-223; Score =13.4; E_value=0.85; Accession=PF00560.23; Description=Leucine Rich Repeat
  Pfam annotation: Domain name=LRR_1; Domain location=226-248; Score =14.4; E_value=0.42; Accession=PF00560.23; Description=Leucine Rich Repeat
  Pfam annotation: Domain name=LRR_1; Domain location=30-52; Score =11.3; E_value=2.2; Accession=PF00560.23; Description=Leucine Rich Repeat
  Pfam annotation: Domain name=LRR_1; Domain location=75-98; Score=4.9; E_value=35; Accession=PF00560.23; Description=Leucine Rich Repeat
  Pfam annotation: Domain name=LRR_1; Domain location=99-121; Score =11.8; E_value=1.7; Accession=PF00560.23; Description=Leucine Rich Repeat
  Pfam annotation: Domain name=Pkinase; Domain location=440-695; Score=- 11.3; E_value=6.9e-08; Accession=PF00069.15; Description=Protein kinase domain
  Pfam annotation: Domain name=Pkinase_Tyr; Domain location=444-719; Score=-27.8; E_value=9.1e-11; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::Pkinase::Pkinase_Tyr; Domain location= 123-145::147-169::180-202::204-223::226-248::30-52::75-98::99 -121::440-695::444-719
MKLVSRNIVETGKSFQNLSKSPIGIITSVTLRKLNLSSNKLYGPLPLRVGHCSIIDLSNNTLSGNFSRIRYWGNYVEVVQLSSNSLGGMLPNETSQFLRLTSLKVSNNSLEGFLPPILGTYPELEEIDLSLNQLSGFLLPSFFTSTKLINLDLSNNKFSGSILIQFQPPNNPIVSAENCSLVFLDLSHNNLSGTLPSNMSRLHNLAYLNLCNNQLVGTIPDDLPDELRVLNVSFNNLSGVVPESLKQFPDSAFHPGNTMLVFPHLQPSPKDTSNLGLREHRLQKKSATRIALIACLVAGGFVMAFVGIIIYYKVHHEKERTSKQNEARGITQESTFTSNIEEPYRNLEVLPPAQSGSSDDARNIHPVGKKPIDFGPSELGKNEEGTSTPMSILSPSNPSSSKSYQFENPGSLKVSSPDKLVGDLHIFDGSLALTAEELSCAPAEVIGRSCHGTLYKATLDSGHELAVKWLREGITKGKKELAREIKKLGTIKHPNLVSVQGYYLGPKEHEKLIISNYMNAQSLDIYLHETDKGNLHPLSLDERLRVAVEVAQCLHFLHDEKAIPHGNLKSTNILLETPNRNVLLTDYTLHRILTAAGTAEQVLNAGALGYRPPEFARSSKPCPSLTSDVYAFGVILLELLTGRNSGEIVSGIPGVVDLIDWVRFLAEQNRSSQCFDRSLVDKNNGERPSKILDDMLKVALRCILPASDRPDLKTVFGDLSTIR

SEQ ID NO: 227834 - protein, 266 aa, Glycine max
  Coding DNA Sequence Number=SeqID_111056
  Gene Ontology: Mol. function=cysteine protease inhibitor activity; Biological process=defense response
  Homolog annotation: Hit_ID=O04720; Match level="QueryCoverage=99%, HitCoverage=100%, E-value=1e-125, Identity=86%"; Hit description =Cysteine proteinase inhibitor
  Pfam annotation: Domain name=Cystatin; Domain location=177-266; Score= 6.8; E_value=0.048; Accession=PF00031.11; Description=Cystatin domain
  Pfam annotation: Domain name=Cystatin; Domain location=49-137; Score =66.9; E_value=6.3e-17; Accession=PF00031.11; Description=Cystatin domain
  Pfam module annotation: Pfam domain module=Cystatin::Cystatin; Domain location=177-266::49-137
  Subcellular localization annotation: CTP_CleavageSite=29; ConfidenceScore=5.02e-01
MRALTSSSSTFIPKRYSFFFFLSILFALRSSSGGCSEYHHHHAPMATIGGLRDSQGSQNSVQTEALARFAVDEHNKKQNSLLEFSRVVRTQEQVVAGTLHHLTLEAIEAGEKKLYEAKVWVKPWLNFKELQEFKPAGDVPSFTSADLGVKKGMAFSKSIICGLYMTKKHSNWDGHQPGWQSVPTHDPQVQDAANHAIKTIQQRSNSLVPYELHEVADAKAEVIDDFAKFNLLLKVKRGQKEEKFKVEVHKNNQGGFHLNQMEQDHS

SEQ ID NO: 227835 - protein, 149 aa, Glycine max
  Coding DNA Sequence Number=SeqID_111057
MEAIISYSISETFHEPVWVVLEANFLIYRNEIIDIPKALGGKAKAIFMNLHSNKIWGEVKKMTLKRDGAIMFEMVGISCVCCGFKCWIVDDMILGDERGMRGSAAPKTIANSLGLDDDDDNGGDLKSPPKKPDSTSSLIGKIFEAKLSD

SEQ ID NO: 227836 - protein, 197 aa, Glycine max
  Coding DNA Sequence Number=SeqID_111058
MNRPWTIPNLGRGKFMHMMKQKSLKFGTTLEHSKHETPLNLASKVELQMNQIVKHKKTLLIEESVYSKLHTAVRGNSKPQSLKFGTTLEHSKHETPLNLASKVELQMNQIVKHKKTLLIEESVSMILILQITHRRERKLEAAILQNIYLLQLGHALKLFNVVVTNYAVNDGVYHVLNWELWVRRFREGFRGGGGGQG

SEQ ID NO: 227837 - protein, 92 aa, Glycine max
  Coding DNA Sequence Number=SeqID_111059
MSIPLHFAIYNNETPFKLTYGTDAMILVEVGEPSARKAQFEEALNDENLALELDKIDERMRQEARKDNAERKLAMNCEVTFRITTTLENEAY

SEQ ID NO: 227838 - protein, 123 aa, Glycine max
  Coding DNA Sequence Number=SeqID_111060
MEKQTTPTPPNQPQGEKGVPQNTLSKKLSGAMAIRHHQGPLRRVDHVLMMSKRICLIMSVIIKKGENVNHVCFDNVEKKSLDCHHQKGGECEYFVKGFYKEKAKFQVGCLRTGRRHKGVAEPV

SEQ ID NO: 227839 - protein, 86 aa, Glycine max
  Coding DNA Sequence Number=SeqID_111061
MVSMKAIENEMLPKAIESINKNFNVVVQDLAETKNIVKALNDQLTVGEEEKKALELERDNLLKEKEICQINNLPNYKQNFPIRIKQ

SEQ ID NO: 227840 - protein, 215 aa, Glycine max
  Coding DNA Sequence Number=SeqID_111062
MKFPSCTGEIVIVKADQVDAHECYVKCCKIEPYNMMTLSLSKSTRNHINAHKLTRKWKKSVKKVVQMLLRNIDMLACSVSEMPGIEPNFICHKLGEERRQVVEAEIDKLLKVDFIRQVDYTTSEVTPDQQAGELAEIFSELKRHNKRLNLENCTFMVKGGPIKPQCLIDFVEELPPKSSNIDRGNWWMLYVDKVCHSKGSRAGITLEGPGVISIE

SEQ ID NO: 227841 - protein, 39 aa, Glycine max
  Coding DNA Sequence Number=SeqID_111063
  Homolog annotation: Hit_ID=Q1T218; Match level="QueryCoverage=97%, HitCoverage=88%, E-value=2e-11, Identity=94%"; Hit description=Salt -inducible protein-alfalfa
MQETSKRTTLRLIGAQEDLVEAAKEEASSLSNIIAQATK

SEQ ID NO: 227842 - protein, 88 aa, Glycine max
  Coding DNA Sequence Number=SeqID_111064
MFYHRTHCQKGHTKVVLLPITKSINYWCKLFYVVLHYQQRVDNIFLSQAKPEDWDVEKATFEEAKKKREEEVNFYPENASLKMYLWWL

SEQ ID NO: 227843 - protein, 55 aa, Glycine max
  Coding DNA Sequence Number=SeqID_111065
MVVKQRYFDMEVFSVNDDHPSHDMAIGQMFVKEVTGEGAHVYYLALDRQGYWYVL

SEQ ID NO: 227844 - protein, 55 aa, Glycine max
  Coding DNA Sequence Number=SeqID_111066
  Gene Ontology: Mol. function=unfolded protein binding; Cellular component=endoplasmic reticulum; Biological process=protein folding
  Homolog annotation: Hit_ID=A0A762; Match level="QueryCoverage=98%, HitCoverage=13%, E-value=7e-23, Identity=87%"; Hit description =Calreticulin-1
MAGEWNHTSGQWNGDANDKGIQTREDYRFYAILAEYPEFNNKDKILLFQFSVKHE

SEQ ID NO: 227845 - protein, 59 aa, Glycine max
  Coding DNA Sequence Number=SeqID_111067
MIEVLDSFSATLSGLQTQTYDDEASTASSGFGSDEKTINVVFKQMKPQVDPSKLDAPPH

SEQ ID NO: 227846 - protein, 40 aa, Glycine max
  Coding DNA Sequence Number=SeqID_111068
MPNESLDFYLFVRVSEENTNRVVGTQIEYEAGKVKNGFLQ

SEQ ID NO: 227847 - protein, 359 aa, Glycine max
  Coding DNA Sequence Number=SeqID_111069
  Gene Ontology: Mol. function=RNA binding
  Homolog annotation: Hit_ID=Q1T290; Match level="QueryCoverage=95%, HitCoverage=89%, E-value=9e-54, Identity=38%"; Hit description =Cyclin-like F-box
  Pfam annotation: Domain name=F-box; Domain location=17-64; Score =37.6; E_value=4.4e-08; Accession=PF00646.23; Description=F-box domain
MVGRQRQSIRNTKDDKDRISELPIHVFLRILEFMNTRDAVRLCALSKSWKDFWKRLTTLSFDSWESSIVNFEKFVSEVLSGRDGSIPLLNLEIILRTDLEQLDDILKYAVSHNIQQLKIFLFVNHRFHFVFPSSIFSCQTLTFLRLSPSFWGPIWELRKPLQLPALESLHLENVCFTASCDDCAEPFSSCISLKSLILGDCSLHKNAQVLCINNSNLNRVSLCLSSVDAYKIVFSTPNLCSLTIKNVDCHHQLFSTCSLSFLEVDVNAYVDPYSPFFVSLLQVLVNIKKITLSWSTLRMMQEVLPYWDSVGTRPPCFARLESLKLKIDPSSKISDEKVNWVVKCLLQNSPLLRVDIIKC

SEQ ID NO: 227848 - protein, 229 aa, Glycine max
  Coding DNA Sequence Number=SeqID_111070
  Gene Ontology: Mol. function=hydrolase activity; Biological process =aromatic compound metabolic process
  Homolog annotation: Hit_ID=Q10QA5; Match level="QueryCoverage=73%, HitCoverage=67%, E-value=3e-47, Identity=75%"; Hit description =Hydrolase, alpha/beta fold family protein, expressed
  Subcellular localization annotation: CTP_CleavageSite=43; ConfidenceScore=5.06e-01
MSRAVCIIQQGTFTRPRIPLRSLLNTVRDTKSEMSGRMLNSVRENSLTAAGADEDEFGEEVRAADGGEHADHGGDGVADVGAAGDAEGVEDVEEVVDVGVEGGITAVVEVVGVDAAGADEVVENDAVVAGEVREHALPRGLVRAEAVGQDKVLVAGTFHANVQGVENGSAHNYGEICGVCVYWPSFYNVVTGKTLALPNLIALQHIPLSPAGVIAKRPAPIALPNSCAA

SEQ ID NO: 227849 - protein, 404 aa, Glycine max
  Coding DNA Sequence Number=SeqID_111071
MAISVMKEANMKGRMERDEDLTLFRELRKHQNERVSSLFHCVNSEEFECGTNTDSGRISSGKKEYGLEFLETNKNDYDWLKTPPATPLFPSLEMEPSSQLVVQKELPISQVISRLFGFCLYLSKIILACMFGCSSKVQINDIKVGFATQFAWSTRDVEAQPKPKSIDGKATTKSTKAKLPTRSMTTSHNKQRPSIIKNTNELQQTSTTPPTIINNKGSNAKIKHDAANNTRSTPQKQTNNVDFHALSIQKSIETNESQRKSRSARVVSPSVKSRVVNLSNIVELSNETPPNLRTDQRSSSTTRGRSTTRSSTIAGFQNRDPTPRTCRPSRSPSPSMANGGLNQLDRTQKKLREQKETFTLAAGTNENRPHFKGSKMVEKVVNARKSGVNQMDRETKAKAFKYRV

SEQ ID NO: 227850 - protein, 113 aa, Glycine max
  Coding DNA Sequence Number=SeqID_111072
  Gene Ontology: Mol. function=two-component response regulator activity; Cellular component=nucleus; Biological process=two -component signal transduction system (phosphorelay)
  Homolog annotation: Hit_ID=Q1SA49; Match level="QueryCoverage=92%, HitCoverage=81%, E-value=4e-30, Identity=63%"; Hit description =Response regulator receiver
  Pfam annotation: Domain name=Response_reg; Domain location=1-101; Score=58.9; E_value=1.6e-14; Accession=PF00072.14; Description =Response regulator receiver domain
MVHRKMLNSVGLKIQVAENGKEAVEIHRSGQSFDLILMDRDMPVMNGIEATKTLRSMGINSTITGVSTRSVTAHIREFMEAGLDDYLEKPLTLVKLTSIIHKMNKLIKSDLSM

SEQ ID NO: 227851 - protein, 83 aa, Glycine max
  Coding DNA Sequence Number=SeqID_111073
MDGQWVRKQDLSPSIPDERTPSPPLQRDSSSSLLNDVITELRDLQAFSYSHNETNVDLTLAHGVVNVCLTLAHGGVTVTLSLM

SEQ ID NO: 227852 - protein, 262 aa, Glycine max
  Coding DNA Sequence Number=SeqID_111074
  Gene Ontology: Mol. function=DNA binding; Biological process=DNA integration
  Homolog annotation: Hit_ID=Q1S1X7; Match level="QueryCoverage=49%, HitCoverage=14%, E-value=3e-24, Identity=33%"; Hit description =Integrase, catalytic region; Zinc finger, CCHC-type; Peptidase aspartic, catalytic
MAQAGETLYDKINLQQVDVESTSIWPPREGRYTSKRSPRQFSKCWKGLISASGLMELGHWKKDCPKKLKKESVVVVVQSCYYHMCPHKSWFVTYEKKSSGNVLMGNNDPCKTVRIDLILVGTMDSRGFTYCVEGGVRKIKWKGWTKFLKAMHTTKATLDNVHSDCWAPSRISPLGGQRYFLSIIDDYSRMTWAVNTTCYLVNRSLSITIDFKTPGEVWSNKPIDYSMLKVFKCQAYYHANERKKGVFMGYENGVKGFRIWSL

SEQ ID NO: 227853 - protein, 70 aa, Glycine max
  Coding DNA Sequence Number=SeqID_111075
MTDRSIGLDFGNAMNRSWKAKFEKFLPPSSTFCHRRFGALKVGLEVLLDLFKVTYLEKVILNMSGRCLIY

SEQ ID NO: 227854 - protein, 187 aa, Glycine max
  Coding DNA Sequence Number=SeqID_111076
MHCLPWASVSSSRHSSATKEKGKMQREKITLAPERTTIIRRKERGIRRRIVVKEGREKKEYLARNLFCSALAMEDEEAEAVAELKHVRRRIVAAGSPLHAEADNEALLVDEVAVEVERGGDPPLDHGGVGGDDDDDIVFGEIDSVDVVVVTMLYVCDGGYGLENILPKCSSLRLLPKVLTRLVRLII

SEQ ID NO: 227855 - protein, 1093 aa, Glycine max
  Coding DNA Sequence Number=SeqID_111077
  Gene Ontology: Mol. function=binding; Cellular component =cytoskeleton; Biological process=cell division
  Homolog annotation: Hit_ID=Q1SA51; Match level="QueryCoverage=99%, HitCoverage=95%, E-value=0.0, Identity=86%"; Hit description=Mast C -terminus, putative
  Pfam annotation: Domain name=HEAT; Domain location=101-133; Score =1.5; E_value=28; Accession=PF02985.12; Description=HEAT repeat
  Pfam annotation: Domain name=HEAT; Domain location=1018-1053; Score =19.1; E_value=0.016; Accession=PF02985.12; Description=HEAT repeat
  Pfam annotation: Domain name=HEAT; Domain location=440-473; Score =1.5; E_value=28; Accession=PF02985.12; Description=HEAT repeat
  Pfam annotation: Domain name=HEAT; Domain location=482-517; Score =22.3; E_value=0.0018; Accession=PF02985.12; Description=HEAT repeat
  Pfam annotation: Domain name=HEAT; Domain location=522-558; Score =20.6; E_value=0.0056; Accession=PF02985.12; Description=HEAT repeat
  Pfam annotation: Domain name=HEAT; Domain location=608-640; Score =8.1; E_value=4.4; Accession=PF02985.12; Description=HEAT repeat
  Pfam annotation: Domain name=HEAT; Domain location=899-935; Score =22.4; E_value=0.0017; Accession=PF02985.12; Description=HEAT repeat
  Pfam module annotation: Pfam domain module=HEAT::HEAT::HEAT::HEAT::HEA T::HEAT::HEAT; Domain location=101-133::1018-1053::440-473::482 -517::522-558::608-640::899-935
MACHLLCFLSKELLGDFEACAEMFIPVLFKLVVITVLVIAESADNCIKTMLRNCKVARVLPRIADCAKNDRNAVLRARCCEYAYLVLEHWPDAPEIHRSADLYEDLIKCCVSDAMSEVRSTARMCYRMFAKTWPERSRRLFSSFDPAIQRLINEEDGGIHRRHASPSIRDRGAPTSLSSQASAPSNLPGYGTSAIVAMDKSSSISSGTSISSGILLSQAKSLGKGTERSLESMLHASKQKVSAIESMLRGLDLSDKHNSSSLRSTSLDLGVDPPSSRDPPFPAAVPASNHLTSSLTTESTTSGINKGSNRNGGLGLSDIITQIQASKDSAKLSYRSNVGIEPLSSYSSKRASERQERSSLDDNHDMRETRRYMNPNTDRQYLDAPYRDGNFRESHNSYVPNFQRPLLRKNVAGRMSAGRRSFDDNQLSLGEMSNFADGPASLHEALSEGLSSGSDWSARVAAFNYLHSLLQQGPKGTLEVVQNFEKVMKLFFQHLDDPHHKVAQAALSTLADIVPACRKPFEGYMERILPHVFSRLIDPKELVRQPCSTTLEVVSKTYSIDSLLPALLRSLDEQRSPKAKLAVIEFAINSFNKHAMNPEGAANIGILKLWLAKLTPLVHDKNTKLKEAAITCIISVYSHFDSTAVLNFILSLSVEEQNSLRRALKQYTPRIEVDLINYLQNKKEKQRSKSSYDPSDVVGTSSEDGYVGYSRKAHYLGRYSAGSLDSDGGRKWSSQDSTLIKASLGQASSGETREHLYHNFETDPNSGSLGSKTKDLAYAVNPMGQNFGSQTSQHGHMDSSVSLEGLSTPRLDVNGLMSSEHLNGAEGYANDKEHPSELELNHHSAEDVKINTMTHTGPSIPQILHMICSGGDGSPISSKRTALQQLVEASITNDHSVWTKYFNQILTVVLEVLDDSDSSVKELALSLIVEMLKNQKGAMENSVEIVIEKLLHVTKDIIPKVSNEAEHCLTIVLSQYDPFRCLSVIVPLLVTEDEKTLVICINCLTKLVGRLSQEELMAQLPSFLPALFEAFGNQSADVRKTVVFCLVDIYIMLGRAFLPYLQGLNSTQLKLVTIYANRISQARTGKAIDAVQD

SEQ ID NO: 227856 - protein, 220 aa, Glycine max
  Coding DNA Sequence Number=SeqID_111078
  Gene Ontology: Mol. function=protein binding; Cellular component =membrane; Biological process=defense response
  Homolog annotation: Hit_ID=Q1SW19; Match level="QueryCoverage=99%, HitCoverage=22%, E-value=7e-50, Identity=46%"; Hit description =Disease resistance protein
  Pfam annotation: Domain name=LRR_1; Domain location=143-164; Score =6.0; E_value=21; Accession=PF00560.23; Description=Leucine Rich Repeat
  Pfam annotation: Domain name=LRR_1; Domain location=166-187; Score =7.5; E_value=11; Accession=PF00560.23; Description=Leucine Rich Repeat
  Pfam annotation: Domain name=LRR_1; Domain location=189-210; Score =13.1; E_value=1; Accession=PF00560.23; Description=Leucine Rich Repeat
  Pfam module annotation: Pfam domain module=LRR_1::LRR_1::LRR_1; Domain location=143-164::166-187::189-210
MYPEDYEVESDRLIRQWIAEGFVKHETGKTLEEVGQQYLSGLVHRSLVQVSSFGLDGNVERCRVHDLIHDMILRKVKDTGFRQYIDGPDQSVSSKIVRRLTIATDDFSGSIGSSPIRSILIMTGKDENLSQDLVNKFPTNYMLLKVLDFEGSAFSYVPENLGNLCHLKYLSFRYTWIASLPKSIGKLQNLETLDIRGTGVSEMPEEISKLKKLRHLLAYS

SEQ ID NO: 227857 - protein, 52 aa, Glycine max
  Coding DNA Sequence Number=SeqID_111079
DQHQQQQVVKSFDAGNNYDASLLAMNISASLGQLNQLQHQSATGGGDDRNRS

SEQ ID NO: 227858 - protein, 414 aa, Glycine max
  Coding DNA Sequence Number=SeqID_111080
  Gene Ontology: Mol. function=molecular_function; Cellular component =cellular_component; Biological process=cell differentiation
  Homolog annotation: Hit_ID=Q6ZIP6; Match level="QueryCoverage=87%, HitCoverage=80%, E-value=7e-72, Identity=43%"; Hit description =Putative interferon-related protein
  Pfam annotation: Domain name=IFRD; Domain location=4-336; Score =256.8; E_value=4.6e-74; Accession=PF05004.4; Description=Interferon -related developmental regulator (IFRD)
MLDSDDDSSSVSSSSTSRTDHISVSGNEEVHFDQDGLLDQALDALDEKRGSTRERALSVIIGAFTSNMQHHFVDKKFATLLHQCLASIKKGSKKASAKEIALASHAIGLLTLTVGCSDNAREIFEESVRPLDEFLTSKSHLTKIPSIEPAKTKPIWLSELLECLAIITFVGGNGLEETERSMDILWRVIHPRLGSNVVAVKPSAPLITAVVSAWSFLLSTMRNLKLNSKNWQNSISYLSSLLDKEDRPVRIAAGEALAVIFEIGIIEKFSADSKGASDMSQEEINLQESYTHLQGLKGKVITQVKNLSVEAGGKGSAKKDLNNQRNLFRDIVEFFECGYSPEISMKIGGDSLQTSSWSQMIQLNFLKHFLGGGFIKHIQENEFLQDVFNFKPKRRYLNNNEHRMSSGEKVGFYD

SEQ ID NO: 227859 - protein, 160 aa, Glycine max
  Coding DNA Sequence Number=SeqID_111081
MYVLDTLTDKKARKVNKIYGDTNVWGQVDEVPFALLPLVGGGIPRRQQQLLFFLSFQFLLYKCCSNSQPTFFTSSPYHYHHHESRWSIINILSFQPIEAPLPINRAVKREMPFTRINSDTLTPHLGVTFYKNKTGAVKLKGFQDKPGSRSSTVDLRSEHN

SEQ ID NO: 227860 - protein, 711 aa, Glycine max
  Coding DNA Sequence Number=SeqID_111082
  Gene Ontology: Mol. function=binding; Cellular component=thylakoid; Biological process=photosynthesis
  Homolog annotation: Hit_ID=Q10QD7; Match level="QueryCoverage=99%, HitCoverage=98%, E-value=0.0, Identity=52%"; Hit description=TPR Domain containing protein, expressed
  Pfam annotation: Domain name=TPR_1; Domain location=318-351; Score =6.0; E_value=1; Accession=PF00515.18; Description=Tetratricopeptide repeat
  Pfam annotation: Domain name=TPR_1; Domain location=602-635; Score =6.1; E_value=0.99; Accession=PF00515.18; Description=Tetratricopeptid e repeat
  Pfam annotation: Domain name=TPR_1; Domain location=672-705; Score =17.7; E_value=0.042; Accession=PF00515.18; Description =Tetratricopeptide repeat
  Pfam annotation: Domain name=TPR_2; Domain location=134-167; Score =1.8; E_value=20; Accession=PF07719.7; Description=Tetratricopeptide repeat
  Pfam annotation: Domain name=TPR_2; Domain location=318-351; Score =14.1; E_value=0.52; Accession=PF07719.7; Description=Tetratricopeptid e repeat
  Pfam annotation: Domain name=TPR_2; Domain location=513-546; Score =5.8; E_value=6.9; Accession=PF07719.7; Description=Tetratricopeptide repeat
  Pfam annotation: Domain name=TPR_2; Domain location=568-601; Score =3.4; E_value=13; Accession=PF07719.7; Description=Tetratricopeptide repeat
  Pfam annotation: Domain name=TPR_2; Domain location=602-635; Score =4.9; E_value=8.8; Accession=PF07719.7; Description=Tetratricopeptide repeat
  Pfam annotation: Domain name=TPR_2; Domain location=65-100; Score =2.0; E_value=19; Accession=PF07719.7; Description=Tetratricopeptide repeat
  Pfam annotation: Domain name=TPR_2; Domain location=672-705; Score =20.4; E_value=0.0063; Accession=PF07719.7; Description =Tetratricopeptide repeat
  Pfam module annotation: Pfam domain module=TPR_1::TPR_1::TPR_1::TPR _2::TPR_2::TPR_2::TPR_2::TPR_2::TPR_2::TPR_2; Domain location=318 -351::602-635::672-705::134-167::318-351::513-546::568-601::602 -635::65-100::672-705
MLCACSGEQFKFEEAPPRSPDSLATRDFSASGLSSRTGDWESKFDETQVEDVESTLKEALSLNYEEARALLGRLEYQRGNFDAALQVFEGIDIRALTPRMIRAIAERTKQRKSRSKVDNVLPNVMSMHSVSLILEAILLKSKSSEELGRYTEAAKECRIVVDTVESALPNGMPEGIGEDCKLQEMFHEALELLPNLWMKAGLLDEVVTAYRRALVKPWNLEPQRLACVQKDLATTLLYGGVEVNLPPQLQVNGITTPMSGTEEAILLLLILSGKMALQEIDWDPEIMDHLTFSLSVTGMFESLADHVEKILPGVHDRAEQWYFLALCYSAAGQNEVALNLLRKACGSSEAKHRPHFPSFLFGAKLCSLNPNHAREGIKFSQEVIDLVKHQNEHFLSQGQKFLGICHGAAARISVLDSERIIFQKESLKFLKDAALNGNNNDPEVMLTLGLENAIQRNLNAAYDNIMMYSDMMAGSSRRGWQLLALTVSAQQRFQDAETIVDFALDEAGDIDQLELLRLKAVLQITQQQPKQAIETYRILLAVIEARKEHWLQAKTFRHEALTEQKLEMEAWQDLATIYADLCSFLDAKACVDKSQSIEFFSPRSWHITGLLFEAQSLHKEAFVSFSVSLSIEPDYIPCIISTAKLFLKLGIPSLPIARSFLMNALRLDPTNHDAWFNLGLVSKMEGSLQQAADCFQAAYELKLSAPVQKFE

SEQ ID NO: 227861 - protein, 91 aa, Glycine max
  Coding DNA Sequence Number=SeqID_111083
MVWHGSHITLLSLKHVLKGLIPGPCVQKTFVGRGVDWNCRQEQFENSAAGRAARAQQQAMAKQSANANKGEPVLKVGLVFKMPLMFLATTN

SEQ ID NO: 227862 - protein, 455 aa, Glycine max
  Coding DNA Sequence Number=SeqID_111084
  Gene Ontology: Mol. function=protein binding
  Homolog annotation: Hit_ID=Q1SA54; Match level="QueryCoverage=48%, HitCoverage=100%, E-value=4e-74, Identity=66%"; Hit description =Leucine-rich repeat; Leucine-rich repeat, ribonuclease inhibitor subtype; Leucine-rich ...
  Homolog annotation: Hit description=repeat, cysteine-containing subtype
  Pfam annotation: Domain name=LRR_1; Domain location=160-179; Score =6.6; E_value=16; Accession=PF00560.23; Description=Leucine Rich Repeat
  Pfam annotation: Domain name=LRR_1; Domain location=207-229; Score =4.3; E_value=44; Accession=PF00560.23; Description=Leucine Rich Repeat
  Pfam annotation: Domain name=LRR_1; Domain location=235-258; Score =13.7; E_value=0.66; Accession=PF00560.23; Description=Leucine Rich Repeat
  Pfam annotation: Domain name=LRR_1; Domain location=267-285; Score =1.5; E_value=1.5e+02; Accession=PF00560.23; Description=Leucine Rich Repeat
  Pfam annotation: Domain name=LRR_1; Domain location=296-318; Score =2.1; E_value=1.2e+02; Accession=PF00560.23; Description=Leucine Rich Repeat
  Pfam annotation: Domain name=LRR_1; Domain location=67-90; Score=4.3; E_value=45; Accession=PF00560.23; Description=Leucine Rich Repeat
  Pfam module annotation: Pfam domain module=LRR_1::LRR_1::LRR_1::LRR _1::LRR_1::LRR_1; Domain location=160-179::207-229::235-258::267 -285::296-318::67-90
MNKDHGNNMIKGALTSGFCLGLQNVLCTAETSVLLRECKLQSLVLRCIRSKEQIDGLCKLLAQHCRTLTSLEFVHCALSTDFINAIFGSLVIERVQKHGIQHLSIIATSFLEPCTVSLPSGLVSFLSSGRSLCSLKLSENHHGWTFAKDLFVTLLNLSSGISVLDLSRNRLTKVLCTCFKISGWLFYYRRSLSGSHLSFGNGKSLKLLRVLNLRENNLGKDDVQHLRYALEHVPNLEELDISDNSIEDEGIRNLIPYFVGASETCPRITCLKLENCDLSCVGVNLLLHYLSTFKGPLKSLSIAENYLGRQVVEALGNFFHTPIEVLDIAGIGLGSDGFQELQSLIKEEIKLVKINISKNRGGTETAKFLSKLLSQAPQLVDVNAACNLMPIESLAIICCALKFAKGNVQQVDLTGHIWDYKPEHVSPYAEFVHNGLPILVLPSPSVSAAPHDHDP

SEQ ID NO: 227863 - protein, 701 aa, Glycine max
  Coding DNA Sequence Number=SeqID_111085
  Gene Ontology: Mol. function=RNA-directed DNA polymerase activity; Cellular component=exocyst; Biological process=exocytosis
  Homolog annotation: Hit_ID=Q6YZW7; Match level="QueryCoverage=96%, HitCoverage=97%, E-value=1e-105, Identity=35%"; Hit description =Putative leucine zipper-containing protein
  Pfam annotation: Domain name=Exo70; Domain location=55-663; Score =141.9; E_value=1.8e-39; Accession=PF03081.6; Description=Exo70 exocyst complex subunit
MALEEDHPTTTLLKLQSACSDLKTLLRASEETQDNLGNTDSRFHLLQGSLSTASRGIAPLQSLAMSRKALDTRITRALSPALTLLNTFKFTESLQNSLVVLSTKLSSEKPHHVRRLQRLLEYTECVDQLNEGLNNISDEVEVVIMKLQEVVEFISRTKAADQYREARLREALGTLKGLYEIEVDEMRFQGLLDQALVHVQDEFEGLLLRIKHRNFGDLVHQHGDDFRELGSELEIQVLRKISTTLAANDCLDICIDIYVKARYRRAAKALMKLNPDYLRTYTPEGIDEMEWETLETAITLWIQHLEVAVKKVLVAEKKLCERVLGDFMEGLIWPECFIKISDKIMAVFFRFGEGVARSNKEPQKLFKLLDMFESLEKLKPDMSQIFEGESGVDICTRFRELEKLIIDASSKVFLELGLQIEGNIDGLPPPQDGSVPKLVRYAINYLKYLTTVNYRTSMAKVLRTQQTWKDSSSSSNDMSSDEGLLKHAISNVMDALQRNIEAKRLCCRDKVLVHVFTMNTYWYIYMRTKNTELGEVLGEKFMKEGYKAVAEESAYLYQKQAWGGLVRVLDGDDVREEGKGSVGRVVSEKIEAFFKGLNEVCERHVRGVYSIPDVDLREQMREATVRLVVPVYAEFLEGYSGLLQRKGYPSVERVNGLVGKAFDGGKLKGRGSASSDWNVARNSGSLERDVVRSRNDGGGDV

SEQ ID NO: 227864 - protein, 151 aa, Glycine max
  Coding DNA Sequence Number=SeqID_111086
  Homolog annotation: Hit_ID=Q9SLT8; Match level="QueryCoverage=47%, HitCoverage=26%, E-value=1e-19, Identity=71%"; Hit description=ZCW7 protein
NLNVAEDDDFGKDANEDSGDLVSGLYCKIVVQFEKYRDSHDALKVVCGRPIMRFVGTEMDFFGIQGIKLKATCLEHDKHRDSWALTQSYKTGLAADHCRSEAPTRQAYNSRHSPDNVRPRRFKALIATCITPYGARTTEWLEWKYYASEAH

SEQ ID NO: 227865 - protein, 187 aa, Glycine max
  Coding DNA Sequence Number=SeqID_111087
  Gene Ontology: Mol. function=RNA-directed DNA polymerase activity; Cellular component=signal recognition particle, endoplasmic reticulum targeting; Biological process=RNA-dependent DNA replication
  Pfam annotation: Domain name=zf-CCHC; Domain location=135-152; Score =8.9; E_value=0.033; Accession=PF00098.13; Description=Zinc knuckle
MKGSLWTSSKGLDKGSMSVEEYKQQMELLVLRVGLREEDRKIIARFLSGLNMEVGEKVELLPYRDLDDLVQLCIRVEQQLKRKPTSKYYNSHSYPKKDQGQGILGAASSKPKDDKGKTIEKKTPKASIQEKTSSINYFKCLGRRHIVSQCPTKKNMIMRGQDIYSSQDEATTSPSSNESEETKGEES

SEQ ID NO: 227866 - protein, 283 aa, Glycine max
  Coding DNA Sequence Number=SeqID_111088
  Homolog annotation: Hit_ID=Q9SLT9; Match level="QueryCoverage=55%, HitCoverage=65%, E-value=6e-09, Identity=31%"; Hit description=ZCF37 protein
MLNLFVCGPFHNEYDDEPCLASPNSSSPRKYKRKNSKNNNPYSTRGLDKFSELLADLDEKRQKIYSQTNPHDISFVRFVYSNTDDDIVPVVVKVKNNNKDHRHSKSQELKVVRARTTTTTLTHNTSESTDKSATADKKNPVEERKQHKLETHAKVAKKKNNNFSSDMGKPSFYVPVVAILILLLLVVFGRSVTTLCICILWYVMSTLKGSSSSSNTLKSMKKKDLSEKKIVINEGTKKKNYVRGWSEKMVVSEGSNKKKDYGRGWSEKKMASTDGLISPRSGE

SEQ ID NO: 227867 - protein, 364 aa, Glycine max
  Coding DNA Sequence Number=SeqID_111089
  Subcellular localization annotation: CTP_CleavageSite=80; ConfidenceScore=5.12e-01
MIKTLNPYPNPAKTAEIMSRYRPIAPKPETSPNSMSEGPSSSSLSQKIKQSPYLRNLWPQLQARPTRTRKRGRAPLTLPSSSLKRHKTTHHHVLGFCPPCHHVVTSSSSSPSKNLSLQGFAPPHPLPHHLGVLNCTMEKNNTNPSLVTLPLLPCSPTLTTKPCAGEVINLNTKASVPEEKDLLQQLQKPVSNNIINVITPQPIRPIGSSISVVCISEDSTLSPLAQTPKKPNEVEQEVENEALPTVISDSNHRIRMANSAYKEMVGQPVCPWLESMGNLLQCRRISGEVTLNLSDSSTVIPTSSNGFSCWVRIEWLSEHNNKKKNCINAFCDVMKLACESRDYLFTWRFHTRTTREASQSSCNA

SEQ ID NO: 227868 - protein, 62 aa, Glycine max
  Coding DNA Sequence Number=SeqID_111090
MRLRQNDERIFIISYGNTVVDKEGKGGGESYKGRRALEERGLMKKDMWGLGIESGSMHGYTT

SEQ ID NO: 227869 - protein, 471 aa, Glycine max
  Coding DNA Sequence Number=SeqID_111091
  Homolog annotation: Hit_ID=Q9LHH2; Match level="QueryCoverage=96%, HitCoverage=37%, E-value=6e-66, Identity=34%"; Hit description =Ankyrin-like protein
  Pfam annotation: Domain name=F-box; Domain location=10-57; Score =35.4; E_value=1.9e-07; Accession=PF00646.23; Description=F-box domain
MANNEKDACSSFTDFPEDIQVCILSFLGPPEIATLACTSKRMGSLCATDSKLWFSMCERRWGSYTRITQWAQGKNPTLSFKHLYNTLHRWENLLGFWRRSGTGIPSLLFFEWGPSFISASRVSPSASDSNSVTYGVTKTPFLWMSLSEEGHVVTYLDPDGRSDFKPEIRSELVAVDVSFMGKTHLVVEEKRVRGGACHDCGDDVVVVESGSPPEKLMAEIYQHFANPRSPGSDRSRRQRRREKERLAGRKWEPQHFVKIVNCSPTPARPCRACGSSFRARHNRNYGCIGHICPLLQFETLTMGICGDMSLAFYLVGYDDIGGIACRRIGDPPDRFSGHAPVFWTSNATFLESPFSPEEESLYDSRVHLRPLQPGNEVLEQFPFSDSEVVNQIQQFQLSDNVVDRILHISSSYDLVVPDLAGTLNPRSAEGRIWQYRNGTFGFGFLSDNFVIDMKHIVHNGCIVDTVNSSAN

SEQ ID NO: 227870 - protein, 117 aa, Glycine max
  Coding DNA Sequence Number=SeqID_111092
  Gene Ontology: Mol. function=DNA binding; Cellular component =nucleosome; Biological process=chromosome organization and biogenesis (sensu Eukaryota)
  Homolog annotation: Hit_ID=UPI000065E2E3; Match level="QueryCoverage =71%, HitCoverage=22%, E-value=9e-39, Identity=95%"; Hit description =Homolog of Homo sapiens "Histone 1, H2ai
  Pfam annotation: Domain name=CBFD_NFYB_HMF; Domain location=28-91; Score=5.0; E_value=0.053; Accession=PF00808.13; Description=Histone -like transcription factor (CBFNF-Y) and archaeal histone
  Pfam annotation: Domain name=Histone; Domain location=25-94; Score =67.1; E_value=5.7e-17; Accession=PF00125.14; Description=Core histone H2AH2BH3H4
  Pfam annotation: Domain name=TAF; Domain location=28-92; Score=-6.7; E_value=0.023; Accession=PF02969.8; Description=TATA box binding protein associated factor (TAF)
  Pfam module annotation: Pfam domain module=CBFD_NFYB_HMF::Histone::TAF ; Domain location=28-91::25-94::28-92
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFGVFVIVVAPVFIGLEV

SEQ ID NO: 227871 - protein, 781 aa, Glycine max
  Coding DNA Sequence Number=SeqID_111093
  Homolog annotation: Hit_ID=Q2HT93; Match level="QueryCoverage=100%, HitCoverage=96%, E-value=0.0, Identity=62%"; Hit description=P-type trefoil
MSKTSSITTARSEMWRGRLGSALRTTLACTVAGCTSLYGPAPLRRYLEFPSFMYVTTVLVVSDATLGDTVRGFWHVVCSNIQVMMLSLLSLQLIGPHRFNSCVAALAMAASAFVVGLPESTHLVTKQLAFGQLVNVFVSTVVDGGRTGVAVHPVHVVCSTAFGGVAAVLAMLLPFPRLAHYETRKFYRLYAKNTCERFDCNIEAISASDNSTAVGFIAQAKSLSTTGAKLLQIIRSKQDGMHWEWPQTRIFNSHWIDPEDELQHLELTIRATDIALSTCTSFPVGVIDEELRGVLLNCRGHFSKVLGQQAKCFDSFDATITSDMKKEILTKNLSIAYKDLPTSFFLYCVHLLLYDSPIAKKTDHVLGKTQKRGDFKWSARKTREVVMNLIPNNHNLAFAFKSSLSLGLAVFLGLTYNKENGYWAGLLIALCFVPGRHPTFSLANARGQGTAMGSIYGILCCFVFKKIVDFSFLPLLPWIFFSSFLKYSRMYGQAGGIAAVTGALLVVGMKHNDPPSQFALARMVEATIGLLCFVIVEIIFNPCRAATLAKSELSQCLRSLHDCIGQIAIITPTKREMPFSSCQELREGQKKLKSLVCQLEEFTAEAELEPNFWFIPFHNACYRKMLESLSKMADLLLFVAYSMENIMLLSQKNGAFGVDLHDGVNKNVRIFKNKVSPTLEHLEEITRKKIPGKLANELNRNIPCDIEAQEHPNAEALRVWSGDEVVDSITGSFLKHLEEMANKTHTNIDEEMLKSQMLFHYSCLGFCTNNLMRETMKIQSE

SEQ ID NO: 227872 - protein, 54 aa, Glycine max
  Coding DNA Sequence Number=SeqID_111094
MAPRRISGFGFVAVVNCGMVVSLVCYGGFQFGWRLPLEREKMEKGKEEEQRRDG

SEQ ID NO: 227873 - protein, 483 aa, Glycine max
  Coding DNA Sequence Number=SeqID_111095
  Homolog annotation: Hit_ID=O80926; Match level="QueryCoverage=99%, HitCoverage=100%, E-value=0.0, Identity=74%"; Hit description =Expressed protein
MENHHPSTLLSMDSSASSHEELDLEMNTQIIPPDINLPLSAERSPPPQPWNSDPCDILDVGLGTQGYETETFLNLPKAGRKCTKRIDSIWGAWFFFRFYFKPVLHEKSKTKVIRDSSGVSGFDKTDLNLDVFMVQHDMENMYMWVFKGRPDNALGKMQLRSYMNGHSRQGERPFPFSAEKGFVRSHRMQRKHYRGLSNPQCVHGIEVVPSPNLMGLDKDEQKRWMELTGRDLNFTIPPEASDFSSWRNLPNTDFGLERPPVPIKSAPNSHPKKLLNGTVLNLSNHSNGDAIDLSPVNGKKRKELFLNDEDYYLSVNPPSDRIPDIEMQPTEHPWLNDFSGVMKNVCGPVTAGKTIYEDEEGYMIVISLPCVDLSSVKVSWRNTLIHGIIKVSCVSTSGKPYIKRHDRTFKLTDPSSEHCPPGEFVREIPLSTRIPEDANIEAYYDGPGSVLEIMVPKLRVGSEEHEVRVCLRPHLGGNDLMLT

SEQ ID NO: 227874 - protein, 450 aa, Glycine max
  Coding DNA Sequence Number=SeqID_111096
  Homolog annotation: Hit_ID=UPI000016287F; Match level="QueryCoverage =33%, HitCoverage=34%, E-value=8e-18, Identity=36%"; Hit description =protein binding
  Pfam annotation: Domain name=Ank; Domain location=116-148; Score =15.8; E_value=0.15; Accession=PF00023.20; Description=Ankyrin repeat
  Pfam annotation: Domain name=Ank; Domain location=48-78; Score=20.5; E_value=0.0061; Accession=PF00023.20; Description=Ankyrin repeat
  Pfam annotation: Domain name=Ank; Domain location=82-114; Score=29.7; E_value=1e-05; Accession=PF00023.20; Description=Ankyrin repeat
  Pfam module annotation: Pfam domain module=Ank::Ank::Ank; Domain location=116-148::48-78::82-114
MEILEDPKLRDDAMRELYEVSLNGCVSTLKTLIQKGPLILSRISVYPYTETPLHIASLLGHLDFCEVLLQNSPSLPTELNSEGRCPLHLASANGHTEVVKALLRTNPEMCLVGDKDEMLPLHFAAMRGRVGAIKELIKAKPDSIREMTKTNDGTSSPSQTNNDSPSSSESLLTNNDHELAQVSLQQTSTGNSNPPSSPASQSNGHVQAVTSTVVSNQETTLTTYPQQQPTSSQTQSVTIELAQQDPPPQASAQLSQLQQTASQSNAPVVQPANITTSDQRQQGQDDTWSRLERFFRTYLLEQGNWIDNGSRKHLLVVATMIATMAFTSVINPPGGVWQGDTTQDGFACHDYGFCEAGTAVMGYVWPLAFVKFLSSNSLSFFLSLCVMLVLVIGFPVENNKVVMWMLAVLIIGAATCMMFTYSTGLSYEYCLDDLAHHFQFDSNKPNRILV

SEQ ID NO: 227875 - protein, 179 aa, Glycine max
  Coding DNA Sequence Number=SeqID_111097
  Gene Ontology: Mol. function=DNA binding; Biological process=DNA integration
  Homolog annotation: Hit_ID=Q1SS72; Match level="QueryCoverage=83%, HitCoverage=10%, E-value=9e-43, Identity=50%"; Hit description =Integrase, catalytic region
MNEASINNAESYLYLHPSENPAIALVSPVLDSTNYHSWSRSMVTVLSAKNKVEFIDGSAPEPLKTDRTYGAWCRCNNMVVSWLVHSVATSIRQSILWMDKAEEIWRDLKSRYSQGDLLRISDLQQEASTMKQGTLSVTEYFTRLRIIWDEIENFRPDSICSCNIRCSCNALHHHRTTQA

SEQ ID NO: 227876 - protein, 72 aa, Glycine max
  Coding DNA Sequence Number=SeqID_111098
  Gene Ontology: Cellular component=chloroplast
MVGASLKKDLRVSRVVSGGSLNVFLFLLIGVISQSTLGERNTTGAMIYFTGEVSGSSPKWSSYVNEKNRKLI

SEQ ID NO: 227877 - protein, 1265 aa, Glycine max
  Coding DNA Sequence Number=SeqID_111099
  Gene Ontology: Mol. function=DNA binding; Cellular component=beta -galactosidase complex; Biological process=DNA integration
  Homolog annotation: Hit_ID=Q1SS72; Match level="QueryCoverage=99%, HitCoverage=86%, E-value=0.0, Identity=47%"; Hit description =Integrase, catalytic region
  Pfam annotation: Domain name=rve; Domain location=399-559; Score =156.7; E_value=5.9e-44; Accession=PF00665.16; Description=Integrase core domain
  Pfam annotation: Domain name=zf-CCHC; Domain location=63-80; Score =3.0; E_value=0.32; Accession=PF00098.13; Description=Zinc knuckle
  Pfam annotation: Domain name=zf-CCHC; Domain location=99-116; Score =12.8; E_value=0.0078; Accession=PF00098.13; Description=Zinc knuckle
  Pfam module annotation: Pfam domain module=RVT_2::rve::zf-CCHC::zf -CCHC; Domain location=762-1017::399-559::63-80::99-116
MQFLRGLNDQYTNIRSHVLLMDPIPAISKIFSYVAQQERQLLGNTGPRINFEPKDVSINAAKTICDFCGCVGHVESVCYKKHGIPATYDGRHKNNNGRKTCTHCGKIGHTVDVCYRKHGYPPGYKPFGGKTTVNNIMAVEGRTTDDHAQQHESQEVVHFSPEQYKALLALIQQPQAGNSASNQPKQVASMSSSTINTSLNPGTSLSTHTYPTSWILDSGATDHVTCSLHNLYSYTKIESITVKLPNGHHVHATHSGTVHFSSNLILHDVLYLPTFTFNLISISKLVSSNNYELIFSSTSCVLQETNNHVKIGIVEARHGLYHLIPNQIPTKAANSIITHPQCNIIPIDLWHFRMGHPSIERLQCMRNYYSLSRNDTNFVCNTCHYAKHKKMPFSSSKSHALHSFDLLHMDIWGPCSKLSMHGHKYFLTIVDDHSRFTWVYLMKTKAETRHIITNFIAYIETQYDGKIKIIRSDNGMEFFMHDYYASKGIIHQTTCVETPEQNGIVERKHQHLLNVTRSLLFQASLPPTFWCYALPHATYLINCIPTPFLHNISPYEKLHKHPCDISNIRVFRCLCYINTLKANRQKFDPRGHPCIFIGFKAHTKGYLVYDLHSHDVAVSRNVTFYENYFPQLPETQPSNKNNSAPSPIPFFGKELDPPEERQIPQTSIPTHPPCNDHLREQAPSQSRRSTRSKRSPTYLQDYHRSLASSTSTASMVVRYPLNSVLSYSRLSPAHRNFVMTISSAIEPASYVEASRHDCWIKAMTAELQALQMNNTWRLMPLPPHKTAIGCRWIYKIKYRADGSIERYKARLVAKGYTQTEGLDYLDTFSPVAKLTSVRVLLALAALNKWHLRQLDVNNVFLHGELEEEVYMQVPPGLPVDNLRLVCRLQRSLYGLKQASRQWFTKLSSFLTSHDFQRSNSDHSLFLRITGSTITILLVYVDDIILTGNSLTEIQAITTLLDQKFRIKDLGNLKFFLGLEIARTSKGIHLCQRKYVLDILSESGMLGCKPHSTPMDYSVKLQKSSGNPLPNESSSSYRRLIGKLIYLTNTRPDIAYAVQQLSQYMAAPTTAHLQAAFRLLRYLKGTPGSGLFFAATGTPQLRAFSDSDWAGCKDSRKSTTGFLVYLCSSLVSWQSKKQSTVSRNSSEAEYRALASTTCELQWLTYLLQDLRATFVQPATLYCDNQSAIQIATNPVFHERTKHIEIDCHLVRNKVTSGFIKLLPVSSSLQLADIFTKPLTPVVFQHLCNKLGMINIHSQLEGGVLTV

SEQ ID NO: 227878 - protein, 627 aa, Glycine max
  Coding DNA Sequence Number=SeqID_111100
  Homolog annotation: Hit_ID=UPI000016287F; Match level="QueryCoverage =34%, HitCoverage=51%, E-value=4e-26, Identity=33%"; Hit description =protein binding
  Pfam annotation: Domain name=Ank; Domain location=116-148; Score =15.2; E_value=0.2; Accession=PF00023.20; Description=Ankyrin repeat
  Pfam annotation: Domain name=Ank; Domain location=151-180; Score=6.7; E_value=3.4; Accession=PF00023.20; Description=Ankyrin repeat
  Pfam annotation: Domain name=Ank; Domain location=189-224; Score =12.7; E_value=0.46; Accession=PF00023.20; Description=Ankyrin repeat
  Pfam annotation: Domain name=Ank; Domain location=48-80; Score=20.7; E_value=0.0053; Accession=PF00023.20; Description=Ankyrin repeat
  Pfam annotation: Domain name=Ank; Domain location=82-114; Score=25.3; E_value=0.00021; Accession=PF00023.20; Description=Ankyrin repeat
  Pfam module annotation: Pfam domain module=Ank::Ank::Ank::Ank::Ank; Domain location=116-148::151-180::189-224::48-80::82-114
MEILEDSKLREDAMRELYEVSLNGCVSTLNTLIQKDPLILSRISLYPYTETPLHIASLLGHLDFCEVLLQNSPSLATELNSEGRCPLHLASANGHTVVVKALLRTNPEMCLVGDKDEMLPLHFAAMRGRVGAIEELIKAKPDSIREMTKTDDGSVLHLCVRYNHLEALKLLVESLRSEHQFLYSLKDKEDNTLLRLAVKRRQIKIVKYLLSLSEMSTEINTLNKEGLISMDTLGQCPREFISQHILTEGVEKSENEVITQEAVSSTTLVSNHQTTLSTSRQEPTSSQSSITIVIVQPDLSLASSPSQTNNDPPPQTSSSSSSESSPTNNDPEPAQVSLQPTQPYRQQQSSQTQSVTIELVQLDPPPQPSPQQIPSPSQTNINPEQGQPSTQQTPTNNSNSIPPATPSNGQVQPLTSENIITSENQGHPNRWNRFERFCRTYLLDDGNWMMDIKTREQLMVAATVMATMTFQSAISPPGGVWQGDTTQDGFACPDYGFCQAGTAVVGYAWSPDFLKFIFLNSSSFFASLCVMLVLMSGLPLENKVVMRILTFFMIVAASCMLLTYMWALGMVSPNHIYYTTKKLGYLLVGMWAFLLALVILLHASRLVFWFRSPRTPSSTNIAPPSLP

SEQ ID NO: 227879 - protein, 211 aa, Glycine max
  Coding DNA Sequence Number=SeqID_111101
MKREKYASYSSHNPCKSLSEELHDYYEGKHRSHLRPHSHRRENEIKPQEANINLSYFHGKDNVEANLDWEIRVEQQLKRKSTSKSYGSNFYPKKDQGEGILGVTPSKPKDDKGKTIEKQPLKASMQEKTSSMNSQDEATTSPSSSGIEEAKEEESSEEIYPQEEGQPLMVKEECKEVSVSSKRYLAPIVRQFVKFRDMPELKRKHRCTIRE

SEQ ID NO: 227880 - protein, 233 aa, Glycine max
  Coding DNA Sequence Number=SeqID_111102
  Gene Ontology: Mol. function=nucleoside-triphosphatase activity; Cellular component=chloroplast; Biological process=macromolecule biosynthetic process
  Homolog annotation: Hit_ID=Q2PMM5; Match level="QueryCoverage=99%, HitCoverage=12%, E-value=1e-130, Identity=84%"; Hit description =Protein ycf2
MSHTNGFGSTTMGSNVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRVTLLLRSEPRNPLNMIQNGSYSIVDQRFLYEKYESEFEEGGGVLDPQQIEEDFFNHIVWAPRIWSPWGFLFYCIERPNELGFPYWA

SEQ ID NO: 227881 - protein, 102 aa, Glycine max
  Coding DNA Sequence Number=SeqID_111103
MTPPLTSSPLSSAASPWFPYDCEKLKNKKVAVAGVSLSEAYALSEQHPLSETSARLASEENLEKNLPRMHALSVPSARPASHLSLLAPNAPDSLSQKSLTRA

SEQ ID NO: 227882 - protein, 148 aa, Glycine max
  Coding DNA Sequence Number=SeqID_111104
HVHTHEYRAFQFRPASLSFEPRSLDVVNIGPAFRGHYGAFAPNSNLPPLDCGPHDSPMISDGGDETMGKMKQATKDQRELNQCAEGFEVGRLSRMMGSEAKNYTEGLEELYQKMLVKIENLSGLVEKSSAMVIEQGNFVDFYNNCFNS

SEQ ID NO: 227883 - protein, 111 aa, Glycine max
  Coding DNA Sequence Number=SeqID_111105
MPNSLKIVRSGVANYCNLPFDGRATQGSRVRHPREEDARSSHQHLFEEIVGKTRTCGLRTLSVKGLGFVFTHGEEASFMMMNQAILTMPKAQVIDSRLQDQASRIQSKIQD

SEQ ID NO: 227884 - protein, 56 aa, Glycine max
  Coding DNA Sequence Number=SeqID_111106
  Subcellular localization annotation: CTP_CleavageSite=35; ConfidenceScore=5.12e-01
MAGVGRYMAPTDIFQPTLRNFLYKRWPIMTARFFRASSTGGSFRPTQACCSSHLGG

SEQ ID NO: 227885 - protein, 156 aa, Glycine max
  Coding DNA Sequence Number=SeqID_111107
  Gene Ontology: Mol. function=sequence-specific DNA binding; Cellular component=intracellular
  Homolog annotation: Hit_ID=P0AAR8; Match level="QueryCoverage=50%, HitCoverage=63%, E-value=8e-24, Identity=71%"; Hit description =Hypothetical protein ybaV precursor
MVIAAVLLACAAGSQGALAASASGKAASAKETIQAPQTKMPEEAKTADTHGAQVSINNASAEELAQAMNGVGLKKAQAIVSYREEYGPFKTLDDLKQVPGMGSSLTQIKVRGYHLDVYQHVNNARYLEFLEEARWDGLESSPAFHWMTSHNIAFVV

SEQ ID NO: 227886 - protein, 96 aa, Glycine max
  Coding DNA Sequence Number=SeqID_111108
ESIESAIKNLEVQVGQLAKQLADRPSSSFTANTEKNLKEECKVVMTRSRMEIQADEGRAEEKVEGYKQQLAAEPALELVSDFVELEEVVEDEDDQQ

SEQ ID NO: 227887 - protein, 108 aa, Glycine max
  Coding DNA Sequence Number=SeqID_111109
MLGSALSVPIALRLNYSLLSANMLLFFSPLNKAKRNCYAKPLLSVKEAKRALCAKPKGHSSKAELSPACYAKPKPSSVLKIMASKKRKAPATPSQVRYDRSRFTSPEA

SEQ ID NO: 227888 - protein, 218 aa, Glycine max
  Coding DNA Sequence Number=SeqID_111110
  Gene Ontology: Mol. function=transition metal ion binding
MSGAYIQARMDHAISSQPRKVLKAPDRPIAIRENYITDSRTLLTLRPQGDAQSVAAYKVQDGSGVTQFTASGRKYNGRSCREFRDSSGLPLFELHRKFSFRDAWCITLPGSPTAESIATGAPRLAPFGNLVFTFTNVAVTDVKGSVDDKKVTLEVERHGRVLESFDIVDGDRKVAEVRESVQHNPKLALTPSTRRNYRPVLDIIVTPGVDLSLVRSIP

SEQ ID NO: 227889 - protein, 189 aa, Glycine max
  Coding DNA Sequence Number=SeqID_111111
  Pfam annotation: Domain name=Transposase_23; Domain location=102-175; Score=6.9; E_value=0.0002; Accession=PF03017.5; Description=TNP1ENSPM transposase
DELQEQTKQGAFVPHGRQDILNTAIGCPEHPGRVRIDGHEDENKDRMDQLKMELDAIKSELSQIHTQQSAPPRPSNPDVFVARVSTKESCAEAANNVVGNERSTFDTCSMGLYIVCGDSTQLVAGGKVFGVGDTIHIVAYGDDVLRVCVDTVYDGEAIVPLPTSEIQYVRDAVNSFIGWPRHLVKPLSY

SEQ ID NO: 227890 - protein, 216 aa, Glycine max
  Coding DNA Sequence Number=SeqID_111112
  Gene Ontology: Mol. function=hydrolase activity
  Homolog annotation: Hit_ID=Q1T1F7; Match level="QueryCoverage=98%, HitCoverage=44%, E-value=4e-20, Identity=31%"; Hit description=IMP dehydrogenase/GMP reductase
MVFLDALRDLTQSRGYAWGAAALVHMYDNLNDTSKSTVRQLVGYITLLQCWIYEQFSSVSFTVPAEDYDEKRQRACRWTSGKALPISTYRRRMDRLTPDAVCWSPYGDHRSFREFEVISLFFGHFKWGPLAVIHRPERVVQQFGYIQTIPPHPIASSLSIEEINDRRMQFGEYIAPVGQLCAIPDHYSPDYMDWFYMISHPFMSLAQPRDPPRVPL

SEQ ID NO: 227891 - protein, 225 aa, Glycine max
  Coding DNA Sequence Number=SeqID_111113
MDDRRGFRRGRPVAMNGDPTGLCTFVGCVFIRTWGCARQPVNLQPSPKPDKGWKAGPWSKASHAMDGVCRAIRDETASLRSGPVFHPETAKTTDEKKPAFCKAGFLNDGRRERITLLCEKRPAGRCWRNVVSLRSAQTSFGGSHPLFATDEKKPAFCKAGFLNDGRRERIRTSDPLVPNQLRYQAALLADGGEYYCRDFRASIPFPENPPDCLESKQCIKHLPAQ

SEQ ID NO: 227892 - protein, 92 aa, Glycine max
  Coding DNA Sequence Number=SeqID_111114
  Homolog annotation: Hit_ID=UPI00005F954D; Match level="QueryCoverage =78%, HitCoverage=41%, E-value=1e-07, Identity=41%"; Hit description =COG0433: Predicted ATPase
LQVVLNKAVTLKGQPGTAAGYGDFRQFPDLLVLGYFWRKVDGKLLALQITLPADNQQQAQSDVDAIVKSITLKYVCTNGSGAIYRALLKTAQ

SEQ ID NO: 227893 - protein, 48 aa, Glycine max
  Coding DNA Sequence Number=SeqID_111115
MALYRLAFAYSNPLKILGCPAATFFACPAPGRDDDLSLVTLSSICIHP

SEQ ID NO: 227894 - protein, 119 aa, Glycine max
  Coding DNA Sequence Number=SeqID_111116
MVEPSKKRKGSSIKAFYSNLEIQESTLISEVYGIKIIINQSLFYDLTKLSSDGVPFEGALDDDWKFDFSVQDARRLVCTNQADMTGRLLAGSLALESRILHLSNCLYLTPQIFKPCIGF

SEQ ID NO: 227895 - protein, 303 aa, Glycine max
  Coding DNA Sequence Number=SeqID_111117
MLKGAKPRKTIAVEGLADVRFFNQWFSENEKIRFVSLDGKPNVLRLHKDYLKSPLKSVKGMFFCVDIDWDLIHGKALPLKEDFLINSYCQIKNKFSFNDLESFLINSRALQKLIASYDLVIEDFNDFKMKIEVCSRKIGKYRAADDIIKNKFMLRNSVLNGASVDDFFDAENFEFNEKLFTENMPRWANYSEHIEDLVQEAEILDDANKELWSLSRGHDITTMLSLFIENKAKIKTSPEKIEKELRLSCEYADFLTSPMYEKMLVHNVTQMRRVCHLFWEISADAGDHVEQRASPPFRHSGCY

SEQ ID NO: 227896 - protein, 187 aa, Glycine max
  Coding DNA Sequence Number=SeqID_111118
  Gene Ontology: Mol. function=RNA-directed DNA polymerase activity; Biological process=RNA-dependent DNA replication
  Homolog annotation: Hit_ID=Q1SE58; Match level="QueryCoverage=88%, HitCoverage=26%, E-value=5e-10, Identity=24%"; Hit description=HAT dimerisation
MADSFLGDISQQQLHPLREDTWIWKPEPAGDYSTKSGYDLIWGELMEAKQEQDYGAIWKLKIPIKIAVNKEEWAAHLFFNCSKTLPLWWESMSWVNLITVMPQNHRDHFMQHGMEVTDGVRSKTWKCWWIALTWTIWHHRNKVVFQDTTFHGTKLLEDALFLLWSWIKAMDKDFTLHFNQWSSNLKE

SEQ ID NO: 227897 - protein, 82 aa, Glycine max
  Coding DNA Sequence Number=SeqID_111119
  Subcellular localization annotation: CTP_CleavageSite=47; ConfidenceScore=5.07e-01
GSRLQNIQWTRRSPTGSWNCQALITGLFQFYGVPVTSSKGIRPPTNRAFIKKYCVSRQAQGETPQQPGDGQQRATDAPPSPL

SEQ ID NO: 227898 - protein, 124 aa, Glycine max
  Coding DNA Sequence Number=SeqID_111120
MYKDNWTQPWPMGLEIYPNVHENPRAFFSYSSPILLEPRAHSSMAVIMRSDTNTGMRRRTSFVIIGCEMTGQYGSRKKDFVRRDIGSMKCGCPFKLHGKPVVGGCSFSHMVPFSTIFNKYIQGK

SEQ ID NO: 227899 - protein, 52 aa, Glycine max
  Coding DNA Sequence Number=SeqID_111121
MSPRRYMPNESEPSNENPTKNSQKDPFTLKDANLRVKICPNVHHLNLKMLVN

SEQ ID NO: 227900 - protein, 128 aa, Glycine max
  Coding DNA Sequence Number=SeqID_111122
MVFKTFLIMGTGKGKVIMREYTKKLENSYAFIAELWGVLESLKVVASKHIRYLELQIDSRCFDDNKDDDKKPKRMISRLSQEQFKNQEKDSRESFIKKIQDSRFKNNQDQDSRLKDSRIKRRLNRDKY

SEQ ID NO: 227901 - protein, 328 aa, Glycine max
  Coding DNA Sequence Number=SeqID_111123
MKKARKEEWCRNKFRGALLGNSNELKLRKAERDKSRMENVMLEDKLRNCQRSKGSLKEQLSKTEENMLIIIDKYKEKVNQAASHGQMLRDEQAKMSALRSQELPRLLARAKTVANTYSALDEVDMEAMKEHMTTMMEAMMSMRKMMEVNTTTVGVASTATEVDLIHLSGFNRVGCPVSDVVGQGGESAENACGPLYVQVQRKHSFLPYGLPPNYTPPTVVYASGKNVNNYEPILIKNQQPQPDHAHAPQPMEETHEAPQDHTLADFGPHSGYAIEGHAFPGPCIVLEKERIEHMEERPRTIEGGENYAFVDMAELCLVSNVVIPPKFK

SEQ ID NO: 227902 - protein, 280 aa, Glycine max
  Coding DNA Sequence Number=SeqID_111124
  Gene Ontology: Mol. function=DNA binding
  Homolog annotation: Hit_ID=Q1S0F5; Match level="QueryCoverage=79%, HitCoverage=43%, E-value=1e-25, Identity=34%"; Hit description=IMP dehydrogenase/GMP reductase
MAETLASQGEWVSFMDVLALLVFEIVLFPNVDRLVDLAAIDAFLAYHHSKESSVIAVLANAYDTFDLRCEKSSAIIVCCTPDLYVWLISHVFNHGSRSVYPLQGHHMCSRKDKANWEELLAGMTGASISWFPRWKEGGAGVLCSCEGFLNVPLMGTRGFINNNPVLAIRQLGYPMRGVPSEETITPFIARGFNKANTKILQKICKAWNKVGRKDKELRGRSNGVIGGYHKWLKSRTQGITWLKKLKGLNGEVAEVPEESEEVQALNDELKKTKVANENLK

SEQ ID NO: 227903 - protein, 94 aa, Glycine max
  Coding DNA Sequence Number=SeqID_111125
MSGQVISAEKTSIYFSKNVFSQLWADLANQSGFKEVGALGRYTGAPLLGVAKVWPFLSKEEWWAIGNGQSVNLWSDKWIDDNTRLKNSFTLCLD

SEQ ID NO: 227904 - protein, 84 aa, Glycine max
  Coding DNA Sequence Number=SeqID_111126
  Homolog annotation: Hit_ID=Q1STZ2; Match level="QueryCoverage=74%, HitCoverage=13%, E-value=2e-07, Identity=38%"; Hit description=IMP dehydrogenase/GMP reductase
MDQVQCQSFSKVYGKIWDLAMIEVSVEAIASLTQYYDQSLRCFTFGDFQLTPTIEEFEGILGCLIGGRKPYLFSGYYPSMAKVA

SEQ ID NO: 227905 - protein, 1019 aa, Glycine max
  Coding DNA Sequence Number=SeqID_111127
  Gene Ontology: Mol. function=DNA binding; Cellular component=nucleus; Biological process=regulation of transcription, DNA-dependent
  Homolog annotation: Hit_ID=Q1SKG8; Match level="QueryCoverage=99%, HitCoverage=100%, E-value=0.0, Identity=65%"; Hit description=SBP
  Pfam annotation: Domain name=Ank; Domain location=850-899; Score =16.5; E_value=0.097; Accession=PF00023.20; Description=Ankyrin repeat
  Pfam annotation: Domain name=SBP; Domain location=102-180; Score =175.3; E_value=1.5e-49; Accession=PF03110.5; Description=SBP domain
  Pfam module annotation: Pfam domain module=Ank::SBP; Domain location =850-899::102-180
MEKVAPPPILMHRKRDLSYDIVSAGPNESWRWEWDSVRFAGKPPPPPPLSPNNDVVFEAESVVPPLQLKLGGTTRVNNNNININVSNKRVRSGSPGTASYPMCQVDNCREDLSKAKDYHRRHKVCEAHSKASKALLANQMQRFCQQCSRFHPLSEFDEGKRSCRRRLAGHNRRRRKTQPEDVTSATPAPAAAANLEIFNLLTAIAGASQGKFEEKRSQVSDREQLVQILNKIPLPADLATKLLDAGSGNVNGKKDHVQLQTPSSSYQCHESHDLLNHTPAAPLTMDLLAVLSTTLSGGSAPDSSASPSQNRSCSSDGGSADQTRQQQFFSVGGERSSSSSQSPVEDSDCQEVRVNLPLQLFSSSPEDDSLPKLASSRKYFSSDSSNPAEERSPSSSPPIVEMQFDLQDGARGLKPESISSGRGVNANKEASQSHSSNISLDLFKGSNNWIQQPSSLQSVPFQAGYTSSGSDHSPPSLNSDAQDRTGRIMFKLFDKHPSHFPGTLRAQIYNWLSNRPSDMESYIRPGCVVLSIYASMSSADWERLEENFLQHVHSLIQNSDSDFWRNGRFLVHSGSRLVSHKDGKIRICKPWRTWKSPELISVSPLAIVSGQETSISLKGRNLSTLGTKIHCTGTGSYASAEVIGSAHSGVMYDKIKLSGFKVQDVSPGVLGRCFIEVENGFKGNSFPVIIADETICKELRPLESEFDEEEKICDAISEEHEHHFGRPRSREEALHFLNELGWLFQRERFSYVHEVPCYSLDRFKFVLIFAVERNCCMLIKTLLDVLVGKHLQGEWLSTGSVEMLNAIQLLNRAVKGKYVGMVDLLIHYSIPSKNGTSRKYVFPPNLEGPGGITPLHLAACTSGSESVVDSLTSDPQEIGLKCWESLVDANGQSPHAYAMMRNNDSYNALVARKLADRQRGEISVTIANAIEQQSLRVELKQKQSYLVKRGQSSCAKCANAEIRYNRRVPGSHGLLHRPFIYSMLAVAAVCVCVCVFFRGRPFVGSVAPFSWENLDYGTM

SEQ ID NO: 227906 - protein, 75 aa, Glycine max
  Coding DNA Sequence Number=SeqID_111128
MWNCGHKAQTIMKAVSIGNKENCDSFSVCSEIQIVIPSAYYILPMQDVQVSGTLGIMRSSVRFQKLLEAGLRVCY

SEQ ID NO: 227907 - protein, 135 aa, Glycine max
  Coding DNA Sequence Number=SeqID_111129
QGWIFVDSGNEMEHETFLATWLAEIDFSPNGLVSKEMSPHVMQDGGSSQYCIIIVILQRILLSEREVYAMMLVFPPEFSPLTTILFGNPSQDTVEPLMEALEEDYKDGNEINESRQFIEGVLDLEKRINRLDTLT

SEQ ID NO: 227908 - protein, 92 aa, Glycine max
  Coding DNA Sequence Number=SeqID_111130
MDEAPTTKSVVQKHPPCYHQSNHQGIQHKNCEHKAGHELALDCFDSTPEEWNWNWVIGKENWVVEFQVRRERERRVEMVETEGGRNKVSEFV

SEQ ID NO: 227909 - protein, 93 aa, Glycine max
  Coding DNA Sequence Number=SeqID_111131
  Gene Ontology: Mol. function=protein serine/threonine kinase activity; Cellular component=transcription elongation factor complex; Biological process=protein amino acid phosphorylation
  Homolog annotation: Hit_ID=Q1S2S9; Match level="QueryCoverage=51%, HitCoverage=8%, E-value=5e-13, Identity=74%"; Hit description =Protein kinase
MSWWSPGYSLGTFTGHSTPVMLVDFHPNKDDLICSCDGDDFGLATSIEVERPLTNRVVTLWYRAPELLLGSTDHGFIIDLWSAGCLMGLNAQK

SEQ ID NO: 227910 - protein, 58 aa, Glycine max
  Coding DNA Sequence Number=SeqID_111132
MPPPNILRQFSGNRLRRCLPTLTPLQLWCRLRRNHPMPSFKRCHLEGHHPCLLIYIAT

SEQ ID NO: 227911 - protein, 1451 aa, Glycine max
  Coding DNA Sequence Number=SeqID_111133
  Gene Ontology: Mol. function=RNA-directed DNA polymerase activity; Cellular component=chromatin; Biological process=chromatin assembly or disassembly
  Homolog annotation: Hit_ID=Q108V0; Match level="QueryCoverage=98%, HitCoverage=87%, E-value=0.0, Identity=40%"; Hit description =Expressed protein
MEWVVHNKEVKHKILFLVEMLEPFLDPGIAVPKSKIAFGDIASSFPEKQEHNCTIALNIIRTAVRKPAVLPSLESEWRHGSVAPSVLLSILEPHMLLPPDVDLCKSVLRPTDHETASISHLSSAINGGGAFSKSNGQDESDGKTNVSEMAGKSDFVEDRNLLFAPQELQSMTLTNFSNIPDQNSSVSNIGDISLESKHVAEKHASHHFPTNILDAGLGFEYFNLQADYFQLLNYHDCELRASEFRRLALDLHSQNDVSVESHDAAIDAMLLAAECHVNPYFMLSIGASSKLMDLLNVNEFKVVQSHDKVTIKKASGKNKPNLETIAHIERKRDKLVFQILLEAAELDRKYHLQVSNGEDGAYSAEGFDEQVIKLSPLDVQYADALTLVRQNQALLCNFLIQQLQGDQISMHEILLQSLVYFLHTGTKLCCPPEHVIDIILKYAEDLNKLLTSFHHPLREGSLHLTKERMHGVERRWLLLQRLVIAASGGGEEQTFGTNVQNNYLCGNLIPSSAWMQRISHFSGSLYPLVRFLGWMAISRNAKQYMKDRIFLASDLSQLTYLLSIFADDLAVVDDVVNKKYEEVKIEDSRLEHSSSAKREFERGNQCDEERSFCAIYPELWKFFPNMKRQFKSFGEAILEAVGLQLRSVSSTLVPDVLCWFSELCLWPFSFASSIGSNNLKGYNAKNARAIILYILEAIIVEHMEAMVPETPKLVQVLVSLSSSTYCDVSFLDSVLRLLKPIISYSLSKISRDEKLLDGDSCLNFEELCFNILFMKLKQKSEIEHSSEDKEYNTALAIFILASIFPDLSIRYRREFLQSLLKLANFAAFAPTTSFFDFLSAFQCVMDNCKLLLVNALTEFGVIPLQLPPYPHRNVGGLSDDNLKPNPWFLSDVCCTSCVNDVHNVESNNSDVGHFHLPSDDLEGFSKDIEGLISELNPAIECCWNLHHQISRKLTIASAECFVFSKCLTSVSQKFHKAEDDDQNSSPTKSSDIFTLHWRFGLQGLCELIVMLQERSCWEVSCLMLDCLLGVTYSFCLDGVVGIICSTIKNVSCSAPKISWRLRSDKWLSSLIARGIYNSQESEVPLIDLFCTLLAHAEPEQRIIAVKHLGILLGQCTNGERAVMNFKICTDFIQNKLVLSIPDYVLSRLVSSTWDEVVVLASSDLSLQLRIHAMALLSNYIPFAERHHLQSFLVAADSICCLCNAQPSQDGPILQLSLALIAYACLYSPAEDISLIPQNLWENVETLGSTKHDGKLGDLEKRTCQVLCRLRDEGDEAKEALKEVLSQNSSKQYDPDFANTRESVVQVLGNLTAVHSYFDLFTRKIDQDDMELEEAELELDIIQKEHALPGRMDDSKDWNQIPGLPSYRKDVSRLQQIRECIRSLEKSKLKEDIIARRQKKLLMRHARQKHLEEATLREADLLQELDRERTAEMEKELEGQRLLDIEHAKTKE

SEQ ID NO: 227912 - protein, 87 aa, Glycine max
  Coding DNA Sequence Number=SeqID_111134
MREIAVVDTGPRDDSLLRMQHLHVLENVWNDEADCVLRSRRAQCQQENYWVKLVFLVLQKFHFSMYDNTLIYALVECWRLETYTFHM

SEQ ID NO: 227913 - protein, 618 aa, Glycine max
  Coding DNA Sequence Number=SeqID_111135
  Gene Ontology: Mol. function=binding; Cellular component=nucleus; Biological process=metabolic process
  Homolog annotation: Hit_ID=Q10IY6; Match level="QueryCoverage=83%, HitCoverage=73%, E-value=1e-114, Identity=31%"; Hit description =Pentatricopeptide, putative, expressed
  Pfam annotation: Domain name=PPR; Domain location=151-185; Score=2.9; E_value=3.4; Accession=PF01535.11; Description=PPR repeat
  Pfam annotation: Domain name=PPR; Domain location=186-220; Score=8.2; E_value=0.8; Accession=PF01535.11; Description=PPR repeat
  Pfam annotation: Domain name=PPR; Domain location=249-283; Score=3.4; E_value=3; Accession=PF01535.11; Description=PPR repeat
  Pfam annotation: Domain name=PPR; Domain location=315-349; Score =26.6; E_value=8.8e-05; Accession=PF01535.11; Description=PPR repeat
  Pfam annotation: Domain name=PPR; Domain location=416-450; Score =29.6; E_value=1.1e-05; Accession=PF01535.11; Description=PPR repeat
  Pfam annotation: Domain name=PPR; Domain location=518-552; Score =38.8; E_value=1.9e-08; Accession=PF01535.11; Description=PPR repeat
  Pfam module annotation: Pfam domain module=PPR::PPR::PPR::PPR::PPR::PP R; Domain location=151-185::186-220::249-283::315-349::416-450::518 -552
ECLFEAGSNQQSECCGSYNHDANFSDSKYCNNFSACRFNIEFHSSNLSLPPVSTHFNFPLPAQVMVPIGGKDFVILGSQVVLAAKTEEEKNGERGNEVAEVYIVHMIRSLGDSTKLLRLVLIASHGKTRCSNNFTPCFYFTHQAALDMDSHSYANMLQQAIRNRDPNAGKSLHCHILKHGASLDLFAQNILLNTYVHFGFLEDASKLFDEMPLTNTVSFVTLAQGFSRSHQFQRARRLLLREGYEVNQFVFTTLLKLLVSMDLADTCLSVHAYVYKLGHQADAFVGTALIDAYSVCGNVDAARQVFDGIYFKDMVSWTGMVACYAENYCHEDSLLLFCQMRIMGYRPNNFTISAALKSCNGLEAFKVGKSVHGCALKVCYDRDLYVGIALLELYTKSGEIAEAQQFFEEMPKDDLIPWSLMISRYAQSDKSKEALELFCRMRQSSVVVPNNFTFASVLQACASLVLLNLGNQIHSCVLKVGLDSNVFVSNALMDVYAKCGEIENSVKLFTGSTEKNEVAWNTIIVGYVQLGDGEKALNLFSNMLGLDIQPTEVTYSSVLRASASLVALEPGRQIHSLTIKTMYNKDSVVANSLIDMYAKCGRIDDARLTFDKMDKQDE

SEQ ID NO: 227914 - protein, 85 aa, Glycine max
  Coding DNA Sequence Number=SeqID_111136
MYQSCLNQGQASDQSNIKSRYPKSLNLMDFQGLRSEIENERCASRLRKCLPFAIWSRNGDQRLELCWATMVDERKEEEGCVRERE

SEQ ID NO: 227915 - protein, 111 aa, Glycine max
  Coding DNA Sequence Number=SeqID_111137
MWRDRLAEALKEMQSEGKADRVFHLISASNGTIEREKDDQPVIKLNEILAVCLSMLSMANAGMWWKAKIPPYRHAIAAYGAAMVGLPSQIAYGGWQKSAMPFRYSSHGATI

SEQ ID NO: 227916 - protein, 145 aa, Glycine max
  Coding DNA Sequence Number=SeqID_111138
  Gene Ontology: Mol. function=carboxypeptidase activity; Cellular component=membrane; Biological process=auxin mediated signaling pathway
  Homolog annotation: Hit_ID=Q3LSN0; Match level="QueryCoverage=95%, HitCoverage=60%, E-value=6e-42, Identity=75%"; Hit description =Nodulin-like protein
MDSTITFTDIMFFICSKFQATQQKVQLGIGIAVSFFIQSWCISERGPLYCAMFNPLATVITALISATFLQEEVYVGSLVGAVGVIAGLYIVLWGKAKEFAEIKPEAAPQSSNLQDDHDISSRIDLEQPLLSEKLSEHVTEADSKV

SEQ ID NO: 227917 - protein, 112 aa, Glycine max
  Coding DNA Sequence Number=SeqID_111139
MVACVKGDMWEKMVMKMVIAMGYAEKVEEASHDESCRFNEQVIFTSNEVNRYLRRSRILKNILNFYSDITAKFDRHRRFGKHRFEDDKTKPKKPATVDWWWRLRKPSIVDIN

SEQ ID NO: 227918 - protein, 100 aa, Glycine max
  Coding DNA Sequence Number=SeqID_111140
  Gene Ontology: Mol. function=carboxypeptidase activity; Cellular component=membrane
  Homolog annotation: Hit_ID=Q69PB3; Match level="QueryCoverage=91%, HitCoverage=26%, E-value=3e-19, Identity=54%"; Hit description =Putative MtN21
MGGLASNLPLIVMVGLQIHYAALAIFTRAALLDGLSTTVFVVYRQGIATLALAPMFFSPKRVTANQNAYFKGLFYASSTAATAMSNLIPALTFVIAAIAG

SEQ ID NO: 227919 - protein, 168 aa, Glycine max
  Coding DNA Sequence Number=SeqID_111141
GTSFVVQVEGISTWVITENKRGYISCGSVQVEGTSNWLFKENKGGYIPCGSLLVCGAIVLLNGQVLQLEGRVASMMPRTKGFLNYNNCLTKVLKDGVSLRFLRPVRLLEVSILAPKADYSIVVVFVPVLVIAMNSWVLGAQVSRRAKRWNTYKRHSNAQIRVRLRAIN

SEQ ID NO: 227920 - protein, 179 aa, Glycine max
  Coding DNA Sequence Number=SeqID_111142
MSLPRQADFFTMKLFGGPGELEANLGELGSRKTKEKTLLPPLFLVLIERGEDDFYGIIQYIYEVEYNTLSYPKKVVVILKKWMSLKNPYNMFKYKKKYMTTRGCDLSRPPSFHGNKGKEKAKPKKPRYVIKVFSQKDASRSSVEAPSVTASPSPSSVAAIIPSLVCWTSDLNNLRGGVN

SEQ ID NO: 227921 - protein, 52 aa, Glycine max
  Coding DNA Sequence Number=SeqID_111143
MKGHENDAFFQCFKYFYKLYVVQCPMYAITTLKRIIVFVEVATIGGDVLASV

SEQ ID NO: 227922 - protein, 49 aa, Glycine max
  Coding DNA Sequence Number=SeqID_111144
RLALLTLLGRKVLGLGVGLKLLVERPRDDYMGLETLLVIIKVEIVASRN

SEQ ID NO: 227923 - protein, 205 aa, Glycine max
  Coding DNA Sequence Number=SeqID_111145
MEREMITMIVDMLPVFYYEKMVGYMPSSFADLVFVGERIEVGVRKGKFDHVALMNRKPEANRENKKEGETHVVIVVPTWPNFPLAQQYQYSANISPSHYSPLYQPRTPNHPQNPSTAHPRPNTTLNTGQTPPLIRTKTPTREGIFQKKSLYNSPQFRCRMLTYSYIYSIMQWLAKIRGGQLLVNSDIVERHYAWGNLKVVVRCLQ

SEQ ID NO: 227924 - protein, 82 aa, Glycine max
  Coding DNA Sequence Number=SeqID_111146
MKEGWLNFEEKPMQMDTDLFQVQANYVELVQILMVGASIGMSKVETPLSEDEVNQALEEFEKEEEFLFPPAGDTLLEFLTKK

SEQ ID NO: 227925 - protein, 196 aa, Glycine max
  Coding DNA Sequence Number=SeqID_111147
  Gene Ontology: Mol. function=nucleic acid binding; Biological process= DNA integration
  Homolog annotation: Hit_ID=Q0KIN0; Match level="QueryCoverage=91%, HitCoverage=16%, E-value=3e-26, Identity=50%"; Hit description =Integrase core domain containing protein
MTRSEVEHFIFFLHSSFGPCIYLVVYVDDIVITGDDSDGIKVAQSISGIVISQRKYALDILTQTGMLDCHPCDTHVDPNLKLLLGHGEPLEDPERYHTLISRLNYVNVIRSDIIFVINVDHHQTDDLPLAIVFLLELQFGDTQGTKLICDNHATLHNASNLVFHEWTKHIEIDFHFVRERKYSQVASDILRRGGGG

SEQ ID NO: 227926 - protein, 59 aa, Glycine max
  Coding DNA Sequence Number=SeqID_111148
MPISRTYFEKKALEAARGAAFAKRPSVARPKVQAQNLTYPPSLIQLIQSNLLDKWPQIS

SEQ ID NO: 227927 - protein, 61 aa, Glycine max
  Coding DNA Sequence Number=SeqID_111149
MGCYSDNQQQSFLEANEPTPMCHWEMGSLGVGGVVRGPNGVGDDVRGSICGTTDVFCGLHR

SEQ ID NO: 227928 - protein, 56 aa, Glycine max
  Coding DNA Sequence Number=SeqID_111150
MDSKAVVYISRRSTVEKFRIVVLLGQIGVYAGKKEGFGRRRSKNEIEKKRKCRDYH

SEQ ID NO: 227929 - protein, 148 aa, Glycine max
  Coding DNA Sequence Number=SeqID_111151
  Gene Ontology: Mol. function=ribonuclease H activity; Biological process=RNA-dependent DNA replication
  Homolog annotation: Hit_ID=Q1SDT5; Match level="QueryCoverage=59%, HitCoverage=24%, E-value=2e-13, Identity=35%"; Hit description =Ribonuclease H
MGTTSFKHNSNDVMRSFFHVLAGLFGNPINLTYQVKKDPSPIHRQPQRLVTWTSPDGDIIKLNVDGSSLGNLNISGFRGILSNSCGEWLLGFGGNCSFTTNMHAELVNIYKGLRRAWETDYPPWHNYATILNKIKALIGHHLSMTNFS

SEQ ID NO: 227930 - protein, 384 aa, Glycine max
  Coding DNA Sequence Number=SeqID_111152
  Gene Ontology: Mol. function=metal ion binding; Biological process =oxygen transport
  Homolog annotation: Hit_ID=Q5JNB3; Match level="QueryCoverage=74%, HitCoverage=21%, E-value=9e-33, Identity=30%"; Hit description=Zinc finger protein-like
MAMNSAVSSFLPSLSAYAKGKKALNLIELLVNKLFLGEAVNTNGLKILPLLINILLEPLFGYAEPDTDMEDWLQLVIACYPFSTIGGPQGLKPARSISSDERKLLYKLFQKQRHVACRSAMFNQLTVVQMLLSKLMIVSVGYCWNEFNEEDWDFLLSNQRCWIQSAVVMMEDHCKLQEAEDTDNSNTFKSGKLDSVKDRILEGVLHLLFCTGVSEAIANACYKEAASVIASSRFAAYFVLSNEPVLRIAVLEDNACNSNIYAASEEDISRLEVPMEEKVHLKEEIPFMVERAPYEVLEMDLLAHQRSLPSSSSQRERLIQYIQDSATPVILDCLFQHIPVEISTVQILKKKDAELSGGLSSGALAEAIGIWKRNIDKEIEGVEE

SEQ ID NO: 227931 - protein, 160 aa, Glycine max
  Coding DNA Sequence Number=SeqID_111153
  Homolog annotation: Hit_ID=Q9XES3; Match level="QueryCoverage=60%, HitCoverage=98%, E-value=2e-18, Identity=48%"; Hit description=Wound- induced protein WI12
  Pfam annotation: Domain name=WI12; Domain location=62-160; Score =111.0; E_value=3.4e-30; Accession=PF07107.2; Description=Wound -induced protein WI12
MCELANSSQKPWLEDQEDPNKRGVIDLYNAILSNDTDTMQRLLAPDLEWWFHGPPCHRHHLVPLLTGSSSKPLVPDLVVGFGSVTIAEGFDESNLVWWVHAWTTTDEGIITEVREYVNTSVTVTKLGLHVNNDDVVSATCQSVWQSKLCDESVPGLILAI

SEQ ID NO: 227932 - protein, 123 aa, Glycine max
  Coding DNA Sequence Number=SeqID_111154
MADRSRQVRAPLHRMDVGEGPRGLRETSRFEGERGLRESEVSGRAQGLRQQRLRERGVRPRAEQWWSYKSVWFRSLIRKVEVRARPRIPLTTPIHMQHYLIASSLNIRDPSWWRASHIIHDFD

SEQ ID NO: 227933 - protein, 57 aa, Glycine max
  Coding DNA Sequence Number=SeqID_111155
MQQGQPYIPIVGFPDPNYGSNTPIKIKGAKGCFGFFYKEVSFQNFDHANVTGVQQRS

SEQ ID NO: 227934 - protein, 91 aa, Glycine max
  Coding DNA Sequence Number=SeqID_111156
MKQLMLAFSQMQSQGIVHLVEPKVAPSGAHVIDKQVLPKGLKKPVDRLEFDDDPIYQMTLMIPTTFPQAHAGVVGCNLICLGSTTIIFHCI

SEQ ID NO: 227935 - protein, 215 aa, Glycine max
  Coding DNA Sequence Number=SeqID_111157
  Gene Ontology: Mol. function=protein binding; Cellular component =ubiquitin ligase complex; Biological process=ubiquitin-dependent protein catabolic process
  Homolog annotation: Hit_ID=Q8RWU5; Match level="QueryCoverage=92%, HitCoverage=83%, E-value=2e-53, Identity=35%"; Hit description =Putative F-box protein family, AtFBL3
MENQQPANKTTNLLNHLVKELLYAILDHLDEDPFARKSLSQSCKSFHALEATHRTNLKPRRLEFLPRTLHRYRSISHLDLTLCPCVDDNTLKSLSLAWNSSLRSIDLSKSRLFSHVGLSALAMNCTCLVEADLSNRPDLTDVAAKAIAEAVNLERLCLGRCKGITDLGIGCIAVRCSKLRHVGLRWCIRVTDFGAGLIAIKCKEIRSLDLSYLPL

SEQ ID NO: 227936 - protein, 817 aa, Glycine max
  Coding DNA Sequence Number=SeqID_111158
  Gene Ontology: Mol. function=solute:hydrogen antiporter activity; Cellular component=integral to membrane; Biological process =regulation of pH
  Homolog annotation: Hit_ID=Q9SIT5; Match level="QueryCoverage=91%, HitCoverage=93%, E-value=1e-115, Identity=32%"; Hit description =Putative Na/H antiporter
  Pfam annotation: Domain name=Na_H_Exchanger; Domain location=49-442; Score=56.1; E_value=1.1e-13; Accession=PF00999.11; Description =Sodiumhydrogen exchanger family
  Subcellular localization annotation: CTP_CleavageSite=56; ConfidenceScore=5.10e-01
MALADIIPNSTLALNTTLWVCEHTTKFQRNSKGIFYNGNPLNYTLSVVSLQASLVCLSTTWLQSFLIPFGETTFIPQVLGGLLTGPSILGQIKNLDKLLFAPKPFYVCEAISLYGTLLFLFLMGVKIDISVLMRLGKKNWAIGLCSCVLPLILTISSALVLRQILTPETDLYKNLFYIAAFSSTGSFQVTASVLEDFKLLNSEVGRLAISSCMINGFISAVWQGVVVAHQQRVIWKVDIIASKMMAISLLAMVLIIICVLRPIMSWMIRNTPEGKPLKESYIVAIYLMLLTCSLYSEVSGEHYIVGPVLLGLTVPDGPPLGSGLVERLQTLTSALFMPLFFFSSSAKFKLSLVDAYGFAIVQPVAIIGFFGKLLGTMLPSLYCKMSLTDSLSLGLIMSSQGITHLLHLQSLQYLRIIDDRSYAQMFIALIWLTAASNPIVKFLYDPSKSYLSFTKRRTIEHALSNAVLPLMACIHYEEDTLPMINCLEMSHSTIENPICFHVLHLVELTGRTIPVLIDHQHENKANNTLHSKHSQSITNVFKSYEQHNMGNVMVKLYTSISPFETMHDEICLQAAQKRVCMLIVPFHKQWRDGQVMESAHHVRTLNLHLLRTAPCSVGILVERGKLTRNNPLNSVSFYSVGIVFIEGPDDREALAYAMRMADHSNIKVTLIRLMEPCMKSRQLMNRDPDGDLIHKFKVDYIQIKRHDYREEVLRDSVEMVSFIKSLEGCFDLILAGRCHENDSSLFSGFNEWNEYPELGSVSDMLVSSDSTFDGSVLVVQQNRVGVGHHDLHLDNSFAAKHEPATIVDVHPKVMAFV

SEQ ID NO: 227937 - protein, 167 aa, Glycine max
  Coding DNA Sequence Number=SeqID_111159
MGNSLRCCLACVLPCGALDLIRIVHLNGYVEEITRPITAGEVLKANPNHVLSKPTSQGVVRRILILSPDTELKRGSIYFLIPTASLPEKKKRRCSDDGGNDNDHRNKNDLVKVRRNAHGGITGAVAADCGSLGWRASQKTSFFLFRQPAPESGLPVGTGNRRWFNNT

SEQ ID NO: 227938 - protein, 58 aa, Glycine max
  Coding DNA Sequence Number=SeqID_111160
MFFGEGIARNGDKGESCSFKSVMNWKLMRRDSMLEGDGFKKFTLLRLMVVVLIGLDGV

SEQ ID NO: 227939 - protein, 408 aa, Glycine max
  Coding DNA Sequence Number=SeqID_111161
  Gene Ontology: Mol. function=protein binding; Cellular component =cytoplasm; Biological process=ubiquitin cycle
  Homolog annotation: Hit_ID=Q2RBJ7; Match level="QueryCoverage=88%, HitCoverage=85%, E-value=1e-108, Identity=36%"; Hit description =Leucine Rich Repeat family protein, expressed
  Pfam annotation: Domain name=LRR_1; Domain location=104-124; Score =1.3; E_value=1.7e+02; Accession=PF00560.23; Description=Leucine Rich Repeat
  Pfam annotation: Domain name=LRR_1; Domain location=129-151; Score =2.5; E_value=97; Accession=PF00560.23; Description=Leucine Rich Repeat
  Pfam annotation: Domain name=LRR_1; Domain location=153-180; Score =4.0; E_value=52; Accession=PF00560.23; Description=Leucine Rich Repeat
  Pfam annotation: Domain name=LRR_1; Domain location=205-228; Score =1.5; E_value=1.5e+02; Accession=PF00560.23; Description=Leucine Rich Repeat
  Pfam annotation: Domain name=LRR_1; Domain location=230-254; Score =7.6; E_value=11; Accession=PF00560.23; Description=Leucine Rich Repeat
  Pfam annotation: Domain name=LRR_1; Domain location=282-307; Score =8.5; E_value=7.4; Accession=PF00560.23; Description=Leucine Rich Repeat
  Pfam annotation: Domain name=LRR_1; Domain location=52-75; Score=6.5; E_value=17; Accession=PF00560.23; Description=Leucine Rich Repeat
  Pfam annotation: Domain name=LRR_1; Domain location=78-101; Score =8.2; E_value=8.2; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1; Domain location=104-124::129-151::153- 180::205-228::230-254::282-307::52-75::78-101
MPCAAAHSINCTQVTTDLAKCLQSFSRLQSVKLDSCLGTKSGLKAIGNLGASLKELNLSKCVGVTDENLPFLVQPHKDLEKLDITCCHTITHASISSLTNSCLRLTSLRMESCSLVSREGFLFIGRCQLLEELDVTDTEIDDQGLQSISRCTKLSSLKLGICSMITDNGLKHIASSCSKLKQLDLYRSSRITDEGIVAIALGCPSLEVVNIAYNSNTTDTSLEFLSKCQKLRTLEIRGCPRISPKGLSNIVARCRYLEMLDIKKCHKINDTGMIQLAQHSQNLKHIKLSYCSVTDVGLIALASISCLQHISIFHVEGLTSNGLAAFLLACQTLTKVKLHACFESLIPQQILKYMEARGCALFWRDKTFEASGISNYKLCTFVTGGTRSKKMEATCWKEFESSISRNQC

SEQ ID NO: 227940 - protein, 533 aa, Glycine max
  Coding DNA Sequence Number=SeqID_111162
  Gene Ontology: Mol. function=solute:hydrogen antiporter activity; Cellular component=integral to membrane; Biological process =regulation of pH
  Homolog annotation: Hit_ID=Q1S134; Match level="QueryCoverage=93%, HitCoverage=72%, E-value=7e-54, Identity=25%"; Hit description =Probable Na/H antiporter [imported]-Arabidopsis thaliana, putative
  Pfam annotation: Domain name=Na_H_Exchanger; Domain location=45-358; Score=-20.7; E_value=0.0018; Accession=PF00999.11; Description =Sodiumhydrogen exchanger family
MAHANLSSNPTLSLNTTQYICEHATKFQPYSKGIFYSDNPLNHTLTIISMQASLVCLSSTWLQFLLVPFGETTFIPQVLAGMLTGPSILGQIKNLKDLFFTPKPFYICETISLYGTMIFLFLMAVKVDVSMVMRMGKKIWVIGVCSCVLPLLFTICAALILRQILSPKTELYKSLFFIAAFSSTGSFQVTASVLEDFKLLNSEVGRLAIPSSMLIGEHYIVGPMILGLAVPEGPPLGSTLVERLDTLTSTVLMPLFFFSSSARFNFHLVDFYGLAIVQPVAILGFFGKLLGAMLPSLYCKLPLTDALILGLIMSSQGLTQLLHLQSLQLFHIIDDRTYAQMLIALIWLTAASNPVVRFLYDPSKSYLSLTSRKTIEHAPPNTVLPLMACIHSEENTLPMMNFLEMSNSTNENPIYFHVLHLLELKGRTIPVLIDHQPNNKDTLHSKDSQSIINAFKSYEQQNKGNVMVTLYTSISPYETMHNEICMQAAQKRVCMLIVPFHRQWRANQAMESTFAIRALNRHLLRTAPCSVES

SEQ ID NO: 227941 - protein, 67 aa, Glycine max
  Coding DNA Sequence Number=SeqID_111163
MATKSTMLSTNMKGVNHIVNMAKSPYTWIKEHKNRILALPSMSQRHIMMPVLLIYVLKSLDSIILAM

SEQ ID NO: 227942 - protein, 290 aa, Glycine max
  Coding DNA Sequence Number=SeqID_111164
  Gene Ontology: Mol. function=nucleic acid binding; Cellular component= beta-galactosidase complex; Biological process=DNA integration
  Homolog annotation: Hit_ID=Q1T010; Match level="QueryCoverage=98%, HitCoverage=21%, E-value=1e-107, Identity=64%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MTNLGKLSYFLGLEFLWTEYGIVMHQRKYAGEILKRFRMEDCNVAITPTETNQKLEDKPEEEGVDPTGYKQLVGSLRYLCNSRPDICYAVGVLSKFMNRPKKSHFLAAKRVLRYVKGTMQYGVMFPSSVDGAEMKLIGYSDADWCGDRTDRRSTSGYLFKFGGAAVSWSSKKQLVTALSSCEAEYISGSFAACQAIWLKSLLDELKCEVQMPLSLLIDNKSAISLAKNPVSHGRSKHIETRFHFIREQVNNGVLKLIYCPTEDQLADLLTKAVKPDRFIKLREEIGVICF

SEQ ID NO: 227943 - protein, 295 aa, Glycine max
  Coding DNA Sequence Number=SeqID_111165
  Gene Ontology: Mol. function=sequence-specific DNA binding; Cellular component=nucleus; Biological process=regulation of transcription
  Homolog annotation: Hit_ID=Q1SVZ6; Match level="QueryCoverage=87%, HitCoverage=79%, E-value=4e-80, Identity=58%"; Hit description=DNA -binding WRKY
  Pfam annotation: Domain name=WRKY; Domain location=210-268; Score =75.8; E_value=1.4e-19; Accession=PF03106.6; Description=WRKY DNA -binding domain
QKKLWRIVGFLSSVIGLICYALSSSFNHLFGEWNFLKIILYAVISFSISSIMLLLKKWKLSKSFMLKAHVGVLVLLITSVYSFVSDKAVNGKPDMLSLISCFAFAFMSLCLSKQIDLGFGADLLNFFLGCLTVQLMHIHLMLSIVAAIFCYCFMFFRSKLDSQSQIGTVEVEDHVNIEIDAEDGKREFDDNRSDFQANHSHQQVPLLRMVGDGYNWRKYEDKVVKGSANQLSYYKCTQPTCYVKKKVERTIEGEIVDIHYQEPVTFPDQSFASQGNGELDYHVQQQRTPQYPNEI

SEQ ID NO: 227944 - protein, 151 aa, Glycine max
  Coding DNA Sequence Number=SeqID_111166
  Gene Ontology: Mol. function=hydrolase activity, acting on ester bonds; Biological process=lipid metabolic process
  Homolog annotation: Hit_ID=Q941W9; Match level="QueryCoverage=90%, HitCoverage=38%, E-value=1e-31, Identity=47%"; Hit description =Putative family II lipase EXL1
MAYTIYFIILMHFCTFVVVTTSISNDLMRTKFLSILVFGDSTVDTGNNNYINTLAKGNHLPYGKDFPGHMPTGRFCNGKLVPDFIATVLNLKDTVPPFLDPNLSDEELLIGVSFASGGSGFDDFTTALTGAIAVANWILQSRVRLKLKQGL

SEQ ID NO: 227945 - protein, 661 aa, Glycine max
  Coding DNA Sequence Number=SeqID_111167
  Gene Ontology: Mol. function=sequence-specific DNA binding; Cellular component=exocyst; Biological process=exocytosis
  Homolog annotation: Hit_ID=Q1SEU4; Match level="QueryCoverage=97%, HitCoverage=97%, E-value=1e-116, Identity=38%"; Hit description =Exo70 exocyst complex subunit
  Pfam annotation: Domain name=Exo70; Domain location=110-642; Score =97.7; E_value=3.6e-26; Accession=PF03081.6; Description=Exo70 exocyst complex subunit
MADSGSGMEICWFCSTIVGLVCYGLSSSFNYLFGEWSLLKIFLYSGFSLFICLGNLFAKVCRPSTSTSLRFKAHSSFLVLTITSVYSYFADKAMNGKPDIKFALAVVGVGFSYSLIILRSSLDTALHHNLGAQVDQLASTTDTSAVVLFVDQLGRTDIDVAAVQDIVVEGQRDNAQRDNASMMQQLMACIEVLRQGNSNLTNMLLEHTKEYFDDKSELAGVDHNFVIDALPSGKINDLEETIKLMVDDGLEKECCDVYCNWRRESLEQCIINLLRLQGINIEEKLEQREFQYYILRWIKAVNVAHRILFPSERRLCDCIFSRFSSVAALCFNEVCRGALIQLLNFAEAVASGSPSEWRLSKILDMFETLRDLIPEFQSLFPESMVKEVMKVHDKLGEASRVIFMNMENVIFHIPETKVIAPADGRVHLMTKHVIRYLVFTSRAQKILEQILEQYPKFANEVAKSNSVSDQIDQVIKRLETELVTVSKNYDKPALRYFFLMNNWRCVELEAIKLRLNLGCFHKDTTKVQQNLELYQSSSWNMVLNFLKLENNELVEPNANAESLKGSLNLFNMHFKDICSTQSRWLAFDKQLSEKIIMSLQHILLPAYGNFIEKLQDVLGIHASEYIKYGLFDIKDQLNHLFLGSMPMNQYLKDKEKLLKLA

SEQ ID NO: 227946 - protein, 782 aa, Glycine max
  Coding DNA Sequence Number=SeqID_111168
  Gene Ontology: Mol. function=sequence-specific DNA binding; Cellular component=nucleus; Biological process=regulation of transcription
  Homolog annotation: Hit_ID=Q1SEX1; Match level="QueryCoverage=97%, HitCoverage=66%, E-value=3e-81, Identity=37%"; Hit description=Exo70 exocyst complex subunit
  Pfam annotation: Domain name=Exo70; Domain location=6-489; Score= -197.0; E_value=0.001; Accession=PF03081.6; Description=Exo70 exocyst complex subunit
MARWLKKEAVWRYVGFVSTILGLLCYGLSSSFNSLFGEWSLLKIFLYSVFSLFICLWSLFPKVWQYSTSLRLKAHLAFLVLTITSVYSYFADKVVNRKPDAYSLISSAAFAIVSLSLSRQTECGFEVDFLYFFLGCLIVQLLKIKLALVIVGVGFSYALIILRSSLYTTPYQNLGVQDEHSVVIDVNSLRTDNASIMPQLMTCIRALPQGNSNVTNMLSKLVKEYLEDNSKPVVIDSNFVIDALPWGKINDLRKTIKLVIGVGFAQECYEVYCNWRRESLKECLINLLGLPEINVEKSRLLAFEDYILRRRIKAIQTSKHNGAGTSSLSLQIDRIMKHLERKWVAESKHLGERRYFFMMNNWRLVELCAEKSGLDVDCFKKYTAKIQQNLKLYQRSSWNVVLDLLKLENDDRFVEPNANAESMKDKLKLFNNHFKDLCSIQSRWVAFDMQLREQIMKSLENILLPAYGNFIGRFQDILDTTSYQNLGVQDEHSVVIDVNSLRTDNASIMPQLRTCIRALQQGNSNVTNMLLEHVKEYLQDNSNLAVDDGRVTCVKSEEVLERNSVENEGHVSDDIHHMEVRKGNGDRRELYYHYSVKIVRALLLLFVQFFSLTDSAIVQEINVKQKWEEKQLEEYIIRRWIKALKFRIGVLPCPLFLSQVALRIQFPNEQRLSDGVFSGFSSIADLCFTEVCRGATIQLLKCVDEVVSESSPKWPLSKMLDMLQTLRGLIPEFQSLFPESMVKEVMTVHHKLGETCRVIFMKMEDNIFCNPSVKIICSARCH

SEQ ID NO: 227947 - protein, 123 aa, Glycine max
  Coding DNA Sequence Number=SeqID_111169
MLQPYEISIGLKEHSNPVTPKAYTPKSPSGPLPPDSDSSGFLRERKRLQCEGFFSQFRHDIKIPNGENARNCVANMILKFHNDPTVNGFEIVIFLRLVWWVAGKRKGFERRRGKTEMRPKGGS

SEQ ID NO: 227948 - protein, 1097 aa, Glycine max
  Coding DNA Sequence Number=SeqID_111170
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=94%, HitCoverage=66%, E-value=0.0, Identity=42%"; Hit description=Chromo
  Pfam annotation: Domain name=RVP_2; Domain location=323-447; Score= -51.9; E_value=0.011; Accession=PF08284.2; Description=Retroviral aspartyl protease
  Pfam annotation: Domain name=RnaseH; Domain location=837-957; Score= -13.2; E_value=0.00097; Accession=PF00075.14; Description=RNase H
  Pfam annotation: Domain name=zf-H2C2; Domain location=1034-1075; Score=23.5; E_value=0.00027; Accession=PF09337.1; Description=His(2)- Cys(2) zinc finger
  Pfam module annotation: Pfam domain module=RVP_2::RVT_1::Retrotrans _gag::RnaseH::zf-H2C2; Domain location=323-447::579-748::95-185::837 -957::1034-1075
MTGPHDSSSPNLESILTRLTDTMQTMNLKLDELLHRPTSFPSPQPEPPPPSPVPATQHKMKLEVPRFDGTEPLGWIFKINQYFEYHGTPERDHLTIASFYMEGRALAWFQWMSSNAQFTSWPGFLQALQTRFALSQYEDPTGVLFKLTQKGSVNQYLSEFEDLANRVIGLPSPFLLSCFISGLNPEIRREVQAHQPLTLVQAAGLAKLQEEKISDNRLPSRPRAPPPQPNPLRVLPASAEPRQTLPPLLPAPPRPTPPIMKRLTPEELTSRRERGLCFTCDERYHRGHRCAARAFLLVTEDEDPSDSKIDPPDPPPDPPHEPDPFQAQISLNSFSGHLAPEALRMVGLMADHRVVLLIDGGSTHNFVQPVLVTQLGLPCRRISPLRVMVGNGQHLDCACVCEGVSIMIQDVMFTMDLHVLPIVGANVVLGVQWLKTLGPILTDYGSLRMQFFYQNQLIELKGENTNDSGFITHHQLRRLCRTQTQASYFRIALITDNPEPPPPHTLTPEIQALLTRFSTLFQNPSGLPPNRDTDHHIHLLPHTNPVNVHPYRYPHYQKKEIEQQVNDMLQKGLIRPSTSPFSSPVLLVRKTDGSWRFCVDYRALNAVTVRDRFPIPTIDELLDELGGAQYFSKLDLLQGYHQIRMHDPDIPKTAFRTHHGHYEFKVMPFGLCNAPSSFQATMNSIFRQHLRRFIIVFFDDILVYSTSFEAHLHHLTITFQLLLDHNFVLKLSKCSFAQKQVEYLGHVVSHKGVEPVASKIEAIRQWPTPRSAKAVKSFLGLAGFYRRFIRHYATIAAPLVRLTTTDAFAWTPQTQDAFDQLKTALSTAPVLALPDFTSPFTVETDASGSGMGAVLTQKGHPVAFFSKPFPPKLAVASTYVRELVAITTAVKRWRQYLLGQRFIIIMDHRSLKELLTQVIQTPEQHKYLARLLGYDYVIQFRSGHQNKVADALSRQREPIPSQCLILSVPSLTFLNELRRQLEAHPEFCRRKQEIRDTPYNHPAFSITQDLILTGGRIWLPRDLPITATLLQEYHTTPTGGHAGVTKTLARISENFTWSGLREDVKQFVANCFDCQVTKYQTQRVAGLLCPLPVPHRP

SEQ ID NO: 227949 - protein, 104 aa, Glycine max
  Coding DNA Sequence Number=SeqID_111171
MAQPIMRSAREGWLSQLGNIWLSAPFLHLANQALSQRRMAQRTAKIKLHQTCLFYLKLKWKGLPSKSFKHLIHERKWIMVLPGGIIQLPIVNVHSPPGDNPCGY

SEQ ID NO: 227950 - protein, 203 aa, Glycine max
  Coding DNA Sequence Number=SeqID_111172
  Homolog annotation: Hit_ID=A0AXT1; Match level="QueryCoverage=30%, HitCoverage=93%, E-value=5e-17, Identity=63%"; Hit description=CsbD family protein
  Pfam annotation: Domain name=CsbD; Domain location=4-56; Score=47.6; E_value=4.1e-11; Accession=PF05532.3; Description=CsbD-like
MNKDIISGKWSQLKGKAQAKWGDLTNDDFDVAEGNAEYLAGRLQERYGWAKDRAEKEVREFQDSVSKDYPDYKISAPAGPARSGWGRPAARAAGARVNPPGCRVRAGCGRCRSAAAGLGRGCGWRVRSRYRVPTTVRERRGRCPAQGPATCWHSPRCGWHWRRPPLRPSGPVLAGYGADRIRTPAARFLEHGHAHHADVVRAA

SEQ ID NO: 227951 - protein, 121 aa, Glycine max
  Coding DNA Sequence Number=SeqID_111173
  Homolog annotation: Hit_ID=Q4UPH1; Match level="QueryCoverage=31%, HitCoverage=86%, E-value=2e-09, Identity=78%"; Hit description =Putative entericidin A
MVHYASTACSEKHAQKKAGDVPGPFSFRSAPGLLALGGVLNLFTGLLHVLASTGHGVATGQQGHREHRQQHQGNYALHGLLLGFAAIPLHSRMGFFRSAGGHQCPLPPREVQSGGRGVERA

SEQ ID NO: 227952 - protein, 169 aa, Glycine max
  Coding DNA Sequence Number=SeqID_111174
MLDRHRKSLERGSKENKRENVDNYLLQDINGTYPRRSHNQGTLLRDASLGRANHIVALVPSTLLYCILPWNNNVIDHEEETHKVYMLGIGALNSRANIIIEGENDRDRGRPPKRDDRHRKKDPLIGLKELEKGRAQRDGHVVGLEIPMKARVKRLKENLKVINTLHGQA

SEQ ID NO: 227953 - protein, 72 aa, Glycine max
  Coding DNA Sequence Number=SeqID_111175
MHCVPVSFIMRFFIVIYLFIYFHKHKGDQSGSCCFARMLQPYGINIDLKEHSNRVYLPQGLHSEESVKASPS

SEQ ID NO: 227954 - protein, 256 aa, Glycine max
  Coding DNA Sequence Number=SeqID_111176
  Gene Ontology: Mol. function=RNA binding
  Homolog annotation: Hit_ID=Q1T6A5; Match level="QueryCoverage=88%, HitCoverage=38%, E-value=1e-26, Identity=37%"; Hit description =Cyclin-like F-box; Agenet
  Pfam annotation: Domain name=F-box; Domain location=115-162; Score =23.3; E_value=0.00089; Accession=PF00646.23; Description=F-box domain
MEWITHQLQERRMRRRMRIRKTRQAYGKNEDNEDWISEREVDGETEDDGDMISERKRNIREVDAENEDNGDRIGKRKRNIREVDAENEHNGDRISERKKNIAREVDGENEDHRPDRISALPDSLLFHMINFMDTKSAVQTCVLSKRWNDLSKCLTNLTFNSDLPSEGLDRSFKKFESWVLSSRDDSYPLLNLTIESWIDADVQDRVIKYALLHNVQKLKMNINSTTYRPNFKSLPLIFRSQSLTSLELSNKLSPSR

SEQ ID NO: 227955 - protein, 332 aa, Glycine max
  Coding DNA Sequence Number=SeqID_111177
  Gene Ontology: Mol. function=sequence-specific DNA binding; Cellular component=nucleus; Biological process=regulation of transcription
  Homolog annotation: Hit_ID=Q1SEX1; Match level="QueryCoverage=99%, HitCoverage=53%, E-value=2e-85, Identity=48%"; Hit description=Exo70 exocyst complex subunit
MTSLTIQMARWLKKEALWRYVGFVSTILGLLCYGLSSSFNSLFGEWSLLKIFLYSIFSLFICLWSLFPKVWQHSTNLRFKAHLAFLVLTITSVYSYFADKVVNGKPDAYSLISSAAFAIVSLSLSRQTECGFEVDFFYFFLGCLIVQLLKIKLALVIVGVGFSYALIILRSSLYTMPYQNLGVQDEHSLVIDVNSLRTDNATMMPQLMTCIRALQQGNSNVTNMLSKLVKEYLEDNSKPVVIDRNFVIDALPSGKINDLRKNIKLVMGVGFAKECYEVYCNWRRESLKECLINLLGLPEINVEEKSRLLEFENYILRRRIEAIQVALGTLIP

SEQ ID NO: 227956 - protein, 145 aa, Glycine max
  Coding DNA Sequence Number=SeqID_111178
  Homolog annotation: Hit_ID=Q1SPB9; Match level="QueryCoverage=56%, HitCoverage=13%, E-value=8e-11, Identity=43%"; Hit description =Transposase
METISKRFEELDVCGKVTLKSKVQEIAYPDLKSVSSSRKVKRSASSSDQAIPRRIMPMLDQFHSFIHDSIENIVNVIADGNCGYRVIAALLGMGEDSWLLVHNHFLKELAKWSDEYINLFGGIDKFEELKRSLLVDRLSIVTMDK

SEQ ID NO: 227957 - protein, 69 aa, Glycine max
  Coding DNA Sequence Number=SeqID_111179
MARRWWTVPRIRQWKHRTAEAWHKRNTNETAPSSSSFFISPSLRATIVHAACPATSDSYQDSRIRLLLR

SEQ ID NO: 227958 - protein, 98 aa, Glycine max
  Coding DNA Sequence Number=SeqID_111180
  Homolog annotation: Hit_ID=Q1T1Y0; Match level="QueryCoverage=68%, HitCoverage=16%, E-value=2e-07, Identity=45%"; Hit description =Ankyrin
  Pfam annotation: Domain name=DUF1723; Domain location=21-70; Score =41.2; E_value=3.5e-09; Accession=PF08330.1; Description=Protein of unknown function (DUF1723)
MIFERPELKFSSHGRKVEKFGNDWGLMSAFMERQHKETNSFHLSIGEVTITLDDVASFLHFPITGTFHSFKPFHVDNDVFLLVEFLEVSTEEARVETV

SEQ ID NO: 227959 - protein, 76 aa, Glycine max
  Coding DNA Sequence Number=SeqID_111181
MSMQVINQLGAPEEAQQEQMAISSKSVFFIPILDGILNYFKVLDSWGQIWDVLSNEEVVDIVASASQSTAARAVVE

SEQ ID NO: 227960 - protein, 139 aa, Glycine max
  Coding DNA Sequence Number=SeqID_111182
MNSLTTQIVTWLKQLLLQLSIWRMEHVEDLHLPLESVSKDTTSYENLRVQDDSVVIDVNNARMMQQLMTCISALQRGNSNLTNILFEYLDDKSEVAGIDHNPFVKVIVRPDVKENPMTCCVMDYLELILEQFVCLLIEQ

SEQ ID NO: 227961 - protein, 549 aa, Glycine max
  Coding DNA Sequence Number=SeqID_111183
  Gene Ontology: Mol. function=transferase activity, transferring hexosyl groups; Cellular component=integral to membrane; Biological process=cell wall organization and biogenesis
  Homolog annotation: Hit_ID=Q2QN55; Match level="QueryCoverage=99%, HitCoverage=99%, E-value=1e-162, Identity=50%"; Hit description =Glycosyl transferase family 8 protein, expressed
  Pfam annotation: Domain name=Glyco_transf_8; Domain location=189-522; Score=370.9; E_value=1.9e-108; Accession=PF01501.10; Description =Glycosyl transferase family 8
  Subcellular localization annotation: CTP_CleavageSite=28; ConfidenceScore=5.05e-01
MLLQISPSLRHVTVLPGKGLKEFIKVKVASRKLSYRMLFYSLLFFTFLLRFVFVLTAVDNIDGENKCSSLGCLGKKLRPKILGRSLESNVISLTLIISVCVRIHMVPEVIYGILDQPLGKDELEGRSDIPQTLEEFMTQMKEGGYDAKTFAIKLREMVTLMEQRTREAIVQEYLYRHVASSGIPKQLHCLALRLANEHTNNAAARLQLPSAELVPALVDNNYFHFVLASDNVLAASVVATSLVRNSLRPQRVVLHIITDRKTYYPMQAWFSLHPLSPAIIEVKALHHFDWFTKGKVPVLEAMEKDQNVRSHFRGGSSAIVANTTEKPKVIAAKLQALSPKYNSVMNHIRIHLPELFSSLNKVVFLDDDTVVQTDLSPLWDIDLNGKVNGAVETCSGEDKLVMSKRLTSYLNFSHPLISQNFDPNECAWAYGMNIFDLDAWRKTNISSTYHHWVEQNIKSDLSLWQLGTLPPGLIAFHGHVHTIDPFWHMLGLGYQENTSFADAETAGVIHFNGRAKPWLDIAFPHLKPLWTKYIDFSDYFIKSCHIRAL

SEQ ID NO: 227962 - protein, 511 aa, Glycine max
  Coding DNA Sequence Number=SeqID_111184
  Gene Ontology: Mol. function=phosphoinositide binding; Cellular component=multivesicular body; Biological process=cell communication
  Homolog annotation: Hit_ID=Q00V04; Match level="QueryCoverage=81%, HitCoverage=67%, E-value=2e-31, Identity=27%"; Hit description=[U] KOG2273 Membrane coat complex Retromer
  Pfam annotation: Domain name=PX; Domain location=135-252; Score=94.8; E_value=2.5e-25; Accession=PF00787.14; Description=PX domain
  Pfam annotation: Domain name=Vps5; Domain location=299-511; Score= -44.0; E_value=2.1e-05; Accession=PF09325.1; Description=Vps5 C terminal like
  Pfam module annotation: Pfam domain module=PX::Vps5; Domain location =135-252::299-511
MMEDHPLSVPRDEMENLVLHDDDAAAAGNNGNDDTAATSPFSSNYRSAMSTLSESHHHHPLSPPILATPADSDPLLSPNPSSPDASSYLDPPSYAEAVFTPFDGDTNGIESPSSPISLSRSPSSSSEYLKITVSNPVKEQETSNSIVPGSNNYVTYLITTKTNIPEFGAGGADFAVRRRFRDVVTLSDRLAEAYRGFFIPPRPDKSVVESQVMQKQEFVEQRRMALEKYLRRLAAHPVIRKSDEFRVFLQVQGRLPLPTTTDVASRVLDGAAKLPKQLMGESVLAPHEVMQPARGGMDLMRLFKELRQSVANDWGGSRPSVVEEDKEFLEKKEKIQELEQQITGASQQAESLVKAQQDMGETMGELGLAFIKLTKYENEEAIVNSQRVRAADMKGVATAAVKASRLFRELNAQTVKHLDTLHEYLGLMLAVHGAFSDRSSALLTVQTLLSELSSLQSRAEKLEVASSKIFGADKSRVRKLEELQETIRVTEDAKNVAIREYERIKVWFVFK

SEQ ID NO: 227963 - protein, 1422 aa, Glycine max
  Coding DNA Sequence Number=SeqID_111185
  Gene Ontology: Mol. function=DNA binding; Cellular component=beta -galactosidase complex; Biological process=DNA integration
  Homolog annotation: Hit_ID=Q1SS72; Match level="QueryCoverage=98%, HitCoverage=99%, E-value=0.0, Identity=45%"; Hit description =Integrase, catalytic region
  Pfam annotation: Domain name=rve; Domain location=582-742; Score =141.9; E_value=1.8e-39; Accession=PF00665.16; Description=Integrase core domain
  Pfam annotation: Domain name=zf-CCHC; Domain location=246-263; Score =12.0; E_value=0.01; Accession=PF00098.13; Description=Zinc knuckle
  Pfam annotation: Domain name=zf-CCHC; Domain location=282-299; Score =16.0; E_value=0.0023; Accession=PF00098.13; Description=Zinc knuckle
  Pfam module annotation: Pfam domain module=RVT_2::Retrotrans _gag::rve::zf-CCHC::zf-CCHC; Domain location=939-1194::77-192::582 -742::246-263::282-299
MNETVLNSTESYLYLHPSENPATSLVSPVLDSTNYHSWSRSMITTLSAKNKLEFVDGSAPEPLKTDRMYVAWRRCNNMVVSWLVHSVATSIRQSILWMDKAEEIWRDLKSRYSQGDLLRISDLQQEASTLKQGALSVTEYFTRLRVIWDEIENFRPDPVCTCNIRCTCSTFTVIAQRKTEDRAMQFLRGLNEQYANVRSHVLLMDPIPAISRIFSYVAQQERQLIGNSTPDLNLEPKDISINAARIICDYCGRTGHTENVCYKKHDVPLNREGRSKNTGGRKTCTHCGKTGHTVDVCYQKHGYPPGYKPYNGRNVNNVVATDGKPEDDHMQHRESQELVRFSPEQYKALLALIQRPTAGNSATDQPKQVASISSCTIDKTSSPGKALPPVTTKSTSWILDSGATDHVTSSLDNLHSYECINPVTVKLPNGHHVHATHSGIVHLSPTITLFNVLFIPTFTFNIISISKLVSSTDCALIFSSNSCMLQDTNKRMKIGIVEARHGLYHLIPDLLTTKTICSTVVHPKCNILPIDLWHFRMGHPSTERLQCMKSYYPILSNDKSFTCNTCHYAKHKKLPFPSSISHASHVFYLLHMDIWGPCSKPSMHGHKYFLTIVDNHSRFTWVHLMHNKAETRPIIMNFITSIETQYDSKVKIIRSDNEPEFMMHGFYASKGIAHQTTCVETPEQNGIAERKHQHLLNVTRALLFQANLPPGFWCYALTHAVYLVNIIPTPFLHGISPYEKLHGRPLDIANLRVFGCLCYVSTLKANRKKLDPRAHPCIFIGFKANTKGYQVYNMHSHDIISSRNVIFYENYFPQISELQQLDSNSSTPLPASFSTNQYDSPIEPITQEPINVDHLTKSSSSPPRRSTRARHAPTYLQDYHHDLSINNTSASTFVRYPLSSVLSYSRLSPTHKHFVLSISSTVEPSSYAEASRHDCWIKAMKAELQALQSNETWRLTLLPPQKTAIGCRWIYKIKYRADGSIERYKARLVAKGYTQMEGLDYLDTFSPVAKLTTVRLLLALAAVNQWHLRQLDVNNAFLHGELDEEVYMQVPPGLTVSNPQLVCRLQRSLYGLKQASRQWFTKLSGFLVSHGFQKSNSDHSLFLRFTGSITTVLLVYVDDIILTGNSINEIQDITMLLDQAFKIKDLGTLKFFLGFEIARTSAGIHLCQRKYVLDILSDSGMLGCRPNTTPMDYSTKLQAMVDTPLSAESSSSYRRLIGRLIYLTNSRPDIAYAVQQLSQYMSSPTNVHQQAAYRVLRYLKGTPGSGLFFPATNTLQLRAFSDSDWAGCPDSRKSTTGFLIYFGSSLISWQSKKQSTVSRSSSEAEYRALASTTCELQWLTYLLQDFRITFINRYLHIEIDCHIVRHKVTMGLIKLLPVSSSMQLADIFTKALSPSIFQHLCTKLGMMNIHSQLEGGILTASC

SEQ ID NO: 227964 - protein, 63 aa, Glycine max
  Coding DNA Sequence Number=SeqID_111186
MNCNLRKRERPWKGETCRCGVIYIQYEEAMKLKIDSAKRRTNMHKGDAMKTEEGNYSEEENRS

SEQ ID NO: 227965 - protein, 74 aa, Glycine max; identical to SEQ ID NO: 127836
  Coding DNA Sequence Number=SeqID_111187

SEQ ID NO: 227966 - protein, 143 aa, Glycine max
  Coding DNA Sequence Number=SeqID_111188
MEAMKEQMAIMMEAMMSMKKMMEVNAATVVATSTATEVDPTHSSGPNQNKHSFPPYGLPPNYMPPNVAHTPNKDVNNFTLILTKSQQLQSNHAHVSQPIGETHEAPRDHNLVDFEPHLGYATEGQAVGGVPLPNTLGGPQYHP

SEQ ID NO: 227967 - protein, 142 aa, Glycine max
  Coding DNA Sequence Number=SeqID_111189
MNRWMTMKNLMLEDSGTRRSDRMGRGCHRRGNGGEGGTKKAIRSGWRGGGRGSRAAFLRQLDAPGTPVRPVAPTTAALTNAPARRVPTEAPAPPTHPILKRPRQQRVQTCPTASHIMPCVTITGNAPIREALCSKKTDPRSK

SEQ ID NO: 227968 - protein, 286 aa, Glycine max
  Coding DNA Sequence Number=SeqID_111190
KEHALWRPYRTRARARVTGKAEEVQEKVKADMEAMKGKMSTMMEAMMSMKKIMEAHAIVVAATGAVAKPHDVQIQNEHAFPPYGLPPNYTPPNVAYTPNENVNNSTPILIESQQPQSDHAHVSRPMGETHEMPHHNLADFEPCLGYATKGQTVGGITLQNTLEGPQFRPQPQPSHSTMVKNPYAWLKWEKLDPLEERLKAIEGGDYLPHEPSKDVLSEDGVYARDEELLIHFFQESLTGAVSVHSDMAPDRMQLQNMCKKGYESFKEYAQRWRDLAAQVAPPTMEE

SEQ ID NO: 227969 - protein, 92 aa, Glycine max
  Coding DNA Sequence Number=SeqID_111191
MDFYTNTRPTEEGVRGVHSWVRGQWVPFDANALSQFLGHPLILEEGQQCEYSQRRRQYLALMRRPLPSYYAYRGRISPRPLQGYRCGSCTPA

SEQ ID NO: 227970 - protein, 69 aa, Glycine max
  Coding DNA Sequence Number=SeqID_111192
MKADMEALKDQLASMMEAMLSMKRMMESNTAAVAVSNAAVKTVPTHPSATPAYRGRLGAASGRGRERET

SEQ ID NO: 227971 - protein, 324 aa, Glycine max
  Coding DNA Sequence Number=SeqID_111193
  Gene Ontology: Mol. function=transporter activity; Cellular component= mitochondrial inner membrane; Biological process=transport
  Homolog annotation: Hit_ID=Q8LEH2; Match level="QueryCoverage=96%, HitCoverage=99%, E-value=1e-122, Identity=53%"; Hit description =Putative mitochondrial carrier protein
  Pfam annotation: Domain name=Mito_carr; Domain location=125-213; Score=105.4; E_value=1.7e-28; Accession=PF00153.17; Description =Mitochondrial carrier protein
  Pfam annotation: Domain name=Mito_carr; Domain location=221-315; Score=107.1; E_value=5.3e-29; Accession=PF00153.17; Description =Mitochondrial carrier protein
  Pfam annotation: Domain name=Mito_carr; Domain location=31-122; Score= 109.8; E_value=7.9e-30; Accession=PF00153.17; Description =Mitochondrial carrier protein
  Pfam module annotation: Pfam domain module=Mito_carr::Mito_carr::Mito_ carr; Domain location=125-213::221-315::31-122
MATDARAKFQNPEFRPDFHADLTVSTHDGLHFWQFMIAGSIAGCVEHMAMFPVDTVKTRMQAIGSCPVKSVTVRHALKSILQSEGPSALYRGIGAMGLGAGPAHAVYFSVYETCKKKFSEGSPSNAAAHAASGVCATVASDAVFTPMDMVKQRLQLGNSGYKGVWDCVKRVMSEEGFGAFYASYRTTVLMNAPFTAVHFTTYEAAKRGLLEVSPESVDDERLVVHATAGAAAGALAAAVTTPLDVVKTQLQCQGVCGCDRFKSGSIGDVIKTIVKKDGYRGLMRGWIPRMLFHAPAAAICWSTYEAGKSFFQDFNQQKDIGTVT

SEQ ID NO: 227972 - protein, 212 aa, Glycine max
  Coding DNA Sequence Number=SeqID_111194
  Gene Ontology: Mol. function=RNA-directed DNA polymerase activity; Cellular component=chromatin; Biological process=chromatin assembly or disassembly
  Pfam annotation: Domain name=rve; Domain location=2-149; Score=93.7; E_value=5.5e-25; Accession=PF00665.16; Description=Integrase core domain
MSIDFITGLPSSQGHTVIMVVVDRYSKGAHFGALPTQHTAHQVAVHFLTLVCKLHGFPRSLVSDRDALFLSQFWKELFRLSGTQLRMTTAYHPQSDGQTEVVNRTLEQYLRAYVHHKPSHWFQYLPLAEWSYNTTVHSSTGFTPFEIVYGRPPPSTVDYIRGSSPIDAVDSLLTDRTELHALLQRRLQKAQSSMKATADKHCRDTQFSIGDW

SEQ ID NO: 227973 - protein, 35 aa, Glycine max
  Coding DNA Sequence Number=SeqID_111195
MGHKTLNILLDGGPVKTLSEAVEGFCNSGVSSEGR

SEQ ID NO: 227974 - protein, 390 aa, Glycine max
  Coding DNA Sequence Number=SeqID_111196
  Gene Ontology: Mol. function=hydrolase activity; Cellular component =endoplasmic reticulum
  Homolog annotation: Hit_ID=Q01A81; Match level="QueryCoverage=74%, HitCoverage=48%, E-value=4e-55, Identity=42%"; Hit description=[TR] KOG0374 Serine/threonine specific protein phosphatase PP1
  Pfam annotation: Domain name=Metallophos; Domain location=58-334; Score=36.8; E_value=7.4e-08; Accession=PF00149.18; Description =Calcineurin-like phosphoesterase
  Subcellular localization annotation: CTP_CleavageSite=44; ConfidenceScore=5.78e-01
MASLCLNSLPVPPTSLSSSSSSSSLLLHNNNNNNNNLSPLKPIVVSGDPPTFVSAPGRRILAVGDLHGDLKQARSALEMAGVLSSDGRDLWTGGETVLVQLGDILDRGEDEIAILSMLRSLDRQAKEKGGAVFQVNGNHETMNVEGDYRYVESGGFDECNDFLEYINGSEGDWEETFTSWVDVSKRWKEDRTMSKSYWGPWNLLKRQKGVIARSILFRPGGLLARELARHAVVLKVNDWVFCHGGLLPHHVAYGLERMNKEVSEWMRGQHEDDNTHKMPFIATRGYDSVVWNRLYSRDTPDLVDYQAKQVCSILDETMQAVGAKAMVVGHTPQTIGVNCKYNCSIWRVDVGMSSGVLNSKPEVLEIIDDKARVIRCKRDRHSELQAAAYT

SEQ ID NO: 227975 - protein, 74 aa, Glycine max
  Coding DNA Sequence Number=SeqID_111197
MYKKTKLDFKLKEYQSALEVRKDKNLTRINVHSENALNQIGIANCGKGGGFGPRRGNRRNRQFRGCRLQCGQTW

SEQ ID NO: 227976 - protein, 468 aa, Glycine max
  Coding DNA Sequence Number=SeqID_111198
  Gene Ontology: Mol. function=nucleic acid binding; Biological process= DNA integration
  Homolog annotation: Hit_ID=Q1SDN3; Match level="QueryCoverage=42%, HitCoverage=20%, E-value=4e-57, Identity=43%"; Hit description =Polynucleotidyl transferase, Ribonuclease H fold
MQNLQRIGTVDMEEGPYGLKMSPLSLDKECFEVARTPVGINLCQQKYALDILNDSEMLGSKSVQFVDQPTSTQQQATSRILRYIKGSPDWAGCLDTRKSITGYAIYIGNSLVSWKSKKQATISRSSSEAEYRAWASATYELQWVNFLLEEFKVHSQQPATLYCDNKSALHIATNPIFHERTKHIEIDCQVIRKKVMTGIVKLLPISSANQLADIYTKALLSRDFQFLYFKLGSPNKQTGRIREAGSLNLEPVDRVNRNYSNLPLPFGGISITVKGFSRPTGWLSAGEWLNANLAYLRKNMMQMINRILRWLMQPKSVENRMFCFVCCGRYCFTLFSVSLSGLPSSRQPSTSLRLENHLAFLVLMATSIYSFFFDKTSNGKPDAYSLISYASFVAIMSLGLSRLTQFGFEIDLLHFFCGGLIIQLLEIKRWLVIIGGCFIYFLVVILGPSLETPEQRVQLQDVVIQIPK

SEQ ID NO: 227977 - protein, 565 aa, Glycine max
  Coding DNA Sequence Number=SeqID_111199
  Gene Ontology: Mol. function=sequence-specific DNA binding; Cellular component=exocyst; Biological process=exocytosis
  Homolog annotation: Hit_ID=Q9FGH9; Match level="QueryCoverage=55%, HitCoverage=60%, E-value=2e-36, Identity=32%"; Hit description =Leucine zipper protein
  Pfam annotation: Domain name=Exo70; Domain location=4-417; Score= -194.0; E_value=0.0008; Accession=PF03081.6; Description=Exo70 exocyst complex subunit
MGMLWTVFLFWVWTYVTQSNSSSQEDSGNDGLILLRFINCIMSLEKENEMLVPMVCSHVNKYIKAMVDSESKDEGHIPELQLDPDVNFMMDAQPSGISMHLHETVKLMMAAGFEQECCDAYSNCHKEFLEQCLWALGLQLQALNTWNIENWIKTCKAAGKILFPNERRLCDSVFFGLSRAVDVSFTKVCKGLTIRLLSFADTMITTESYFLLNLLSSVIPKMSESLHEIKQELLLHKFCKDSMYMLLKADVKKVEKRLNILKAFAKIIYGNTAQATVAAIFLIEGKSSFSVLIAWMTELLESILEAKSRDDYTDPALGYVFMMNNLRYIGQEACKWRSIVDERNDNWFRQTATKGKESVVPPNVVAESMKDKLNLFNLMFVEIITQWADVIGKVVFLQTILLEEEEVAKEALAEGVLMGKETRPQGSNVNNVNVVEEKGDSLVLERSQEVQNDEVKLNSLQYKALMTLLQQQQNSAHVNSHVNQIGIVTGFVGSSNIHVGSTPLFSYQKNLQDQKKNRKHSKATSKSLHHEFRWFDNVPTSTGNAAHHHHIDHETLQVQHKQQLA

SEQ ID NO: 227978 - protein, 552 aa, Glycine max
  Coding DNA Sequence Number=SeqID_111200
  Gene Ontology: Mol. function=sequence-specific DNA binding; Cellular component=exocyst; Biological process=exocytosis
  Homolog annotation: Hit_ID=Q9FGH9; Match level="QueryCoverage=76%, HitCoverage=68%, E-value=2e-63, Identity=37%"; Hit description =Leucine zipper protein
  Pfam annotation: Domain name=Exo70; Domain location=9-549; Score =13.2; E_value=1.5e-11; Accession=PF03081.6; Description=Exo70 exocyst complex subunit
METPEECLLLEDLSQVMIQSNSNTELVDAEGDSTLNTPPPENGDADGVPLLGLDLVTQCNSSSQEDNSDDGLIPQFMDCIKVLEKENEILVPMVSSHVDKYLKAMLDSESKPELSPPPPELYPDVNMVVDALPSGIVTRLSDTAKQMMEAGFERECCEAYSKWRREFQEQCLSALGLKLQELKIEDFENWIKTCKAAVKIMFPNERRLSNIVFSGFHRAADVSFTEVCMKLTICLVSFADTIITTTTTTTDQSYLLPSFLSSVIPEMSKSLHELNQESLLHGFCKDGILLEADVKKVHERFEIFKAFANLIYINTAQETVAGGGGLHLITQQATNYIDHVCESFGETVREYKVIPGREGKSSFSELLARMIELLESILETKSRDDYTDPALGYVFMMNNLWYIGQEACKWRSLVDGRTILDDHWFQQNTTKVEQNCKLYQRSSWNKMLDILKLEGNESVAPPNVVAESMKDKLNLFNLQFEKIYFFQSTWILSDHKQLREQVINSIDSTLLPAYGKFIDRFQDVLGEHACEYIEYGIVDIQNRLSCLFLLSE

SEQ ID NO: 227979 - protein, 52 aa, Glycine max
  Coding DNA Sequence Number=SeqID_111201
MAAEKLWGPPTMLKGILTMEGTVYTVVFIVGDGDEEVTVFIGRERVLGEQRE

SEQ ID NO: 227980 - protein, 303 aa, Glycine max
  Coding DNA Sequence Number=SeqID_111202
  Gene Ontology: Mol. function=transferase activity, transferring hexosyl groups; Biological process=metabolic process
  Homolog annotation: Hit_ID=Q1SIP8; Match level="QueryCoverage=99%, HitCoverage=68%, E-value=4e-83, Identity=56%"; Hit description =Probable indole-3-acetate beta-glucosyltransferase T27E13.11- Arabidopsis thaliana
MEAAPSSSTCACSHLVTMPYPARGYINPMMNFCKMLLSNDNTRLILVTFVVTEEWLGFIGSDPKPDIMRFATIPNVVASDHPGFLEAVMAKMEASFEELLNRLQPPPTAIVSDTFLYWAVVVGSRRNIPVALFSTMSASIFFVLHHHHLLVNLSENGGERVDYIPEISSMRVVDFPLNDGSCRSKQLLKTCLKGFAWVSKAQYLLFTSIYELEPHAIDVLKAELSLPIYTIGPAIPYFSLQNNPTFSTTNGTSDSYMEWLQVLFFTSHKGSHFSVSRAQMDEIAFALRESGIQFLWVGRSEAS

SEQ ID NO: 227981 - protein, 1573 aa, Glycine max
  Coding DNA Sequence Number=SeqID_111203
  Gene Ontology: Mol. function=protein serine/threonine kinase activity; Biological process=one-carbon compound metabolic process
  Homolog annotation: Hit_ID=Q84JK0; Match level="QueryCoverage=13%, HitCoverage=33%, E-value=3e-09, Identity=25%"; Hit description =Putative hydroxyproline-rich glycoprotein
MTDPEIPQGNTVETEKIRKQQRSLHLLLKPEIANLCEILHLPENVKSMVENCLEYTMNNYQICTEPVSILQAFQLSLCWTAAALLNHKLDFEESLMLAKQNLNFDCKKEVVDEINSRLWDLKEFFLKLTGNSNVASYPKASESSNGVYSFIEETPEVELVKNDNSKNIKNVQKSKSQWNKLLLTQQEEKQKLKKDIENENGEFWRRYRIHRAAIQSCSPNDVTKEQKLKVFNSEYMKIIRELERQHEICLKDLEDKQLKTRLTFQEISAPDELINPVTSNKSGTKVDQTCDQAQHSNAPKDLVSDHVVEGEGFNDIVEIMTRTGTGIGLSEAPDANASVVVPCSSTVELQTPLVKHAYANEMDIVASKDGPVSGNKCYNVAENEYDSQGNIFSKHYNSREQCSDGAISSPEEGEFVNYSCESHDFWKDAITQVLPSSNEEICDGITLDIQCSDGAISSPEDGEFVNYSSESHDFGQDAMTRVLLSSNEEMCDWKTLDVQRSDGAISLPEEGECINYSCESHDFGQDAIAQVLPSSNEEICDGKTLDVPCGEVSPTGCNTSSSNGDHVEIPSSRQGELDGTILSNPVCGSSIEVGANGSNDGAKNMAPLNSQSSEEHIPCVNTISTPNCVNAAQIHEADDNNGSKNAETLNSSLSDERISSLNSKSPQDHVRNENAMCMQNCENFAPSLEDDDGDGSTIVIPNPPLIDERNADRTIVLNRDAHVGMLETVNLTPSTEQISGGAVDEDGLPNHIPKSSVLDSVLSRPREADSPSNSSDADCIILSNQPSLEKQNHEVLSNIPVGQIPVEVSDTCHERITVNVLDGEEAVGRPATVNCTDYPENIIPLNSSSMDQISNGGPLLDGDLSSGPCATSPGNGLTLPDEQIPVLVPENSDKVARCQLTDSAVVKKNAISDQQEGVCRTMTENSLSQETPVSRTVHDLMEPLEPLQSLSSVESPPDPDTAREMPNTLISSPVDIVPDNQSINVSLVMEPPEQEGQLLSAGFLSSNQDLSNLPLVTGNKDQPSDEDDLPYHISEIQNQVVQQASYSDQQEGACRTMTENSLSLETPVSRPVDDLMEPLEQVQPLSSVESPPDRDTAREMQNILVSSSVDFVPDNQSINDSLVMEPPEQEGQLPSAGILSSNQDLANLPLVTRTEDQPSNEDGIPNHIPETSIEIQNQAVGQCASNVELDSCSRQVVHPASNMDLDSLLPGGFRRQSSDTRNLSTLTENNSHPVQPASQSASRIIRHLCLDPLTNELERLRILTDQNMKEYENKKLQLKCDFEKELEELYRKYDIKRKEIEVEFQNIRKNLDTRNKIVFVNKILAEAFRAKSMDLKVSGASRMQQDASVPMQLFQLASQQNATQPCLVGASSCGPPAASVQSSYATTTTQTMVSPIQATYSTPGTFSSVSPRLPHINSLSSPLGNVQTAGEIRAPAPHLQPYRPPTSIPASSPCTVPHGRPGQPTPGNIPVTSPPFSHRTPRPMPANFQSVPHRGHWPVSTGGLSTPNLSAAMNSRGDANSQPGINLANVRPHMPDLPTLMNLNLSKFGCNSSPANSAHQATSPDVVCLSDDE

SEQ ID NO: 227982 - protein, 75 aa, Glycine max
  Coding DNA Sequence Number=SeqID_111204
RISLSESDVKKGGRKTANNVDQPSSKSNGENLSTRNKEVSELRCRVVNLAYPREDTGRSQKQKSFSSGVQTVPKE

SEQ ID NO: 227983 - protein, 73 aa, Glycine max
  Coding DNA Sequence Number=SeqID_111205
MLNSESSAEKILLGFRKRRRTATVFFELGWCCNQGDSPSTIKRCMCIPRKAEKLLRRMEYNWLQERGKGHYRL

SEQ ID NO: 227984 - protein, 60 aa, Glycine max
  Coding DNA Sequence Number=SeqID_111206
MQFTSSTCSKNFVSSRALHKQQLPSLVVSGIVDNMVFGVKWWLDRNIEMAITEATWLQMR

SEQ ID NO: 227985 - protein, 63 aa, Glycine max
  Coding DNA Sequence Number=SeqID_111207
  Gene Ontology: Mol. function=structural constituent of ribosome; Cellular component=ribonucleoprotein complex; Biological process =translation
  Homolog annotation: Hit_ID=Q2PMP7; Match level="QueryCoverage=87%, HitCoverage=25%, E-value=1e-22, Identity=96%"; Hit description =Chloroplast 30S ribosomal protein S3
  Pfam annotation: Domain name=Ribosomal_S3_C; Domain location=11-63; Score=34.3; E_value=4.1e-07; Accession=PF00189.10; Description =Ribosomal protein S3, C-terminal domain
MGFPKFLIEEFIAGQLKNRVSFRKAMKKAIELTEQAGTKGVQVQIAGRIDGKEIARVEWIRER

SEQ ID NO: 227986 - protein, 220 aa, Glycine max
  Coding DNA Sequence Number=SeqID_111208
  Gene Ontology: Mol. function=metal ion binding; Cellular component =intracellular; Biological process=regulation of transcription
  Homolog annotation: Hit_ID=Q94KJ2; Match level="QueryCoverage=43%, HitCoverage=24%, E-value=2e-19, Identity=55%"; Hit description=CIL
  Pfam annotation: Domain name=CCT; Domain location=183-220; Score =63.6; E_value=6.5e-16; Accession=PF06203.4; Description=CCT motif
MGCTSLLRSPKKEEQEVPDANSNQAYTYEGFSILDELEGVLNTKEEQNFPQQNSSSGGELHWDFMEWEEFQPPNVGEEGEDENEGKEHTRKNTRSKCLFEEEQAIIRRESNNNIVGFWEVDDEKMVALNLNLNYQEVLDAWSDRGSLWADDCSLSFPTNNAYYMGEVPVLEEERARREASVLRYKEKRQNRLFSKKIRYQVRKLNADKRPRIKGRFVKRH

SEQ ID NO: 227987 - protein, 151 aa, Glycine max
  Coding DNA Sequence Number=SeqID_111209
MASIIVAICSFMASVLGLHLLLHLLYFTHYSTSSTGSIFNMVHDIFVKVKLEVTRTLTVLNVFGSRRSNDVTQSIFCPNFCKMVTSILQLDSMNLFVKARAWFNPITQGMAILIANTSTTFHRDERFGNTHAMYGKCNYEIEMPEETSFLN

SEQ ID NO: 227988 - protein, 99 aa, Glycine max
  Coding DNA Sequence Number=SeqID_111210
  Homolog annotation: Hit_ID=Q6KF70; Match level="QueryCoverage=67%, HitCoverage=12%, E-value=2e-07, Identity=41%"; Hit description =Transglutaminase
MQCACFKFSFTDAYRNAIEFEKKTHARNLEHRRAMDNNMIIMDREVEKLRADLANAEKRARAVMAADAKTNPGYPANYDNPEMGYGGITCPPDSYSMHQ

SEQ ID NO: 227989 - protein, 186 aa, Glycine max
  Coding DNA Sequence Number=SeqID_111211
MKLEEESAFSNLKGENESPWRRERMNFIVAIARGTQQHCWCTQQFLKNPKNAPNGVSVSDSTQEIFFQRRHYNCGRKKLLPWSLAEDVFREIQRKKVSSVVEITPAEECFFRGVSRKTSSVRLHGRSILLLLTLQLRKTASSVETHGRHFPRALMEDVFRSCDINSGRKLLSWSNSFYDFLVLRLF

SEQ ID NO: 227990 - protein, 150 aa, Glycine max
  Coding DNA Sequence Number=SeqID_111212
MAPPPLALPRRSCHVERDAQVAAAAWPFAYMEWDVQGALARCAWETKDASQTGVLALQKVTGCTVLQQTAAAAGSRKETPLEPAGCVCKSNAPSRGALSSFYMQFSCCIVLPVCSAFFKLASFGWFLASLVSTACNFLVKFVLYVNVMYA

SEQ ID NO: 227991 - protein, 88 aa, Glycine max
  Coding DNA Sequence Number=SeqID_111213
MVSISFSIADIPPKSVFGVRAIGVAMVEIDAETIIEMEAVLGLIGVIITVGIDHIHTEGFNSEHFMYYGLWSEEFVVFSWLAGINLSM

SEQ ID NO: 227992 - protein, 90 aa, Glycine max
  Coding DNA Sequence Number=SeqID_111214
MFVGTVGLLGLEFENLDDGVIDVVLKLRRRSKLRKPPSASMATIEEPRHQSWVFWELGFFVIPLEERAMGMKEKQNKERREDARCMQPSS

SEQ ID NO: 227993 - protein, 72 aa, Glycine max
  Coding DNA Sequence Number=SeqID_111215
MGANEPVDAKKLTSSFAPFVIQEQRVRWFFTLVVRKHSSPAMREILLCWAEMIRCNGEGKCRGCPTLSFSKH

SEQ ID NO: 227994 - protein, 142 aa, Glycine max
  Coding DNA Sequence Number=SeqID_111216
  Homolog annotation: Hit_ID=Q69VK6; Match level="QueryCoverage=37%, HitCoverage=21%, E-value=1e-14, Identity=72%"; Hit description =Putative COP9 complex subunit, FUS5
MDKLKTNKVVDTFLILKLKQLTVLTLAETYKVLPYNQLMQELDMTNVRELEDFLINECLYSLVLQPTLRREGDARLTGASSEKGKCAESPPTFIRGNCRKNRKRHGLRILSVKGSGVVFMHGEGCFPRSYVFLNCDKEIGPT

SEQ ID NO: 227995 - protein, 208 aa, Glycine max
  Coding DNA Sequence Number=SeqID_111217
  Gene Ontology: Mol. function=nucleic acid binding; Biological process= DNA integration
  Homolog annotation: Hit_ID=Q1SDG1; Match level="QueryCoverage=50%, HitCoverage=11%, E-value=1e-13, Identity=33%"; Hit description =Integrase, catalytic region; Zinc finger, CCHC-type
  Pfam annotation: Domain name=zf-CCHC; Domain location=177-194; Score =21.4; E_value=0.00029; Accession=PF00098.13; Description=Zinc knuckle
MASSNYLFPEGNSINRPPIFIVKDYHYWKTRMQIFIDAIDLNIWEAIEIGPYVLTMVAGNITSALGMDEYFKVSNCKNAKDKWDTLQVTHESTTNEHEMELLRLNQLEENDKKKGIAFKASSSIQEESDKEGSIDLDEDEDLSLYVKRFNIFLRMRRIQRRQNFKPKRRTQESSQTPRCYECNQLEHLSVDCPIFKKKMEKLEKKNIG

SEQ ID NO: 227996 - protein, 174 aa, Glycine max
  Coding DNA Sequence Number=SeqID_111218
MEANAVTVAATSAVAKVNPMPPSGLNQMNHPTSAMVGKDLGSTGGPHYAQIQNKHAFPPCGSPPKEDTHEMPHHNLADFEPCLGYATEGQVVSAPPAMAKMGKLAHIKERLKDIEGGEDYAFANLEELFLVPNFDKYKGTTCPKNHLKMYYRKMRAYAKDEELLIHFFQESLTR

SEQ ID NO: 227997 - protein, 92 aa, Glycine max
  Coding DNA Sequence Number=SeqID_111219
MSAVSSMHPFQEKGRPPKIQKTDNKFTKEPEKLNNRIPNTRAPPNPNVPDALNSYLTTGTPQLQNDDAIAELIYQKQIKNENNQYSRWLLQM

SEQ ID NO: 227998 - protein, 160 aa, Glycine max
  Coding DNA Sequence Number=SeqID_111220
MENPKENNKVENPHTVNAVLHPTFVFSARKLADQLGDTKADMDPDPEQQILDPKLRRILSNSFVAQRSREKKKNHLAHMEIQKKTFEVNNVIDFFGINVIDKNEIAQKQPIQDLYQNKRQAQIVEEETLYQEIDILKNYSMFEDAEIEKNKGEVNREREL

SEQ ID NO: 227999 - protein, 98 aa, Glycine max
  Coding DNA Sequence Number=SeqID_111221
MWLDMFLKLPYTRGFLPWFQDQGLSEPQVTIKEEMKIISKRFEELDVCGKVTLKSKLQEIAYHDQKSMCPPPEKVNTKGAQKKPMNRNQRSTKRDSSY

SEQ ID NO: 228000 - protein, 130 aa, Glycine max
  Coding DNA Sequence Number=SeqID_111222
  Gene Ontology: Mol. function=nucleic acid binding; Cellular component= intracellular; Biological process=ubiquitin-dependent protein catabolic process
  Homolog annotation: Hit_ID=Q5JLH9; Match level="QueryCoverage=94%, HitCoverage=35%, E-value=4e-14, Identity=54%"; Hit description =Putative PRLI-interacting factor K
  Pfam annotation: Domain name=zf-C2H2; Domain location=100-122; Score =20.5; E_value=0.006; Accession=PF00096.16; Description=Zinc finger, C2H2 type
MSQIGTIEEGKFVYYKFSIDNVIWEKLSSGNSCVEVKLESESDWGGDTDIFISRHPLIFPTRHQHKCIILHVIYGTGYRTMYSFAGCGVFLRIEEPKNHIHCDRCGQAFQQEELENHMKVFHEALHCPVE

SEQ ID NO: 228001 - protein, 156 aa, Glycine max
  Coding DNA Sequence Number=SeqID_111223
  Gene Ontology: Mol. function=helicase activity
  Homolog annotation: Hit_ID=Q1SN45; Match level="QueryCoverage=80%, HitCoverage=7%, E-value=3e-18, Identity=35%"; Hit description=AAA ATPase
MAGKHIFGDVELQLMDFPQQPSSSTKTRYFDILGPIMQCKECQAMMWYDERIDKYRDVANLKFNLYCGNGKVQLPFLQLVPQLLQHLLFDKFASEGKNYQQNIQMYNTMFAFMSPAAKVDKTINNGKGPPTIHIQGQPCHRIGSLLPPSGGVPKFA

SEQ ID NO: 228002 - protein, 118 aa, Glycine max
  Coding DNA Sequence Number=SeqID_111224
  Gene Ontology: Mol. function=transporter activity; Cellular component= mitochondrial inner membrane; Biological process=transport
  Homolog annotation: Hit_ID=Q1SX96; Match level="QueryCoverage=88%, HitCoverage=30%, E-value=7e-36, Identity=73%"; Hit description =Mitochondrial substrate carrier
  Pfam annotation: Domain name=Mito_carr; Domain location=2-93; Score =67.2; E_value=5.4e-17; Accession=PF00153.17; Description =Mitochondrial carrier protein
MAGAVMGGEVHTIMAPIERAKLLLQTQESNLTIVASGRLRFKGMLDCIARTVREEGILSLWRGNGSSVIRYYPSVALNFSLKPLVALVYPIIQEIYSGNRLPDDVIDYQWPKTVYNSY

SEQ ID NO: 228003 - protein, 156 aa, Glycine max
  Coding DNA Sequence Number=SeqID_111225
  Gene Ontology: Mol. function=helicase activity; Biological process =protein amino acid phosphorylation
  Homolog annotation: Hit_ID=Q9LTU4; Match level="QueryCoverage=94%, HitCoverage=10%, E-value=1e-31, Identity=47%"; Hit description =Helicase-like protein
  Pfam annotation: Domain name=DUF889; Domain location=56-156; Score= -81.8; E_value=6e-06; Accession=PF05970.5; Description=Eukaryotic protein of unknown function (DUF889)
MSIKVVELLKQTSLIIWEEAPVAHKYHFEALDKTLRDIMRITNEVDIVFGGKVIDFGGDFRQILSVIPRGTHSDIVHPTINASYLWDHCTILTLTKNMRLQTTVESEYTLEVADFVKWILEIDDDNLGQPNYGYATIEIPLDLLILDYSSNIIFPE

SEQ ID NO: 228004 - protein, 77 aa, Glycine max
  Coding DNA Sequence Number=SeqID_111226
MVKSFKVQVQMQFSEVTRQKSLLLNPTMTLSDIITAIQSSITDNDVTPIITTLWYRCLVYEFNGEVQYRAIQIIDEE

SEQ ID NO: 228005 - protein, 307 aa, Glycine max
  Coding DNA Sequence Number=SeqID_111227
  Gene Ontology: Mol. function=catalytic activity; Cellular component =mitochondrial respiratory chain complex I; Biological process =cellular metabolic process
  Homolog annotation: Hit_ID=Q0KF18; Match level="QueryCoverage=90%, HitCoverage=81%, E-value=1e-70, Identity=50%"; Hit description =Predicted nucleoside-diphosphate-sugar epimerase
  Subcellular localization annotation: CTP_CleavageSite=28; ConfidenceScore=5.60e-01
PDPGAHPPLRPGTRTPDPAHRHPARQRRARRRRVGPPGARLRRGRQSRRHPARQCGPPLWLRFRAGARAPAATHRPGLPPPGRAPAAACQRAGGGFQWRQHVPAFQGRWRGRHPAGAGRLARRGVDDVPPLGGVRAGRQFHQHVRAPGALAAGAAAGRRARAHAAGVRGRRGVGDAVGVGQHACLRQDLRAGRAAGLHPGRDRAPVRGLERPSASGDERADGRGPDAGVAVRMLAGAAADVARQPRFPAQRQHLRGADGARTECGADGPGGGGARLPGAGALVREACVDGGSPGAYRACCRDQPWSQ

SEQ ID NO: 228006 - protein, 143 aa, Glycine max
  Coding DNA Sequence Number=SeqID_111228
MFMTPRLCISGVLGEKTCFREENPSQGAAVRLSRRFHEQISEDFPPRVLHRSSSILRSFFGLQPNYVGLSSSSQLRIHRSKSPTFVDHPKRSLMVQRLNVSLLSKTKRSLMVQRLNVYLLSKTKRSLMIQHLNVSLLSKPRDR

SEQ ID NO: 228007 - protein, 178 aa, Glycine max
  Coding DNA Sequence Number=SeqID_111229
MKADVEAMMSMRKMMEVNTTTVVATGTATKVDPTHPSSLNQVQSKHSFPPYGLPPYYTPPNVAHAPDENTHEVPQDHNLANFEPRLEYATKGQAIGGIPLPNTLGVPQYRPQLQPLLPLAMLCLVPNVVIPLEFKVADFDKYKGTTCPKNDLKMKVLLGQPSPGTPIWSLPGSVLGKT

SEQ ID NO: 228008 - protein, 197 aa, Glycine max
  Coding DNA Sequence Number=SeqID_111230
MGQPSKKLLPFEFAQSFGIQFRASRYITGLNQTSEASVFNFERLDIFRDSIRHPSKKLLSFEFLRASLQHSISRVSIYYGIQSDIRVKSYWRLNLLRASAFKSEPLDILRDSIRPPSKKLLSFEFAQSFGIQVQSSRYITGLNQTSEASVFHFERLDILRDSIRHPSKKLLSFEFAQSFDNQFRASRSITGLIQTTE

SEQ ID NO: 228009 - protein, 145 aa, Glycine max
  Coding DNA Sequence Number=SeqID_111231
  Subcellular localization annotation: CTP_CleavageSite=65; ConfidenceScore=5.07e-01
MEASQNLAPTSHTSDLNMDRARLVYGLVTNMDMNIGALISGQISSISQSNSSRLRSLALITALSRARGVTSDNLTYESLSPAINLAYIKKNCWNMDDLTVNFKGAKKEKVRPAEVSFFFYSTSSFHFCYSYTSSFRLIYSRLSVL

SEQ ID NO: 228010 - protein, 46 aa, Glycine max
  Coding DNA Sequence Number=SeqID_111232
METLKIEQRKLTRNSNGYNVSLGCLVHLDHISRPSKLNTKLLENSE

SEQ ID NO: 228011 - protein, 57 aa, Glycine max
  Coding DNA Sequence Number=SeqID_111233
RVSYTQDWLKGTSFSMFTDEDFKELNKGNEIYKQKKFKEARDRNSRSIVLSPTIVNQ

SEQ ID NO: 228012 - protein, 37 aa, Glycine max
  Coding DNA Sequence Number=SeqID_111234
MTNFCLLAKPICRFSETSAECTTLVAECTTPAAEREE

SEQ ID NO: 228013 - protein, 149 aa, Glycine max
  Coding DNA Sequence Number=SeqID_111235
  Gene Ontology: Mol. function=RNA-directed DNA polymerase activity; Biological process=RNA-dependent DNA replication
MKVEQLFACHHISKEGKVPLATLSFQGKRHIPSYYERELMDKLQRLRQGSMSVEEYRQQMELLLLRARLREEERTSIARFLSGLNMEVRDKVELLPYRDLDELVQLCIRVEQQLKRNPSSKSYGSHSYPRKDQAHGILGAAPSKPKEDK

SEQ ID NO: 228014 - protein, 104 aa, Glycine max
  Coding DNA Sequence Number=SeqID_111236
MQHLSIDGNMGILLHHGAHQKSNHCNQKKDCSLRHPYWMHAKTKIKSEIEEVQEQMKADMEVMKKQMTTMMEAMMDMRKIMEVNVVVAAERDPTHPPVLIKKVT

SEQ ID NO: 228015 - protein, 160 aa, Glycine max
  Coding DNA Sequence Number=SeqID_111237
MATQVVLSMMERELITMIMDILLVFYYDKMVGYMPSSFAYLVFASERIEVGLRKGKFNCVASVNFGNRGLGRSGERKKEGEPHVVAAVPARPNFPLAPYNPMYLSQRALRGRARARLTGALPKGGKMRGVPTNVYLWKTSEKPKETGQNENSKFGSCIYA

SEQ ID NO: 228016 - protein, 88 aa, Glycine max
  Coding DNA Sequence Number=SeqID_111238
MWNWEMCFFKGYPHNIMDISLSRTIFVATYPSAGGRHEGSRVRLPWEEDARSYHQRLFEENIRKTGKVWSTNFNRERFRSCIYARGKY

SEQ ID NO: 228017 - protein, 79 aa, Glycine max
  Coding DNA Sequence Number=SeqID_111239
MSPDVNSCIYDSNLKKNSVQQTLEFDLNCKYQARTDPSTVYLPHKSWTKPSPDKLPAPTKRRSTRGRAPQRFSMKEVAS

SEQ ID NO: 228018 - protein, 85 aa, Glycine max
  Coding DNA Sequence Number=SeqID_111240
MKENWIRGQPPDKARKKANLAFFISSLVKLPCPQGDNPHIIDPNSPTRCHPGIALPIAPTLPKALVLKLADNLIWLAKGVMTGWC

SEQ ID NO: 228019 - protein, 122 aa, Glycine max
  Coding DNA Sequence Number=SeqID_111241
MTLITIEANASCHFTFKHTPQGDINHIISYYAYFGFAWSDNPVRISQQFFGHDANGKPTRSIFNQNTIVKVHEDVGDFNDDEDITSSEISFYRDVYSEEIFEGEMVSSDKECDSLGDESNPS

SEQ ID NO: 228020 - protein, 175 aa, Glycine max
  Coding DNA Sequence Number=SeqID_111242
MDLEGRYSLRIGDYSLEDIQSEEIADHAKVLAELEAAQAQVDQECKDASCDQDIQIRIPKLKDLESKAKELRKSSRCKKVSVLNKKNVCLMKEMSYYMFSNLLGSQVVDISIRASTQSRSLLKISSILATARSGGHDRHTVAAMDVDEAKRDFRTIGIEGDASVNMIVVGGEGEA

SEQ ID NO: 228021 - protein, 115 aa, Glycine max
  Coding DNA Sequence Number=SeqID_111243
SALNARCPVLFLLKDGTVKMALAAGPAWVTQLPMRVRAINLQTFDTASKSVWPLYLQPLAERIEHLGPSTDIFRAVAEIAVQLSGSGSTSNDLLDELCSNESLARGVGGVELLIP

SEQ ID NO: 228022 - protein, 491 aa, Glycine max
  Coding DNA Sequence Number=SeqID_111244
  Gene Ontology: Mol. function=serine-type endopeptidase activity; Cellular component=cytoplasm; Biological process=proteolysis
  Homolog annotation: Hit_ID=Q658B2; Match level="QueryCoverage=96%, HitCoverage=65%, E-value=0.0, Identity=73%"; Hit description =Putative prolyl endopeptidase
  Pfam annotation: Domain name=Peptidase_S9; Domain location=256-488; Score=299.4; E_value=6.7e-87; Accession=PF00326.11; Description =Prolyl oligopeptidase family
  Pfam annotation: Domain name=Peptidase_S9_N; Domain location=1-197; Score=-147.0; E_value=0.011; Accession=PF02897.5; Description=Prolyl oligopeptidase, N-terminal beta-propeller domain
  Pfam module annotation: Pfam domain module=Peptidase_S9::Peptidase_S9_ N; Domain location=256-488::1-197
MVKFITLQLCKLDVIYVLLYIEEGCDPVNKLYYCDLSELPNGLEGFRNESSLLPFVKLVDKFDGQYQAIANDDTLFTFLTNKDAPKYKLVRVDLKEPNAWTDVIPESEKDVLESARAVNGNQLIVSYLSDVKYVLQVRDLETGSLQHKLPIDIGTVSEISARREDTVLFIGFTSFLTPGIIYQCDLGTQTPDMKIFREIDIPGFDRSEFHVNQVFVPSKDGTKIPMFIVARKDIVLDGSHPCLLYGYGGFNVSLTPYFNISRTVLARHLGAVFCIANIRGGGEYGEEWHKSGSLANKQNCFDDFISAAEYLVSAGYTQPRKLCIEGGSNGGLLVGACINQRPDLFGCALAHVGVMDMLRFHKFTIGHAWATDYGCSEKEEEFHWLIKYSPLHNVRRPWEQHPDQSIQYPSTMLLTADHDDRVVPLHSLKLLATLQYVLVTSLDKSPQTNPIIGRIECKAGHGAGRPTQKMIDEAADRYSFMAKMLDAHWIE

SEQ ID NO: 228023 - protein, 463 aa, Glycine max
  Coding DNA Sequence Number=SeqID_111245
  Homolog annotation: Hit_ID=Q96MI8; Match level="QueryCoverage=24%, HitCoverage=21%, E-value=3e-20, Identity=45%"; Hit description=CDNA FLJ32312 fis, clone PROST2003210
MSMVVAASGDNDSDNVSGSGSNVGNNDGDNGDSGVGGGIIGGIVGNGDSNVNEGGGSNTDGGGYISSNNGGSDDSGGGSGYDDVGGSCRDNYRGSGVGGNNDGGRGSGSNVGGDDDGDSDSGIGDHDGDNDDDSYINGDGSNVGASYVIDNNDGSDNDKNDIGGGDEGMEKEAELGEKEFEQMVRALPSDAVKELLSHGVGPVYASPPSLSSLFDATQQDCLCTLCLGILQFTYSNVQNDNLPLLIADMVKRQAYQFDTFSLEVSIPPIIIDDLLYENQIWIPTLVPRKLAQWMHLYKGRLKIFSYLSSSKSSGEPSIVGERSFSSTLENDSSDCCKFLLEKYSRNVSQTRWIIDDERMGEASVEEIIGGNILQACQGDSFKFHAAGREDIDVRMLGPGRPFLVEVQNGRHIPSELFVKDIEKTINKMENKLVRVKNLKLVGSDGWNLMREGEAEKQVLHFDS

SEQ ID NO: 228024 - protein, 388 aa, Glycine max
  Coding DNA Sequence Number=SeqID_111246
  Gene Ontology: Biological process=protein modification process
  Homolog annotation: Hit_ID=Q9FH07; Match level="QueryCoverage=89%, HitCoverage=34%, E-value=2e-37, Identity=34%"; Hit description =Arabidopsis thaliana genomic DNA, chromosome 5, TAC clone:K5J14
MKTTKLCLDYRCFPLEGAEIWRWISFVSYSRNMLLFALYNGRLEREGTSADLHIRGQIQSESVQIGLAMQHLGALLLELGRTMLTLRMGQSSAESVVNAGPAVYISPSGPNPIMVQPFPLQTSSLFGGPVPPSTPATLGTIGIGNAPRNVNIHIHAGTSLAPIVSAIGSRENNGEGTRSEHHNEPGSGDSGSTRVLPVRNVIAATIPSHPPGVGVSSSTQTGFGISTSQPPSDSASLSSVLAEINSRLRNVVGNMQGDNTVPSGQMESNSRDLSSGSESRPPTVNKQQDTVDVNGFGAISASSVGCTSESEVQKVQTEAVQTSSNVLVDKFVSSSSNQDLQSCSSGETIVKPEIEQDVLAVSERQNVTEPAKAAPLGLGVGGLERKQF

SEQ ID NO: 228025 - protein, 321 aa, Glycine max
  Coding DNA Sequence Number=SeqID_111247
  Gene Ontology: Biological process=protein modification process
  Homolog annotation: Hit_ID=Q9FH07; Match level="QueryCoverage=92%, HitCoverage=36%, E-value=3e-64, Identity=49%"; Hit description =Arabidopsis thaliana genomic DNA, chromosome 5, TAC clone:K5J14
  Pfam annotation: Domain name=ubiquitin; Domain location=29-97; Score =57.3; E_value=4.9e-14; Accession=PF00240.13; Description=Ubiquitin family
MAGQSSNEGSSTGNISAECSDSTVQLNIKTLDSRIYSFQVDKNMPVSLFKEKIANEIGVPVNQQRLIFRGKVLKDEHVLSEYRILQIASGMSSGESTGTSGNRGSGAPRNRVGQISHSVVLGTFNVGEQGEGIVHDLTRVIGHVLNSIGNSGQSTISGPNATQTSSVQPRNETDGMHAGNQNPAGNQAPSGQTFHGPTFQSVSHVVQIPVAAGTIPIPSLNAPIPDSLNTLSEFMNRMEQILTQNGYQSNLSSANPRDQLVELPSNVQGLPTLEALSTVLHRAEQLLGGQAVAALSVINTSHLLIFMFTLMIKISFYYLQL

SEQ ID NO: 228026 - protein, 111 aa, Glycine max
  Coding DNA Sequence Number=SeqID_111248
  Homolog annotation: Hit_ID=Q1SNW6; Match level="QueryCoverage=65%, HitCoverage=23%, E-value=3e-24, Identity=75%"; Hit description =Tetratricopeptide-like helical
MSEDGNILRENTNFVNEFILSEDVAVVESQILKLFEDSEDELAIGLLNLRWCAIAGFPICKSADQSLWAKRLEGMQLETSMKGLRGGEWGSVVERRRRCIISCVNCSHNSE

SEQ ID NO: 228027 - protein, 214 aa, Glycine max
  Coding DNA Sequence Number=SeqID_111249
MGEDEMESKTVILQGSLIHFSQNLTSTAGREFTEFATEPSMQRQVVEALHSGDRKKASDLLSDFGSRSRHSLTADHFVHIFEYCARSPDPLFVMEILRFMELKGVSMNNICSSLMMQALCNGGYLEEAFDIVDYLGGSQRLYPVLPLYNSLLRSCTTMQNIIQASRCLDLMEKKMVGKNEVTYIELLKTDNVRLRDHFNPFSNCGMSLHIYLTA

SEQ ID NO: 228028 - protein, 79 aa, Glycine max
  Coding DNA Sequence Number=SeqID_111250
  Homolog annotation: Hit_ID=Q1SNW6; Match level="QueryCoverage=91%, HitCoverage=23%, E-value=2e-16, Identity=58%"; Hit description =Tetratricopeptide-like helical
MMRALGEEGMIKELIQYLHVAENLFIYRNPSLGTHMYNTVLHYLVEAKEESLTLVRDKAKIEYISGGHPHPVSYLLGVN

SEQ ID NO: 228029 - protein, 376 aa, Glycine max
  Coding DNA Sequence Number=SeqID_111251
  Pfam annotation: Domain name=PPR; Domain location=1-35; Score=4.2; E _value=2.4; Accession=PF01535.11; Description=PPR repeat
  Pfam annotation: Domain name=PPR; Domain location=126-160; Score=1.9; E_value=4.5; Accession=PF01535.11; Description=PPR repeat
  Pfam annotation: Domain name=PPR; Domain location=197-230; Score =14.6; E_value=0.14; Accession=PF01535.11; Description=PPR repeat
  Pfam annotation: Domain name=PPR; Domain location=263-297; Score =18.9; E_value=0.019; Accession=PF01535.11; Description=PPR repeat
  Pfam module annotation: Pfam domain module=PPR::PPR::PPR::PPR; Domain location=1-35::126-160::197-230::263-297
MALDRFIWSFTRLGDLESAYKILLEMISLATRGNIPIARTVHGKVYTNRLDIPVPSNKGPGSTMLDLKENKKLDYCMHPPLMYIPDSISASIEQQIICMGNKKAKSTELAGLNGQKHPLLKKALSRSFDDIIHGCAKQKNHMLARKLMLQIRLLFVSTSNMFLTWAPKPSLHLPDMCETLVVLLVYMTNLGLQPSRHTYNGIIKVVSHRSFGDAIRVLKKMQQKNLKPYDSTLASLSITCSKALQLDLAEAFLNQISECLYPNPYNALLASCDQLNQLERAIRVFAKMEQKKVLPNIRTCELLFSLFGVVNGHYEDSDALSKVDVAKRINAIQKHMANNGIQHRVAQGQRKTLLNSHMLRSAEWWAANTRYGRMDE

SEQ ID NO: 228030 - protein, 602 aa, Glycine max
  Coding DNA Sequence Number=SeqID_111252
  Gene Ontology: Mol. function=protein binding; Biological process=cell adhesion
  Homolog annotation: Hit_ID=UPI0000D5585B; Match level="QueryCoverage =42%, HitCoverage=37%, E-value=2e-13, Identity=28%"; Hit description =PREDICTED: similar to CG17754-PC, isoform C
  Pfam annotation: Domain name=BACK; Domain location=445-568; Score =4.5; E_value=0.00033; Accession=PF07707.5; Description=BTB And C -terminal Kelch
  Pfam annotation: Domain name=BTB; Domain location=192-290; Score =45.1; E_value=2.4e-10; Accession=PF00651.21; Description=BTBPOZ domain
  Pfam annotation: Domain name=BTB; Domain location=326-439; Score =87.1; E_value=5.3e-23; Accession=PF00651.21; Description=BTBPOZ domain
  Pfam module annotation: Pfam domain module=BACK::BTB::BTB; Domain location=445-568::192-290::326-439
FLTVPPFECAWREDLKFREAGRGCVAFEAFACNDVTLVFRENVGSQGYHYKRDSSPHYTIILGSHRNRRLRIEVNGKAVVDVAGVGLCCSSSFQSYWISIYDGLISIGNGKYPFQDVVFQWLDSYPNCNVQYIGLSSWDKHVKYRNVNVLSLTHTHVPLSKHVVFGDYQVEDEVDAADCYNYKNMDYDKWGLKKFLESWDLSDVLFIVGKEEKPVPAHKAILAASGKFSLCSSSFVINLPTVSYLLFRALLHYIYVGWTQEQLGSLRDLSLQFEVTPLVKQCEETMERFKLDKKLFDTGKNVELTYPSIRPHCSTLPSLPVSTQQLKQLKLTGQYSDVNIYIEGYGLIARAHKIVLSLWSIPFARMFTNGMSESMSSEVTLRDVPPEAFKAMLNFLYDGQLNDKVIDSGALLLQLLLLADQFGVTFLQQECCKMLLECLSEDSVCPLLQVVSSMPSCRLIKESLQRRISMNFDYYISASTDFVLLDETTLINIIKHPDLTVTSEEKVLNAILMFGMNAKQLFGWEVVDQLMENSKPELLFGERLQLIYDLLPFVRFPLLQYSLLEKLQHSSIGRHIPVFQNLVNEAINFVKCGLAESENEEK

SEQ ID NO: 228031 - protein, 50 aa, Glycine max
  Coding DNA Sequence Number=SeqID_111253
RHDDGRGNTGWRLRNDPEGTGRAKTEHLADEDGPTNVQSGKDTHEMTIND

SEQ ID NO: 228032 - protein, 370 aa, Glycine max
  Coding DNA Sequence Number=SeqID_111254
  Gene Ontology: Mol. function=oxidoreductase activity; Cellular component=peroxisome; Biological process=electron transport
  Homolog annotation: Hit_ID=Q49HE0; Match level="QueryCoverage=89%, HitCoverage=93%, E-value=1e-123, Identity=63%"; Hit description=12 -oxo-phytodienoic acid reductase
  Pfam annotation: Domain name=Oxidored_FMN; Domain location=29-343; Score=216.2; E_value=7.2e-62; Accession=PF00724.10; Description =NADH:flavin oxidoreductase  NADH oxid
MHARALVFVILDQNHHLSSTCGCGLINFTIFDTVYDRIVLAPLSRSRSYNFIPQPHAALYYSQRTTKGGFLIGEASGVSDTAQGYPNTPGIWTREQLEAWKPIVSAVHEKGEYQPDGKAPISSTDKRLRKDIANNKATADKYPPPRRVRADEIPKLVNDFVIAAKNAMEAGFDGIEIHGANGYLLDQFLKDKVNDRDDEYGGNLENRCRFPLQVVKAVADEIGADKVGMRLSPFADYNDCGDSDPHALGVHMAQSLNEMGILYIHLIEPRMVTQFHKFDGTKSSLTPIRKAFKDGTFIVAGGYDRNEGNEAISCAAADLVAYGRLFLANPDLPTRFQLDAHLNQPDATTFYSHHPVLGYTDYPFLQPNPK

SEQ ID NO: 228033 - protein, 139 aa, Glycine max
  Coding DNA Sequence Number=SeqID_111255
  Homolog annotation: Hit_ID=UPI000034F3B5; Match level="QueryCoverage =26%, HitCoverage=3%, E-value=2e-08, Identity=70%"; Hit description =ATP binding / ATP-dependent DNA helicase/ ATP-dependent helicase/ DNA binding / ...
  Homolog annotation: Hit description=hydrolase, acting on acid anhydrides, in phosphorus-containing anhydrides / nucleic acid binding
MTIIVATNITITATTTGGDSGDHSGGGDGGDDSGNNHVNHVSGGKGSDDHSGVEVAAMAIMVETVMTVVVVMMMIGAHSHYAYPEVKMTDKERLATSLNTTAGFKHHKLKVYVQFLEALPGIEPTNGNYNNAVITQAET

SEQ ID NO: 228034 - protein, 444 aa, Glycine max
  Coding DNA Sequence Number=SeqID_111256
  Homolog annotation: Hit_ID=UPI000034F3B5; Match level="QueryCoverage =20%, HitCoverage=7%, E-value=5e-34, Identity=76%"; Hit description =ATP binding / ATP-dependent DNA helicase/ ATP-dependent helicase/ DNA binding / ...
  Homolog annotation: Hit description=hydrolase, acting on acid anhydrides, in phosphorus-containing anhydrides / nucleic acid binding
MASFTSELGVHFETSLEAPHVIDVDSQVWPAIISTGPGNYPLNASYKTADGYAFQDAVGKSLEEIFKIVPGGCLVFFPSYKLMDKLCKRWSETVDSLQNSEKGGAALLGVCRGKDQNAWFKRKKNQKLNKSGNGDGRETSVIENNMSFPTLTPQDLVESQPSAQKSSNTYNCKYLPQCCNQTEPRFTGESSVAIIHEETSIVMETPCIDVENDPTSPDYSKDDNSGSIIIEASAQFADHLSSLSIMSLTKGSKNSSRAQSSITITPKKNVITSDIPEMESVNSHNQKRRNPMVTPFINLVEEDNFVAPCASPLTWYTKSSVDVREITHGSEYGFKRILKSNSPPLLTSTIPGSCSPTAPPLDKSNINNLLGVQIMATDSSNVQLLDKILFYFDSLEVKSSEESGNVASGKVDLSPVKDSREDEIAVLNSIEKYSYFPRPGNSEV

SEQ ID NO: 228035 - protein, 102 aa, Glycine max
  Coding DNA Sequence Number=SeqID_111257
MEKLNGIKGINFRLVVMALVSDDFQGMKKDVVFESWCEPDTVVLRGFGYYGFESGEVFGFVEQICAEFQGEKGCFRCGSLFDGGGAWRGCKKGGRSLHKCRF

SEQ ID NO: 228036 - protein, 420 aa, Glycine max
  Coding DNA Sequence Number=SeqID_111258
  Gene Ontology: Mol. function=hydrolase activity, acting on acid anhydrides, in phosphorus-containing anhydrides; Cellular component =nucleus; Biological process=nucleobase, nucleoside, nucleotide and nucleic acid metabolic process
  Homolog annotation: Hit_ID=UPI000034F3B5; Match level="QueryCoverage =98%, HitCoverage=39%, E-value=1e-131, Identity=51%"; Hit description= ATP binding / ATP-dependent DNA helicase/ ATP-dependent helicase/ DNA binding / ...
  Homolog annotation: Hit description=hydrolase, acting on acid anhydrides, in phosphorus-containing anhydrides / nucleic acid binding
  Pfam annotation: Domain name=DEAD_2; Domain location=77-237; Score =78.8; E_value=1.7e-20; Accession=PF06733.6; Description=DEAD_2
MISASNPNPKNVYHIGGLQVEFPYQPYGSQFAFMGRVISTLNRAQKEGHCHALLESPTGTGKSLSLLCSSLAWQHHYKSQHHHLKSAHEATADPLAYGGGFVPDEVPLSSESLDRTQSEGNNKKQKKKEAPTIYYASNAHKVKGHPSLHKGGCNEVHDIEDLVKVGQLVKGCSYYAARSMSDDAQLVFCPYNYIINPVIRAAMDVDIKGAIVILDEAHNIEDIARDAGSVDIEEDVVDSMLNYMVIPLKELQMELQQLCSIKAEIYQPLYEMTQGLTSWMEQKKNKLEKRDFQHYVSCWTGDKALRELEEANISKQCFPILLECATKAIKVATDLETDAPHISAMSVITLEGLFSSLTYFFSRNGSHMLDYQLALQRCIREDTGRASRNWTYTLSLWCLNPAVVFRDVANLSLSVILTSG

SEQ ID NO: 228037 - protein, 123 aa, Glycine max
  Coding DNA Sequence Number=SeqID_111259
MLRDGGLLAVEGFEGFFGEGFEGFFGEGIERLGFLGDRVLKGGEVGGEGDKEIMLTEFFCATPPPNPDLSTRLKSLWRKVDTTTLLRSVVSKLNESTSLGAEIATAMEEAVDPVRLVEREREK

SEQ ID NO: 228038 - protein, 69 aa, Glycine max
  Coding DNA Sequence Number=SeqID_111260
MKKIEDLLENLTEFSNKGIVGWNALGNLENGGHRDGVEADTPMEMHGSWALTSQLDEETKKMAWATEEG

SEQ ID NO: 228039 - protein, 129 aa, Glycine max
  Coding DNA Sequence Number=SeqID_111261
  Homolog annotation: Hit_ID=Q1S7C5; Match level="QueryCoverage=90%, HitCoverage=9%, E-value=5e-09, Identity=34%"; Hit description =Integrase, catalytic region
MLEYLGKIKMIVDDIASVGDVTTYHEYMNSLESLPRDSDSVIALVESRLPNISIEEVECLILAQELHLKKCVKFSLLSNSFVTLVNLTHGKTSQSMIDDDFVSNSSSNTPITYVNKYSSDSRVFGGHNY

SEQ ID NO: 228040 - protein, 126 aa, Glycine max
  Coding DNA Sequence Number=SeqID_111262
  Gene Ontology: Mol. function=RNA-directed DNA polymerase activity; Biological process=RNA-dependent DNA replication
MCIDYHKLNDAIRKDHFPLSFMDQMLKRLAGQFFYCFLDGYSRYNEIVMNPKDQEKIAFIGLLVSFPTDECHSGYVECTSYFSTEKSSGKPQRQGMVYDWRKRIQDMFSQGEGVSTLGVRHENDSL

SEQ ID NO: 228041 - protein, 48 aa, Glycine max
  Coding DNA Sequence Number=SeqID_111263
MSLLTNGHSLMQTNLFTNLEVRGGKLLHVVGLIGRRRGYLGLQCQRWE

SEQ ID NO: 228042 - protein, 118 aa, Glycine max
  Coding DNA Sequence Number=SeqID_111264
AAGFELGAENACVWLAVERVVQNEFWIVFWLCPVLLGCDSLCCLNVVLLGCCGSLGGLMGTRGWWVYARIVDVENLLCTIARPPPSTTCDGVKLPAFIVDHRVVPGDMSRGSGDLGDV

SEQ ID NO: 228043 - protein, 122 aa, Glycine max
  Coding DNA Sequence Number=SeqID_111265
MTETVCTDNRLGISVRHLTSWVMITKGGVVDKSGAFALTYIIVAICSFMASMLAFIYSCTSSTPSITLPLAWIFNMVHDIFVKVELEVTRTSTTLNVFGIRRSSDVTQFIFCPNLQIGYFHT

SEQ ID NO: 228044 - protein, 140 aa, Glycine max
  Coding DNA Sequence Number=SeqID_111266
MMQKHIRGDAAFARPFHAIRDIEFAPENIVTGASFTASSVPGLPPQPPLPLLQLERHKDMLDAAEQAAIEKEQWIDDEAERLLSCFPDHLYLFRAWNVHPEVKKCCAGSGAEEAYRDFIIGLAYLQAEQNYDLQVVLGWE

SEQ ID NO: 228045 - protein, 326 aa, Glycine max
  Coding DNA Sequence Number=SeqID_111267
  Gene Ontology: Mol. function=sulfuric ester hydrolase activity; Cellular component=integral to membrane; Biological process =metabolic process
  Homolog annotation: Hit_ID=Q6DB57; Match level="QueryCoverage=99%, HitCoverage=58%, E-value=1e-148, Identity=74%"; Hit description =Putative membrane protein
  Pfam annotation: Domain name=Sulfatase; Domain location=96-325; Score= 80.4; E_value=5.5e-21; Accession=PF00884.13; Description=Sulfatase
LKTPGQRLKPTVILLLSVALVWLPIRYFDKLQKANEELTNIDLPSYGGVVAHSYLPSNWIAALGLFAWTKVDERLDSQELLDPAKKFTYIAPPGIDDTYVVFVIGETTRWDHMGMLGYNRDTTPKLSKEKNLVAFRGESCDTATKLSLRCMFVREGGTMDNPGRTLKEQNIFAVMKELGFTSELFAMQSEVWFYDNADVNNFSFREQIGSEKRNQGKAVDDMLLVPELQASLQRFPKGKHLVVLHTKGSHYLYSQRYPREYARYQPECIGVDDKCSKAQLINAYDNSILYVDTMLDSVLDQLRDKKAIVFYAADHGESISENMHLH

SEQ ID NO: 228046 - protein, 140 aa, Glycine max
  Coding DNA Sequence Number=SeqID_111268
  Gene Ontology: Mol. function=transmembrane receptor activity; Cellular component=membrane; Biological process=defense response
  Homolog annotation: Hit_ID=Q1T1A2; Match level="QueryCoverage=99%, HitCoverage=15%, E-value=1e-30, Identity=48%"; Hit description=TIR; Disease resistance protein; AAA ATPase
MHVLLSGGSVHQIHEVKEMNPQDSLKLFCLNAFNESQPKMGYEKLTEEVVKIAQGNPLALEVLGSDFHSRCIDTWECALSKIKKYPNEKILSVLRFNYDGLDELEKKTFLDIAFFFYNHDKDYVIRKLDAQGFHGASGIK

SEQ ID NO: 228047 - protein, 157 aa, Glycine max
  Coding DNA Sequence Number=SeqID_111269
  Gene Ontology: Mol. function=transcription factor activity; Biological process=regulation of transcription, DNA-dependent
  Homolog annotation: Hit_ID=Q930V0; Match level="QueryCoverage=93%, HitCoverage=48%, E-value=6e-20, Identity=38%"; Hit description =Putative transcriptional activator
RSVDVAIRYRETPERGLHCTLLHEDRFIVVASPALGITRLEDLRHATLFHVEHRHVPADSPGWENWQRRYGPPQLNIDAGLTFSDETHALQAAVAGQGVVIASELLARDLLQRGVLTAPFEMFLPGANYYLVATQELAQRADISALRDWLLQQIAMS

SEQ ID NO: 228048 - protein, 34 aa, Glycine max
  Coding DNA Sequence Number=SeqID_111270
MVKHRRIKGCRGQMVLMEKAIKLSMKDMHFNDNE

SEQ ID NO: 228049 - protein, 275 aa, Glycine max
  Coding DNA Sequence Number=SeqID_111271
  Gene Ontology: Mol. function=transition metal ion binding; Biological process=metabolic process
  Homolog annotation: Hit_ID=Q218M6; Match level="QueryCoverage=87%, HitCoverage=58%, E-value=1e-62, Identity=48%"; Hit description =Hypothetical protein precursor
  Pfam annotation: Domain name=DUF323; Domain location=61-275; Score =49.9; E_value=6.5e-12; Accession=PF03781.6; Description=Domain of unknown function (DUF323)
MTAFLQSEFMNPSIEPLLELGLNHEQQHQELLLTDIKYILGHNPLFPAYRKDKEESKEIVLTGEMIRLSEGVYEIGFNGNGFCFDNELGRHKVYLNNFEISDRLVTNGEYLEFINDNGYRDFRHWHAEGWDWVKQNEVKSPLYWHWIDEKWMYYTLDGLQEVDPDEAVCHINFYEASAFAAWKGMRLPTEAEWEVASVHFQWGERWEWTGSAYLPYPGFKKEAGAVGEYNGKFMVNQMVLRGASEATPKGHSRNTYRNFFHANLQWQFTGIRLAR

SEQ ID NO: 228050 - protein, 240 aa, Glycine max
  Coding DNA Sequence Number=SeqID_111272
  Homolog annotation: Hit_ID=UPI00006A17C7; Match level="QueryCoverage =86%, HitCoverage=87%, E-value=8e-10, Identity=32%"; Hit description =UPI00006A17C7 related cluster
DCTSSAPEDCMSSPSEDYTHSPIEDYKPSPSRGYTPSPYLQEATRPRLAFRGLHTLAFRELHVLAFRGLHTLAFRGLRVLDFRGLHVFAFRRLDRITRPHLKRPTRPRLQRTACPRLQMATRPRLQRTTRPRFQRATGPRLKRTTWLHTLAFRGVHVYAFRGLHALSLRGLHVLALRGLHALAFKGLHARTYRGVHVLVFIGLHALAFRGRVSYPNFVRGPSLDDMRPFFGPCEVLGTRH

SEQ ID NO: 228051 - protein, 186 aa, Glycine max
  Coding DNA Sequence Number=SeqID_111273
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=8e-24, Identity=33%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
AYKLQWSLHHAFRRLHAFAFRGLHVLAFRGLHNLAFRELHILAFRGLHALGFRGLHALAYTGLYYLTFTGLDILAFRGWHVLGFRGLHVLAFRGLHILTFRGLHFLTFEGLHALAFRGLHAMRGLQALNFRRLQVLAFRGLHILAFRWLHALAFRGLHMLAFRGLHTLAFIGLQTLAFRGLHVLTF

SEQ ID NO: 228052 - protein, 143 aa, Glycine max
  Coding DNA Sequence Number=SeqID_111274
MRNMLLVKETKLPTDQSNICFLDEKQCVYWGRESMLMKFSHNPLNEILDVSISFLNDHLEEALGSTKIEENHSKCINLTHCGARKSLAHRILVGNQRERTTLGRGQGLTFSPWVKVYDKLGFWPRPVERLVMIYVRVWPAVRG

SEQ ID NO: 228053 - protein, 64 aa, Glycine max
  Coding DNA Sequence Number=SeqID_111275
MTYEDLFARPLIANHLGRGKLPEKDAGWLTFQEDRPNVKTNLLANHGGGAVNAVESDRPRRSKP

SEQ ID NO: 228054 - protein, 45 aa, Glycine max
  Coding DNA Sequence Number=SeqID_111276
MSVKNLVKCSGVHDKTNHTLGDQSGSRYFTRMLQPCGIDTDLKEY

SEQ ID NO: 228055 - protein, 173 aa, Glycine max
  Coding DNA Sequence Number=SeqID_111277
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSAQGGGGAWSSVRPGTHLVSTSRQNEREPTNGFVGDLEGGTNQSDRAESQWIVAARHSATYNTPS

SEQ ID NO: 228056 - protein, 285 aa, Glycine max
  Coding DNA Sequence Number=SeqID_111278
  Gene Ontology: Cellular component=integral to membrane
  Homolog annotation: Hit_ID=Q7CHI0; Match level="QueryCoverage=89%, HitCoverage=85%, E-value=2e-83, Identity=65%"; Hit description =Putative surface protein
MGIITLWGPGGPQGRGSGEQGDQHRRQQAQQEAVHDGGGHHVQPAAALQHRQGEVHRGGAAQAEGGGAAAAHQRRDQHDCHQLARQIVEERGAAHHRAVGVGDQNARQRIPAEAGGHRQPGLDRQPQQLRRQRAAGQRRDGHHQRHQRAAAVEHDLAQRHAAVAQLNADQQQQEDQRIFAAFMGELQPLPLRQAEQEAAEHHAAQLERLQRHVHARRQLFLFMAAAPRHAPLQQRQQQQIGAENAEEEHRAVLEDQHQVAAEIFHERQADTHEKQDHVHHPAQQP

SEQ ID NO: 228057 - protein, 225 aa, Glycine max
  Coding DNA Sequence Number=SeqID_111279
KEGRIRILSSCEGCPNVPMMRTRGCINYNPVLAIRQLGYPMRGVPSDESITPFITRGFSDPNARDRELRGSSNGIIGGYHKWLRVRTQGLDWLPNLKTVRDNGVKASEESDEVQALKAKLERARVVKEKFKSIAIKGSNSELKLRRGERNHHGETEGNMWAIIDECKEKLNQAATHEQRLEDEYAKISVEREARERVIDSLHQEATMRMDRFALTLNGSQEIPDC

SEQ ID NO: 228058 - protein, 163 aa, Glycine max
  Coding DNA Sequence Number=SeqID_111280
MVCRDRTHKTPSGPEVVQQGPGVSISGYGPLLVLQGAVPPARSCHRDIGIAPTKTPVDSEKSNRALGFLALGSRPQDTQWTRRSPIGSWSCQALITGLCQFYGVPVAPSKVIRPPTNRAFIKKYCVPRQAQGETPQQPGDGRQRATDAPPSPLEFTSAHPQKG

SEQ ID NO: 228059 - protein, 140 aa, Glycine max
  Coding DNA Sequence Number=SeqID_111281
MEHRSHQPNTSDLPLIDHSLTNIACQGKYNNWSSFSSLSQQQILDHHHSIRHPWSQSQHTYRGWSSRCTLTCVIWLINPNTYPWPTPEQFRATITWPGEAPIIQVEVGPADAQEAAQGDRGRAEEDEDMEDLVDYFIGGN

SEQ ID NO: 228060 - protein, 82 aa, Glycine max
  Coding DNA Sequence Number=SeqID_111282
MYLATGNRLHPLKPSEEETKTSSSVLSDENLNLIQQDDQLSSTDDDGQINTLTRDKISCLKQSILYLTPRKRRFFWKNSRKH

SEQ ID NO: 228061 - protein, 122 aa, Glycine max
  Coding DNA Sequence Number=SeqID_111283
GVVLAEVLLADSRFTRPDMGFHPTKLIFVPSDADEAPLDVSICLHAFGIVGCGSFSGVKSCERDDPFHPGLFVGDAGGFQSPTREPLNVGGLVPPHCSLKSVVSDDACPGACFVQRDASTLS

SEQ ID NO: 228062 - protein, 169 aa, Glycine max
  Coding DNA Sequence Number=SeqID_111284
MEGQEQMKADMEAMKEQMATTMEAMMSMKKIMEANVVEVAASSAITKVNPTPPSGLNKMNHPTSDMVGKDLGSMGGPHYMQIQNKHAFPPYGLPPNYTPPNVAYNPTENVNKSPPMLIESQQPQSDHAHVSQPMGETHEIPHHNLANFEPCLGYATEGKAVGGIPLQNT

SEQ ID NO: 228063 - protein, 50 aa, Glycine max
  Coding DNA Sequence Number=SeqID_111285
MEVEEPWQGLWLPLHYQVVFGHWACAEQAGIMADLGMAFMDDWVKGTVIG

SEQ ID NO: 228064 - protein, 193 aa, Glycine max
  Coding DNA Sequence Number=SeqID_111286
  Gene Ontology: Mol. function=actin binding; Biological process=actin cytoskeleton organization and biogenesis
  Homolog annotation: Hit_ID=Q9SE97; Match level="QueryCoverage=81%, HitCoverage=16%, E-value=3e-19, Identity=39%"; Hit description =Formin-like protein AHF1
RPSRRVELFFIVLHRCRRFLPKPRSLPRQRRQRLELWRVHFPRVQRGSAWVRELINAAAGVHNGAKVEKLRACRRRVSGFPGSGAGCGGGFAREETDAAVGSEGFIVGGVVFAAAAAVDEGGKGDDRGGAGDGGDGDGEEFFGGRFELLGLGEDERGDVSREGSKGRRRRRRRRRRVCWEKGCGRRSIGIGCG

SEQ ID NO: 228065 - protein, 273 aa, Glycine max
  Coding DNA Sequence Number=SeqID_111287
  Gene Ontology: Mol. function=oxidoreductase activity, acting on NADH or NADPH; Cellular component=integral to membrane; Biological process=electron transport
  Homolog annotation: Hit_ID=Q06FP8; Match level="QueryCoverage=49%, HitCoverage=34%, E-value=4e-69, Identity=88%"; Hit description=NADH -plastoquinone oxidoreductase subunit 7
  Pfam annotation: Domain name=Complex1_49kDa; Domain location=1-181; Score=72.7; E_value=1.2e-18; Accession=PF00346.9; Description =Respiratory-chain NADH dehydrogenase,
  Pfam annotation: Domain name=NADHdh; Domain location=132-272; Score =29.8; E_value=1.4e-13; Accession=PF00146.11; Description=NADH dehydrogenase
  Pfam module annotation: Pfam domain module=Complex1_49kDa::NADHdh; Domain location=1-181::132-272
MLRASGIQWDLRKVDNYECYEEFDWEVQWQKEGDSLARYLVRIGEMMESIKIIQQALEGIPGGPYENLEIRCFDREKEPEWNEFEYRFISKKPSPTFELPKQELYVRIEAPKGELGIFLIGDQNGFPWRWKIRPPEREISAGIQQRIGPEYTGPFGVLQALADGTKLLFKENLIPSRGDIRLFSIGPSISVISIIISYSVIPFGYNFVLSDLNIGVFLWIAISSIAPIGLLMSGYGSNNKYSFLGGLRAAAQSISYEIPLTLCVLSISLRAIR

SEQ ID NO: 228066 - protein, 87 aa, Glycine max
  Coding DNA Sequence Number=SeqID_111288
MNAKTRISNQKSKEKEEKKEKEEMKRKKRKGKEGFPIKDRKKAKKGKIGGKHNNSRSIKETRKENIRSSDQINVRRGCSRLAMSRPA

SEQ ID NO: 228067 - protein, 98 aa, Glycine max
  Coding DNA Sequence Number=SeqID_111289
MYGSRKRCDFEGELYVYDVEGETAAADDDCCKLIEDAAVRAWRQGEQKQKADVTRDVLTSWRRLVDVQLEEFPLCLITLIMEVADPTCITARTCSGSV

SEQ ID NO: 228068 - protein, 94 aa, Glycine max
  Coding DNA Sequence Number=SeqID_111290
MASYGEAKDSIGEEVPRPTSSTWSYIICALVRLTWRVDTCLGVPQRMPRVRNLPASAPDCQMFLCSMPRTKIPNTDSSSIWTNLNQTSFVDPSC

SEQ ID NO: 228069 - protein, 78 aa, Glycine max
  Coding DNA Sequence Number=SeqID_111291
  Subcellular localization annotation: CTP_CleavageSite=32; ConfidenceScore=5.10e-01
MRLNREVVKVVVALSSPFRLSVHPSLSTASVRLARQKNLAEHQYQGRAKREISVLSTAVVFSQTQRMTGAKLKSTYSR

SEQ ID NO: 228070 - protein, 109 aa, Glycine max
  Coding DNA Sequence Number=SeqID_111292
MEVRDKVELLPYRDLDELVQLCIRVEQQLKRKTSSKSYGSHSYPRKDQAHGILGAAPSKPKEDKGKHPLALPYCGSKDYLLLSRETSLFTHDELKRALYSGAWEHKEWR

SEQ ID NO: 228071 - protein, 313 aa, Glycine max
  Coding DNA Sequence Number=SeqID_111293
  Gene Ontology: Mol. function=urocanate hydratase activity; Biological process=histidine catabolic process
  Homolog annotation: Hit_ID=Q3QFR5; Match level="QueryCoverage=74%, HitCoverage=34%, E-value=1e-109, Identity=81%"; Hit description =Urocanate hydratase
MGQLLTSASILATAEKLSNAELLAALTYRAAKALNLSDRGTLKEGMRADFTLFKTDNYQNITYHQGSMQPQAVWKDGVEELRDYGRIYMYRFRPEYAMHARSIADYPAVSKQAAAIMLMIQNNLDPAVAQHPHELITYGGNGAVFQNWAQYRLTMQYLSQMTDEQTLHLYSGHPMGLFPSSQHAPRVVVTNGMMIPNYSKPDDWERFNALGVTQYGQMTAGSYMYIGPQGIVHGTTITVMNAFRKHLAAGDTIEGKVFLTSGLGGMSGAQPKAGNIAGCITVCAEINPAAARTRYDQGWVDRLIEHIGQLTEQ

SEQ ID NO: 228072 - protein, 69 aa, Glycine max
  Coding DNA Sequence Number=SeqID_111294
MDIFEDTDIPVILGRPFMLTASCIVDMGKRKLELGFEDQKIDFDFFVENKAYSRTQCVLTGKGRKSRGS

SEQ ID NO: 228073 - protein, 73 aa, Glycine max
  Coding DNA Sequence Number=SeqID_111295
MDECMKKCLWHKFILWTREAERLSLFKYSIWAAQRPMHALKKETRAFQLLVTNEGINIQHVRDDMMQMRKSAT

SEQ ID NO: 228074 - protein, 161 aa, Glycine max
  Coding DNA Sequence Number=SeqID_111296
EAAQSGSTNTVIDPPSPIRRQVKWKMTRTKETGQMTSEAAKEIAEKIVSQAGVTIKKYFGSAPRTSHTSSSMAPEDLEQLTQQIRDQLEGVILPLEPEVGPSAACVSTKESCVDPSRNDSDTGILYEGSTTVHNIHLLHEVKVGVEEVRDADALILVPTEE

SEQ ID NO: 228075 - protein, 92 aa, Glycine max
  Coding DNA Sequence Number=SeqID_111297
  Subcellular localization annotation: CTP_CleavageSite=54; ConfidenceScore=5.53e-01
MSPPPLGPLYHSQTQLTLSGRLHFPALRMDRSGALSGMTLRLADMHNSSFLQPRSVVLSGWLTKPADCLSEKVKISPSQTCLINLKLRENDY

SEQ ID NO: 228076 - protein, 206 aa, Glycine max
  Coding DNA Sequence Number=SeqID_111298
MGEIEEEQERMKAYIEAMKEQMATMMEAMMSMKKIMEVNATIVAATSAVAEGGKELGITGGPHCVQIQNKHAFLPYDLPPNYTPPNVVPTPDENVNNSTPILIKCQQPQFDHAHISQPMGETHEIPHHNLADFEPHLEYATMGQVVGGVPLPNTLEGPQFRPQPLPLHFAVGRVPPTMVEREKLDHIPERLRVIEGGGDHAFADIA

SEQ ID NO: 228077 - protein, 112 aa, Glycine max
  Coding DNA Sequence Number=SeqID_111299
MEDSSWLEVHLNQRVAVREEQGFVHGKTQVINEFFVTNSCYIVDLAANGVAPNTEASVGPLSWIGICETNSAFPQNFSLMCFHWACAWSSAISNSFEIYSPNMRVVYKYNFC

SEQ ID NO: 228078 - protein, 44 aa, Glycine max
  Coding DNA Sequence Number=SeqID_111300
MEETREDAGPAEQGPSNDETLSNKESPQHFDKDVLSSQKASQKL

SEQ ID NO: 228079 - protein, 242 aa, Glycine max
  Coding DNA Sequence Number=SeqID_111301
  Gene Ontology: Mol. function=protein binding; Cellular component =nucleus; Biological process=proteolysis
  Pfam annotation: Domain name=Transposase_21; Domain location=137-242; Score=-20.4; E_value=7.2e-13; Accession=PF02992.5; Description =Transposase family tnp2
MNASCMSPAYEEGVEQFLEFASERSRLDEDEKYFCPCINCLNGRRQAHKCQVKKILCPMGMKYQKIYACPNGCILYRYEFEEMHKCPRCGVSWHKVKDDNECNSVKSTKKGPPAKVLWYLLIIPRFKHLFANGDDTKDLTWHADERNCDGMRKYMMLSMMISGPRQSGNDIDVYHSHLIEDLTKLWEKGVVVFDGYQNETFRLCVMLFCTINDFPAYENLNGYSVKGHHAHPICEKTQAMYN

SEQ ID NO: 228080 - protein, 71 aa, Glycine max
  Coding DNA Sequence Number=SeqID_111302
MILPDDPLFHPKEPYFRKFSGRTSSGSFERSLHDSSGNSHRNKEANLKGKTRLIEAEEAAGLAGLAEKKKH

SEQ ID NO: 228081 - protein, 70 aa, Glycine max
  Coding DNA Sequence Number=SeqID_111303
MDRLVVHVDPATGKADGPHRRKAEFDIPEASNQRTKKKILKMGLVLPPEPEVGPSVARVNTKGSSVYPSG

SEQ ID NO: 228082 - protein, 127 aa, Glycine max
  Coding DNA Sequence Number=SeqID_111304
  Subcellular localization annotation: CTP_CleavageSite=43; ConfidenceScore=5.26e-01
MTYYFKLFFRASGASTLLLLLPVRPRDGLLPHVSNSLPSLTFCCDAVTTSPVLCCDVITTSTRVLLRHHRRFILSTSRQRYCIWFRGLFPRNFLPRFIGVLVVCMNLVLVVFDSVGLTIVCLHDFGS

SEQ ID NO: 228083 - protein, 123 aa, Glycine max
  Coding DNA Sequence Number=SeqID_111305
MLMCNDQFSCVGPIELLCTIGRTPDGVINLLQRTMPRTHDVIMYYNGKWNMPPQNKFVGCAFTGKNPKKFQIPSTCTIDELKDLIKQVAPKGIPPLGIHEFKRCYLMEPGNDINFFRFFDVQT

SEQ ID NO: 228084 - protein, 103 aa, Glycine max
  Coding DNA Sequence Number=SeqID_111306
  Gene Ontology: Mol. function=DNA binding
  Homolog annotation: Hit_ID=Q5JML8; Match level="QueryCoverage=67%, HitCoverage=51%, E-value=1e-22, Identity=76%"; Hit description=DNA -binding protein-related-like
  Subcellular localization annotation: CTP_CleavageSite=2; ConfidenceScore=5.06e-01
MASATKQQQEGEKPAKRKPVFTKVDQLKPGTNGHTLVAKVLSSNTVLQKGRPSSSHNIRPTLIAECLIGDDTGTIIFTARNEQVGILGMGIRILIMKWLTLLD

SEQ ID NO: 228085 - protein, 161 aa, Glycine max
  Coding DNA Sequence Number=SeqID_111307
  Gene Ontology: Mol. function=nucleic acid binding
  Homolog annotation: Hit_ID=Q5JML8; Match level="QueryCoverage=36%, HitCoverage=42%, E-value=1e-22, Identity=88%"; Hit description=DNA -binding protein-related-like
GVLDKTPVYVLLFDMMKPDNTVILRNAKIDMFKGSMRLAVETSGVLDKTPVYVLLFDMMKPDNTVILRNAKIDMFKGSMRLAVETSGVLDKTPVYVLLFDMMKPDNTVILRNAKIDMFKGSMRLAVDKWGRIEVTDPAKFVVKEDNNLSLVEYELVNVAEE

SEQ ID NO: 228086 - protein, 42 aa, Glycine max
  Coding DNA Sequence Number=SeqID_111308
MVESFVCSSQKRRKIPQRLQVLRVGDRDGERGVDEVLFSKNV

SEQ ID NO: 228087 - protein, 136 aa, Glycine max
  Coding DNA Sequence Number=SeqID_111309
  Gene Ontology: Mol. function=nucleic acid binding; Biological process= DNA integration
  Homolog annotation: Hit_ID=Q1T010; Match level="QueryCoverage=99%, HitCoverage=13%, E-value=1e-26, Identity=51%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MEKILLRLTPQFDHIVVAIDESKDLEELKVEEPQNSLEAHEQRLNEKSSTSLNHQIKEEEELSTIKEEGKGKTKRKFSASTVKNEVAMPLNVGMAKGSRPRTVKRRLMWLKMKFLMRILFCWLQPVMELPIQKLDI

SEQ ID NO: 228088 - protein, 70 aa, Glycine max
  Coding DNA Sequence Number=SeqID_111310
MTNLSSLAYFLGLELVTTSKGIILHQQRYVIKVLKRFHMADCNLANTPAKVCEGNIGLWYIVPRKIDQKP

SEQ ID NO: 228089 - protein, 90 aa, Glycine max
  Coding DNA Sequence Number=SeqID_111311
MCKEFYLQQGAGCKNGSHSWLPRDAQGCEGRSLCERKMKLQLRRRTTKRSFFSINVWTLWFLKRSQKPKWLRRLRTSCRKHTGMLRRPRK

SEQ ID NO: 228090 - protein, 85 aa, Glycine max
  Coding DNA Sequence Number=SeqID_111312
  Gene Ontology: Mol. function=ribonuclease H activity; Biological process=DNA integration
MKEMCKDFKIQHHNSTPYKLKIDGAVKAANKNIKKIVHKMIVSYKDWHEMLPFALNGYRTLVRTSTGETPFSLVYGMEDVLPFEV

SEQ ID NO: 228091 - protein, 87 aa, Glycine max
  Coding DNA Sequence Number=SeqID_111313
  Homolog annotation: Hit_ID=Q9JKS4; Match level="QueryCoverage=92%, HitCoverage=10%, E-value=4e-07, Identity=43%"; Hit description=LIM domain-binding protein 3
MSSPLQGYTPSPSEDYMSSPYRGLHVLTFIGLHSLTFRGLHALALRGLLVLALRGLYDLTFRGLHALTFRELQVLAYRGLHVLTFIR

SEQ ID NO: 228092 - protein, 118 aa, Glycine max
  Coding DNA Sequence Number=SeqID_111314
MMQGMTQILRAGEHLHCVIGSDVCSPDWQKRIIGVMKESRASSRTRFRELSGEREDGVSQGIQITSVSRFEDENEEKLVDGTCIECGSTGAAGSDSASLSLIFKKPRPNGHPIGISSF

SEQ ID NO: 228093 - protein, 83 aa, Glycine max
  Coding DNA Sequence Number=SeqID_111315
  Gene Ontology: Mol. function=3'-5' exonuclease activity; Cellular component=intracellular
  Homolog annotation: Hit_ID=Q2V9B5; Match level="QueryCoverage=82%, HitCoverage=21%, E-value=1e-14, Identity=72%"; Hit description=3'-5' exonuclease domain-containing protein-like
MIPQPRSLRHQRRQGFLELLPSPDTLHLSNADLRGGRRTRCTCLPFDLALYERISNLRVHHVVQLDVELKAQRLLVAFAIVNQ

SEQ ID NO: 228094 - protein, 139 aa, Glycine max
  Coding DNA Sequence Number=SeqID_111316
MTEGCGEGFCLANLPGDAFSLWGNFFEAKKQMMADAKFAGLLGLGKPLVEILPPGQLRGFCPLLAWLGSAVLGYGPVLSFGLVGPLLPPVISFVARILPTLACAPLAKSVPREGRIKATRAESQWIVAARSLCHLQYPV

SEQ ID NO: 228095 - protein, 201 aa, Glycine max
  Coding DNA Sequence Number=SeqID_111317
  Pfam annotation: Domain name=zf-CCHC; Domain location=180-197; Score =21.6; E_value=0.00027; Accession=PF00098.13; Description=Zinc knuckle
MFCLRSCLNTLEGTSLCGTSRGYIYLGLTENNRGYISCGSVLVEGTSTRFKENKGGYIPCGSLLVKGFLQGHSIQHLEELVRILKVHEQEFAQDEGTKKGKLLALTTQRPKRSTTSKESLSKSLVVSDTLEEESDDDSDEEDYELSLITRKVRKIWKNKNSSRFNGLSKRSFHKKEKSPIICYECKNPGHFKLECPDLEKP

SEQ ID NO: 228096 - protein, 344 aa, Glycine max
  Coding DNA Sequence Number=SeqID_111318
  Gene Ontology: Mol. function=DNA binding; Cellular component =mitochondrion
  Homolog annotation: Hit_ID=Q9LVB0; Match level="QueryCoverage=54%, HitCoverage=47%, E-value=3e-49, Identity=57%"; Hit description =Similarity to DNA-binding protein
  Pfam annotation: Domain name=AT_hook; Domain location=67-79; Score =16.7; E_value=0.03; Accession=PF02178.9; Description=AT hook motif
  Pfam annotation: Domain name=DUF296; Domain location=139-259; Score =216.3; E_value=6.8e-62; Accession=PF03479.5; Description=Domain of unknown function (DUF296)
  Pfam module annotation: Pfam domain module=AT_hook::DUF296; Domain location=67-79::139-259
  Subcellular localization annotation: CTP_CleavageSite=90; ConfidenceScore=5.10e-01
MEEREIFSSGHAVKVVEAPQSFHVALNSVQFSGPTVESPVPSPVPASAPAPAPVSASVMNSGSTEGKKKRGRPRKYGPDGKVALSPMPISASIPLTGDFSAWKRGRGKPLESIKKSFKFYEAGGAGPGDGIAYSVGANFTPHILTVNEGEDVTMKIMSFSQQGCQAICILSANGTISNVTLRQPTSSGGTLTYEGRFEILSLSGSYITTENGLTKSRSGGMSISLAAPDGRVMGGGLAGLLVAAGPVQVVVASFVPGHQLEQQKPKKPRVEHISMAAPTYVNPTSAEEIRIGLGGVKPIMTPAAFQVHHIFGNGQSSGNSASDDSAPFPENESNPSHADAGVAC

SEQ ID NO: 228097 - protein, 743 aa, Glycine max
  Coding DNA Sequence Number=SeqID_111319
  Gene Ontology: Mol. function=microtubule binding; Cellular component =phragmoplast; Biological process=positive regulation of microtubule polymerization
  Homolog annotation: Hit_ID=Q6L4A9; Match level="QueryCoverage=98%, HitCoverage=99%, E-value=0.0, Identity=53%"; Hit description =Putative microtubule-associated protein, identical
  Pfam annotation: Domain name=MAP65_ASE1; Domain location=34-696; Score=247.2; E_value=3.4e-71; Accession=PF03999.3; Description =Microtubule associated protein (MAP65ASE1 family)
MSKPNHLLQTKTTCGSLLDELQIIWNEVGESETEKDRMVFEIEEECLEVYRRKVDKANRSRAQLRQEIADSEAELASICLAMGERPVHVRQAWVKEEGCVRPLVAYVKLVHMPNMFDQKAVSLKQELARVRQELEEMQKRKSGRRNQFIEVQEQIQSISNEISPSITAIVDETDLSLRKLEELHRQLLALQKEKSERLKKVQDHLYTLNSLCSVLGLDFKQTVSGVHPSLGNSEGPKSVNNDTINQLAIGIQGLRKVKLKRMQRLQDLASTMLELWNLMDTPIEEQQVFQNVTCNIAASEHEVTEPNSLSENFIYNVEAEVSRLEELKSSKIKELVLKKRVELEEICQKTHLIPEIGSAMKYPVEAIESGSVDPACVLEQIELRIARVKEEAFFRKEILEKVEKWLSACDEESWLEEYNRVGTNLHQILSLGHLLYCFSRLDENRYNAGRGSHITLKRAEKARALVNKLPAMVDALTSKTVAWEKDKGIEFTYDGTCLLSMLENYSLSRQEKEQERRRQRELKKLQGQIIVEKEVLYGSKPSPSKAQSVKKAPRLSTRSTSSKRISLGCQTPKSDSKATQSFSTGKTDKKKILHRILPTTLLDGFLIRLYVAPRNARRGLDIAGVPLRKYSTGAGSVLDMVSPLTRQPFSPISLTLSSKANVANAANDTQNEKLQKTLVTTTVANEENKTPKAVPIPDPTTPLKLLNPMNMSMTPGPASVPYGVSAQEIEYSFEERRLGFVLA

SEQ ID NO: 228098 - protein, 71 aa, Glycine max
  Coding DNA Sequence Number=SeqID_111320
MVKTFSGRTLNYRRKLFRKKLFWKQNYELPEVLLPEVDLSTFGRSSSGRDFRNNFFWNFSVVFPEEHLPEC

SEQ ID NO: 228099 - protein, 53 aa, Glycine max
  Coding DNA Sequence Number=SeqID_111321
  Homolog annotation: Hit_ID=Q6K9F6; Match level="QueryCoverage=68%, HitCoverage=5%, E-value=2e-12, Identity=75%"; Hit description =Putative CER1 protein
MVGYVTYIDFMNNMGHCNFEVVPKWLFDIFPPLKYFMEYLAIGVHEKLKKLIY

SEQ ID NO: 228100 - protein, 150 aa, Glycine max
  Coding DNA Sequence Number=SeqID_111322
  Gene Ontology: Mol. function=catalytic activity; Biological process =metabolic process
  Homolog annotation: Hit_ID=Q01CB8; Match level="QueryCoverage=70%, HitCoverage=34%, E-value=1e-16, Identity=42%"; Hit description =Homology to unknown gene
  Pfam annotation: Domain name=PGAM; Domain location=16-145; Score= -9.6; E_value=0.023; Accession=PF00300.12; Description=Phosphoglycerat e mutase family
MNAKRRENMVGVLPKRRILMRHGESQGNHDTTMYTTIPDHNIQSTAQGMTQALRAEKHLRRVISSYGCSPDWRVQFYVSPYARTRSTLCKLRHCFLKKRIIDVREESRVREHDFENYQVEERMKTWLVGDGLTEKERLKAPKGTLFIPYT

SEQ ID NO: 228101 - protein, 67 aa, Glycine max
  Coding DNA Sequence Number=SeqID_111323
MATEIPKWLFVQRQHLLIPIHEVRWQAEISEWLSVHNFLLIPTRESGGRRRYPSGYPHKTTSVNPDP

SEQ ID NO: 228102 - protein, 81 aa, Glycine max
  Coding DNA Sequence Number=SeqID_111324
MRFRSYGSASSKEIQKFIILQLPLSLSKELPSLGGLKMLLMFHSMESVFVEACVGLQGRTRTLFNGALPGPLRGELLHGQF

SEQ ID NO: 228103 - protein, 164 aa, Glycine max
  Coding DNA Sequence Number=SeqID_111325
  Homolog annotation: Hit_ID=Q2HV31; Match level="QueryCoverage=32%, HitCoverage=9%, E-value=7e-14, Identity=70%"; Hit description =Prefoldin
MAQVQPINKKRNEVDRKVEANLKEIEEIKVATDMALRNVEMVDSAKVVVKGELRLVEEQCQGRDLLSHYCQKGTADFSSVQIALHITCSLCATVFSAILLKDNVSIEIIEARNERHIYCDADWASYPTGRRSTSMGKNSCNDQPESDLNQPILVQDEELKPRWL

SEQ ID NO: 228104 - protein, 165 aa, Glycine max
  Coding DNA Sequence Number=SeqID_111326
MREATMREAGMRMLTRLVAAPLAAFRISQQKLVQMLGNIQAMTLVGWQIRMEHVLNNQRNFLPQGGNFDAGDACGNAVETSSGEDQNRTGLKQRRSLVMVDCERLKMQAIFLDSLSVRKTEKIKTSKFRACTTVMMPMSLSSTVLDKCSPTRCLHRAPRLSNSAL

SEQ ID NO: 228105 - protein, 69 aa, Glycine max
  Coding DNA Sequence Number=SeqID_111327
MLFGAGRSLVTMGEGWRRWFLSEMMQHDDGGATVLFGGGVSKDLVEDKNALPLDRCHKLVEAKMAFSIG

SEQ ID NO: 228106 - protein, 109 aa, Glycine max
  Coding DNA Sequence Number=SeqID_111328
MLKRANTPPRDNPLKFEMPGITFTSADFKGMGPEQDDPMVITNETLINQGSMTNILFWNTFKQLDIPESTLQPYGDLLFGFANERVGMKGSIELLTRFDTKIGYRDIVV

SEQ ID NO: 228107 - protein, 57 aa, Glycine max
  Coding DNA Sequence Number=SeqID_111329
MTMKTNVMLIKDVSQKAKRSIRDALRQREQDEGNVDRRCITRRVRKLHAPKHTWGCV

SEQ ID NO: 228108 - protein, 252 aa, Glycine max
  Coding DNA Sequence Number=SeqID_111330
  Gene Ontology: Mol. function=protein binding; Cellular component =intracellular; Biological process=protein modification process
  Homolog annotation: Hit_ID=Q0WRN6; Match level="QueryCoverage=70%, HitCoverage=99%, E-value=4e-71, Identity=79%"; Hit description =Polyubiquitin 4 UBQ4
  Pfam annotation: Domain name=ubiquitin; Domain location=136-193; Score=83.9; E_value=5e-22; Accession=PF00240.13; Description =Ubiquitin family
  Pfam annotation: Domain name=ubiquitin; Domain location=48-100; Score= 6.3; E_value=0.06; Accession=PF00240.13; Description=Ubiquitin family
  Pfam module annotation: Pfam domain module=ubiquitin::ubiquitin; Domain location=136-193::48-100
MDDFGEHGDQNLFHHNNDQSDVEGVAIPISPMLQYHQPRRPMELNLDHLPQYIDHHHFVQQQDPVQLPFGALKMQLEDGRTLADYNIQKESTLHLVLRLRGGMQIFVKTLTGKTITLEVESLTSKLKFRTKRIFVKTLIGKTITLEVESSDTIDNVKAKIQDKESIPPDQQRLIFAGKQLEDESTLHLVLRLRGGMQIFVKTLIGKSVTLEVESSDTIDNVKAKFQDKEGILPDQRRVDLCWEAIGGWKDTC

SEQ ID NO: 228109 - protein, 141 aa, Glycine max
  Coding DNA Sequence Number=SeqID_111331
MNSESICAYIYINGEVISDSSASAIFKGDKTKSILLNPTMKLRDIITAIQSSIRDDDVTSIITALWYRCPVYIFNGCVQYRAVPIIDEEGVWCMFHTFTNMTSVICMELKVDVHNSSSSSQVNDLNWPEMEQKLENSLKLE

SEQ ID NO: 228110 - protein, 202 aa, Glycine max
  Coding DNA Sequence Number=SeqID_111332
  Gene Ontology: Mol. function=protein serine/threonine kinase activity; Cellular component=nucleus; Biological process=response to high light intensity
  Homolog annotation: Hit_ID=P05478; Match level="QueryCoverage=79%, HitCoverage=100%, E-value=2e-78, Identity=90%"; Hit description=18.5 kDa class I heat shock protein
  Pfam annotation: Domain name=CS; Domain location=95-187; Score=0.2; E_ value=0.021; Accession=PF04969.6; Description=CS domain
  Pfam annotation: Domain name=HSP20; Domain location=98-201; Score =179.9; E_value=6.1e-51; Accession=PF00011.11; Description=Hsp20alpha crystallin family
  Pfam module annotation: Pfam domain module=CS::HSP20; Domain location= 95-187::98-201
  Subcellular localization annotation: CTP_CleavageSite=32; ConfidenceScore=5.57e-01
DSSSTSYKYPTARVFTHCVTAKFSKAPISLLRVPKFSPRDKMSLIPNFFGGRRNNVFDPFSLDVWDPFKDFPFPNTLSSASFPEFSRENSAFVSTRVDWKETPEAHVFKADIPGLKKEEVKVQIEDDKVLQISGERNVEKEDKNDTWHRVERSSGKFMRRFRLPENAKVEQVKASMENGVLTVTVPKEEVKKPDVKAIEISG

SEQ ID NO: 228111 - protein, 270 aa, Glycine max
  Coding DNA Sequence Number=SeqID_111333
MKESIISFSSQMEDITVTTTQLSESFNDRLRLYMKPTYNVLKFFRNFDRLLDDMRYKEIESNYEMSQKMPSSMNIMICVVLVKISSKAAECEEATTFLARKLVELDIEVNNILNKRSSTSTSALGDANCQNNEVSAYDTTIGVSRVKGIKKKEGVSWVKGRPKSCVKKTCKKGKDTHKYSPMRQKISTTMSIPITQKMPLLHGFQDPETIGINMTHLMSKTQENGEHMEELCLSMYTHQGQVHLKENIEKCPSPVLQTTNVPGRNTVGFK

SEQ ID NO: 228112 - protein, 138 aa, Glycine max
  Coding DNA Sequence Number=SeqID_111334
  Gene Ontology: Mol. function=protein serine/threonine kinase activity; Cellular component=nucleus; Biological process=response to oxidative stress
  Homolog annotation: Hit_ID=P19243; Match level="QueryCoverage=93%, HitCoverage=84%, E-value=4e-27, Identity=49%"; Hit description=18.1 kDa class I heat shock protein
  Pfam annotation: Domain name=HSP20; Domain location=40-137; Score =92.0; E_value=1.8e-24; Accession=PF00011.11; Description=Hsp20alpha crystallin family
  Subcellular localization annotation: CTP_CleavageSite=32; ConfidenceScore=5.02e-01
MSIIPNANPLEDSPFTTQSMSTLPQSAATLMSSSSISQFDWHETTDSHVLKAEVPGLKKEEMKIEVDSERTLQVSGERNVEKKDESGVERSSCMFKKCFTLPPNAKLDLVKASYENGVLTITIPKMNEATAKAIENSY

SEQ ID NO: 228113 - protein, 204 aa, Glycine max
  Coding DNA Sequence Number=SeqID_111335
  Homolog annotation: Hit_ID=Q6H6E6; Match level="QueryCoverage=36%, HitCoverage=35%, E-value=5e-23, Identity=62%"; Hit description =Putative fiber protein Fb2
  Pfam annotation: Domain name=Di19; Domain location=10-164; Score= -9.2; E_value=2.5e-08; Accession=PF05605.3; Description=Drought induced 19 protein (Di19)
MDSDFWTSRLAAAKRQYTLQHHHPNSHLDRLGIDDFDVEEEVRPDFPCPYCYEDFDIASLSSHLEDEHSCESRVTVLLGGGGGYRSNSAAVSNAAATDPFLSSFILNFPACEAEEISKSVVTSADDSSSKNATPVHIWKSSFDPSLSTEEREKRMRQAAGRSAAPLTYSAESDHSYPFIPPLTLGPYAPFQVESDEEVGNFSFR

SEQ ID NO: 228114 - protein, 183 aa, Glycine max
  Coding DNA Sequence Number=SeqID_111336
  Subcellular localization annotation: CTP_CleavageSite=32; ConfidenceScore=5.68e-01
MATPPSSPHPPPKSATPSSSTLKKTRKATRLRSLATRSVGVERLVVHVDPTTGKVDGPHGKKLIMYLGIGACDKVDVTYDNWKQVHVDQKDLIWELDLTSKCALADVKESDDDKVCGNYNISKEKWNQLCQSHRDPSWEASRGSFVAHGHQDVLTTVIGRPKHPGHVRATGANVTIKQYFGLA

SEQ ID NO: 228115 - protein, 32 aa, Glycine max
  Coding DNA Sequence Number=SeqID_111337
MEVHNGVAERRSRIILSMAKIMMKGKGMPHYF

SEQ ID NO: 228116 - protein, 96 aa, Glycine max
  Coding DNA Sequence Number=SeqID_111338
MTQVAYNASTNNFSQDMQFFKDMIIIISFYLLLIDFTVCVVILPQLLSPNKLLQIWDKFALNYDALLQPKVDGDCILQAQGSSQSIKFSAQHGCKG

SEQ ID NO: 228117 - protein, 129 aa, Glycine max
  Coding DNA Sequence Number=SeqID_111339
MSGFTRNSPQISASPHQLDLAPYASGPYNAQWNAPGLLRDKHTLRSSRILGEMEVDEPWLGLWLPLNYQVDMGSSLAYDNGIWGEPYRLFAAKFLFVGIAFVDNWAVGKEKEWQSQHGLLPHSHPLHLP

SEQ ID NO: 228118 - protein, 137 aa, Glycine max
  Coding DNA Sequence Number=SeqID_111340
LKNLRIARHGKFGENSARSSVLAWVYRPTKPRPNDFELVQPSRPNSIQARLIPLVQPNSAEGSSANTAEFSACRTFLDGSANMIQVRPTPIQLCYAQASQALQVQPNFTQHVPYSHSWPNQVHPPLPINCLLESLFG

SEQ ID NO: 228119 - protein, 104 aa, Glycine max
  Coding DNA Sequence Number=SeqID_111341
MPRSFQLKEVSPRMWIQVINNYFERHKKYLHYYQLMVQESSSALAVHTIIKIKPSTKHAKSAQTYTMKNKNIKKPKNSLYREQVFSLSKPPNSDSSKQLIGSGG

SEQ ID NO: 228120 - protein, 154 aa, Glycine max
  Coding DNA Sequence Number=SeqID_111342
MGEVEKVQEQMKADTEALKEQMATMMEAMMSIKEIMEVNAAAIATTSTIVEVDLTPPYGLNQIIQPQICAKNKHAFPPYGLPPNYTPPNVAYTPSEDVNNSAPILIESQQPQTDHAHVSQTMGETHEIPHHNLADFEPCLGYATEGQAIGGIPL

SEQ ID NO: 228121 - protein, 84 aa, Glycine max
  Coding DNA Sequence Number=SeqID_111343
MGSVGKTLNISNTFFNRNHKEDEEATKKMNHEEEEDPGRRSVSEWRKKKHEKIEKMLGAQNNNLWFLVNNSCSYDSILFYFGTG

SEQ ID NO: 228122 - protein, 88 aa, Glycine max
  Coding DNA Sequence Number=SeqID_111344
MKPLHLTAMVEDQIINRHGNGARTREACPGHAPILMGKIRVDQGRGRVWVFPDNQSWVRDRDFLSMSGAGRGGVGRGKPDPVEGRDRG

SEQ ID NO: 228123 - protein, 49 aa, Glycine max
  Coding DNA Sequence Number=SeqID_111345
MEIQDPDFHMDHEPYGFFTNEYSSRSSCWEDSTDSAIYGFQASLDCKLK

SEQ ID NO: 228124 - protein, 211 aa, Glycine max
  Coding DNA Sequence Number=SeqID_111346
  Gene Ontology: Mol. function=helicase activity; Biological process =viral genome replication
  Homolog annotation: Hit_ID=Q1SRJ5; Match level="QueryCoverage=89%, HitCoverage=24%, E-value=3e-43, Identity=44%"; Hit description =Probable helicase [imported]-Arabidopsis thaliana-related
MFQPYTVLDADGFPVYRRRNNGNAIEKNGVIIDNRYIVPYNPRFIRKYQAHINIEWCNQSTSIKYLFKYINKGYDRVIAILIDEDNDQTENGDTHNDEIKEYLDYRKPAVERLHFHLPGQHSDLYEDHDDIDDELSKPSISDSKFISWMNTNQNSVEGRNLTYAELVSKFVYHQKKICWPLRKKGYTIGRLLWGSTNYRGIILFENDAYCL

SEQ ID NO: 228125 - protein, 862 aa, Glycine max
  Coding DNA Sequence Number=SeqID_111347
  Gene Ontology: Mol. function=zinc ion binding; Biological process =metabolic process
  Homolog annotation: Hit_ID=Q6ZA58; Match level="QueryCoverage=56%, HitCoverage=29%, E-value=1e-80, Identity=38%"; Hit description=PHD finger transcription factor-like
  Pfam annotation: Domain name=PHD; Domain location=720-763; Score =61.2; E_value=3.4e-15; Accession=PF00628.19; Description=PHD-finger
  Subcellular localization annotation: CTP_CleavageSite=86; ConfidenceScore=5.15e-01
MESGVGSGGSGVVVKSRNSSGCLIVRKKGDGLGATASTSRKLYESKKRPNINVPVSSSDSGSSDELLMPPGRRLGPETIRVCNGLVASERVGSEISRKRDRVGRISGSGEGIGAEKGLEQWERKRSKLDVYDFDEYDGMDVENMRRRHLDGPGGGRFMGSVHAATSGIDRDFRTGSSGRVLDKRKNSYADRPSCFYPEDYVCNSRFKMNNDGAQVPPPSQREKFNSDESIRVQGKNGVLKVMVNKKKVGGTSEQYYDHHKPLESRQRLKTEETAKRLKTEETAKRLKTEGTAKRNIPILKKNEKKPVDKPALLKRPEKKRTASRKSLSSKDSKGDEGDSDNSDTSLNPRIRNTEARKSVKKIISEDEQTPVREKTPTTRTKEGKIKRGSGTEKQKLREQIREMLLNSGWTIDYRPRRNRDYLDAVYINPAGTAYWSIIKAYDALQKQSNDDADEVKPKGDSSSFAPIADEVLSQLTRKTRKKMEKELKKKKKRHDSESDNEKEPQIRRSASHKRDMNSMDSDSNEEKLSSFIKQGNRSMKNKMFENTSISARSKIQNATHQSSDGIEKPLFGCDPHIHGRKSKKHGRCTLLVRSSNKGSNSESDGFVPYMGKRTVLAWLIDSGTVELSQKVQYRRRKKVMLEGWITRDGIHCGCCSKILTVSKFELHAGSKLPQPYQNIYLESGVSLLQCQIDAWNRQEHAEKIGFHSVDIDGNDPNDDTCGICGDGGDLICCDGCPSTFHQSCLDIQMLPPGEWHCPNCTCKFCGIASETSDKDDASVNVLRTCILCEKKYHDSCTKEMDTLPNNINSSSLSFCGKECKELSEYLKKYLGTKHELEAGFSWCLIHRSDEDSEAACRGLTQR

SEQ ID NO: 228126 - protein, 75 aa, Glycine max
  Coding DNA Sequence Number=SeqID_111348
MRFLNMLKRCFKVVPELALRVFNWLKLKDGYSHTMQTYNTVLHIAGKAKEFGLVKKLVEEMSMESKMMLTHGPFL

SEQ ID NO: 228127 - protein, 73 aa, Glycine max
  Coding DNA Sequence Number=SeqID_111349
MTILRRFEPPLQWNVVVLNKGINDKYATLPWYKFLQEGDFSHGDELSFYYRRAEKIWEVVIRRAIDWDDSDID

SEQ ID NO: 228128 - protein, 74 aa, Glycine max
  Coding DNA Sequence Number=SeqID_111350
  Homolog annotation: Hit_ID=Q1S175; Match level="QueryCoverage=96%, HitCoverage=20%, E-value=5e-24, Identity=70%"; Hit description=MtN19- related
DGRTLCTSTPKYGIGKEAGNEKGYLIGMSVCYPQPGSIKIHDGEILTLESRYKNEFRTGAMEHFYIYLAEELPQ

SEQ ID NO: 228129 - protein, 86 aa, Glycine max
  Coding DNA Sequence Number=SeqID_111351
  Homolog annotation: Hit_ID=Q1SY67; Match level="QueryCoverage=75%, HitCoverage=7%, E-value=3e-11, Identity=45%"; Hit description =Peptidase aspartic, active site
MSVALSGRSLSQQIGLARSKQAEDEEDEDWGLPLELKRMVEQEDKEVKPHQEETKIVNLGVGEERKEVKVGTGMSMNIRDELVALL

SEQ ID NO: 228130 - protein, 68 aa, Glycine max
  Coding DNA Sequence Number=SeqID_111352
  Homolog annotation: Hit_ID=Q1SDE2; Match level="QueryCoverage=65%, HitCoverage=6%, E-value=1e-12, Identity=68%"; Hit description =Protein kinase; Curculin-like (Mannose-binding) lectin
MDTLRFLEGKIQAKSIMLLGFCIESSHRILVYELMPKGTLSSFLFGEGEKPQWGHRVEISCWSRKRKK

SEQ ID NO: 228131 - protein, 326 aa, Glycine max
  Coding DNA Sequence Number=SeqID_111353
  Gene Ontology: Mol. function=DNA binding; Cellular component=beta -galactosidase complex; Biological process=DNA integration
  Homolog annotation: Hit_ID=Q1SD84; Match level="QueryCoverage=95%, HitCoverage=25%, E-value=3e-74, Identity=42%"; Hit description =Integrase, catalytic region
NIEEALDDPNWKLAVLEELDALRKNVFMSLPPGFEEELGRNKVCRLKKSLYRLKQSPKAWFGTVVIELGDDSLELKGLKEKLAKAFEIKELGPLKYFLRIEFARSKEGIFMNQRKYILDLLKETGLLGCKAAETPMEPNIKLQPAKTEDMVDKGSQFMHTPRPEHLKAAFRILRYLKGSPGKGLLYKHRGHLQVEAYTDADCKKQSVVARSNEEDEFRAVAHGICEVLWVEKILQEFKVFNSPPIKLYCDNKSAISIAHNLVLHDRTKQVEVDKHFIKEKIERGQICITHVPTADQSADILKKGLPKKLFNNITSKLSKKDISKLA

SEQ ID NO: 228132 - protein, 78 aa, Glycine max
  Coding DNA Sequence Number=SeqID_111354
MELREKHHWELENLTLTTQPLKTLKFFTLAVIQYIKKTAIYLLAKGGWVMLFSVAVGTLGIVLMTLGCLHEKVFVFSQ

SEQ ID NO: 228133 - protein, 55 aa, Glycine max
  Coding DNA Sequence Number=SeqID_111355
MVARGAVVITQESDIGGSTDEHTNLTSSQLPIVLDKEFQLVNFEDSNSDNASSQT

SEQ ID NO: 228134 - protein, 183 aa, Glycine max
  Coding DNA Sequence Number=SeqID_111356
  Gene Ontology: Mol. function=electron carrier activity; Cellular component=anchored to membrane; Biological process=electron transport
  Homolog annotation: Hit_ID=Q1SDF8; Match level="QueryCoverage=71%, HitCoverage=73%, E-value=2e-57, Identity=76%"; Hit description=Blue (Type 1) copper domain
  Pfam annotation: Domain name=Cu_bind_like; Domain location=32-115; Score=147.3; E_value=4.2e-41; Accession=PF02298.8; Description =Plastocyanin-like domain
MAFIEKAVVFLMMTAFQVSNSAVHKVGDSAGWTIIGNIDYKKWAATKNFQVGDTIIFEYNAKFHNVMRVTHGMYKSCNASSPLTRMSTGNDTIKITNYGHHLFLCGVPGHCQAGQKVDINVVKKVSAEAPTPSPISAMASPVPPAPSPNNGAPFIVVKGALIMPLLALALSSYASLGISLLVN

SEQ ID NO: 228135 - protein, 545 aa, Glycine max
  Coding DNA Sequence Number=SeqID_111357
  Gene Ontology: Mol. function=sugar porter activity; Cellular component=integral to membrane; Biological process=carbohydrate transport
  Homolog annotation: Hit_ID=Q1SDF6; Match level="QueryCoverage=97%, HitCoverage=97%, E-value=0.0, Identity=82%"; Hit description=Sugar transporter superfamily; Major facilitator superfamily MFS_1
  Pfam annotation: Domain name=MFS_1; Domain location=21-472; Score =84.5; E_value=3.3e-22; Accession=PF07690.6; Description=Major Facilitator Superfamily
  Pfam annotation: Domain name=Sugar_tr; Domain location=26-511; Score =523.2; E_value=2.9e-154; Accession=PF00083.14; Description=Sugar (and other) transporter
  Pfam module annotation: Pfam domain module=MFS_1::Sugar_tr; Domain location=21-472::26-511
MAVGGFTNAAGGADFEAKITPIVIISCIMAATGGLMFGYDVGVSEAQSILIFLDEDHDSCGANMGIPRGVTSMPPFLKKFFPTVYRKTVEEKGLDSNYCKYDNQGLQLFTSSLYLAGLTSTFFASYTTRRLGRRLTMLIAGFFFIGGVVLNAAAQDLAMLIVGRILLGCGVGFANQAVPVFLSEIAPSRIRGALNILFQLNVTIGILFANLVNYGTNKIKGGWGWRLSLGLAGIPAVLLTLGALFVVDTPNSLIERGRLEEGKTVLKKIRGTDNIELEFQELVEASRVAKEVKHPFRNLLKRRNRPQLVISIALQIFQQFTGINAIMFYAPVLFNTLGFKNDASLYSAVITGAVNVLSTVVSIYSVDKLGRRMLLLEAGVQMFLSQVVIAIILGIKVTDHSDDLSKGIAILVVVMVCTFVSSFAWSWGPLGWLIPSETFPLETRSAGQSVTVCVNLLFTFVIAQAFLSMLCHFKFGIFLFFSGWVLVMSVFVLFLLPETKNVPIEEMTERVWKQHWFWKRFIDDAADEKVANVSNGNGFDPTSRL

SEQ ID NO: 228136 - protein, 696 aa, Glycine max
  Coding DNA Sequence Number=SeqID_111358
  Gene Ontology: Mol. function=voltage-gated chloride channel activity; Cellular component=integral to membrane; Biological process=chloride transport
  Homolog annotation: Hit_ID=P92943; Match level="QueryCoverage=95%, HitCoverage=86%, E-value=0.0, Identity=71%"; Hit description =Chloride channel protein CLC-d
  Pfam annotation: Domain name=CBS; Domain location=517-658; Score =19.3; E_value=0.0012; Accession=PF00571.18; Description=CBS domain
  Pfam annotation: Domain name=Voltage_CLC; Domain location=47-485; Score=622.8; E_value=3e-184; Accession=PF00654.10; Description =Voltage gated chloride channel
  Pfam module annotation: Pfam domain module=CBS::Voltage_CLC; Domain location=517-658::47-485
MSDARGTGLAAVVINIAVENFAGWKFSVTFNIIQKSYIAGFVVYVLINLALVFSSVYIITQFAPAAAGSGIPEIKGYLNGVDIHGILLFRTLIGKIFGSIGSVGGGLALGKEGPLVHTGACIASLLGQPEISDWTSPTRLAQFQLESSEQVTCGCAAGVAAAFRAPVGGVLFALEEVTSWWRSQLMWRVFFTSAVVAVVVRAAMGWCKSGKCGHFGSGGFIIWDISELRSKLLPFSLGQEDYSFAELFPMAIIGVIGGLLGSLFNQLTLYITTWRRNHLHKKGSRVKIIEACLVSILTSAISFGLPLLRKCSPCPDSDLASGIECPRPPGMYGNYVNFFCSKDKEYNDLATIFFNTQDDAIRNLFSAKTINEYSSQSLLTFLVMFYALAVITFGTAVPAGQFVPGIMIGSTYGRLVGMFVVKYYRRLNIEEGTYALLGAASFLGGSMRMTVSLCVIMVEISNNLKFLPLIMLVLLISKAVGDAFNEGIYEEQAQLRGIPLLESRPKYEMRNMTAKEACGSGRVVSFPRVVKVSDVVSILRSNKHNGFPSKVDFQHSPLPSDPRGGGRSIRHDSGEFAKPVSSKGICIDDIHLSSDDLEMYIDLAPFLNPSPYIVPEDMSLTKVYNLFRQLGLRHLFVVPRPSCVVGLITRKDLLIEDKENVNTLELQSTSKVYAFMDIFVRLSLQKKHDFSIIDNF

SEQ ID NO: 228137 - protein, 81 aa, Glycine max
  Coding DNA Sequence Number=SeqID_111359
  Homolog annotation: Hit_ID=P92943; Match level="QueryCoverage=74%, HitCoverage=7%, E-value=2e-11, Identity=58%"; Hit description =Chloride channel protein CLC-d
MLANHFQNGIETARLVWSRIPNSEESQLLDDAVGILKKNDGGCVESLDYEVIENFAYREEQLRNDIVLCFEICRRREGSCM

SEQ ID NO: 228138 - protein, 316 aa, Glycine max
  Coding DNA Sequence Number=SeqID_111360
  Gene Ontology: Biological process=regulation of progression through cell cycle
  Homolog annotation: Hit_ID=Q6EEW1; Match level="QueryCoverage=94%, HitCoverage=97%, E-value=2e-44, Identity=56%"; Hit description =Cyclin T1
MSFGWNLQAPGHDLHGVYWSTCDGNNFNNGNRKRSRISYYHGNSNIHNNYWAEHGVYSNVYHFDYGNHFQCDADPLSLKRRKHSSPICENNQKYYLPSTVQGNIPSSVNFQASPTRSNVDTSVSPICKLDCSIFEDKELVFMSRDEIDRCSPSRKDGIDVLRERHLRYSYCAFLQNLGMWLNLPQTTIGTAMGWFEKYHDRVLEAELLLLTTLNFELNVEHPYTSLTSVLNKLDPSKTVLVNLALNLISKGLQSSLWLQYKPHHIAAGAAYLASMFLKIDLTAYHNIWQEFEATPSILRGTLHPLLPSFPFSPFPC

SEQ ID NO: 228139 - protein, 247 aa, Glycine max
  Coding DNA Sequence Number=SeqID_111361
  Homolog annotation: Hit_ID=UPI00006A2D9E; Match level="QueryCoverage =56%, HitCoverage=76%, E-value=3e-10, Identity=18%"; Hit description =UPI00006A2D9E related cluster
GLHALTFRGLHILTFRGLHVLTIKGLYVLTFRGLHVLTFRGLHVLTFRGLHVLTFRELHVLTFRGLRALTFRGLHALAFKRRHVLDFSGLHAFAYRRLCVLTFNGLHICTLREFKRESITHLLCILGQDFTHAAAKRRVRIMCTNMTTLTQIWMTLLLSNILSSDHNADLPLQKYQLGSHPQRHPVDQEKSNKVLGFPALITGLCQFYRVPVAPSKGETPQQPRHGRQQATGAPPPPLEFTSAHPQK

SEQ ID NO: 228140 - protein, 68 aa, Glycine max
  Coding DNA Sequence Number=SeqID_111362
  Subcellular localization annotation: CTP_CleavageSite=23; ConfidenceScore=5.01e-01
MRLHCHQTSRRPSMTTNRPPLLMAHIDPGIRPNISMCVRGVGPNSLTVPSGVANCLNLPFGGGVKRPR

SEQ ID NO: 228141 - protein, 388 aa, Glycine max
  Coding DNA Sequence Number=SeqID_111363
  Gene Ontology: Mol. function=solute:hydrogen antiporter activity; Cellular component=integral to membrane; Biological process =regulation of pH
  Homolog annotation: Hit_ID=Q4ZU04; Match level="QueryCoverage=67%, HitCoverage=62%, E-value=8e-31, Identity=36%"; Hit description =Sodium/hydrogen exchanger family protein precursor
EAGMNDGSALPLLMLALLLMHPGAFSLELLGGWAARDVVWAIGGGLAIGYLLGRLIGQLATHLRSAHHDVAPNDFLALALIALSYAAAQSVDASGFLATFAAGVGLRRAELRVTKRFPLEDLPEEKRYLPAEVLVNPNQRLKQGGGSPVKSVGLVVGDALDDGGAGHYAGASLESHRHRPGAAAVCGGAAAGGMADHLALRNAVYAADADWLAGDSRHRQYQLYCLCLGAWPAGPAGGTDDGHGADAGGVQHCAARHHGDAATELAALADDTDADAQENIYASQLCHIVSGEQKTGDMQSYTEKMKSQLAASQSPSAMNKPSFNEETAQEVVNGWLELGEEERAKLRHDQQQCEQTDLHHIMRRRLRAGAFSIPATGQDDYTASFSVG

SEQ ID NO: 228142 - protein, 641 aa, Glycine max
  Coding DNA Sequence Number=SeqID_111364
  Gene Ontology: Mol. function=glutathione-disulfide reductase activity; Cellular component=cytoplasm; Biological process =glutathione metabolic process
  Homolog annotation: Hit_ID=Q6DB39; Match level="QueryCoverage=69%, HitCoverage=98%, E-value=0.0, Identity=87%"; Hit description =Putative glutathione reductase
  Pfam annotation: Domain name=DAO; Domain location=82-400; Score= -61.3; E_value=0.072; Accession=PF01266.14; Description=FAD dependent oxidoreductase
  Pfam annotation: Domain name=Pyr_redox; Domain location=245-338; Score=96.2; E_value=1e-25; Accession=PF00070.17; Description =Pyridine nucleotide-disulphide oxidor
  Pfam annotation: Domain name=Pyr_redox_2; Domain location=82-385; Score=236.5; E_value=5.9e-68; Accession=PF07992.4; Description =Pyridine nucleotide-disulphide oxidor
  Pfam annotation: Domain name=Pyr_redox_dim; Domain location=415-526; Score=179.5; E_value=8.1e-51; Accession=PF02852.12; Description =Pyridine nucleotide-disulphide oxidored
  Pfam module annotation: Pfam domain module=DAO::Pyr_redox::Pyr_redox _2::Pyr_redox_dim; Domain location=82-400::245-338::82-385::415-526
MGNKDFFQLAGLKRRSHKLMLRRFATVEQPGLAALRQRQRNGGDVALQAGRARAGTKKCQRRYTLCQFSSNRWTQRMTRHFDYLAIGGGSGGIASINRAAMYGQKCALIEAKELGGTCVNVGCVPKKVMWHAAQIAEAIHLYGPDYGFDTTVNRFDWSTLVKNRSAYIDRIHTSYDNVLGKNQVEVIKGFARFVDAHTVEVNGETITADHILIATGGRPIHPKVPGAEYGIDSDGFFELEALPKRVAVVGAGYIAVELAGVVNALGAETHLFVRQHAPLRSFDPLIVETLVEVMQAEGPTLHTESIPKAVIRNADGSLTLQLENGQQQTVDCLVWAIGREPATDNLNLAVTGVALNDKGYIQVDKFQNTNVKGIYAVGDNTGAVELTPVAVAAGRRLSERLFNNKPDEHLDYSNVPTVVFSHPPIGTVGLTEPQAREQYGDDQVKVYKSSFTAMYTAVTQHRQPCRMKLVCVGPEEKIVGIHGIGNGMDEMLQGFAVALKMGATKKDFDNTVAIHPTAAEDAHTRYDFCFAGPAASVLRCGRRRALHPDSHHGGDAIHHEIPRSERRAGFCRAPRHAVTEAAGDYRPGAVRTHPVKFCQFCRTARRAGDHGEARHVRPPHGSHAGDAVCDGPGQRLLSADS

SEQ ID NO: 228143 - protein, 300 aa, Glycine max
  Coding DNA Sequence Number=SeqID_111365
  Gene Ontology: Mol. function=transcription factor activity; Biological process=regulation of transcription, DNA-dependent
  Homolog annotation: Hit_ID=Q0M2V3; Match level="QueryCoverage=98%, HitCoverage=97%, E-value=8e-79, Identity=50%"; Hit description =Regulatory protein, LysR:LysR, substrate-binding
  Pfam annotation: Domain name=HTH_1; Domain location=6-65; Score=68.7; E_value=1.8e-17; Accession=PF00126.17; Description=Bacterial regulatory helix-turn-helix protein, lysR family
  Pfam annotation: Domain name=LysR_substrate; Domain location=89-297; Score=147.0; E_value=5e-41; Accession=PF03466.10; Description=LysR substrate binding domain
  Pfam module annotation: Pfam domain module=HTH_1::LysR_substrate; Domain location=6-65::89-297
MKRPSWHELQAIKTLGEQRSFRRAAELLGLKRSSLSHLVKTLEHNLGVQLFQRTTRSVSLTDAGEQLLQRLAPLLNQMDEVLHDVSLSRQQQYGTLRISASDVVIGLLLDQVVPEFSARYPGIQLDFSAQGALVDITAAGFDAGIRLIEDVPQDMVAIALGGPLTFVTVASPDYLAVHAPVRQPQDLLQQQCIRHRLPGGKRYRWEYQSAEESLEIDVPGTLTLDNNALMARAAINGSGIAFVPSLYVSEALQQGKLVELLADWRIQSAGIALWFPPNRHQSMALRLFIDALKTRLPHYR

SEQ ID NO: 228144 - protein, 231 aa, Glycine max
  Coding DNA Sequence Number=SeqID_111366
  Gene Ontology: Mol. function=nucleoside:sodium symporter activity; Cellular component=membrane; Biological process=transport
  Homolog annotation: Hit_ID=Q3C4B6; Match level="QueryCoverage=51%, HitCoverage=51%, E-value=4e-09, Identity=28%"; Hit description =Hypothetical protein precursor
MNAFSGPGNILFKHSHWVPAPAAIGVYRFPRHQTHGTNYAAGDYALLTYQNIVLTMKINLAIDECRRDGRFQSGLNHVDIKRWASEQQAVRRGAQRNAQQNAGHGEAEQTRKTAGEPEENADAGQIEGLNQQACRGVDVVRTVLPLFDQTGNHARCQQLRQQLNGAGTLQDAHYRQGKDQHRQRTEREANGVGTRGVDDGDQSRLRVAVLHALVFIAQRDVGKFAGKKMIG

SEQ ID NO: 228145 - protein, 273 aa, Glycine max
  Coding DNA Sequence Number=SeqID_111367
  Gene Ontology: Mol. function=oxidoreductase activity; Cellular component=membrane; Biological process=metabolic process
  Homolog annotation: Hit_ID=Q0M2V4; Match level="QueryCoverage=90%, HitCoverage=90%, E-value=3e-86, Identity=65%"; Hit description=NAD -dependent epimerase/dehydratase:Short-chain dehydrogenase/reductase SDR:Male sterility-like
  Pfam annotation: Domain name=Epimerase; Domain location=4-243; Score=- 41.7; E_value=0.002; Accession=PF01370.11; Description=NAD dependent epimerasedehydratase family
  Pfam annotation: Domain name=KR; Domain location=3-176; Score=-57.6; E_value=0.00051; Accession=PF08659.1; Description=KR domain
  Pfam annotation: Domain name=NAD_binding_4; Domain location=6-227; Score=-102.7; E_value=0.055; Accession=PF07993.2; Description=Male sterility protein
  Pfam annotation: Domain name=adh_short; Domain location=2-166; Score =89.2; E_value=1.2e-23; Accession=PF00106.15; Description=short chain dehydrogenase
  Pfam module annotation: Pfam domain module=Epimerase::KR::NAD_binding_ 4::adh_short; Domain location=4-243::3-176::6-227::2-166
MKTWLITGASSGLGRLMSERLLERGDRVVATVRREQALEDLQQQYGDRLLVMRLDLAETASIAPAIASAFARVGRIDVVVSNAAYGLFGAAEELSDAQIARQIATNLTGSIQLIRAVIPHLRQQGGGRIAQISSEGGQVAYPNFSLYHASKWGIEGFFEAVRQEVASFGIELLLVEPGPTVTNFASGLDIAAPLDAYRDNASGQLRRAIEAGDFAILGDAGKCVAATLATLDQETMPLRLALGSTAYQHIEAALEARLAELRAQRALAFGADA

SEQ ID NO: 228146 - protein, 213 aa, Glycine max
  Coding DNA Sequence Number=SeqID_111368
  Gene Ontology: Mol. function=hydrolase activity; Cellular component =membrane fraction; Biological process=metabolic process
  Homolog annotation: Hit_ID=Q4KDV0; Match level="QueryCoverage=99%, HitCoverage=99%, E-value=2e-93, Identity=78%"; Hit description =Hydrolase, isochorismatase family
  Pfam annotation: Domain name=Isochorismatase; Domain location=7-169; Score=27.6; E_value=3.6e-08; Accession=PF00857.11; Description =Isochorismatase family
MSKLDLLDPQNSTLIFIDHQPQMAFGVANIDRQQLKNNTVALAKAGKIFDVPVIYTSVETESFSGYIWPELLAVHPESKPIERTSMNSWEDAKFVEAVEKTGRKKLIISALWTEVCLTFPALMALKAGYEVYVVTDTSGGTSVDAHERSVQRMVQAGAVPVTWQQVLLEYQRDWSRKETYDAVMDLVREHSGAYGMGVDYAYTMVHKAPQRQG

SEQ ID NO: 228147 - protein, 162 aa, Glycine max
  Coding DNA Sequence Number=SeqID_111369
  Subcellular localization annotation: CTP_CleavageSite=60; ConfidenceScore=5.14e-01
MDSKSILRLMRTLGPSLTSLVQSSWSLLSNALEGISLQLKHSSLSGGSATSNSGSWWPPMVMGGGEEAQHFQLSAIPLPLSATFRAEHNSSSAMPSKVILMMPKNQELSKFQRFKNQISRIKIQESSFKNKDSRIKFQESRFKDNQDQDSRLKIQESREDLI

SEQ ID NO: 228148 - protein, 76 aa, Glycine max
  Coding DNA Sequence Number=SeqID_111370
MKRPMYKKPYPEWVDHMMPLRKGYKTLDFSMFSVQLSEGEYAALATKNMHPRLKKNLVAQEYGDLSQLPSKANRIE

SEQ ID NO: 228149 - protein, 133 aa, Glycine max
  Coding DNA Sequence Number=SeqID_111371
MEDTPVSPALPSCRRVGCDSSRKTLNELRAIVSTPHLTMKLHTLTREIVTVKADQRQSCQCYTESLKVAPYPPIQELAISHPTAVEGTQVMIVDERSQSRALTIYQSILGNEFDIDPLDDTPDRGPKPIEKLV

SEQ ID NO: 228150 - protein, 91 aa, Glycine max
  Coding DNA Sequence Number=SeqID_111372
FFRRFPQINVGGDSVRIPFLEDAPLSLAHQWAKRASTVKRSFNALCVTIESGKASISRSCTKHEISALSTAVVFSQAQCTTGAKLKSTYSR

SEQ ID NO: 228151 - protein, 64 aa, Glycine max
  Coding DNA Sequence Number=SeqID_111373
MTLQLDGTSTASEMNVHDLMRFTSQAQQKEHQPHYVHRNWLDVNNITAHYGRMLELAFVRALTK

SEQ ID NO: 228152 - protein, 135 aa, Glycine max
  Coding DNA Sequence Number=SeqID_111374
  Gene Ontology: Mol. function=protein binding
  Homolog annotation: Hit_ID=A0D9R2; Match level="QueryCoverage=47%, HitCoverage=11%, E-value=5e-07, Identity=40%"; Hit description =Chromosome undetermined scaffold_42, whole genome shotgun sequence
MEKEARDIEIPNIRWEVFEPMMRSNKFCIRVLYESCAVKAFDITLDIAQDLLRAADQYLLEGLKRLCEYTIAQDISLENVSSMYELSEAFNAISLRHTCILFILEHYDKLSGKPGYLSESLNPVFAFSLQYIKDV

SEQ ID NO: 228153 - protein, 543 aa, Glycine max
  Coding DNA Sequence Number=SeqID_111375
  Gene Ontology: Mol. function=nucleic acid binding; Cellular component= SWI/SNF complex; Biological process=establishment and/or maintenance of chromatin architecture
  Homolog annotation: Hit_ID=Q9SFG5; Match level="QueryCoverage=98%, HitCoverage=57%, E-value=1e-162, Identity=70%"; Hit description =Putative transcriptional regulator
  Pfam annotation: Domain name=Helicase_C; Domain location=196-275; Score=101.1; E_value=3.3e-27; Accession=PF00271.21; Description =Helicase conserved C-terminal domain
  Pfam annotation: Domain name=SNF2_N; Domain location=1-229; Score= -35.5; E_value=3.2e-06; Accession=PF00176.13; Description=SNF2 family N-terminal domain
  Pfam module annotation: Pfam domain module=Helicase_C::SNF2_N; Domain location=196-275::1-229
GVTGPHLIVAPKAVLPNWINEFSTWAPSITTILYDGRLDERKAMKEELSGEGKFNVLITHYDLIMRDKAFLKKIHWLYLIVDEGHRLKNHECALARTLDSGYDFLLVQYWCYDDDQSVGSGKSKSLQNLTMQLRKCCNHPYLFVGDYDIHKHKEEIFRASGKFELLDRLLPKLRRAGHRVLLFSQMTRLMDILEIYLRLNDFKFLRLDGSTKTEERGSLLRKFNAPDSAYFMFLLSTRAGGLGLNLQTADTVIIFDSDWNPQMDQQAEDRAHRIGQKKEVRVFVLVSVGSIEEVILERAKQKMGIDAKVIQAGLFNTTSTAQDRREMLQEIMRRGTSSLGTDVPSEREINRLAARSDEEFWLFEKMDEERRQKENYRSRLMEEHELPDWVYSPLNKDDKVKIFDSGSVTGKRKRNEVVYADTLSDLQWMKAVENGQDISKLSVKGKRRDHLPVDNHAQASDDMGTEERLFRSEDTFDVTPASKRLKPEEINSQKHENEDVSVGGLNEHIFSWNTRRKKRSGYLGQGSFSDSRGQNSNGRANWN

SEQ ID NO: 228154 - protein, 286 aa, Glycine max
  Coding DNA Sequence Number=SeqID_111376
  Gene Ontology: Mol. function=nucleic acid binding
  Homolog annotation: Hit_ID=Q60EX7; Match level="QueryCoverage=90%, HitCoverage=26%, E-value=6e-72, Identity=51%"; Hit description =Putative transcriptional regulator
MEEIERRREGCMKGEFDSFGTERKVKAPAMEQAVSLIGALNLVSRNLPLPPDLFDTVSSIYHRSNPLSSEADAPEQDLLADLQNALLEQRPNYASASKLNKTRESRYHTQIRHRLTQLQGLPSSRGEDLQTMCLLELYGLKLAELQRKVQTDVNSEYWLNVKCAYPDRQLFDWSMMRLRRPLYGVGDPFSMDADDQIRKKRDAERLSRLEEQAKNHMETRKRRFFAEILNAVREFQLQIQAFLKRRKQRNDGVQAWHGRQRQRATRAEKLRFQALKADDQEAYMRM

SEQ ID NO: 228155 - protein, 539 aa, Glycine max
  Coding DNA Sequence Number=SeqID_111377
  Gene Ontology: Mol. function=protein serine/threonine phosphatase activity; Cellular component=protein serine/threonine phosphatase complex; Biological process=protein amino acid dephosphorylation
  Homolog annotation: Hit_ID=P46014; Match level="QueryCoverage=93%, HitCoverage=82%, E-value=1e-146, Identity=55%"; Hit description =Kinase-associated protein phosphatase
  Pfam annotation: Domain name=FHA; Domain location=229-305; Score =57.1; E_value=5.8e-14; Accession=PF00498.16; Description=FHA domain
  Pfam annotation: Domain name=PP2C; Domain location=330-538; Score =66.6; E_value=8.3e-17; Accession=PF00481.12; Description=Protein phosphatase 2C
  Pfam module annotation: Pfam domain module=FHA::PP2C; Domain location= 229-305::330-538
MGPMLQTILTVLLLLMLLLIVIFLFFLFKPWRFFFSPRFLSSIKGELERPLFVGDEGDASSFNQCNELPRDYDLEGACYPSEVHFRSPRTHGQGLVHKQRLQTLNMPQPHAGDTLVVDVISDHSSEDLDVGQTLKLPSSHLAQIQKHAPPNFQNDRLEDFVQRDISDQSNFLSPFFYCLAIALCICIVNIMTYPFVRSAGSCLTLEVISGPSRGLRYSVESTNPSRLPLTLGRVSPSDLLMKDSEVSGKHAMINWNLDKMKWELVDMGSLNGTLLNSKPINHQDTGSRNWGNPMNLTNGDIITLGTTSKVMVHITSQTQHHIPFGVGMASDPMAMRRGGKKFTMEDVCYYQWPLPGLDQFGIFGICDGHGGDGAAKSASKLFPEVIASILSDSLKRERVLSLCDASDVLREAFSQTEAHMNNYYEGCTATVLLVWTDGDENFFAQCANVGDSTCIMSVNGKQIKMSEDHKLTNYSERLRIEETGEPLKDEETRLYGINLARMLGDKFLKQQDSRFSSEPYISQVVHIDQASNAFAILAR

SEQ ID NO: 228156 - protein, 278 aa, Glycine max
  Coding DNA Sequence Number=SeqID_111378
MAAIVCQSRLHRLMLASPKPPPQQPFKSCCFWEESNYAKPHYDDEDNYKADDTPTDWSSIQALSSTVTVSNSIYEVKQSSSLLRLSPKSLELCTEKLGNETGSDDITAETGNDDLLSSSSSSSEITREQKSKKVREAARTFPPPLRTIRGSESIRVRPHREDGRLVLQLTKVVPSCFQALRSPGRLRLCFWTNDDIQETQDHVEDNQKEIEKMEQQEQDQSVDDVVENNGRGWEHEQTKGCNSWTVVERPSSSCKEEGDHENNDFLINWGEPRLVTTS

SEQ ID NO: 228157 - protein, 71 aa, Glycine max
  Coding DNA Sequence Number=SeqID_111379
  Homolog annotation: Hit_ID=O80646; Match level="QueryCoverage=36%, HitCoverage=20%, E-value=6e-07, Identity=96%"; Hit description=40S ribosomal protein S15a-3
MMQFGYIVLTTSAGIMDHEEARRKNVGGSNMRSAGSNSGCAERTPQRCSMTNQDEIIDCTNVLKADPEILR

SEQ ID NO: 228158 - protein, 133 aa, Glycine max
  Coding DNA Sequence Number=SeqID_111380
MVSSWLWPRLLVSYSTIGAGLVLGLTISFGSISGFGCWCRVNFRIWLLVSGQFRDLTAGVGSVPRLVIGVGSIPGFEDGMLMLDRLVIEKSKGSLILIMLGTLRFMDDGGIVTRLAFGQTTLEYFLRLFSSYC

SEQ ID NO: 228159 - protein, 189 aa, Glycine max
  Coding DNA Sequence Number=SeqID_111381
MKPNTMVVRAFDGSHREEIGEISLPIKICPISFEKLKFIVDDKLVIIEEDLLVSKPSSTPYIEVSEEALKTLFQGIEIANDIYAKEGKAITQPSGASLMVAKVMLENGHQYGHGLGRHGQDEESGDEKGYFFKVIRLVEQEAKEILTNEEPIDIINLGTKDDKKGDMSGLDVNIVEYNLQLNLECPPVK

SEQ ID NO: 228160 - protein, 75 aa, Glycine max
  Coding DNA Sequence Number=SeqID_111382
  Subcellular localization annotation: CTP_CleavageSite=16; ConfidenceScore=5.03e-01
MSSIGVFTSSTLILLSSSPPSSIILTDGSLCPGKGLFPMLGLSSLKFNHPALIKLYILNFKAVQFFEEWPITPAR

SEQ ID NO: 228161 - protein, 234 aa, Glycine max
  Coding DNA Sequence Number=SeqID_111383
  Gene Ontology: Mol. function=RNA-directed DNA polymerase activity; Cellular component=intracellular; Biological process=RNA-dependent DNA replication
MAKEDKEKTTFSMPWGTFCYKVMLFWLKNIWATYQRVMVTLFHDMMHKEVEVYMDDMIAKSEKVEDHVVHMQKLLEGLRKFKLRLNPAKCIFGIKSGKLLGFIFNQRGIKVDFNKDKDMPLIRIQCHDQLAYYHMVEEESDGKPMYFDIKEYIKSREYPPNASENGKRTLRRLAMSFFPNRDMSLKCKRSLEKFMKGHYVVKKAFSEGALILKNMDGKDLPYPVNSDVMKKYYA

SEQ ID NO: 228162 - protein, 67 aa, Glycine max
  Coding DNA Sequence Number=SeqID_111384
MEEMVRTTWDNVRKKGDKELGKPHVIASLEYKEWRKLRGVPASILAETPCGDSSSHEFVLTIASLTS

SEQ ID NO: 228163 - protein, 122 aa, Glycine max
  Coding DNA Sequence Number=SeqID_111385
MLEAQKEVDHKERVLPIKRKSPSFEAQDSSEEVNLGTNDNPIKTKRFTQQEVCNMLKNWSSALSTPVPTQPEEPKWRPIVPCSFSHPGFSILGLGFTELHSLSFKAGLRHWLNFSKSWERRN

SEQ ID NO: 228164 - protein, 103 aa, Glycine max
  Coding DNA Sequence Number=SeqID_111386
MVPLILDKVVNAIQIVSRFWANMADEGSNKEVPNTHEGVSPNDPDFEGLQWVESIMKILFWNMRGLANSETRFVLKHLYLSNKLDLLFLEEPWTTLDKIPVGY

SEQ ID NO: 228165 - protein, 46 aa, Glycine max
  Coding DNA Sequence Number=SeqID_111387
MVEGLGKGFPWIRRGGRCGIVGARAKEPLRNERGDFDHGFFFTGMS

SEQ ID NO: 228166 - protein, 183 aa, Glycine max
  Coding DNA Sequence Number=SeqID_111388
MDMTNVLKPGQDATSLVGPWYTTMCAPSSEENPLEAREEMKKIGSRKSTSINILLGTFDRSHMDPSMEAKTPKVQWDKKINIWMPPSKLILVNVANLHLRLAEFSRIDEQQLPNDTVKIKEVLIDLTISSIVHENEVPEVSLAMSNATKADKVIPTSSSEPTSKQTKTLLEATVSRLIQLTFV

SEQ ID NO: 228167 - protein, 85 aa, Glycine max
  Coding DNA Sequence Number=SeqID_111389
MVGEGCTKSHNEEGADRTRWSRRRRRVVAGRITTFTGRRGVVAGAVIASGSCMAGKVVFGMLGVEGYKYGSIGFKTLASTVGNQN

SEQ ID NO: 228168 - protein, 169 aa, Glycine max
  Coding DNA Sequence Number=SeqID_111390
  Pfam annotation: Domain name=DUF1723; Domain location=84-133; Score =65.7; E_value=1.5e-16; Accession=PF08330.1; Description=Protein of unknown function (DUF1723)
MFEHKRHVEAQVVDPLKQPAQVEPSKHVKKVEDVEHVDQVQERGEIKLVSHGRKLQLKIILYDQIQDVVKGSSFFPLTTCSYQIIDNGLLSAFVEKWHRETNTFHLPVGEMTITLDDVALLLDTLITGAFYNCEHMDKEAAILVLVELLEVEYKDAFNEQRKLEVDKSV

SEQ ID NO: 228169 - protein, 382 aa, Glycine max
  Coding DNA Sequence Number=SeqID_111391
  Homolog annotation: Hit_ID=Q94D97; Match level="QueryCoverage=99%, HitCoverage=70%, E-value=1e-79, Identity=42%"; Hit description =Nodulin-like protein
  Pfam annotation: Domain name=MFS_1; Domain location=12-375; Score= -25.3; E_value=0.0045; Accession=PF07690.6; Description=Major Facilitator Superfamily
  Pfam annotation: Domain name=Nodulin-like; Domain location=8-253; Score=350.2; E_value=3.4e-102; Accession=PF06813.4; Description =Nodulin-like
  Pfam annotation: Domain name=Sre; Domain location=10-300; Score= -142.1; E_value=0.035; Accession=PF03125.8; Description=C. elegans Sre G protein-coupled chemoreceptor
  Pfam module annotation: Pfam domain module=MFS_1::Nodulin-like::Sre; Domain location=12-375::8-253::10-300
  Subcellular localization annotation: CTP_CleavageSite=63; ConfidenceScore=5.26e-01
MPSSTAFQWLSLVGIIWLQSINGTNTNFPAYSSQLKQLLSISQFQLNNLAFASDAGKIFGFFSGMAAFYLPLWLVLMIGSTLGLIGYGVQYLLITNQISSLSYWHVFLLTVLAGNSICWINTVCYVITIRNFSSDHRQVAVGLTTSYQGLSAKIYTSIVGTVSGQNKAKTFLFLNSFLPLIVSLIAAPVVREIEAVTRPKHMSVGFVVMFVITIATGIYAVMSSLQFVSNKISPLSNLVGVLVFLLFPLLVPLSMKINALVGSWHKNREKQRVYHFTAEESHDIEERIENEVKEGEDSREVNQEVGIGIREEVGVKLMLRRIDFWLYFFVYLFGATLGLVFLNNLGQIAESRGYSGTSSLVSLSSSFGFFGRLMPSIGDYFY

SEQ ID NO: 228170 - protein, 104 aa, Glycine max
  Coding DNA Sequence Number=SeqID_111392
MERLSYDLSTHTDMIIDNEQHKELCQVPCELWSYIGMGLCQQLRLRDTYSPSLSKGCIAIDDRSIVEYGSILCQEETGKETLHSKVSFIYSCIWVKVDFAHCCD

SEQ ID NO: 228171 - protein, 94 aa, Glycine max
  Coding DNA Sequence Number=SeqID_111393
  Gene Ontology: Mol. function=catalytic activity
  Homolog annotation: Hit_ID=Q1SUK8; Match level="QueryCoverage=77%, HitCoverage=50%, E-value=5e-25, Identity=61%"; Hit description =Thioesterase superfamily
MAGYCALLLCLYFLVLLVPSRHELLQNIGINCDAVARSGDALALSELSLKFLAPLRPILEAKAIAVWLDKNYRPIRIPAEMKSKFVKFIRIEDS

SEQ ID NO: 228172 - protein, 108 aa, Glycine max
  Coding DNA Sequence Number=SeqID_111394
MACRFHYPETIKVPIPIQRKTISMVYEDDDGRPFLIVFENVAVPFAIQRQASLIACTKAFADAPDVFYALSFDREVASCGSYLARLGELDGNDLPHFCYKMAFGAEGK

SEQ ID NO: 228173 - protein, 170 aa, Glycine max
  Coding DNA Sequence Number=SeqID_111395
MVTTPMLPIMEINNWDKHSPCLKMPVVGVAKEGNPMNGENILHQELDDHAMIVAMQKEMNMLKTEEANTTWRERTPSITQPTPRATNAKNRLYPFIDVFPKTLKDATLHWYTRLPRNSIDSFVMLIAYFGAQYMISRPHHLIVVAFANIKQEEDELLDFMKRFSLVLVRI

SEQ ID NO: 228174 - protein, 131 aa, Glycine max
  Coding DNA Sequence Number=SeqID_111396
  Homolog annotation: Hit_ID=Q1SL15; Match level="QueryCoverage=56%, HitCoverage=7%, E-value=7e-11, Identity=41%"; Hit description =Ovarian tumour, otubain
MDEDQWMYDNTMSEEVNMDYENEQECGVNESHVDCSDAFNTSQARSVAHENRFVAVIMRKKEFVRRDTGSRKCGCLFKLCGKLVIRGEGWMVKLICGIHNHELAKSLVGHPYVGRLTKSEKNIIADMTKSM

SEQ ID NO: 228175 - protein, 75 aa, Glycine max
  Coding DNA Sequence Number=SeqID_111397
MSTIDELLDELGDVCEKGRYNKQKGTEIKKKRRKSEEAQVQQGAKRRTRARRDMALSARLRAQRDYEGPSPSLHL

SEQ ID NO: 228176 - protein, 300 aa, Glycine max
  Coding DNA Sequence Number=SeqID_111398
  Gene Ontology: Mol. function=DNA binding; Cellular component=nucleus
  Homolog annotation: Hit_ID=Q9SNV4; Match level="QueryCoverage=62%, HitCoverage=91%, E-value=1e-18, Identity=34%"; Hit description =Squamosa promoter binding protein-homologue 4
  Pfam annotation: Domain name=SBP; Domain location=74-145; Score=35.2; E_value=2.2e-07; Accession=PF03110.5; Description=SBP domain
  Subcellular localization annotation: CTP_CleavageSite=60; ConfidenceScore=5.37e-01
MGSASVTKAPPSSSSSPNSSSTESLDGLKFGQKIYFEEVSVAAAAATTTQGGNKTRGGVSASKKGRGGSVQAPRCQVAGCKVDLSGAKAYYSRHKVCAMHSKSPTVTVADNNGRDDGFLMEFASYPKLTLRNTLPTQRSTEPAPGNHAATLTWQGGSDTPSEFFLQGSGSSGGTSFLSSKHPLVESYTGVTDSNCALSLLSSQTWGSRNTAPATSFELNNNLFNFNGTSMTQFAVASLQAAAIHQLPNATSWLYLKGVDSGNCSPERVPNHGLAQISPPLHSHVHSELDVSQQGRRHYMI

SEQ ID NO: 228177 - protein, 83 aa, Glycine max
  Coding DNA Sequence Number=SeqID_111399
MTPTHDELLYYNGRWNMSHQNNFVGYAFTGKNPKKFEIPLGFTIDELKDLIKQVVPEGIPPHGIQASQMVMEIEDDMPTSLQD

SEQ ID NO: 228178 - protein, 586 aa, Glycine max
  Coding DNA Sequence Number=SeqID_111400
  Gene Ontology: Mol. function=RNA-directed DNA polymerase activity; Cellular component=chromatin; Biological process=chromatin assembly or disassembly
  Pfam annotation: Domain name=zf-H2C2; Domain location=460-501; Score =19.6; E_value=0.00088; Accession=PF09337.1; Description=His(2) -Cys(2) zinc finger
MNLAQRNPNIKRISPAEMQLSREKGLCYWGDDQFSLTHKCPNRQIMMLQFDDPEEDTQPELEKTQLDMTYPEPDLATNDHYLSLNAMKGTDSMGILRFTGQIGQIHVQVLVDGGNFLQPRIAEFLKLPMEPYPCFKFLVGNGQSMTSEGVIPNLSITLQGHELTFHTEDDVLKDLPQHIAPKIALLLHTYSSMFQTPTSLPPPRSQNHAIPFLEGMQPVKVKSYRYPHSQKEQIEKMVHEMLDQVFFDDILIYNSTWPEHLTHLKNVLRVLQQHVLFVKLSKCSFGVLEIEYLGHIVSGQGVSMDSSKVHAIHEWPPPTNVTQLRGFLGLTGYYRHFIKAYAKIVAPLTELLKKDGYLWIEETETAFLRLKEAMMTTPVLGLPNFQQPFILETNASGIGIECKPRKDNLAADALSRVMSLSWSEPEHSIVRKLKEALQRDPKIVVPKDVDLIQQLLQEFHSSPIGGHFGLTRTLARVTQQFHWPDLKHDVQQFVQSCAICQQAKTLHTKPTGLLQPLPIPSQVWEDITMDFITGLPNSYGFHTILVVVDCLSKYGHFIALKGDYTSRVPHWPCPQPTILNSMANQK

SEQ ID NO: 228179 - protein, 706 aa, Glycine max
  Coding DNA Sequence Number=SeqID_111401
  Gene Ontology: Mol. function=nucleic acid binding; Cellular component= oxygen evolving complex; Biological process=DNA integration
MAGSLSKITPDMSKIEPLDGSNYRRWSQKLLILFEALEVDYVLFEDPPADVNASESSTPETPATPVVTPLPAETKKAGKEAKKKYEKDNKTARGHLLTHMADNLFDLFINQKSAKTIWNTLLKRYGDDDAGRKKYVAGNWLRFQMMDDKPIMEQIHEYENLVGDILNEGMKMCHKAYECKLRKGQQSNNSKPAAPHAPQAHLAENEEVIVVVVVEANMVDNKVDWILDTGASKHLCANKELFHQIEDADDGECVFMGNSATSGVLGKGKILLKLTSGKTLSLSDILVPHKRLDKTPYELWKGFAPNLNFLKVWGCLAKVALPDFKRTNVVPLHLHTSSSVTNEQVNEPRRSKRKRIESSFGPDFVTAFVVENNDVDKINDVFVSTFLIEEDPKTYNEVVTSIDANFWKEEINSELDSIMYNHTWDLVDLPKGSKPIRCKWIFRKKLRTDGTIDKFKARLVVVGYTQKKEIDYFDTYSPVTKISAIRSLVALAAIHGLIVYQMDVKTAFLNGDLREEIYVEQPEGYVIQGQENKVCKLRKSLYGLKQAPKQWYEKFDQTLSHYIEKILKKKINCYDELPVRTPYDPSIHLKKNNGSSVSRTEYAKIIGSVMFLMNCTRPDIAYAVSRLSRYTHNPGNEHWTALRRLLGYLKGTMDWCLHFYKFPAVLEGFCDANWVTDNDEWRCHIMEVFQENLYSTFNYGIRIYCS

SEQ ID NO: 228180 - protein, 330 aa, Glycine max
  Coding DNA Sequence Number=SeqID_111402
  Gene Ontology: Mol. function=DNA binding
  Homolog annotation: Hit_ID=Q1S0F5; Match level="QueryCoverage=60%, HitCoverage=38%, E-value=4e-17, Identity=33%"; Hit description=IMP dehydrogenase/GMP reductase
MTDRRKEAIPFFWVLSFDGENSRGDQDLGMRIRLSEAKLVDLAAIDTFLAYHHSKESPVIAVLADAYDTFDLRCEKSSARIVYCTPAFYVWLVSHVFNHESRSVCPLQGHRICVEKDKANWEELLAGMTRASISWFPWWKEGGEGVLCSCEGFPNVPWMGTRGCINYNPMLAIRQLGYPMRGAPSEETIAPFITRGFNEANVKTLQRIYKEWNKAERKDKELSGSSQGVIGSYHKWLKSRTQGITWLPKLKSLSGEEAEMLEESEDVQALKAELENTRVEKKKLKVAITRVRKECDELKDINMTIVEALERETKKAQKEEWSRNKFRGAL

SEQ ID NO: 228181 - protein, 81 aa, Glycine max
  Coding DNA Sequence Number=SeqID_111403
MEELGDFEEFEFDTIEDEVLVELNQVEDLRLLIIVTLLLLNIDENPKTNQIQGPPGVGPGNPYGIYLDLSSLSGSGIIQTS

SEQ ID NO: 228182 - protein, 101 aa, Glycine max
  Coding DNA Sequence Number=SeqID_111404
MDNFSSRLDTDIHEASKDTGPPLIHLLPTYIRYGINMGANHTCNNVMVYQRKVVANTTKKTIFNDVQSITVLLTRCRLVSGGSPVIIAKMTTTFMEDRLYR

SEQ ID NO: 228183 - protein, 124 aa, Glycine max
  Coding DNA Sequence Number=SeqID_111405
MQINPVKFGRVEAQNYMGEKKQLPYVKESKWRVNAHERRQWRCQGNTAARQGSVTYGGGDSLQGRVNAQKRLATTEYELRFRAHPMHVTIKCLNNDDPLEKPPLKLTNQFMRLPLCARLVHVTV

SEQ ID NO: 228184 - protein, 101 aa, Glycine max
  Coding DNA Sequence Number=SeqID_111406
METVLLEDDNAAEALLSFISESGSQILVLGSDSSNFITRKLKGPGIPTTILRCAPDSCDVYIVARDKIISKLADFSSSHSYGMIEDLAFQDFDVCTYALIV

SEQ ID NO: 228185 - protein, 335 aa, Glycine max
  Coding DNA Sequence Number=SeqID_111407
  Gene Ontology: Mol. function=oxidoreductase activity, acting on the CH-OH group of donors, NAD or NADP as acceptor; Biological process =electron transport
  Homolog annotation: Hit_ID=Q8L8N1; Match level="QueryCoverage=88%, HitCoverage=75%, E-value=1e-119, Identity=63%"; Hit description=UDP -glucose dehydrogenase, putative
  Pfam annotation: Domain name=UDPG_MGDP_dh; Domain location=130-187; Score=26.1; E_value=3.9e-07; Accession=PF00984.10; Description=UDP -glucoseGDP-mannose dehydrogenase family, central domain
  Pfam annotation: Domain name=UDPG_MGDP_dh_C; Domain location=209-307; Score=80.4; E_value=5.5e-21; Accession=PF03720.5; Description=UDP -glucoseGDP-mannose dehydrogenase family, UDP binding domain
  Pfam annotation: Domain name=UDPG_MGDP_dh_N; Domain location=1-121; Score=-13.0; E_value=7.7e-08; Accession=PF03721.5; Description=UDP -glucoseGDP-mannose dehydrogenase family, NAD binding domain
  Pfam module annotation: Pfam domain module=UDPG_MGDP_dh::UDPG_MGDP_dh_ C::UDPG_MGDP_dh_N; Domain location=130-187::209-307::1-121
MKKKIQKTAEMILKLSASIHLISLLLHNVSRSVESWFKLKIVVEKSTVPVRTAEAIEKILCHNTNSKGIKYQILSNPEFLSEGTAIQDFLNPDRVLIGGSQCPEGLEAIQKLKAIYAHWVPEDRMITTNLWSAELSKLADNAFLAQRISSINAMSAFCEATGPKFHNNGLTEVANYWKQVIKVNDYQKSRFVKRVVTSMFNTVSGKKIAILGFAFKKHTSDTRKTPAIDVCKGLLGDNTCLSIYDPCVTEEQIQKDLSMDGVEWDQQPMSSTTQKKWDEFKNIDYQSVYDNMHKPAFVFDGRNILNVDKLREIGFIVYSIGRPLEQWLKNMPQQA

SEQ ID NO: 228186 - protein, 215 aa, Glycine max
  Coding DNA Sequence Number=SeqID_111408
  Gene Ontology: Mol. function=transporter activity; Cellular component= outer membrane-bounded periplasmic space; Biological process=transport
  Homolog annotation: Hit_ID=Q4K8F4; Match level="QueryCoverage=86%, HitCoverage=52%, E-value=3e-76, Identity=73%"; Hit description=ABC transporter, periplasmic substrate-binding protein
MKAFISSVVASAVLLALPAAQAADNDVAALEKAARAEGQVNSVGMPDTWANWKDTWNDLSTKYGLKHSDTDMSSAQELAKFAAEQDNASADIGDVGAAFGPIAVAKGVAQPYKPTHWDQIPAWAKDADGNWMLAYTGTIAFLIDKQQVKDAPHSWADLKKGKYVVTIGDVGTAAQAANGVLAASYALGGDEKNIKPALAFFGELAKPGRLGVTDP

SEQ ID NO: 228187 - protein, 156 aa, Glycine max
  Coding DNA Sequence Number=SeqID_111409
  Homolog annotation: Hit_ID=Q1RYJ7; Match level="QueryCoverage=44%, HitCoverage=6%, E-value=2e-18, Identity=56%"; Hit description =Timeless protein; Timeless C-terminal
MVITCFESVRREKVLLDENAKLTENGRLSEKIEAVANYQGDSYMGKPVRINCQKAILVMKCSALFSRPLSTSPNQLDGDKITGATNHKSVNLEGSLLVPHLFKDHRRCSYMIANALDKDGKFTTVQVSRKLKQLGLYLPLPKDGKFTTAQGVLLLN

SEQ ID NO: 228188 - protein, 142 aa, Glycine max
  Coding DNA Sequence Number=SeqID_111410
MGIDHSLTSSKQNIWGERKCVVSPSFGILSQSSGTQAEQKWAGSNWIQWEVNRIPQIEKVEVDFGFLIGSDLRMNYNVLKSENSELGNNEAEIPIEALVGLKEFDGHEGLHSEFNGDDVFMLEESLLITHRSKCVVSKKDEY

SEQ ID NO: 228189 - protein, 176 aa, Glycine max
  Coding DNA Sequence Number=SeqID_111411
  Homolog annotation: Hit_ID=Q19VG4; Match level="QueryCoverage=44%, HitCoverage=22%, E-value=9e-16, Identity=48%"; Hit description =Serine/threonine kinase protein
  Subcellular localization annotation: CTP_CleavageSite=30; ConfidenceScore=5.22e-01
MKHGASQAALSSNKPFWKQQKHSMQNNQSRQNEEGRISKQKHTKNTLKLKFRGTENVQNGNGKFQFGSPHPLVTFGDMLRKTACPRVLITEVYAATNHLNEMNIIGKGTLGKVYKGTMTNNLNVAIKHIINDDGNVDTFVREITSLSHVRHPNISSCKQSQFTWCQLKVELNKEYA

SEQ ID NO: 228190 - protein, 198 aa, Glycine max
  Coding DNA Sequence Number=SeqID_111412
MVSPQGRNTCTIDDLVPYVEKLAILSQEQERITEPVAHGPASERRFPPQQFHMIQSSVETRGFDRRREIVQAEDFSQQMEQRGHGMYYMPPTFSQYPSQMYQYPFEGHDTDMSASEYSFGGVAETHPHFSWPTMTPSQQHDALMATPNAPLASQWDVPGAIPDMGDLLGVDLRHEFSTEAEQQGQRQRARRNQDRLAR

SEQ ID NO: 228191 - protein, 232 aa, Glycine max
  Coding DNA Sequence Number=SeqID_111413
  Gene Ontology: Mol. function=protein binding; Cellular component =integral to membrane; Biological process=xylan catabolic process
  Homolog annotation: Hit_ID=Q1SWI7; Match level="QueryCoverage=98%, HitCoverage=96%, E-value=8e-71, Identity=40%"; Hit description =Leucine-rich repeat
  Pfam annotation: Domain name=LRR_1; Domain location=120-142; Score =15.8; E_value=0.16; Accession=PF00560.23; Description=Leucine Rich Repeat
  Pfam annotation: Domain name=LRR_1; Domain location=144-165; Score =8.5; E_value=7.5; Accession=PF00560.23; Description=Leucine Rich Repeat
  Pfam annotation: Domain name=LRR_1; Domain location=3-25; Score=17.3; E_value=0.057; Accession=PF00560.23; Description=Leucine Rich Repeat
  Pfam annotation: Domain name=LRR_1; Domain location=72-94; Score=8.2; E_value=8.4; Accession=PF00560.23; Description=Leucine Rich Repeat
  Pfam annotation: Domain name=LRR_1; Domain location=96-118; Score =13.2; E_value=0.94; Accession=PF00560.23; Description=Leucine Rich Repeat
  Pfam module annotation: Pfam domain module=LRR_1::LRR_1::LRR_1::LRR _1::LRR_1; Domain location=120-142::144-165::3-25::72-94::96-118
  Subcellular localization annotation: CTP_CleavageSite=26; ConfidenceScore=5.15e-01
MSHLQVLDLAQNNLSGNIPSCFSNLSAMTLMNQSTDPRIYSQGKHGTSMESIVSVLLWLKGRGDEYRNILGLVTSIDLSSNKLFGEIPREITYLNGLNFLNMSHNQLIGHIPQGIGNMRSLQSIDFSRNQLFGEIPPSIANLSFLSMLDLSYNHLKGNIPTGTQLQTFDASSFIGNNLCGPPLPINCSSNGKTHSYEGSDGHGVNWFFVSMTIGFIVGFWIVIAPLLICRSW

SEQ ID NO: 228192 - protein, 462 aa, Glycine max
  Coding DNA Sequence Number=SeqID_111414
  Gene Ontology: Mol. function=arylamine N-acetyltransferase activity; Cellular component=intracellular; Biological process=metabolic process
  Homolog annotation: Hit_ID=Q32IZ4; Match level="QueryCoverage=45%, HitCoverage=100%, E-value=1e-102, Identity=89%"; Hit description =Putative response regulator
AGVWATSMPRQQLMVEGEMHQLDGAVALQLAQDVGAMHVHRFMAERELESDLLYAVAFDQQIEDFTLARGQRFQRRGRLLAAAQRPQRVGAQVMAAHIDGTHRLHQLFRPAAFGQIAAGAGVQRALHEGGGVIDAEDDRAELRLLRPQALQQAEAVFIRHGDVHQRDADVVAQQCRPGRRRAAVLPHHVEIVLEAEQLRKAGAHHHMVIHQYHTDHFSHSVAESWPYDACRRGAGNQPSARGTPLLFRMQRRFVALMIFGHDQLHVAEGHPAVALGEVRLRRGAVEAAHLVELMQLAWLNGKAIQGFGMRTLVAVAAFQQVILAFPLQVEGAAGLRLRLGGDDLQRRQEGIAETDVHQPGLARQIHPQRQMVVGRAEMAVARADLAGDEAHLETDLPQQQSEQRVQLITETAAVALDHLAEQRLRRQLNTLMINNAQVLERDAQHVAMVQLLQRGEVRAGGA

SEQ ID NO: 228193 - protein, 110 aa, Glycine max
  Coding DNA Sequence Number=SeqID_111415
  Gene Ontology: Mol. function=nucleic acid binding; Biological process= DNA integration
  Pfam annotation: Domain name=rve; Domain location=3-110; Score=-1.2; E_value=0.0075; Accession=PF00665.16; Description=Integrase core domain
MDSHGQKYFISFIDDYSRYMYLYLLNNKYEALDAFKVFKAGVEKQCGKQIKIVRSDRGGKFYGKYTENGQAPGPFAKFLQEHDIVAQYTMPGSPNQNSVAGRRNRTLRDM

SEQ ID NO: 228194 - protein, 69 aa, Glycine max
  Coding DNA Sequence Number=SeqID_111416
  Subcellular localization annotation: CTP_CleavageSite=11; ConfidenceScore=5.08e-01
SSRAQRTIWAQCASDAKRNFSALSVTREFGRAQESRPLAKGKISSLSEMFISCQAQRVAGAKPISIYSR

SEQ ID NO: 228195 - protein, 174 aa, Glycine max
  Coding DNA Sequence Number=SeqID_111417
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=98%, HitCoverage=14%, E-value=3e-56, Identity=66%"; Hit description =Tyrosine protein kinase, active site
  Pfam annotation: Domain name=Pkinase_Tyr; Domain location=1-165; Score=-144.2; E_value=0.0013; Accession=PF07714.7; Description =Protein tyrosine kinase
MHHECSPRIVHRDISSKNVLLDSEYVAHVSDFGTAKFLNPDSSNWTSFVGTLDMLLQHFYFVTELAYTMEVNEKCDVYSFGVLAWEILIGKHPGDVISSLLGSSPSTLVASTLDLMALMDKLDQRLPHPTKPIGKEVASIAKIAMACLTESPRSRPTMEQVANELVMSSSSSMD

SEQ ID NO: 228196 - protein, 207 aa, Glycine max
  Coding DNA Sequence Number=SeqID_111418
  Gene Ontology: Mol. function=receptor activity; Cellular component =integral to membrane; Biological process=protein amino acid phosphorylation
  Homolog annotation: Hit_ID=Q9SLS3; Match level="QueryCoverage=60%, HitCoverage=39%, E-value=8e-18, Identity=39%"; Hit description =Elicitor-inducible LRR receptor-like protein EILP
MDPESLFSSRNKKSKWTKLPMEAGIGPVNSFKDKDNTLSFDKFPMVKGMDPENLFPSRSMCMESKLTKLPMEAGIGPVSSLKDIDNTLSFDKFPMVKGMIPERSLSERLRNKSLERLPMVLGMLPKSNLRRSSKCTEVHHKKQQKWLELHGQKRWNYEHHEEILRKDSITDCLIQSNAGEVLTSNSCDMHTYMQNIVNHEPESRDII

SEQ ID NO: 228197 - protein, 129 aa, Glycine max
  Coding DNA Sequence Number=SeqID_111419
  Gene Ontology: Mol. function=nucleic acid binding; Biological process= DNA integration
  Homolog annotation: Hit_ID=Q1SXR1; Match level="QueryCoverage=96%, HitCoverage=11%, E-value=8e-10, Identity=27%"; Hit description =Integrase, catalytic region; Zinc finger, CCHC-type
  Pfam annotation: Domain name=zf-CCHC; Domain location=90-107; Score =22.2; E_value=0.00021; Accession=PF00098.13; Description=Zinc knuckle
MTLIDHIDKIMRSISRNWRPQVIVLRDLKNLDSMSLWKLVATLKKTQTKMSSLSSLAKSILCGETKVVPSGEAPQEEYPETRRKKTKSFIVCNECKKPEHFKSECPDLEKNQDMKKFFSTKEKKGLMST

SEQ ID NO: 228198 - protein, 70 aa, Glycine max
  Coding DNA Sequence Number=SeqID_111420
  Homolog annotation: Hit_ID=Q5CB53; Match level="QueryCoverage=100%, HitCoverage=9%, E-value=1e-22, Identity=75%"; Hit description =Hypothetical protein bTSL
MKPKRMKIISDLLISVSKAERQEARLKVRQDSLRLGNVGVISSIMNCRAGTVISETWEDGQALKDLNAQL

SEQ ID NO: 228199 - protein, 68 aa, Glycine max
  Coding DNA Sequence Number=SeqID_111421
MDSLKQSWYIDSGCSKHMAGDASKFIHISSKNSEYVTYGDNNKEHSTSVLKPMLKVPMLNVSLLTSVL

SEQ ID NO: 228200 - protein, 123 aa, Glycine max; identical to SEQ ID NO: 211307
  Coding DNA Sequence Number=SeqID_111422

SEQ ID NO: 228201 - protein, 178 aa, Glycine max
  Coding DNA Sequence Number=SeqID_111423
MGTNQTGKRFYQVKVKSPDTTSIKELGRLMEPLQMQAFRKTYGKILELTIAEVSIEAIASLTQYYDQPLRIATVVKDSARGLDRIKQTRNGIAGLPQKYLEDKARGMANQGDWVPVYGCVSFANFWGRPLSKRGWFGARRVAHGSSVAYPPFVFGWFHTLFHQDTRHPMSAPKPSLVY

SEQ ID NO: 228202 - protein, 107 aa, Glycine max
  Coding DNA Sequence Number=SeqID_111424
MVVIVPKEHLVVWFCSLHNRPDNYLKGIINSALKGLDDALQSKSKASARWIVVKCNRQKGSTECGYYVMHWMSTIILGSFKNNWEATVRAREIKGAANPVGTILSPS

SEQ ID NO: 228203 - protein, 48 aa, Glycine max
  Coding DNA Sequence Number=SeqID_111425
MRHLARFIFYYVMPMILLSMRLIYELLQILNMNDYMAVMHFKLYLHLN

SEQ ID NO: 228204 - protein, 185 aa, Glycine max
  Coding DNA Sequence Number=SeqID_111426
MVTRSTSRLVNVINEDSDQNSDNTTEAENSNTVPEAIINPINSKQGKTPSKLYYQHPTAPVLLLEERGENNFKSFSANNIYEWNIDAQTEYNIMNTLQHMTMVATTYQTSHECSEETIIDILVARFFGQLKGCTVKTDLNGQVITNDDDQEIPNAVNTLIFTIAQHFIGDPSLWKDRSCRIIIKS

SEQ ID NO: 228205 - protein, 188 aa, Glycine max
  Coding DNA Sequence Number=SeqID_111427
MADYAWSIQTLQALEDMGLTKIPKLAKKTWAEMASESDDDSKTNLFKQIQKTKQTKTYRYGRIENNKQYPSLQRHAFVKWWTQFDTSKVAPDQVNNWFQSHPELLKPADLETSLFFNQKSQLVVFLASSKSKESLAKNLNEVLQMLQQEEEEESSKKEAESSEDFDDQDDDPFYQNEDDCFGISLEED

SEQ ID NO: 228206 - protein, 70 aa, Glycine max
  Coding DNA Sequence Number=SeqID_111428
MVGYTPLSFADMVFADEKIEVGLKRGKSDHPSLMNATTGANKEDENEGETLAMTIILMQSYSQRVLDRRL

SEQ ID NO: 228207 - protein, 74 aa, Glycine max
  Coding DNA Sequence Number=SeqID_111429
MGKEDTVFDGCGISWYKLKDDNKCSSDESTNKGPLMKVLWKEARNLRLGLAIDGMNPFGSLSTNHSSWPIFLVI

SEQ ID NO: 228208 - protein, 239 aa, Glycine max
  Coding DNA Sequence Number=SeqID_111430
  Gene Ontology: Mol. function=transporter activity; Cellular component= integral to membrane; Biological process=transport
  Homolog annotation: Hit_ID=Q8UDH1; Match level="QueryCoverage=70%, HitCoverage=38%, E-value=3e-91, Identity=98%"; Hit description=MFS permease[proline/betaine]
KGKTGGEETTGDADAAEGHVFGNEGPGAGHFTADGGTLQHAQDDEQDGSGHANGGVGRHQCHAQRGKSHQEDRESEDTLAAVTVAIMRQYDTAQRPHQITGGKDAEGLDHHQPIRHLRREEQMADHGREKYENDEVVKFERTAQGRKAERFVILAIEGPGCRRCGGGRHEAASFLNFVLLMGMRQAQRDFKPYAVQSLRRTGEWVAMINCPPRSAAWRMSAASSSCFCIESGLSGSSRK

SEQ ID NO: 228209 - protein, 131 aa, Glycine max
  Coding DNA Sequence Number=SeqID_111431
  Subcellular localization annotation: CTP_CleavageSite=38; ConfidenceScore=5.27e-01
MRRYPSGYPFKLSFAISKTQSMIARRDKHRLLHPLSIAANKPVDTRRFTSSSTQTISVILTLESRDMRRYPSGGGPDDMRLSACSMGDKCTETDSAPFIIQEQRVEWNNKLGGKRAETDSAAFAIQISQIG

SEQ ID NO: 228210 - protein, 285 aa, Glycine max
  Coding DNA Sequence Number=SeqID_111432
  Homolog annotation: Hit_ID=Q9FMD0; Match level="QueryCoverage=98%, HitCoverage=49%, E-value=1e-14, Identity=25%"; Hit description =Genomic DNA, chromosome 5, P1 clone:MUK11
MEDNKESKAGPLFRKLWTKVNQLEHNRIMDLITHPSPVLFDAIKSGNVEAVKMLIDKNPELVTIKDPKNGRNLLHLVVLFRQKRIFISMLWGLEEHIVRAVEVDNEGNNILHLAAHLPVEFQELSSLRASIQMQRELEWFKTCVPRELRRMRNNMGKRPIDVFYEEHKKLSEEIKDAAKGIAEYGMLVSTLVATVAFAAALTVPGDKTNAWFTVFILTNAVALFTSSASLLSFLSNFTSSRFAQSEFVKSLHPSLTFGRALLFISVFAMVVAFTAASFLMFDHKS

SEQ ID NO: 228211 - protein, 75 aa, Glycine max
  Coding DNA Sequence Number=SeqID_111433
TSLKLKDPASIEAPQASFHQVVIRAQELQGNWKRGLVSSLEEFESRSKGPTTLRAIGLRSTPNCVNHQRENNHQN

SEQ ID NO: 228212 - protein, 302 aa, Glycine max
  Coding DNA Sequence Number=SeqID_111434
  Gene Ontology: Mol. function=RNA-directed DNA polymerase activity; Biological process=RNA-dependent DNA replication
ETFKLEKTTGSGFVYLEGIWVGDGEKVEDVPCVGRIFTWYKPNGIVESKLDRILVSAKWFSKWQGSTQFIMYRNFLDRYPIMLRSIIVDWGPKLFWVLDCWFEDKSFRKLEKEGDDKQLNDKESLEWQHSQMNPLRGKRQELDGSRKGVVTLEPSRVKEETRQFFKRRFEEVEWERPRLDGVRFKSIGQQDNDLLVACFEEEEVRAAVLSNGGYGGAMAVWRGGFLIKCHQIAVALRASNGGAMTVAIGLTVVAECTQHATRTSASSLMVSPEVDDGTMHHACEKRTTTVTATAAAIDGDMI

SEQ ID NO: 228213 - protein, 115 aa, Glycine max
  Coding DNA Sequence Number=SeqID_111435
MAYVKAIEVMLRSFGLLFVPFSFLGIPIGAYLRRKDCLGELGDNLSLKGEKGGLGVWDLVKFNYALLEKWHWNLFHHHGELWVQVLDSKYGSWRNLDETRRNNRVSLVTGFKHYL

SEQ ID NO: 228214 - protein, 69 aa, Glycine max
  Coding DNA Sequence Number=SeqID_111436
MMRQEHVDMILEVLSLKYHSVIVIIESKFETQPLEQVEALLLAHEPLALVVVLTMVVASVAVWLRHPLP

SEQ ID NO: 228215 - protein, 84 aa, Glycine max
  Coding DNA Sequence Number=SeqID_111437
MSITLLPYPSRPNNLSLIMHMSLNPWGRYMKYLTSDMPLRGRHLAAYPCQTLYGALSITHNHNPCILCWNDCLLPWWKGRNLII

SEQ ID NO: 228216 - protein, 77 aa, Glycine max
  Coding DNA Sequence Number=SeqID_111438
MVLALFLLIIIGTSWPLKFVTSVPLKHLSGWRGREVNVQRDGLRLSTTCWILYPDDAKAQAVHSTEAMEPDRGAHQD

SEQ ID NO: 228217 - protein, 412 aa, Glycine max
  Coding DNA Sequence Number=SeqID_111439
  Gene Ontology: Mol. function=oxidoreductase activity, acting on single donors with incorporation of molecular oxygen, incorporation of two atoms of oxygen; Biological process=aromatic compound metabolic process
  Homolog annotation: Hit_ID=Q2IT72; Match level="QueryCoverage=94%, HitCoverage=96%, E-value=1e-154, Identity=67%"; Hit description=Ring hydroxylating dioxygenase, Rieske (2Fe-2S) protein
  Pfam annotation: Domain name=Rieske; Domain location=50-150; Score =115.4; E_value=1.6e-31; Accession=PF00355.16; Description=Rieske [2Fe-2S] domain
  Pfam annotation: Domain name=Ring_hydroxyl_A; Domain location=169 -390; Score=-75.1; E_value=0.0033; Accession=PF00848.9; Description =Ring hydroxylating alpha subunit (catalytic domain)
  Pfam module annotation: Pfam domain module=Rieske::Ring_hydroxyl_A; Domain location=50-150::169-390
MSECIPVKNIDTSHTAETLAALVQSDRVHTCLYTSEEIFDLEIDNIFNRTWVWVAHESEIPDAGSYKSSMVGTQPVIVVRDRKGNINVLLNRCRHRAATVCEHRSGKTNGFTCPYHGWGYGLDGALRGVPHPESYGDTLNKSELGMVRLRVESYAGMIFASFNHDIEPLTDFLGPAMKWMDLFMKQGAGYALQATTAHRFRFPGNWKIQLENTTDGYHFPIVHKSFLSSVDKQTEEMLNFVDGKGFVEDLGNGHSVMVMIPELIDLEANLDAPIPERFSELAQALREEGHDEQQVRRIVRAVGGSGFNLNLFPNVACSMAFFRVLQPISMARRSPTRRACGCTNTSRGRWASAPPMIQRPGSGCSAAAARATICGSCSTAACPAKSAPPTACAATSAPKPACAPPINNGKST

SEQ ID NO: 228218 - protein, 239 aa, Glycine max
  Coding DNA Sequence Number=SeqID_111440
  Homolog annotation: Hit_ID=Q1T493; Match level="QueryCoverage=97%, HitCoverage=39%, E-value=2e-08, Identity=21%"; Hit description =Nucleic acid-binding, OB-fold, subgroup
  Pfam annotation: Domain name=Rep_fac-A_C; Domain location=1-122; Score=-50.0; E_value=0.0031; Accession=PF08646.1; Description =Replication factor-A C terminal domain
MDNHSWCYPACAQCHRKTNIQTGPFTCGCGKDNDQPILRYRVEVMVTQNNESENFLLWDRECAELIGQTADGVNRVKIEDDDLDLNASPQALDKLLGHVLAFKVRIQSRFKNLVVLKYSKDLDLINAVLEMLPDSEVFFSDIYFSRCCHDDMIHEFDYHQLIYGADMFQIDPSNVDCNDATHVECQFLSATADHDPVAGLPLTPKKRMSSDEADDELGSSHISSAQLSSNKLTRHSHRS

SEQ ID NO: 228219 - protein, 56 aa, Glycine max
  Coding DNA Sequence Number=SeqID_111441
MAFVDDLVFFVDRVVVNEKGRYWLSNDIVGLVGNLAIPTLILSPAKTKSAKLEGEL

SEQ ID NO: 228220 - protein, 126 aa, Glycine max
  Coding DNA Sequence Number=SeqID_111442
  Gene Ontology: Mol. function=protein binding; Biological process =protein metabolic process
  Homolog annotation: Hit_ID=Q9LU73; Match level="QueryCoverage=86%, HitCoverage=12%, E-value=9e-31, Identity=56%"; Hit description =Arabidopsis thaliana genomic DNA, chromosome 5, P1 clone:MUL3
  Subcellular localization annotation: CTP_CleavageSite=64; ConfidenceScore=5.11e-01
MECKSLSIKAVRHSSVMRSGVCALQQTLTVGAASVLKQSLGLAQRRGHTQLTPLHVVATLLSLRGSSLRRACLKSQPHQTSHHPLQCRALELCFNVALNRLQTTPSPLIHTQPSLSNALIAALKRA

SEQ ID NO: 228221 - protein, 122 aa, Glycine max
  Coding DNA Sequence Number=SeqID_111443
MENLFDRRFRGGHVACDEGERRRDTWQGLRGGESRKRGAVVPRCMCVARISRRRRRERGRGAASRGRDTWRGFEGFEKTKRGGWVFKVMVTLRALGEGEWCVFAVGLVAERDTSGISHVLRW

SEQ ID NO: 228222 - protein, 207 aa, Glycine max
  Coding DNA Sequence Number=SeqID_111444
  Gene Ontology: Mol. function=protein-tyrosine kinase activity; Cellular component=integral to membrane; Biological process=protein amino acid phosphorylation
  Homolog annotation: Hit_ID=O22938; Match level="QueryCoverage=87%, HitCoverage=23%, E-value=1e-61, Identity=58%"; Hit description =Putative receptor-like protein kinase
MGAKYLEVVKRGSHPNKRVYLPNGTLSQLLHESTMLLGYQPDWPARLSIAIGVAKDFKPLIGDIEISEFLDSIKGSTMIIPYVGSSVYVPPEYAYTMRVTEPGNAYSFGVILLEILTTRTSVDEAFGEGLDLVKWVHGAAARGETPEQILDARLSSVSIDWRRQMLAALKVALLCTDCRPAKRPKMMNIVGMLREIRNHKPHEFSVP

SEQ ID NO: 228223 - protein, 113 aa, Glycine max
  Coding DNA Sequence Number=SeqID_111445
MSTRLDVANSKIATIKTVLKSHNQALQEHTTQLGSLLTSVGELIKSVSSLCSEVCDGFHWFPNGASLFSGSTPVGLSISNNHRLHTKHNKLVTFIGNDPVGWIAKAKTYFTIQ

SEQ ID NO: 228224 - protein, 122 aa, Glycine max
  Coding DNA Sequence Number=SeqID_111446
MRLPGKESLLMKSPITINEILDVSISFLNDHLEETLGSTKIEEIHSKCINLAQVYGESRFWLKACRMARHDTCQGLVWFKDKRDAPHYFHDTNAKMMIWKLYAKLVMHAPMWTLKCQIFMVM

SEQ ID NO: 228225 - protein, 112 aa, Glycine max
  Coding DNA Sequence Number=SeqID_111447
MNTQNESEGLSRLVMGLGCQKFMVFLGFKSLDNDKKLKSQDHFMITRMMTFKNEFKIESRTLQGSRGNLISRIKNQESRFKNNQDQDSRLKDSRIKRRLNQDKYLKVFQNIE

SEQ ID NO: 228226 - protein, 41 aa, Glycine max
  Coding DNA Sequence Number=SeqID_111448
MAYPGNPVRKLTLIFQVLTLKKRKHLEELGQCHMRGPKCRL

SEQ ID NO: 228227 - protein, 215 aa, Glycine max
  Coding DNA Sequence Number=SeqID_111449
  Gene Ontology: Mol. function=transporter activity; Cellular component= mitochondrial inner membrane; Biological process=transport
  Homolog annotation: Hit_ID=O49875; Match level="QueryCoverage=56%, HitCoverage=32%, E-value=2e-41, Identity=64%"; Hit description =Adenine nucleotide translocator
  Pfam annotation: Domain name=Mito_carr; Domain location=31-124; Score= 84.1; E_value=4.3e-22; Accession=PF00153.17; Description =Mitochondrial carrier protein
MESNLVYKVTKINPLKKLFNFNKDKDGYWKWFFGNLASGGAAGASSLLFIYCLDYARTGLANDVKKGGERQFNGLVDVYGKTYASDGIAGLYRGFNITCVGVFVYRGLFFGLYDSLRPALLVGNFQLGSFADFSIAFLACCSARRRREGELWKLPILSGLIEGRNKEDFENFGGPHESQFSPLKSKLCEENVIVDDVFTILLVNATIAPQQRWRK

SEQ ID NO: 228228 - protein, 98 aa, Glycine max
  Coding DNA Sequence Number=SeqID_111450
MYAHAIEDLSASCSKHSRQNNDGARVGEEGALGWSTWLDKEEETRPQLMNEELSRENEGGGWTGWSEPWSKDNEGIANVEHETMNDVVMENIQDEEEY

SEQ ID NO: 228229 - protein, 102 aa, Glycine max
  Coding DNA Sequence Number=SeqID_111451
  Gene Ontology: Mol. function=histone-lysine N-methyltransferase activity; Cellular component=nucleus; Biological process=chromatin modification
  Homolog annotation: Hit_ID=Q10P52; Match level="QueryCoverage=97%, HitCoverage=36%, E-value=4e-43, Identity=81%"; Hit description=LOB domain protein 18, putative
  Pfam annotation: Domain name=DUF260; Domain location=16-101; Score =188.3; E_value=1.9e-53; Accession=PF03195.5; Description=Protein of unknown function DUF260
MDCGGNKIGGSDRGGPCGACKFLRRKCVKGCIFAPYFDSDQGTAHFAAVHKVFGASNASKLLMRIPAHKRLDAVVTLCYEALARARDPVYGCVGHLFALQQQ

SEQ ID NO: 228230 - protein, 141 aa, Glycine max
  Coding DNA Sequence Number=SeqID_111452
MSEIEEVQEQMKVNMEAMKEQMTTMMEAMMSMRKIKEDNTATVFAVSTATEMDPIHQENPRGFALPYLRRKLIRPGARGKCPKIDSRPVSSSFSGIDRSLAPIYDLRSGKFHLVIYQSVTIHCHPSMVHAIGPKALYFLVV

SEQ ID NO: 228231 - protein, 106 aa, Glycine max
  Coding DNA Sequence Number=SeqID_111453
  Gene Ontology: Mol. function=RNA-directed DNA polymerase activity; Cellular component=intracellular; Biological process=RNA-dependent DNA replication
MVLASCVVQSLIVNVNSPTVSHSSWDQLIIVVPHNSDSRLPRDHLDRSRIILKEYPMHAYGRIYSKKLQGMWLNGGRQGKVDSWWERNERISDGSLLVGLLWRLDL

SEQ ID NO: 228232 - protein, 133 aa, Glycine max
  Coding DNA Sequence Number=SeqID_111454
MRTLSPMKDKAEDIEVFESARTLSPVEDKGEDFESYGNIKARTLSPMETARTLSPMEDKGEDFESYGNIKVRTLSPMKDKGSLFPNSKDRTMDFGNWHIKRNLCTYSLIWSMSFGMQRHANFVFKCNKCRLCI

SEQ ID NO: 228233 - protein, 75 aa, Glycine max
  Coding DNA Sequence Number=SeqID_111455
MVDVCQTQKQKPQGKGQNGHFLEISRPKLAQANIWLAWAMEKLQPEANNMPRLADTFKLKQPTRLGELMTSSLSN

SEQ ID NO: 228234 - protein, 55 aa, Glycine max
  Coding DNA Sequence Number=SeqID_111456
MYFPFYAGGQGEDLDITCKIKEKGETGCTLRHALWHQKPSFFNSVQKRLPRHVPR

SEQ ID NO: 228235 - protein, 113 aa, Glycine max
  Coding DNA Sequence Number=SeqID_111457
  Homolog annotation: Hit_ID=Q4VPE7; Match level="QueryCoverage=97%, HitCoverage=67%, E-value=2e-26, Identity=64%"; Hit description =Lateral organ boundaries-like 4
MVMNLQAELTYVQARLATMQRLPMQVAPLPHPQSSSPPPTFHSSDHLASNADLQSAPMMHFDPLQPHSASLELSSVVFNQSDQQLEDRELQVLAREFVSKYLPGVRFQQYNSP

SEQ ID NO: 228236 - protein, 625 aa, Glycine max
  Coding DNA Sequence Number=SeqID_111458
  Homolog annotation: Hit_ID=Q10P50; Match level="QueryCoverage=90%, HitCoverage=87%, E-value=1e-156, Identity=53%"; Hit description =Expressed protein
MNNSKKQEEEDEVFLPHPPDLSPPHPPDASFSLLFPSSPSSSHSSPSPSSPPKPLFISPDPHISSQFYTFTPSSHALMLRSLLLRRLPSPSDIRSATPRSVLSSWRTVWKDRNEDTAYLTAWKRIQDKLTTHHDPDSNTHFLCFKNNPHQFVPHVNQWQHIVMSHHSDSDLCHLNLKDTLDRIKHHWTVGAKFYGIPESFIRVCVAACPVCSSATTEGGSSDPSVAARGKRRRFEYTESFDVPAREVPSRLQQLAAKHKVVLCIRQKYIRYKPFMAEVKDYACHRAGEPAAKKSKVLKREPYASKRCGCGFRIRAIVPIANYNEKDKSFVYQEEGVAVFKLYAVHSGHEPGPLDGNARIMHRVVGHKGGGFLMDQENNVYGVSEEMEGEGGFGGLLGKEDGGGDLQFSVMQQVQELRNEVGMLEGKVGKMPREMLGAISRELFEVLNKVRSIGEVGLKPGIELIADKAVAHGVVEDDVLVGDNDLANWSNHHERIYGDGKDTELIEDDEDSFGRTLGEVVSWGDQMTTECRSQKDDLMSDTCKPEKWLKCSDFDEKSILDCEDSKLTKPVRLIRHDEGIVSDVVGLGCMQVDSFYPDNPKWYDSPCALDTGADCGDSAFRHGEIL

SEQ ID NO: 228237 - protein, 104 aa, Glycine max
  Coding DNA Sequence Number=SeqID_111459
  Subcellular localization annotation: CTP_CleavageSite=54; ConfidenceScore=5.55e-01
GINANFTSFSGKKEKNWKVQQLHALSALSARPTSQLSILVLRMPGSLSQSSLTRAKRENGTKRTFEDRKPFLKPKVKNQKEEEESAENREQRHKTEQGSKNLSF

SEQ ID NO: 228238 - protein, 95 aa, Glycine max
  Coding DNA Sequence Number=SeqID_111460
MAGGEDIMRVQICWFKVRMQGIQGETLGVARIENKGSLCYLDGQVLKRNHKCWEILAFDGEFVHFQIDRRIFLFWLEGENYRVPSQKIRYMHIGN

SEQ ID NO: 228239 - protein, 129 aa, Glycine max
  Coding DNA Sequence Number=SeqID_111461
  Gene Ontology: Mol. function=protein disulfide oxidoreductase activity; Biological process=cell redox homeostasis
  Homolog annotation: Hit_ID=Q1RSD5; Match level="QueryCoverage=52%, HitCoverage=43%, E-value=6e-10, Identity=50%"; Hit description =Glutaredoxin active site
MEAVTMTLASDEAIQSLKTIKGSLFLKLKNVAFLRKSFMPKKIYTNVEVRVVVLYDSTIVTFCSHRCHFSSLLGPFVVVSLGIIRALVCQEVLAKEPSPPKVLPNNIVLYQFEACYFCNKVKDLKTVLE

SEQ ID NO: 228240 - protein, 110 aa, Glycine max
  Coding DNA Sequence Number=SeqID_111462
MVMYAMTIGRGNLFLRNPASTNNGLTYPTSTNNDFFMHGVPPLPLAIPHAHHQHIIIHPVHHHPSYHSNFRQSKWRNCCCPIHVDPPFKVARLSYMDPPFRVTRLSCLDP

SEQ ID NO: 228241 - protein, 263 aa, Glycine max
  Coding DNA Sequence Number=SeqID_111463
  Gene Ontology: Mol. function=metal ion binding
  Homolog annotation: Hit_ID=Q9LT14; Match level="QueryCoverage=29%, HitCoverage=18%, E-value=1e-09, Identity=41%"; Hit description =Genomic DNA, chromosome 3, P1 clone: MPN9
  Pfam annotation: Domain name=zf-C3HC4; Domain location=205-254; Score= 41.5; E_value=2.9e-09; Accession=PF00097.15; Description=Zinc finger, C3HC4 type (RING finger)
MNPMMIEPANISSSSSFNINPKIVEERMGPYNIRVINEQVVKPNPRDTLRFNVTVTLRQFSIYDWRLRLIRTSTLLETSTSISFQSLFEDNQDFLRSVLSNPECFLYFIPRSFDQISRNIVSVVQRALEVQGSPSSAESADFECEVFPLTLDIFVDMLEEVDEETLALIEEESIQQEVAMIPASNEAIHSLQAFTDPLFLKTEKCNICMDEFYAEEGNEDDVKLLSSSSMPCGHVFHHQCIVKWLQTSHTCPLCRYPMPSVHD

SEQ ID NO: 228242 - protein, 127 aa, Glycine max
  Coding DNA Sequence Number=SeqID_111464
MSNQKIELILPDELNYLQEIYAYKILTKTTVIQFKKKTNIDKTKVPWCRHVPFAGERGRGSRVRFPKEERCAELPPTFICEKRRENRRKPVKMKILSSGVVFTFEEGRQKRGSCSYVPSIKEEIRPT

SEQ ID NO: 228243 - protein, 79 aa, Glycine max
  Coding DNA Sequence Number=SeqID_111465
  Homolog annotation: Hit_ID=Q9FLU4; Match level="QueryCoverage=82%, HitCoverage=31%, E-value=4e-07, Identity=37%"; Hit description =Arabidopsis thaliana genomic DNA, chromosome 5, TAC clone:K18P6
MEWRKCYLDVILVPLVFLTSIGYHFWLWHKVRTQPHTTIIGINASGRRNWVNAMMKCSRNISLSTIFAANELGRYKVHL

SEQ ID NO: 228244 - protein, 45 aa, Glycine max
  Coding DNA Sequence Number=SeqID_111466
MENWRTALLITSRGSRLEENGELANSATHNFAGLQTRRWRVHELR

SEQ ID NO: 228245 - protein, 103 aa, Glycine max
  Coding DNA Sequence Number=SeqID_111467
MSKKCEDSQVFGLGMVLSSRVQLSYYVGRLSKLVQMKGTFYPKLVKVFYTPFIEYFNIDVSNKIVDFTKASSEITERHLKKLGMRFIDDEWIMVGEPAAGNFD

SEQ ID NO: 228246 - protein, 67 aa, Glycine max
  Coding DNA Sequence Number=SeqID_111468
  Gene Ontology: Mol. function=DNA binding; Cellular component =mitochondrion; Biological process=DNA integration
MHSSNSKKWIDTMKDEMKSMKENEVWDLVKLPEGMKPIGCKWIFKTKKDSKGNIERYKARLVAKGFT

SEQ ID NO: 228247 - protein, 66 aa, Glycine max
  Coding DNA Sequence Number=SeqID_111469
MESVSVVVYCDGDMISSFEEILLECPSGPTIVTLSEEDILFDALRKTIMDVIEANNVNFNLNFKPT

SEQ ID NO: 228248 - protein, 209 aa, Glycine max
  Coding DNA Sequence Number=SeqID_111470
  Gene Ontology: Mol. function=sequence-specific DNA binding; Cellular component=nucleus; Biological process=regulation of transcription, DNA-dependent
  Homolog annotation: Hit_ID=Q40152; Match level="QueryCoverage=49%, HitCoverage=18%, E-value=6e-27, Identity=52%"; Hit description=Heat shock factor protein HSF8
  Pfam annotation: Domain name=HSF_DNA-bind; Domain location=32-208; Score=116.5; E_value=7.6e-32; Accession=PF00447.8; Description=HSF -type DNA-binding
MANNYSVLELNLGLGNNNVGGHAGQSPRQRCPAPFLLKTYDLLEELGENIEDSTKIVSWNAEGTGFVVWSPSEFSELTLPRYFKHNNFSSFIRQLNTYGFKKISSKRWEFKHEKFQRGCRHMLGEITRKKCEPSVFPAYLKSSSEENNATSSTEENNDHQLLMEENKNLKKERLELQVQIDECKALEMKLLECLSQFMDTHQNKVRRLC

SEQ ID NO: 228249 - protein, 107 aa, Glycine max
  Coding DNA Sequence Number=SeqID_111471
MLSLRCELAMVPFSEPCVTDTAMVTGEDGYGYEHDDSPNRMRFHETNKMARRLEVGGWNYLTSHDMEERLERVLWGEDIGEGAVGVDGEGAAAREGSEVGGGGAEKI

SEQ ID NO: 228250 - protein, 85 aa, Glycine max
  Coding DNA Sequence Number=SeqID_111472
MLRGTRERSRSARAETCESGGSLWLKFRFAREVETCESGGSRWPFTVQKLQIERERDRDGDSREVESRDWCGHVVATQREETITY

SEQ ID NO: 228251 - protein, 219 aa, Glycine max
  Coding DNA Sequence Number=SeqID_111473
MTTTRTTMIHPHLGINADSDKGCHMEVVDHFEMMFTTKKTAFYRVSTSNYTNPLDDDDWGDFMNHSKQINEKPFDSFGVPTDPKGAILLSIFGEEEGKEEEKPASGNVFSNGDGGAVKRGSSSNGSVGISDLISSLYNQQHPQVDSHNNKSVSVSNVAAPNLTYSNESKLNSDEDEDGREFKSTEWETGTKSQDVKAETPKHDNGALDVGIVLDSSNEI

SEQ ID NO: 228252 - protein, 142 aa, Glycine max
  Coding DNA Sequence Number=SeqID_111474
  Homolog annotation: Hit_ID=Q8H222; Match level="QueryCoverage=38%, HitCoverage=24%, E-value=2e-07, Identity=50%"; Hit description =Putative RING protein
MDDGGYYSTTTYLSSSIEQVMRPKSPLPGLVDFHGKWKQMVKIQVLEREIGLLQKNCPYVITIETTCTWGAETSNIVSLRMMMPFHHGHYELCPCQGHRGTIVVWHMSSLQTGHWGCSLVQEKHFGHGITCRCRASSIGGHK

SEQ ID NO: 228253 - protein, 181 aa, Glycine max
  Coding DNA Sequence Number=SeqID_111475
  Gene Ontology: Mol. function=protein serine/threonine kinase activity; Cellular component=intracellular; Biological process =protein amino acid phosphorylation
  Homolog annotation: Hit_ID=Q7XTK4; Match level="QueryCoverage=42%, HitCoverage=13%, E-value=6e-29, Identity=81%"; Hit description =Putative mitogen-activated protein kinase 1
  Pfam annotation: Domain name=Pkinase; Domain location=7-174; Score= -91.7; E_value=0.0043; Accession=PF00069.15; Description=Protein kinase domain
  Pfam annotation: Domain name=Pkinase_Tyr; Domain location=7-146; Score=-147.7; E_value=0.0021; Accession=PF07714.7; Description =Protein tyrosine kinase
  Pfam module annotation: Pfam domain module=Pkinase::Pkinase_Tyr; Domain location=7-174::7-146
MENDMGLDVDALNGINKEEGSGEPSRDQSKLYIFLEIVTKGSLRSLYQKYTLRDSQVSFYTRQILHGLKYLHDRNAVHRDIICANILVDASGFVKLADFGLAKFEIDYVGQSELALNEDLYNTKYKDKLELSYKDCLGKWKRASCIFKHHDAVADVFHSQFNNQGLIHEVFTTILCGLSSD

SEQ ID NO: 228254 - protein, 62 aa, Glycine max
  Coding DNA Sequence Number=SeqID_111476
  Homolog annotation: Hit_ID=Q2A9T4; Match level="QueryCoverage=68%, HitCoverage=12%, E-value=1e-13, Identity=81%"; Hit description=MO25 protein-related
MALYQICSGLTTKKFFDYIQLPNFDIAVDATATFKELMTRHKSTVADFLSNYYEWVVLTLVY

SEQ ID NO: 228255 - protein, 96 aa, Glycine max
  Coding DNA Sequence Number=SeqID_111477
MHAWNGFLGMSSRTSGSNGSTFLRSGFHILFLITADDDDSNHCLAFMFMNLVVPFLLLGVEYGHLIAGNFISEGFKSWLLDTWSACTHKKKVMAHY

SEQ ID NO: 228256 - protein, 41 aa, Glycine max
  Coding DNA Sequence Number=SeqID_111478
MGESSTVLDLKPHEGGEVAFGGIGKGKISDIGVTPSTPTYI

SEQ ID NO: 228257 - protein, 287 aa, Glycine max
  Coding DNA Sequence Number=SeqID_111479
  Gene Ontology: Mol. function=RNA-3'-phosphate cyclase activity; Cellular component=nucleolus; Biological process=biological_process
  Homolog annotation: Hit_ID=Q683I1; Match level="QueryCoverage=89%, HitCoverage=68%, E-value=3e-89, Identity=64%"; Hit description=RNA 3'-terminal phosphate cyclase-like protein
  Pfam annotation: Domain name=RTC; Domain location=1-235; Score=-1.2; E_value=1.8e-10; Accession=PF01137.12; Description=RNA 3'-terminal phosphate cyclase
  Pfam annotation: Domain name=RTC_insert; Domain location=64-182; Score=101.9; E_value=1.9e-27; Accession=PF05189.4; Description=RNA 3'-terminal phosphate cyclase (RTC), insert domain
  Pfam module annotation: Pfam domain module=RTC::RTC_insert; Domain location=1-235::64-182
ITNDSKDPSIDTFKSTTLPILKRFGVPFEDLELKVESRGLPPNGGGEVVLSVPVVQNLTAVSWIDEGFVRKIRGTTFSTRVSVQFEYSMIKSARGIINPLVSDVHIFSDHRSGPEAGNSPGYGISLVAETTSGCFISADTAVSQARDEDTSGLADDAKRDLMPPDDIGVGIANALVGEIAQNGVVDSTHQGLLFLLCALCPQDVSKVRVGKLSQHGVETLRNLRDFLDLKFIIKPDPNSQSVFLKCIGYGMKNLSQKATVYMFLHICFRDLELKLYLVPISLYDWSL

SEQ ID NO: 228258 - protein, 109 aa, Glycine max
  Coding DNA Sequence Number=SeqID_111480
GKSNRHIDVALVKEFYANLYNPEDKSPRQVRVRGKLIKFDATSLNTFLETPPILEPEEQYIAYSLFCRTHIDPQELAARLCILGREFVLNVEGAPWKLLRKDLTTLAQT

SEQ ID NO: 228259 - protein, 98 aa, Glycine max
  Coding DNA Sequence Number=SeqID_111481
MAVQPKTTKETEAFWDITEVSVWVSSGLQQHQLAAAVSKIPAITCQLRRSRKRGVELRGKRENKYEGECFESHQVSGKRSSFGGAVVVFVLCLLFLPV

SEQ ID NO: 228260 - protein, 219 aa, Glycine max
  Coding DNA Sequence Number=SeqID_111482
  Pfam annotation: Domain name=AT_hook; Domain location=64-76; Score =16.7; E_value=0.03; Accession=PF02178.9; Description=AT hook motif
MEAREGISSGVTVIGAEAPSAYHVAPRSEAPNQVHVPDGGGAAATAAPVGVSPVSAGLDGTAVKKKRGRPRKYGPDGSVTMALSPMPISSSAPPSNDFSSGKRGKMRGMDYKPSKKVGLDYLAYKPSFCTKKICKERKFVLARESASLDFHLLHFYFFGGMMKYAISLRLNASVEMTWYFLKGDLNACSDGTNFMPHIITVNAGEIVGVGEDDEIVWGK

SEQ ID NO: 228261 - protein, 66 aa, Glycine max
  Coding DNA Sequence Number=SeqID_111483
  Gene Ontology: Mol. function=DNA binding; Cellular component =mitochondrion
  Homolog annotation: Hit_ID=Q6ZJ55; Match level="QueryCoverage=68%, HitCoverage=12%, E-value=2e-17, Identity=95%"; Hit description =Putative AT-hook protein 1
MEIVKKGVVLLERMRTCYMDITMKVISFSQQGPRAICILSANGVISNVTLRQPDSSGGTLTYEVRQ

SEQ ID NO: 228262 - protein, 103 aa, Glycine max
  Coding DNA Sequence Number=SeqID_111484
  Homolog annotation: Hit_ID=Q00VP3; Match level="QueryCoverage=87%, HitCoverage=48%, E-value=8e-13, Identity=41%"; Hit description =Homology to unknown gene
MTPPPTKSTEELILRSSEIATIGAIFNFGGKKPDYLGVQKNPPALALCPATKNCVSTSENISDRTHYAPPWNYNPEGRKKPVSREEAMEELIDVVINATELKS

SEQ ID NO: 228263 - protein, 72 aa, Glycine max
  Coding DNA Sequence Number=SeqID_111485
MSRGGEKTPDKNFARRSVHAGRLAQHEPFCGNSWLERSLENFQPRQRTTGNGQRSISGRWKEELTAEIENCG

SEQ ID NO: 228264 - protein, 83 aa, Glycine max
  Coding DNA Sequence Number=SeqID_111486
MGRGTVVLGMVTRACNPSGSNKMCGRCHRGRVLMFWRDTGGGGNWEAFYLAASKNKKLKKPKSSDYCSVFCTITSKPMLKKRM

SEQ ID NO: 228265 - protein, 167 aa, Glycine max
  Coding DNA Sequence Number=SeqID_111487
  Homolog annotation: Hit_ID=Q84VH0; Match level="QueryCoverage=44%, HitCoverage=34%, E-value=2e-13, Identity=49%"; Hit description =Glutathione S-transferase Z1
  Pfam annotation: Domain name=GST_N; Domain location=72-147; Score =55.3; E_value=2e-13; Accession=PF02798.10; Description=Glutathione S- transferase, N-terminal domain
MALAAMHHCNPILCCILTVIALAHGVFDLLYPSKVFFYFFIVIFVPKSQLPILTITLGLYLCLTYFEKIALSPITVLHDSEQYWLRQKIPVKDINGIPYEYKAVDLSKGEQYSPEFERLNPLHYVPVLVDDNVVVSDSYAIFLHLEEKYTQKPLLPVDPQLRALNLQ

SEQ ID NO: 228266 - protein, 77 aa, Glycine max
  Coding DNA Sequence Number=SeqID_111488
  Gene Ontology: Mol. function=ATP-dependent DNA helicase activity; Cellular component=DNA-dependent protein kinase complex; Biological process=double-strand break repair via nonhomologous end joining
  Homolog annotation: Hit_ID=Q8S563; Match level="QueryCoverage=88%, HitCoverage=10%, E-value=7e-20, Identity=71%"; Hit description=KAP-2
MHSVLPEIEKVCSMLVQEKLIYSKYDEVGIVLFETEDTNNELTTEVGGYQHVVVLKDTKVVDGDILEALVTTASRNN

SEQ ID NO: 228267 - protein, 98 aa, Glycine max
  Coding DNA Sequence Number=SeqID_111489
  Gene Ontology: Mol. function=transferase activity; Cellular component= cytoplasm; Biological process=aromatic amino acid family metabolic process
  Homolog annotation: Hit_ID=Q8H1P7; Match level="QueryCoverage=92%, HitCoverage=41%, E-value=3e-27, Identity=60%"; Hit description =Glutathione S-transferase
  Pfam annotation: Domain name=GST_C; Domain location=1-80; Score=9.9; E_value=0.022; Accession=PF00043.15; Description=Glutathione S -transferase, C-terminal domain
MEKMFCAESKPWAQFTIDKGFSALEKLLKDFAGTYATGEHIYMADVFLAPQITLAVQRFDIDMSKFPTLSRLYETYKALPEFQASSPQRQPDALIHNP

SEQ ID NO: 228268 - protein, 114 aa, Glycine max
  Coding DNA Sequence Number=SeqID_111490
  Subcellular localization annotation: CTP_CleavageSite=54; ConfidenceScore=5.25e-01
MDTDLILFVNSGRSGRYSGGAERNPSATDTSVAVRFQVAAGVAAIAAERSGAVRVAERFFAPLLRSTDGMSGFGGSVASSALFFPERGKREKEGGRERKRERAFLRRGFNIPGD

SEQ ID NO: 228269 - protein, 1302 aa, Glycine max
  Coding DNA Sequence Number=SeqID_111491
  Gene Ontology: Mol. function=ATP-dependent helicase activity; Cellular component=proton-transporting two-sector ATPase complex; Biological process=ATP synthesis coupled proton transport
  Homolog annotation: Hit_ID=Q1RWC6; Match level="QueryCoverage=97%, HitCoverage=98%, E-value=0.0, Identity=69%"; Hit description=ATP -dependent helicase HrpA
  Pfam annotation: Domain name=DEAD; Domain location=269-420; Score= -44.0; E_value=0.029; Accession=PF00270.19; Description=DEADDEAH box helicase
  Pfam annotation: Domain name=DUF1605; Domain location=966-1121; Score= 37.3; E_value=5.2e-08; Accession=PF07717.6; Description=Domain of unknown function (DUF1605)
  Pfam annotation: Domain name=HA2; Domain location=804-936; Score =62.5; E_value=1.4e-15; Accession=PF04408.13; Description=Helicase associated domain (HA2)
  Pfam annotation: Domain name=Helicase_C; Domain location=650-743; Score=55.2; E_value=2.2e-13; Accession=PF00271.21; Description =Helicase conserved C-terminal domain
  Pfam module annotation: Pfam domain module=DEAD::DUF1605::HA2::Helicas e_C; Domain location=269-420::966-1121::804-936::650-743
METWECSGDQIEFNSQSLGNSDSNALILPAKRVRKRKGKEQENGKVKSNKKQKLSKPQKRKMKKLEDDKEKQLLLEKAIKTLNENTLPEYAYPLLLSSCNINRDETMKEKRRRAVHLLKEGLEVSYDGLSKKPETDEIHLEHADEVEENEIQIQPIRSEEVLNTTSVSLESSQEPVHGNEVENYKYVSEHPADISIDKHLDEIRSSTMSCSTDEIKSTKSKDRTDENHNSNELSNLSDYSAPRWSNVPTVVHVYRPTEVEDKRKDLPIVMMEQEIMEAINDRSSVIICGETGCGKTTQVPQFLYEAGYGSSKGIIGVTQPRRVAVLATAKRVAYELGLRLGKENDILLRRYSVLILDEAHERSLNTDILIGMLSRVIKTRQMIYYEQKKMILSGESVSPEKMIFPLKLVLMSATLRVQDFTSGKLFHTTPPVIEVPTRQFPVTAYFAKKTEKTDYIGEAYKKVLAIHKRLPPGGILVFVTGQREVEDLCRKLRKASREFIKKKVEGSVETDSTVVHETNSVEGVNINEINEAFEVHGSSSIQQTDRFSGYDEDEDDVNWNESEFSYDSETDSELEFDEDDDNLELSENRSNIVDVLGQAGSLASLKAAFEKLSGQATLSSSNGEETSVNIEGNLDQSKVFREKRAKENCSTPGALCVLPLYAMLPAAAQLRVFEEVGDGERLVVVATNVAETSLTIPGIKYVVDTGREKVKNYDPSNGMETYEVQWISKASAAQRAGRSGRTGPGHCYRLYSSAAFSNEFPEHSPAEVEKVPVHGVVLLLKSMHIKKVANFPFPTSLKDSSLLEAENCLKALEALDNKDELTLLGKAMAHYPLSPRHSRMLLTVIKNTRHEHKCNPNMLLAYAVAAAAALSLSNPFVMQYEDDSSRDLEMVEKSSLGDGEKGIGKKEKSRKKKLKETAKVAREKFRVVTSDALTIAYALQCFEHSEKSAEFCDDNALHFKTMDEMSKLRQQLLKLVFYQSDKGGFEEEYSWIHGSLEDVERAWQASSEKYPLSLVEERLICQAICAGWADRVAKRITASSRASDGEKTSHALKYQSSMVDESVFLHRWSSASIVGPEFLVYNELLETKRPNKEGITSAKRAYMHGVTSVEPAWLVENAKSSCIFSPPLTDPRPYYDARTDQVKCWVIPTFGRFCWELPKHSLPISNDEHQVQVFAYALLEGQVCPCLKSVRKYMSAPPESIMKREAFGQKRVGNLLSKLKSRLIDSSAMLRMVWKENPRELFSEILDWFQQSFHKHFEELWLQMLNEVLMEKQESPLHKRKECIQALTKSVVTRGISIMYSS

SEQ ID NO: 228270 - protein, 331 aa, Glycine max
  Coding DNA Sequence Number=SeqID_111492
  Gene Ontology: Mol. function=protein binding; Cellular component =mitochondrion; Biological process=vesicle docking during exocytosis
  Homolog annotation: Hit_ID=Q1RWC8; Match level="QueryCoverage=87%, HitCoverage=43%, E-value=1e-116, Identity=75%"; Hit description=Sec1- like protein
MVQALPQYTEQVEKISLHVEIAGKINKIIRETDLRELGQLEQDLVFGDAGAKEVINFLRTKQNTSPEYKLRLLMIYASVYPEKFEGDKASKLMQLAKLSPDDMKVISNMQLLAGSSNKKSSAAGGFSLKFSNQKTKQAARKDRTEEEETWQLFRFYPMLEELIENLIKGELPKNEYSCINEPSPSNARGSVRIRQQTQTAPTTAPHSMRSRRTANWGRARTSDDGYSSDSTLKNVTTDFKRMGKRIFVFIIGGATRSELRVCHKLTQKLKREVILGTTSMDDPPQYLTQCPDYICRSSYRCFMMLKVELNPSQTISVYIAKKISDPTNMIK

SEQ ID NO: 228271 - protein, 126 aa, Glycine max
  Coding DNA Sequence Number=SeqID_111493
  Gene Ontology: Mol. function=protein binding; Cellular component =cellular_component; Biological process=vesicle docking during exocytosis
  Homolog annotation: Hit_ID=Q1RWC8; Match level="QueryCoverage=99%, HitCoverage=18%, E-value=6e-55, Identity=78%"; Hit description=Sec1 -like protein
MELPCVWHRAAKDSDESTAAAVRELVPTKLANAVWDMVSKYKSTIPGFPQNETCDMLIVDRSIDQIAPVIHEWTYDAMCHDLLNMDGDKYMHEVPSKVGGQPEIKEVILQDHDSVWLELRHTHIAD

SEQ ID NO: 228272 - protein, 78 aa, Glycine max
  Coding DNA Sequence Number=SeqID_111494
  Homolog annotation: Hit_ID=P39657; Match level="QueryCoverage=51%, HitCoverage=14%, E-value=5e-08, Identity=63%"; Hit description =RuBisCO-associated protein
MAVFREYTSDDSFTKVDIPKDVSEFQVALTFARDHDGEDSTNGNHKIAHTHNPKYNLDGVDVYYEDIVVTNSTSCLCF

SEQ ID NO: 228273 - protein, 69 aa, Glycine max
  Coding DNA Sequence Number=SeqID_111495
  Gene Ontology: Mol. function=solute:hydrogen antiporter activity; Cellular component=integral to membrane; Biological process =regulation of pH
  Homolog annotation: Hit_ID=Q75L14; Match level="QueryCoverage=97%, HitCoverage=13%, E-value=2e-15, Identity=56%"; Hit description =Putative Na+/H+ antiporter
  Subcellular localization annotation: CTP_CleavageSite=18; ConfidenceScore=5.22e-01
MAISPTRVVRSLSPARMRASIGNAMIERATPMKTRMPQMKGREVLTAVMQNSYRPLRRMEWRSSSRPKS

SEQ ID NO: 228274 - protein, 89 aa, Glycine max
  Coding DNA Sequence Number=SeqID_111496
MGTKGDRGVEGLAERVGLKEVLEANGRSGGGDRKRCVKDEASWVGTKGKIVGSERESEATTNYGFGDLRASEFIFGGWRWWLFWFEVRW

SEQ ID NO: 228275 - protein, 63 aa, Glycine max
  Coding DNA Sequence Number=SeqID_111497
MVLLCDGGGFVGGSDGAMRPAGLTGEEWSEKRRRNRGFGFRILWNTVKSFLDPKTTVKINVSI

SEQ ID NO: 228276 - protein, 112 aa, Glycine max
  Coding DNA Sequence Number=SeqID_111498
  Homolog annotation: Hit_ID=Q1RW23; Match level="QueryCoverage=92%, HitCoverage=79%, E-value=5e-10, Identity=31%"; Hit description=Plant self-incompatibility S1
  Pfam annotation: Domain name=Self-incomp_S1; Domain location=31-105; Score=33.8; E_value=5.9e-07; Accession=PF05938.2; Description=Plant self-incompatibility protein S1
MLKALVTIIVFLMIVSVQDGLSDDGFFGGKNTVRVYNGMNDSILVHLHCQSKDDDLGQHVLAVGEHQEWSFEDRVFGNTLFWCTMDAGYFFNEFSSSWEKRLSWHIPKTPSF

SEQ ID NO: 228277 - protein, 80 aa, Glycine max
  Coding DNA Sequence Number=SeqID_111499
MKATPNLDSGSVGREATTSGGTRESKWGRHTIVASIISHDGCCHRGWFKIFHAVAPHHLPHALFSGEQLTHAELLRLCDE

SEQ ID NO: 228278 - protein, 75 aa, Glycine max
  Coding DNA Sequence Number=SeqID_111500
MGLTENKRGYISYGSILVEGTSTRVSKRTREGTSLVDLCLKLTSFIRVGLQQQSASFDEDQCLPDYGLYLFFIEL

SEQ ID NO: 228279 - protein, 143 aa, Glycine max
  Coding DNA Sequence Number=SeqID_111501
  Pfam annotation: Domain name=DUF1723; Domain location=22-65; Score =11.5; E_value=0.022; Accession=PF08330.1; Description=Protein of unknown function (DUF1723)
RNGEERPKLKLSFHGRKVEKFGRPAPEIEGLETSSFHLPVGKVTITLDDVSSLLHLPITRAFHSFETLHVDDVVFLLVELLEVSYEETRVETVQCHEAYVRYPVASAITAKDYDERKLCACRWKSRQALPISTNRKHLDRLTS

SEQ ID NO: 228280 - protein, 125 aa, Glycine max
  Coding DNA Sequence Number=SeqID_111502
MVRTRGLGRALGAGRGRGISEDAHEADVSLRRRPTASGCRQRVRLREDVTERPEDVPQSHEDVPHVYDATPEMTGAVDAIQTEGVATDGSLGSPAADEGFPGGPRDPSILTDFAVHVAHSIWSGQ

SEQ ID NO: 228281 - protein, 110 aa, Glycine max
  Coding DNA Sequence Number=SeqID_111503
MPRTHDAILYYNGKWNMPPQNKFVGCAFTGKNPKKFQIPSTCTIDELKNLIKQVAPKGIPPLGIHESQTVKRLFFCQPARFEYSDTLIKYEINEQRTNEELLKVLVQSNY

SEQ ID NO: 228282 - protein, 54 aa, Glycine max
  Coding DNA Sequence Number=SeqID_111504
MASKVPVSQQANYCADALANLACGLEEDYVIFDHPKLLLLADVSGVSTPRLISM

SEQ ID NO: 228283 - protein, 59 aa, Glycine max
  Coding DNA Sequence Number=SeqID_111505
MEVATTMKVVALVRGGKDSCYAMMKAIHYGHERSDNGVWFASNAGNVKEKKKVHFVRDS

SEQ ID NO: 228284 - protein, 159 aa, Glycine max
  Coding DNA Sequence Number=SeqID_111506
  Homolog annotation: Hit_ID=Q9FGR0; Match level="QueryCoverage=58%, HitCoverage=6%, E-value=9e-37, Identity=76%"; Hit description =Probable cleavage and polyadenylation specificity factor 160 kDa subunit
MAVLSIGGGDVSRKRDSIILTFADAKISVLEYDDSIHGLRTSSLHCFEGPEWLHLKRGREQFARGPVVKIDPQGRCGGVLIYDLQMIILKATQKHRRGRAGVYPVSELCWLRIRTQLTCDAVSEFTGHGWAAGHAQLDAAHHRKTFTKVNKLPQLSRTK

SEQ ID NO: 228285 - protein, 748 aa, Glycine max
  Coding DNA Sequence Number=SeqID_111507
  Gene Ontology: Mol. function=nucleic acid binding; Cellular component= nucleus; Biological process=mRNA processing
  Homolog annotation: Hit_ID=Q9FGR0; Match level="QueryCoverage=96%, HitCoverage=56%, E-value=0.0, Identity=59%"; Hit description =Probable cleavage and polyadenylation specificity factor 160 kDa subunit
MWNLGFSQYTASRLALLGLDVWITMVGSGLVGDDDAFGSSGAVAARIESSYMINLRDLDMRHNLPHDAYKLLAVPSPIGGVLVIGANTIHYHSQSASCALALNNYAVTLDSSQEIPRSSFNVELDAANATWLLSDVALLSTKTGELLLLMLVYDGSRLGDSMLVQFSCGSGVSMMSSNLKEEVGDIEVDAPSKRLRRSPSDALQDMVSGEELSLYGSATNRTESAQKSFSFAVRDSLINVGPLKDFSYGLRINADANATGIAKQSNYELVCCSGHGKNGSLCVLRQSIRPEVITEVELPGCKGIWTVYHKSTRSHNADSSKMADDDDEYHAYLIISLEARTMVLETADLLSEVTESVDYYVQGKTLAAGNLFGRRRVIQVYERGARILDGSFMTQDVSFGASNSESGSASESAIALSVSIADPFVLLRMSDGSIRLLIGDPSTCTISVTSPASFESSKGSVSSCTLYHDKGPEPWLRKTSTDAWLSTGVGEAIDGTDGAAQDHGDIYCVVCFDNGNLEIFDIPNFNCVFSVENFMSGKSHLVDALMKEVLKDSKQGDRDGVVNQGRKDNIPNMKVVELAMQRWSGQHSRPFLFGILSDGTILCYHAYLYESPDGTSKVEDSASAGGSIGLSSTNVSRLRNLRFVRVPLDAYPREDTSNGSPCQQITIFKNIGSYQGFFLSGSRPAWVMVLRERLRVHPQLCDGSIVAFTVLHNVNCNHGLIYVTSQGVLKICQLPSGSNYDSYWPVQK

SEQ ID NO: 228286 - protein, 399 aa, Glycine max
  Coding DNA Sequence Number=SeqID_111508
  Gene Ontology: Mol. function=binding; Cellular component =intracellular; Biological process=protein kinase C activation
  Homolog annotation: Hit_ID=Q9FJY7; Match level="QueryCoverage=97%, HitCoverage=72%, E-value=2e-93, Identity=42%"; Hit description =Selenium-binding protein-like
  Pfam annotation: Domain name=PPR; Domain location=113-147; Score =11.3; E_value=0.34; Accession=PF01535.11; Description=PPR repeat
  Pfam annotation: Domain name=PPR; Domain location=148-182; Score=3.6; E_value=2.8; Accession=PF01535.11; Description=PPR repeat
  Pfam annotation: Domain name=PPR; Domain location=18-52; Score=30.9; E_value=4.5e-06; Accession=PF01535.11; Description=PPR repeat
  Pfam module annotation: Pfam domain module=PPR::PPR::PPR; Domain location=113-147::148-182::18-52
LVEESQKVFQWAVDRDLYSWNTMISTYVGSGNMSQAKELFDGMQERNVVSWSTIIAGYVQALGFFHEMLQIGPKPNEYTLVSTLAACSNLVALDKGKWFHAYIGRGDIKMNERLLASIIGMYAKCGEIESASRVFLEHRVEKVSPNKVAFIALLNACSHGYMVEEGNLCFRLMVSDYAITPEIVHYGCMVLSRSGLLKEAEDMISSMPMAPNVAIWGALLNACRIYKDVERGYRIGRIIEDMDPNHIGCHVLLSNIYSTSRRWNEARMLREKNKISRDRKKISGCSSIELKGTFHQFLEMTIKLKSAGYVPELGELLHDIDDEEDRVCFVCTQKLAIAFGLMNTANGTPIRIVKNLRVCGDCHQATKFISKVYNRVIIARDRTRYHRFKDGICSCEDYW

SEQ ID NO: 228287 - protein, 59 aa, Glycine max
  Coding DNA Sequence Number=SeqID_111509
MWDRHKLKGALKLGDPQGLHSEESGLSINPSPLKGLSINSSPLKGLSINSSPLKGLIVV

SEQ ID NO: 228288 - protein, 100 aa, Glycine max
  Coding DNA Sequence Number=SeqID_111510
  Homolog annotation: Hit_ID=Q9FGR0; Match level="QueryCoverage=86%, HitCoverage=6%, E-value=2e-38, Identity=83%"; Hit description =Probable cleavage and polyadenylation specificity factor 160 kDa subunit
WNGTELNGIAFFDAPPLHVVSLNIVKNFILIGDIHKSIYFLSWKEQGAQLSLLAKDFGSLDCFATEFLIDGSTLSLMVSDDNRNIQIDGDYVYTVTYYLS

SEQ ID NO: 228289 - protein, 621 aa, Glycine max
  Coding DNA Sequence Number=SeqID_111511
  Homolog annotation: Hit_ID=Q1RVB7; Match level="QueryCoverage=94%, HitCoverage=77%, E-value=0.0, Identity=62%"; Hit description=Zinc finger, BED-type predicted
MVESSRFEIGYNNNNNNNSLHNQHHQQQHLMLSGGKDDLCALAMFEDSVKKLKSPKTSPGPALSKDQVNSALDLLFDWFYETCGSVSLSMLEHRKFQAFLSQVGLPNNLRREISGERLDARFGEAKAESEARIRDAMFFQLASDGWKSGDWLNFDLCCSGGGESLVKFVVNLPNGSSVFQKAVFTGGVENSKYAEEVLWETVTAVTGSVQRCVGIVADKFKAKALRNLEVQYHWMVNTSCQLQGFASLIKDFNRELPLFRVVIESCLKVANFIDNESQMRSVFLKCRMQEMDCGGLIRVPSPKCDPLKNFGVVFPMLEDILSCARVIQMVVMEDGFKVMCMEDPLAREVAGIVQNEGFWNELEAVYSLEKLVRGMVQDVEVERPLIGRCLPLWEELRSKVKEWCGKYNIVGGPVEKIVEKRFRKNYHPAWAAAFILDPLYLIKDASGKYLPPYKCLTREQEKDVDKLLTRLASREEAHVVLMELMKWRSEGLDPLYAQAVQMKQRDPVTGKMKVANPLSSRLVWETCLTEFKSLGKIAVRLIFLHATSCGFKSNWSFMRKISANKHSRVALERAQKMIYIAAHAKLERRDFSSEEEKDAELFALSGSEDGMLADVYADAPL

SEQ ID NO: 228290 - protein, 97 aa, Glycine max
  Coding DNA Sequence Number=SeqID_111512
  Homolog annotation: Hit_ID=Q1RVB7; Match level="QueryCoverage=48%, HitCoverage=9%, E-value=2e-12, Identity=84%"; Hit description=Zinc finger, BED-type predicted
MEEMGRGEGSEPGLRPELKLEQVPRFKCSEAVREGDENGLEVGPVPGAFALDGLCADSEEALEALVDGTDGGGGVVGGGEGVGGGGGGGGHCLELEG

SEQ ID NO: 228291 - protein, 259 aa, Glycine max
  Coding DNA Sequence Number=SeqID_111513
MENMTFQNTLGRNQACEDTCSLSPIRSTNVKKSPRVDLEQDIHEGTGVQYEFQITHENSKGVEWACESNLVEPSLANSDDRDWVNTRLKESFANGGWGQKELIENKADTSDCKEHVRSKSNKTLAKKGMPFGGSKQGVTRGPILNVVSNGSSRTSSLKGHNKKSKENLGLGADLGCFIEWQRGEFGAKIGINGVEGFSTKKMILTYNIRGLGGRLKVKFVKELERKKEGQFLFLQETKREVIDKELCFSLWEDMWCHGR

SEQ ID NO: 228292 - protein, 364 aa, Glycine max
  Coding DNA Sequence Number=SeqID_111514
MSHTRIGNKSLAEFDIPKASDLRTKKKILQTVGERWRQFMFDLTSKWALATGKESVDDTVCKKYDIGKEKMCEKRHRSSRNKTLSLTCCLDKKKKKLEEAAQPGSTDTVIDPPSPIRRHVKWKMTRTKKTGQMTSEATKEIADKIDSLEKQTSQGSFVAHGQHPGRVRAAGVSVTIKQYFGPTPRTSRTSSSMVPEDLEQLTQQIKDQLEESIIKNQIQSQFQSQMQSQGLALPVEPEVKVGVEEGRDADALIPVPTEEVKLVGQTLNTFLAWLTHLIKLLSEQGAVELAKPIDRSDHDVDDPLYLMTLTIPQLFLKPLQVMWDATVFGVFNENFPLYIKHEGLSEIAHGGQCLSISVIQLWIL

SEQ ID NO: 228293 - protein, 241 aa, Glycine max
  Coding DNA Sequence Number=SeqID_111515
  Homolog annotation: Hit_ID=Q9FJC9; Match level="QueryCoverage=23%, HitCoverage=14%, E-value=2e-10, Identity=60%"; Hit description=26S proteasome regulatory particle chain RPT6-like protein
MPQQWPTFLGPIHYLLKVACASIELLHHDAVDLPLGYHRNSRDSFDEASASASASTSTIVTATGLFYNRKSMHEGSTTLTHGRGWWWCCYALGGIGGCFGLTRNATTIHRRFYGCFEPLREGGRNDAVAGDLYTDTWTLIAKHRRRLLSTRKRLQSISVPLIQTNPYKDVIACDVINLDDIDVEFNSIGGLETIKQALFKLGQFKQHFAEEEVEGVGVEQRARSLIPHDAMKYLDTFPRCS

SEQ ID NO: 228294 - protein, 273 aa, Glycine max
  Coding DNA Sequence Number=SeqID_111516
MEAITNKKRDNRPYLDEERKSSTSRKNGRRRGTQRREKQQLARKKNNHLAREKQQLARKKNHQEEEMARERRRKKKSLAERKKKWLAGTGAGGEKRAHSSHCLRAPYFELLVCLHRPFLQLEVVERLVITGSGGFVRAFGGALRRNWGFRGVGVGVVDIVFETLKVDWYCERVLLREVCHSVVGTILPVVRHLPNAQLLVVVEIHRGHDVVTLIVVDFKLCNSSSSSRYVVATNVMMESALCVHGPDLFVGRNKLRCTYSYLFMLHALTQLLE

SEQ ID NO: 228295 - protein, 700 aa, Glycine max
  Coding DNA Sequence Number=SeqID_111517
  Homolog annotation: Hit_ID=Q69T90; Match level="QueryCoverage=35%, HitCoverage=80%, E-value=6e-96, Identity=62%"; Hit description =Pantothenate kinase-like
MVKTRGLDRALGRVPVTVADDVPTVPADLPAVPTNLHVVLEAEPVVAGDEPMDTGAEDAADETEGFPGGPRDPSVLTEYAEHVAAIVWSGEERPKLKLSSHGRKVHKLGRPAPAIEDMIVGIGLSPLIAFSVSITLDDVASLLHLSIIGDFHAFQPLHIDKVVLMLVELLMVSPEVAMAETGHCTGPYVRLSWLRDIYQRRCQTQHWTATTRAYLLHLLGCTLFANKSATHVHVVFLDAMRDLTQTRRYAWGAVDLVHMYDQLNDHFPSVAECNADPEDDEDSRCLLDAICEAPTGLGLSSDFIYRPERVMRQFGYVQCIPAHPSDSWGSFDDVDDRWTHYSDHLAPVDIRSSSICICDVARHIPQVPESRIPQEPTPASTHADSDADEPRHGVETCHAIVETLEHHLSLNKVTPDTSHMRSSKNASGLPGESNVWEVEVEVEGEKHHYMESASELVEFPLLLTPIDSNYRACTIPYRFPSDNPRKPTPTEISWIDLFLNSIPSFKKRAESDTSVPDAAAKAEKFAQRYADILEDLKKDPESHGGPPDCILLCRLRELVLRELGFRDIFKKVKDEENAKAISLFENVVHLNDAIEDEGKRLENLVRGIFAGNIFDLGSAQVIIFVDNSGADIILGIMPFARELLRRGSQVVLAANDLPSINDVTCSELVEIISKLKDEDGQLVGVSTSNLLIANSGNDLP

SEQ ID NO: 228296 - protein, 80 aa, Glycine max
  Coding DNA Sequence Number=SeqID_111518
MHRDLPCLLFYIERCAAPPITKLNQSEERCTTLVPKRTPPVIENKPLGHRWLRRGNQHISNDDLIVFHRKLDIMKRHEFL

SEQ ID NO: 228297 - protein, 61 aa, Glycine max
  Coding DNA Sequence Number=SeqID_111519
WAKRASIAKRNFSMLSATEESGRASISRPHAKREISALSTAIVFSQAQSTTGAKLEATYMH

SEQ ID NO: 228298 - protein, 136 aa, Glycine max
  Coding DNA Sequence Number=SeqID_111520
MAENQLPFVEACTIVKEMWDVIQVTHEGTSEVRKVITVSESKDLTSITPVELFGKLREYEMGMTRMAKEEAKEKKSKGLALNSPYHLGMWVVKKVQKVFDEILPRKGPVTRAMSKKLQEDWARAAEEGPRVLMSLG

SEQ ID NO: 228299 - protein, 222 aa, Glycine max
  Coding DNA Sequence Number=SeqID_111521
  Homolog annotation: Hit_ID=O04892; Match level="QueryCoverage=43%, HitCoverage=23%, E-value=6e-28, Identity=58%"; Hit description =Cytochrome P450 like_TBP
SKWAIFGKQNWRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLK

SEQ ID NO: 228300 - protein, 169 aa, Glycine max
  Coding DNA Sequence Number=SeqID_111522
MPISPCRCIGWDRAHKTPSGPEEVQQGPGVSSSGYGPLSVLQGVRSPNEESHPQRHPVDPEKSNRALGFPALVTGLCSPTGCPFPLARSHHHRDRACKTPSGPEEVQQEYLSPPARASGPLLIELSSRSTASPGRAQGETPQQPGDGRQRATDAPPSPLEFTSAHPQKG

SEQ ID NO: 228301 - protein, 108 aa, Glycine max
  Coding DNA Sequence Number=SeqID_111523
  Homolog annotation: Hit_ID=Q3LBH1; Match level="QueryCoverage=51%, HitCoverage=58%, E-value=6e-08, Identity=58%"; Hit description =PAM492 homologue
MSVKMRTTCTWTERPYEASLFPGIGFGLFLRSLGGGQRRPPSGGARAIRPTGRGTVSGRQFLWGVGLPKGNGGVQRFPRARRRLALECKGRRELDCKTHPSSRDESRP

SEQ ID NO: 228302 - protein, 102 aa, Glycine max
  Coding DNA Sequence Number=SeqID_111524
  Homolog annotation: Hit_ID=Q1SLU0; Match level="QueryCoverage=76%, HitCoverage=8%, E-value=3e-12, Identity=47%"; Hit description =Peptidase S8 and S53, subtilisin, kexin, sedolisin; Integrase, catalytic region
MEEPKTRTLQQAERTSKAYRIFQPQNGKILLSRDVKFMEDWQWSWEEPIRKQLLKALQFFDDDVNDILNIGARSLSEVYQRSNVVVLEPTKFEKKLRRMTSG

SEQ ID NO: 228303 - protein, 74 aa, Glycine max
  Coding DNA Sequence Number=SeqID_111525
MRMRRHSMFPFACMPLVLWGVVRLVVSSLANVRVLTIGSCVAYLPNGIRVASQTHSIQASLLGTLEDFKVRGIL

SEQ ID NO: 228304 - protein, 224 aa, Glycine max
  Coding DNA Sequence Number=SeqID_111526
  Gene Ontology: Mol. function=oxidoreductase activity; Cellular component=membrane
  Homolog annotation: Hit_ID=Q3KK76; Match level="QueryCoverage=99%, HitCoverage=92%, E-value=7e-80, Identity=61%"; Hit description =Hypothetical protein precursor
  Subcellular localization annotation: CTP_CleavageSite=24; ConfidenceScore=5.06e-01
MTLIPAAVIGGSGVGALTAPTPAVAASNTSTQNDYQPTFFTPEEWAFIKAAVARLIPADERGPGALEAGVPEFIDRQMNTPYATGAIWYMQGPFNPDVPKEMGYQLPLVPKQIYNLGISDADAYSKKTAGKPFAELDGAQQDAMLQKFESGEAEFPQLPSKLFFSYLLQNTREGFFSDPIHGGNKDMVGWKLINFPGARADFMDWVERGERYPFPPVSIRGERG

SEQ ID NO: 228305 - protein, 121 aa, Glycine max
  Coding DNA Sequence Number=SeqID_111527
MADSKDDSSTIEKTEQTTFSKKTKFASSKKVNLNNVSKRKNIVHPKPKTKTCHYCMKRKHTSYKCYVKRFDVPRGKSVWIPKDLIVKINPIGPNLNWVPPISNWLCLLSVPKSKRLTMVLG

SEQ ID NO: 228306 - protein, 90 aa, Glycine max
  Coding DNA Sequence Number=SeqID_111528
  Subcellular localization annotation: CTP_CleavageSite=63; ConfidenceScore=5.06e-01
MEGLFVTNFESKDVSKLPITKLQKCPQFWWMFSLSSFTKFGVLLSPIAPKVVGPWLLDSNSSRDGTYPSFQFPIWKLTNKETKRQAITKD

SEQ ID NO: 228307 - protein, 46 aa, Glycine max
  Coding DNA Sequence Number=SeqID_111529
MSKIGRFGGLGMEERRKGKRLRRGGGSLLVIDYMNTVIDYRPSVLV

SEQ ID NO: 228308 - protein, 146 aa, Glycine max
  Coding DNA Sequence Number=SeqID_111530
MWMDRFALTLNGSQELPRLLAKAKAMADTYSAPEEIHGLLSYFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 228309 - protein, 385 aa, Glycine max
  Coding DNA Sequence Number=SeqID_111531
  Gene Ontology: Mol. function=oxidoreductase activity; Cellular component=proton-transporting two-sector ATPase complex; Biological process=flavonoid biosynthetic process
  Homolog annotation: Hit_ID=Q1SPG9; Match level="QueryCoverage=66%, HitCoverage=98%, E-value=8e-93, Identity=63%"; Hit description=2OG -Fe(II) oxygenase
  Pfam annotation: Domain name=2OG-FeII_Oxy; Domain location=237-336; Score=124.7; E_value=2.6e-34; Accession=PF03171.10; Description=2OG -Fe(II) oxygenase superfamily
MASAASISSSQPEAPKVHASDISSIKAFAESKGASLIPYTYHSITEHHDDDVADELAASIPVIDLSLLTSHDPQIHAKAVHQLGKACAEWSFFMVIQNLFFSLMNFTFNYHSLAYHQLTNHGIPESLVEELMKKSREFHDLPMEEKKEFGNKGPFEPIRHGTSFCPEAENVHYWRDYLKAITFPEFNFPYKPPGYREVAYDYSKKIRGVTRKLLEGISESLGLESNSIIESTDFDSGHQLFVVNLYPPCPQPHLALGLPSHSDVGLLTLLTQNGIGGLQVKHNGKWVNVNPLPNCLIVLLSDQLEVVSNGKYARVMHRAILNNADTRISVVLANGPALDKEIGPLPELLQNYKPLFRSIKYRDYFQIQQKSRLQDKSSLDEIRLN

SEQ ID NO: 228310 - protein, 290 aa, Glycine max
  Coding DNA Sequence Number=SeqID_111532
  Gene Ontology: Mol. function=triacylglycerol lipase activity; Biological process=lipid metabolic process
  Homolog annotation: Hit_ID=Q6KA57; Match level="QueryCoverage=99%, HitCoverage=92%, E-value=6e-57, Identity=39%"; Hit description =Lipase class 3-like
NCASFRRAVIASLVQGVYILEHDRQKNRLGTKSLSPPWWEFFHFHLHNVLVDSADFSMFGAILELRLPPNYPKTFALNTPKYVIAFRVRAETRSRDILLDLKCIVNKIHKSFRFELAMHSFQNTVDVAGADNVWLAGHSLGINHQKITQGIHIASSVMKVGISAALKGHHHHHDHTSHDEHDDPFAELSTWVPHLFVNPGDHICSGYINYFAEGEVEKIGARKIEKIATKCTLESLLSDALDRNSEPLHLLPSLELNINMGHTSGFRAAHGIEQWWDPHLRFKSLMYLYK

SEQ ID NO: 228311 - protein, 97 aa, Glycine max
  Coding DNA Sequence Number=SeqID_111533
  Subcellular localization annotation: CTP_CleavageSite=41; ConfidenceScore=5.06e-01
MNFKRLDILWDTFRHPSKKLLSFDFSQSFCYQLRACRYITRLNRTSEAFILNFERLDILRDTIGHPSKKLLSLEFATSIGFQLRASRYTTGHIRTSE

SEQ ID NO: 228312 - protein, 67 aa, Glycine max
  Coding DNA Sequence Number=SeqID_111534
MALLGETSSRIVVNSTLGFIFPNGSIVHNDNGVSFQASTPVPIRVPNGCDFQTLKTRIHNTLKLTDK

SEQ ID NO: 228313 - protein, 123 aa, Glycine max
  Coding DNA Sequence Number=SeqID_111535
MDRDQRKGTKWTNRKYECSDKWNSKCKLLKTSIKGTPETGLQIPGFHKQRKPKRRQSRTGSIQEGEGRRMRNRNLLKLERSAYKIFSFRAPRLRNLKNGQMKGCPTTWLMTPYIAKILRPVVA

SEQ ID NO: 228314 - protein, 49 aa, Glycine max
  Coding DNA Sequence Number=SeqID_111536
MAEEESGLPIVIHPQQKTSQGNEKKKEDENITQGDPPQEERSLRIEIEE

SEQ ID NO: 228315 - protein, 205 aa, Glycine max
  Coding DNA Sequence Number=SeqID_111537
MEAMKDQMAAMLSMKKIMESNAAAVATTSAPIEEDPTHPSGLNKVNPPVSDMVGQGREALGSTGGPHVVQSKNSFPPYGLPPNYTPPNVAHAPDENVNNSTPILIESRQPQFDHAHVSQPMGRHMRHPNLVNFEPHLRYAFEGQAFYGIPLPNTLGGPQYHPQPQPLHFVVGRVPPAMVEREKFNHIEETLKAIEGGENYAFADM

SEQ ID NO: 228316 - protein, 140 aa, Glycine max
  Coding DNA Sequence Number=SeqID_111538
  Gene Ontology: Mol. function=protein disulfide isomerase activity; Cellular component=endoplasmic reticulum; Biological process=cell redox homeostasis
  Homolog annotation: Hit_ID=P29828; Match level="QueryCoverage=90%, HitCoverage=24%, E-value=7e-46, Identity=66%"; Hit description =Protein disulfide-isomerase precursor
MLFINFTAEGAGFFKSRYREAAEQYRQQGLRFLVGDAKSTKGSFQYFGVKEGQVPLIIVQRNDGKKFLKPNLEPDHISTWLKACKEENIVPYFKSEPISEDNNEPVKVVVGDSIQDIVFNSGKNVIVLLFLFGFIPRIIR

SEQ ID NO: 228317 - protein, 91 aa, Glycine max
  Coding DNA Sequence Number=SeqID_111539
  Subcellular localization annotation: CTP_CleavageSite=22; ConfidenceScore=5.00e-01
MSSVSLHGRSRLPQLQCQQRKTASSVESRGRRLPPDSMEEAFFRRQKEGQNDIIKISDPKFAQAGIQLAYAKDVTSTLSKRLACASGCLHH

SEQ ID NO: 228318 - protein, 63 aa, Glycine max
  Coding DNA Sequence Number=SeqID_111540
MAGSHCPKSLPLPKGKAIGIEGDSMIITHSKGRQKNTKGKRGREQARATRYHFKTNGKVFAKL

SEQ ID NO: 228319 - protein, 92 aa, Glycine max
  Coding DNA Sequence Number=SeqID_111541
MIWAFQTIFRSWIASAGGSNPARLGELGGNLLPLFPIKRQKGVVLGELGGNLLPLFPIKRQKGAVLKVPDPLGYAFQLFWVEKIVSVKKIQV

SEQ ID NO: 228320 - protein, 161 aa, Glycine max
  Coding DNA Sequence Number=SeqID_111542
  Gene Ontology: Cellular component=membrane
  Homolog annotation: Hit_ID=Q2SG06; Match level="QueryCoverage=99%, HitCoverage=61%, E-value=5e-21, Identity=51%"; Hit description =Permease of the drug/metabolite transporter (DMT) superfamily
MPHRWHCWWCVLASRWSRCCWWDCFAAAGCRSPAMAEGVTPGLIATIMGIQPILTLCLVERRLPGRRLLGLNGRAGGADTAGVAQSGGVAAADQRRAVCAGRAAVHDLRCHHAAAGDAASGAGAAAAVRREFTGCACWCCPLNLFMSASRYISGWLRCSSA

SEQ ID NO: 228321 - protein, 60 aa, Glycine max
  Coding DNA Sequence Number=SeqID_111543
  Gene Ontology: Mol. function=transcription factor activity; Biological process=regulation of transcription, DNA-dependent
  Homolog annotation: Hit_ID=Q3KDH6; Match level="QueryCoverage=98%, HitCoverage=19%, E-value=2e-15, Identity=62%"; Hit description =Transcriptional Regulator, LysR family
MAALRIDHVERIVGRTPVGEDLHQPSGLQIRGRSVTERLNDAQTRHRRGKVRVALIDANA

SEQ ID NO: 228322 - protein, 227 aa, Glycine max
  Coding DNA Sequence Number=SeqID_111544
MTRGDTLRLSAPFCHPESSGPMTRGDTLRLSAPLCHPEAAGPMTRGDTLRLSAPFCHLEAAGPMTRRDKIWSFCTLVSSRGGGPDDMRRYLTVIRTLLSSRGGGPDDKQRPMWSFCTLVSSRGGEPDDKQRPMWSSTPMCHPEAAGPMTRRDKIWSFCTLVSSRGGGPDDTRRYLTIIRTLLSSRGGGPDDKQGPMWSFCTLRQSRPTSPLTCGDLHHLPHLQDLSH

SEQ ID NO: 228323 - protein, 191 aa, Glycine max
  Coding DNA Sequence Number=SeqID_111545
MDRSMIDAASGCAFMDKTPIAARQLISNMEANYQQFDARVAAPSSTATNELFYSMVVDNQRLEDKLTEFTSLVRKQNKLLMFLPCNMDNHLDLNNNNNIILTPNTYNPGWRDHPNLSKYQAPPFIQQQFQQSTPTPAQPIQNSSFGPSLEELMKQMYINNIRFQQNVSATIQDLKTQIGQSTTNINQLQQQ

SEQ ID NO: 228324 - protein, 54 aa, Glycine max
  Coding DNA Sequence Number=SeqID_111546
MEVEETYQGLWLPLHYQVDKGALCCKIPSLVGVLVRAKGGVRDWKCGRQALWLI

SEQ ID NO: 228325 - protein, 76 aa, Glycine max
  Coding DNA Sequence Number=SeqID_111547
MAPRKLASKRSRKDKAERRVQLRDDEYTDFQEEIVRQQWASVVTPMAKFDPDVVPESYANAWPTEEGVRDMRSWVT

SEQ ID NO: 228326 - protein, 84 aa, Glycine max
  Coding DNA Sequence Number=SeqID_111548
MCESTSSRSRYKLHVVVVTPTYIFPNDAPIALRSYLVSPQWFFFDMFHFEDSPCCCCCTMLKRHVKRIRPHVGDLHGVESTYMA

SEQ ID NO: 228327 - protein, 374 aa, Glycine max
  Coding DNA Sequence Number=SeqID_111549
  Gene Ontology: Mol. function=transcription factor activity; Biological process=regulation of transcription, DNA-dependent
  Homolog annotation: Hit_ID=P67662; Match level="QueryCoverage=66%, HitCoverage=80%, E-value=1e-129, Identity=91%"; Hit description=HTH -type transcriptional activator aaeR
  Pfam annotation: Domain name=DUF1440; Domain location=303-360; Score=- 54.7; E_value=0.00044; Accession=PF07274.2; Description=Protein of unknown function (DUF1440)
  Pfam annotation: Domain name=LysR_substrate; Domain location=50-254; Score=151.7; E_value=1.9e-42; Accession=PF03466.10; Description=LysR substrate binding domain
  Pfam module annotation: Pfam domain module=DUF1440::LysR_substrate; Domain location=303-360::50-254
SKLEDELQVKLLNRSTRSIGLTEAGKIYYQGCRRMLHEVQDVHEQLYAFNNTPIGTLRIGCSSTMAQNVLAAMTADMLKEYPGLTVNLVTGIPAPDLIADGLDVVIRVGALQDSSLFSRRLGSMPMVVCASKSYLAQYGVPEKPADLSNHSWLEYSVRPDNEFELIAPEGISTRLLPEGRFVTNDPMTISRWLVAGAGIAYVPLMWVINEINSGVLEILFPRYQSDPRPVYALYTEKDKLPLKVQTFIQEYSFATIRNSELTLPPPALYLNNSLDDVKQGKEMNIFEQTPPSRRRYGLAAFIGLIAGMVSAFVKWGAEVPLPPRSPTDLFTAACGPEQLIRAAGFTGGCVSPAFCSYDLLPADGADTTAVCTSL

SEQ ID NO: 228328 - protein, 444 aa, Glycine max
  Coding DNA Sequence Number=SeqID_111550
  Gene Ontology: Mol. function=sugar porter activity; Cellular component=integral to membrane; Biological process=carbohydrate transport
  Homolog annotation: Hit_ID=Q1Z3R8; Match level="QueryCoverage=93%, HitCoverage=89%, E-value=1e-147, Identity=64%"; Hit description =Putative sugar-proton symporter
  Pfam annotation: Domain name=MFS_1; Domain location=41-404; Score =34.3; E_value=4.3e-07; Accession=PF07690.6; Description=Major Facilitator Superfamily
  Pfam annotation: Domain name=Sugar_tr; Domain location=37-437; Score =74.7; E_value=3e-19; Accession=PF00083.14; Description=Sugar (and other) transporter
  Pfam module annotation: Pfam domain module=MFS_1::Sugar_tr; Domain location=41-404::37-437
MSRPIPYRWCDSRTLTLVRRVAVNNHQHLNMRYVWSICLVAACGGLLFGYDWVVIGGAKPFYEAWFNVTDPAASGWAMSSALVGCVFGALVSGWSADKLGRRLPLIVAALLFVVSAIGTALASSFTLFVWWRILGGVGIGIASALSPMYIAEISPADKRGKFVAVNQLTIVIGVLAAQLVNLMIADPVVGASTHAALRETWNGQVGWRWMFASAAVPSLAFLLLMMWVPESPRWLMLAGQPQRALAMLNKIGSPAYAQQTQREIARALEQDRQQTRARASSLLAPRTLPIVITGIVLAIFQQWCGDFCFGRFRYQRYAEVDRGHRPDQFAGNSAGTAAGGPARSPQTDADRRRRTDAVLCTDCRCLHAGHHRLAGADSGTGGDCGLCADAGTGHLGAAGGNFPQPDSRSGDVGRHAGTVDCLFCADLYLSHPQCRTWCSGQLYA

SEQ ID NO: 228329 - protein, 82 aa, Glycine max
  Coding DNA Sequence Number=SeqID_111551
  Subcellular localization annotation: CTP_CleavageSite=36; ConfidenceScore=5.17e-01
MAFLGETSSQTVVNSTLGFIFPNGSIVHNDSGVSFQASTPVPIRVPNGCDFQTLKTRIHNTLKLTDKQFLDEIYYRQSFTYA

SEQ ID NO: 228330 - protein, 138 aa, Glycine max
  Coding DNA Sequence Number=SeqID_111552
  Gene Ontology: Mol. function=catalytic activity; Cellular component =endoplasmic reticulum; Biological process=metabolic process
  Homolog annotation: Hit_ID=Q4ACU1; Match level="QueryCoverage=51%, HitCoverage=26%, E-value=3e-19, Identity=60%"; Hit description =Delta7 sterol C-5 desaturase
MTPRNQIKNCAFSVSVCSSHFIFSLCVYLFTLIIPSLLNDDGGPISSNNVVAEQRIFEAVRRGHGLVQSHCVGNPLAALRVGPTPALPPDVASQLPRRRPPLPPLRPPVVLLHLLLEAQRLCSQRDGIFWLGCEMGFD

SEQ ID NO: 228331 - protein, 58 aa, Glycine max
  Coding DNA Sequence Number=SeqID_111553
MKEALAQAFEDRHYVEKQAIKWQLIGDFSYKKTLTRLMLRSSRVNAYFVDVKQKEEKK

SEQ ID NO: 228332 - protein, 53 aa, Glycine max
  Coding DNA Sequence Number=SeqID_111554
MDKALLFMNYHSLIQMNFEPRRVVHVVGLNGITTKWGYEEKETLEEILVKDLE

SEQ ID NO: 228333 - protein, 124 aa, Glycine max
  Coding DNA Sequence Number=SeqID_111555
MNKYGKIQRGKGILDKYGKIPCHRHRRWWLNHPRWFCKRAAMAARGAAMIALRSGVVVIAKKRHWWLEGQSWSHKGATLKNEVGTVGKRRKILELDGEVEKENVRKGEGLGGEKKRGGEVGKEI

SEQ ID NO: 228334 - protein, 113 aa, Glycine max
  Coding DNA Sequence Number=SeqID_111556
  Gene Ontology: Mol. function=catalytic activity; Cellular component =endoplasmic reticulum; Biological process=metabolic process
  Homolog annotation: Hit_ID=Q2QCX6; Match level="QueryCoverage=97%, HitCoverage=78%, E-value=4e-45, Identity=69%"; Hit description =Sterol-C5-desaturase DWF7
MNVSHFVCWKQPLFSLCLAFHPLDGILQALPHSLCLFFMPIHFTTHLVLIFIEGIWTANIHDCIHGKLWPVMGAGYHTIHHTTYRHNYGHYTIWMDWLFGTLHNPEEDEGKAM

SEQ ID NO: 228335 - protein, 131 aa, Glycine max
  Coding DNA Sequence Number=SeqID_111557
MYGNGRCREDAGLHPSLKLVWALCHGLASVKLSQHFLRTFSSCASIGETFLVTSSIVLYFGDMLLLTIKKLHGLLMSSELVTAEYEISRSEISIIIQGLVLGLLLYPIALKYILQIWEWFINTASAEAKRY

SEQ ID NO: 228336 - protein, 193 aa, Glycine max
  Coding DNA Sequence Number=SeqID_111558
DRELRGSSNGIIGGYHKWLRVRTQGLDWLPNLKTVRDDEVKASEESDEVQALKAELERARVVEEKFKSIAIKESSRVKGMISEEVKGIITGQRHDLEGRAKGNMWAIIDKCKEKLNLAATHEQRLEDEYAKISAEREARERVIDSLHQEATMWTDRFALTLNRSQELPRLLAKAKAMADTYSAPKEIHGLLSY

SEQ ID NO: 228337 - protein, 36 aa, Glycine max
  Coding DNA Sequence Number=SeqID_111559
TSPFLGRIASTGPFLGRIASIIMVLVQYFLYVYIHY

SEQ ID NO: 228338 - protein, 52 aa, Glycine max
  Coding DNA Sequence Number=SeqID_111560
  Gene Ontology: Mol. function=phosphoenolpyruvate carboxykinase (ATP) activity; Biological process=gluconeogenesis
  Homolog annotation: Hit_ID=Q94LX9; Match level="QueryCoverage=98%, HitCoverage=7%, E-value=2e-17, Identity=82%"; Hit description =Phosphoenolpyruvate carboxykinase
MAMAQLYEQAIKYEKGSFITSTGALATLSGAKTGRCPRDKRVVKDDVTKNEL

SEQ ID NO: 228339 - protein, 175 aa, Glycine max
  Coding DNA Sequence Number=SeqID_111561
  Gene Ontology: Mol. function=DNA binding; Cellular component =mitochondrion; Biological process=DNA integration
MVGCDPKGTFSVGAKLSRSRIFFGFLSDSPYEVASLFVDDSPPSMGIMVSVPYAFRLVKSSTQGPENDSISCLCMSVILRMFNRGDKVLDPYPCQEVFVSLSFELSVVVDDDSIWEVVLGDKVSLGELFHLAGHNFLKWSCFYPLGEVFNNDNPSMSIPHMAKGQAPHGEGPKGA

SEQ ID NO: 228340 - protein, 231 aa, Glycine max
  Coding DNA Sequence Number=SeqID_111562
  Subcellular localization annotation: CTP_CleavageSite=17; ConfidenceScore=5.31e-01
MGHMRSCKFVFILSSLSSNSFSNELFHVQSTNCVPFRSRESEACSHGLQNRSRWFLDELKHIKWRPPHIGTKQGWQDRTNNMRRGRKEVEVIDKVGDLRKHWSEEKHLPRIPPDDIQDLKSCLLYQQFQVYLERILRKPKIDAFAKELKPHQEESFYMFSEWGKHYCKVFSRHGNGARQGQIEAVIHFDDDTEELQRWDQQTNSEATVVLLLGRILLPKLRLKAYEVVLHV

SEQ ID NO: 228341 - protein, 258 aa, Glycine max
  Coding DNA Sequence Number=SeqID_111563
  Homolog annotation: Hit_ID=UPI0000503967; Match level="QueryCoverage =86%, HitCoverage=82%, E-value=6e-09, Identity=28%"; Hit description =UPI0000503967 related cluster
  Subcellular localization annotation: CTP_CleavageSite=72; ConfidenceScore=5.31e-01
MNCVFVHVSSTFELRAMRSDCLVQFSILNFFRSPMNCVFVHVSSTFEFGAMRSDCLVQFSILNLFRSPMNCVFVHVSSTFEFGAMRSDCLVQFSILNLFWEPMNCVFVHASSTFEFGAMRSDCLVQFSILNLFRSPMNCVFVHVSSTFEFGAMRSDCLGQFSILNLFRSPMNCVFVHVSSTFEFGAMRSDCLVQFFILNHFRSPMDCVFVHVSSTFEFGAMRSDCLVQFSIVNLFRSPMNCVFVHVTSTFDFGAMRCD

SEQ ID NO: 228342 - protein, 64 aa, Glycine max
  Coding DNA Sequence Number=SeqID_111564
MASHPNGSVKMNVDGSCLFPSLHIGVGVVLRDHHYAWIFGYSSFDARKPYAKGVSVTASIPTYI

SEQ ID NO: 228343 - protein, 635 aa, Glycine max
  Coding DNA Sequence Number=SeqID_111565
  Gene Ontology: Mol. function=transporter activity; Cellular component= intracellular; Biological process=transport
  Homolog annotation: Hit_ID=Q6ZCZ7; Match level="QueryCoverage=94%, HitCoverage=91%, E-value=1e-137, Identity=46%"; Hit description =Phosphatidylinositol transfer-like
  Pfam annotation: Domain name=CRAL_TRIO; Domain location=161-348; Score=94.3; E_value=3.7e-25; Accession=PF00650.10; Description =CRALTRIO domain
  Pfam annotation: Domain name=CRAL_TRIO_N; Domain location=56-125; Score=49.8; E_value=9.2e-12; Accession=PF03765.5; Description =CRALTRIO, N-terminus
  Pfam module annotation: Pfam domain module=CRAL_TRIO::CRAL_TRIO_N; Domain location=161-348::56-125
MSGVVEEGGVELVENSEEERRRSRIGSLKKKAISASSRFTHSLKKRGKRKIDFRVPIEDVRDAEEEFAVQELRQRLLLRDLVPTRHDDYHAFLRFLKARDFNIEKTIQMWEEMLTWRKEYGTDAILQIIIWSHHTLAHYPKSLTSQDFEFEELEEVLQHYPQGYHGVDKEGRPVYIERLGKAHPSRLMRITTIDRYLKYHVQEFERALQEKFPACTIAAKRRISSTTTVLDVQGLGMKNFSPTAASLLAAISKIDNSYYPETLHRMYIINAGPGFKRMLWPAAQKFLDAKTIAKIQVLEPKSLCKLLDIIDSSQLPDFLGGTCTCPGEGGCLRSSKGPWNDPDIMKMVHSVEATFERQIARMSNEQQNLDSFWICPQKASLNLQLYPFLISQGQCSDTSTAESGSDLDDSFSSIGQSRFTFPRLAAVHEEVRVSDNYYSCDDSAPAAEKVLESDEFHITQEQSLQNDDTGNIACMENSTGTSVNNWFSFVKEKVEKTNLLYVSRVVIYFMERLVMFFRSLRLEFWRTQNNIYPSVAMEHNNNPAAASEILSERDHILRCMQRLERLEKTFGELSHKPAGIPLEKEHMLTNSLDRIKSVEFDLEKTKRVLHATVMKQLEIAELLENLQASKSQVLI

SEQ ID NO: 228344 - protein, 48 aa, Glycine max
  Coding DNA Sequence Number=SeqID_111566
MDKALLFTNCHSLIQMNFDPGRVIHVVGLNGITTKWGYEVEAWSASFH

SEQ ID NO: 228345 - protein, 215 aa, Glycine max
  Coding DNA Sequence Number=SeqID_111567
TETILDPASPIRQHVKWRMTHTKNSGQMTFEEEQSAQGNFIAYECQDVLIASIGRLEQSRRVRADRDGVTIKQYFGPASTSSCTSTSISQKMTRQLILSFSQMQSQGLVPSPEPEVAHFTVPVSTKGSCVDPSGQDLDTGPQSCTTVPLGNDQVKVGVEGVRDGDARVPISTEVVQLVGQTLNTFLAWTTHLVQHFSEKDKLGSEGPSKPIEHGA

SEQ ID NO: 228346 - protein, 275 aa, Glycine max
  Coding DNA Sequence Number=SeqID_111568
  Gene Ontology: Mol. function=RNA-directed DNA polymerase activity; Biological process=RNA-dependent DNA replication
MALIMNCITTYYLSLKWNGEKLDSFAPNRGLRQGDPMSPYLFVLCMEKLALLIQEKVIEGKWLPIKVSKDGSMVSRLFFADGGLLFAHAKSSEVHIIKESSKVSIIEGKGHQCQLFSFLDRVNYKLVGWKRVCDNNDKLMRGFVWNKPSTHWVNWESTITQHKSCVGLSIRRARETNIALLRKHILPAMYLKGVSILNVEPKDEASYTWQSIMKVVHDLKAGFKFRIGRGHISLWCCLAEESSLHVVCDCSMVKTVWLVLFHELPRNFFKMDVND

SEQ ID NO: 228347 - protein, 50 aa, Glycine max
  Coding DNA Sequence Number=SeqID_111569
MLISARFRRSAFKDGRSLKIATSKTVIVAPSLKVSTFHDVGIYNGHPPSL

SEQ ID NO: 228348 - protein, 268 aa, Glycine max
  Coding DNA Sequence Number=SeqID_111570
  Homolog annotation: Hit_ID=Q1SZB3; Match level="QueryCoverage=18%, HitCoverage=10%, E-value=4e-10, Identity=68%"; Hit description=Heat shock protein DnaJ, N-terminal
MAQPLVKKDDDRDDEGALPLSVIPIGDILEVKALTNCSNDVINLDTGEHKGYSFVAFKTKEVAQKAIEEIHSKEFKGCQRHGSSTKKNKDYQEKLPVVVLRVEEIIYSKANSEVCKKPGEEGARDISGIEEPGWKPKLNVHYEKAGCKNVDDFPCILFLPSFGVCPFHYEKLVLVFSSACNKAKLLKVKVLIADKEYQSAIAESGFLLKEDENNLEAFSWCLPLIISKVGNLFHYLICYVLVITDNFLVAGKFFRECTVGLESLMKQA

SEQ ID NO: 228349 - protein, 137 aa, Glycine max
  Coding DNA Sequence Number=SeqID_111571
MRSLFKYVNESVLKKKNPIFEVGEEGGGDGRCRKPSTKMREVGIESERESENKERRERTLLHSSHNFKIPNPSFTLHSSQMCVFGVPHLAVLRHLVSSDASCEMRKKIIDPSSEKKFHGVRQRLWGKWVAEVQNLAR

SEQ ID NO: 228350 - protein, 115 aa, Glycine max
  Coding DNA Sequence Number=SeqID_111572
  Gene Ontology: Mol. function=binding
  Homolog annotation: Hit_ID=Q10PS3; Match level="QueryCoverage=79%, HitCoverage=13%, E-value=1e-37, Identity=86%"; Hit description=HEAT repeat family protein, expressed
MAEILVHRAGSPDEFTRLTTITWINEFVKLGGDQLVPYYADILGAILPCIADKEEKIRVVARETNEELRALKADPAEAFDVGAILSIARSLNVHLTNQGNLLDVIKRLTTKLILR

SEQ ID NO: 228351 - protein, 140 aa, Glycine max
  Coding DNA Sequence Number=SeqID_111573
MAKYDPEIVMEFYANAWSTKEGFRGKHSWVWGQWIPFDEDDFAQRVPGRRVRIMCTSMTTLTQIWMTLLLSNILPSDHNSDLPLPKCQLVYAILTQDHASQTPSGPREVQQSTGVSSLDHGPLPVLWGVGESHKAYPASH

SEQ ID NO: 228352 - protein, 66 aa, Glycine max
  Coding DNA Sequence Number=SeqID_111574
MSTASYVVDMGKKMLQMGIEDQKISFDLFHVDQEPPDRNVCFKVHVMEERRPEKKVLEVGTLLDPG

SEQ ID NO: 228353 - protein, 79 aa, Glycine max
  Coding DNA Sequence Number=SeqID_111575
  Subcellular localization annotation: CTP_CleavageSite=23; ConfidenceScore=5.07e-01
GPTMLNGMPWGSSMISTRCVRVVSSEKWRLRKPSGVMATIELSSIYGIKVVSYPNFVRGPLLDDMQLLFGPCEVLGTHH

SEQ ID NO: 228354 - protein, 62 aa, Glycine max
  Coding DNA Sequence Number=SeqID_111576
MGAKHLTRTKEWSHVIKQRSPDEIRSKVKPEKIPKRECLALTGKAHSGSQPVLTMEHTDYKN

SEQ ID NO: 228355 - protein, 211 aa, Glycine max
  Coding DNA Sequence Number=SeqID_111577
MVPPPSSSTPMVLPSIALASTSTSFHPRVSLDHIYTSNDVDSLWGMGYKPKQKTPASFVLAFDKNLIRSAGFQHENGRRHQERLSIVAFLEVEFSKWRATVRTVWRVECPKVASAIVALIEAVRSNHQLSSKVGSVLAKLLRTRLDSDELFKCCKDLQEEKRNLAGRVEDVAVEKDELAKKVVDLEAWLKELESAPEESKLWAIREREASK

SEQ ID NO: 228356 - protein, 34 aa, Glycine max
  Coding DNA Sequence Number=SeqID_111578
MQLDLDAFDYLPLERLGFRLGRMCMNGIDVLLIS

SEQ ID NO: 228357 - protein, 86 aa, Glycine max
  Coding DNA Sequence Number=SeqID_111579
MGIDHCIVGLQRGILVSASHQLALTTSLPFVHTARRSYRLNGPVKCSDCGDNPVNHRVFERKLRPKPLGRGHACLGVTHRFPNANM

SEQ ID NO: 228358 - protein, 180 aa, Glycine max
  Coding DNA Sequence Number=SeqID_111580
  Gene Ontology: Mol. function=helicase activity; Biological process =protein amino acid phosphorylation
  Homolog annotation: Hit_ID=Q1SN45; Match level="QueryCoverage=88%, HitCoverage=9%, E-value=6e-31, Identity=43%"; Hit description=AAA ATPase
MADDIVYNYKKSSRSPALQLDDRTLQNLVLLEIEKLLQANQRSLTDYPSMPYPEDANCLTYLDNSLILAKLNYNNQELRSEFEHLFSHMTDEQASIYNHIVEVVDKDEGGMFFLYGYGGTGKTYIWKTLTSSLRDDNKIVIMVVSSVIASLLLPGGKTAHSKFQFQFLKTQLAISIKELN

SEQ ID NO: 228359 - protein, 236 aa, Glycine max
  Coding DNA Sequence Number=SeqID_111581
  Gene Ontology: Mol. function=hydrolase activity; Cellular component =cytosol; Biological process=metabolic process
  Homolog annotation: Hit_ID=Q9FI75; Match level="QueryCoverage=99%, HitCoverage=38%, E-value=2e-82, Identity=79%"; Hit description =Similarity to 5'-nucleotidase
  Pfam annotation: Domain name=5_nucleotid; Domain location=22-236; Score=88.6; E_value=1.9e-23; Accession=PF05761.4; Description=5' nucleotidase family
MEVRSMGENWWTCGKRVDGSFSTHSSLCPKLWLTCRWLTNLMVGLYHPILAPLIIKGFIRLDLQVVGKALIAAHVEGRLKSEIMSNPEQFVEPDPELLFTLLDQKEAGKKLVLITNSDYHYTHKMMHHSFNRFLPNDMGWRDLFDIVIVSANKPEFFQMSHPMYEVVTEEGLMRPCFKAQTGGLYSGGSAQMVESSLNIHGDEILYIGDHIYTDVSQPKVHLRWRAALICRELEEE

SEQ ID NO: 228360 - protein, 200 aa, Glycine max
  Coding DNA Sequence Number=SeqID_111582
  Gene Ontology: Mol. function=hydrolase activity; Biological process =metabolic process
  Homolog annotation: Hit_ID=Q9FI75; Match level="QueryCoverage=68%, HitCoverage=23%, E-value=2e-57, Identity=77%"; Hit description =Similarity to 5'-nucleotidase
MVSLVGIDVHAAFEGPVEEARTEARKAEDLLKKLDIPSPSLRNSPRGIFCTRTLNLRSISAIGYDMDYTLVHYNVKAWEGRAYDYCMENLKNMGFPIDGLAFDPDLVIRGLVIDKEGGNLVKADRFGYIKRAMHGTKMLSTRAVSIFCQALSAEGQFCGALFIQHREASLHANKPAPPPEPKSRVARPEPPDVSSESNRR

SEQ ID NO: 228361 - protein, 95 aa, Glycine max
  Coding DNA Sequence Number=SeqID_111583
MLCRDDSRGTPSPGPRESHLTDLSSLAHEAPGFVFVARTRRPGARGAVVIPSLPTRTAHVATIRTLHRTIQSVGATGGVYKGQGRSQRELMTRAY

SEQ ID NO: 228362 - protein, 84 aa, Glycine max
  Coding DNA Sequence Number=SeqID_111584
  Homolog annotation: Hit_ID=Q9S7C5; Match level="QueryCoverage=34%, HitCoverage=4%, E-value=3e-08, Identity=93%"; Hit description =Protein phosphatase 2A A subunit
MEGCAALGKLLEPQDCVAYILPVIVNFSQASVKKDSLPIGKEAMLGAFSLLKVIESELQAYLSTTEGRVWGVRWNMDELVMERT

SEQ ID NO: 228363 - protein, 131 aa, Glycine max
  Coding DNA Sequence Number=SeqID_111585
  Gene Ontology: Mol. function=metal ion binding; Cellular component =nucleus; Biological process=regulation of transcription, DNA -dependent
  Homolog annotation: Hit_ID=Q1RSW3; Match level="QueryCoverage=90%, HitCoverage=19%, E-value=4e-35, Identity=58%"; Hit description =Fibronectin, type III-like fold
MTTDWGLNSLALTGREYVPLVGSSKKGWPNTPCNLETLKDGPGKNKRSNSSCKYRENVFGKRGAPKMEAHPRREVIRWLECEGHIEKNFRHKFLTWHSLRATSQEVRIAKIYIDTFLEDPTSLAEQLVDTF

SEQ ID NO: 228364 - protein, 123 aa, Glycine max
  Coding DNA Sequence Number=SeqID_111586
  Gene Ontology: Mol. function=zinc ion binding; Cellular component =integral to membrane; Biological process=carbohydrate metabolic process
  Homolog annotation: Hit_ID=Q1SJU0; Match level="QueryCoverage=93%, HitCoverage=25%, E-value=1e-49, Identity=74%"; Hit description=Zinc finger, DHHC-type
  Pfam annotation: Domain name=zf-DHHC; Domain location=81-123; Score =38.9; E_value=1.6e-08; Accession=PF01529.11; Description=DHHC zinc finger domain
MLASLKEEDPHFSNPVLIGGVILTVLDFIFLFMTSGRDPGIIPRNAHPPELDEPLDINTPSMEWVNNRAPNLKLPRVKDVLVNGHTVKVKFCDTCLLYRPPRASHCSICNNCVQKFDHHCPWV

SEQ ID NO: 228365 - protein, 67 aa, Glycine max
  Coding DNA Sequence Number=SeqID_111587
MRFGDSGVPMEELAVECIGDGEDEERAGSEGEEAMEELGGEREHVGEVCEDPREEKEGEAKFKNVKG

SEQ ID NO: 228366 - protein, 103 aa, Glycine max
  Coding DNA Sequence Number=SeqID_111588
  Homolog annotation: Hit_ID=Q9LJG2; Match level="QueryCoverage=99%, HitCoverage=17%, E-value=3e-24, Identity=56%"; Hit description =Genomic DNA, chromosome 3, P1 clone: MJL14
MYGNVTYVPRTFYANREEMLKSYAESVAGNDGFALWFGDIVQAFSTIELSTSPNSMQMDVSRSKGSHLKILVSNEGAGDSVALLGVIRLVQYLSHNHLLGKQR

SEQ ID NO: 228367 - protein, 296 aa, Glycine max
  Coding DNA Sequence Number=SeqID_111589
  Subcellular localization annotation: CTP_CleavageSite=40; ConfidenceScore=5.15e-01
MMDREVISIGSSSLEDTRHGASNNESSSSRGRSSSGGDVRATPRVRHSHSTGSALSRPIVVGYEWVKLASPEDSCKIVVQACRSDDFPFLRAASSSSPFFFMYRCLFEVLGLILPLTAFQYAMLEHLNVAPSQLHPHSWAMVKAFEILCLFFNIRPSVLVFLFFFQMKLTGVGSLASHSTSSLTLLGSSRLMRICWPLSSLTQMSFAILRTISLRFKLFNEDLLTLVERVDKAILEQLSALLDTRAILSLLSESDPLAALDGIMGDFTWRPLVKQVGLTGGTVPPSTAAPVVGERG

SEQ ID NO: 228368 - protein, 117 aa, Glycine max
  Coding DNA Sequence Number=SeqID_111590
MSTPDNLTEAVQTIPVQARGLDKLYRPDNICQHMRARQTRHPLLVKDTTLDTKQYPSTHDNPFRHWTISFACKPTQSLEGLCIVKGPKNTCGTLHGTSRYVSTLHINLGTGVQTLNP

SEQ ID NO: 228369 - protein, 70 aa, Glycine max
  Coding DNA Sequence Number=SeqID_111591
MPLSQNSIQTTPETPPPPPTTIDGHHEPSLLATEPPHQEEHFNQSGILKIHLKDSVEKNPLIPFFHSFFE

SEQ ID NO: 228370 - protein, 288 aa, Glycine max
  Coding DNA Sequence Number=SeqID_111592
  Gene Ontology: Mol. function=nucleoside-triphosphatase activity; Cellular component=membrane; Biological process=oligopeptide transport
  Homolog annotation: Hit_ID=Q66A56; Match level="QueryCoverage=81%, HitCoverage=96%, E-value=1e-100, Identity=80%"; Hit description=ABC peptide transporter, ATP-binding subunit sapF
  Subcellular localization annotation: CTP_CleavageSite=60; ConfidenceScore=5.48e-01
MIKNCATDVNRREDSSTSVSNGVNRAAFSATVVALNARAATPRRLTLRQNGWQSAVWLSRAAARPARQRCRRAPPLRPDASPLQHQVHQLRTHGHVQRGEGFISDNHLRLQNQRARQRQTLLLAGGQHVRIVAGVVAQQPDLTQRGNDALFACFIIKIGIQPQRKVEDLADALARIERRRRILKNHANPLAAVAVIAVAKRVIVNQHLTFSWRHHAAQHLRQRGFARTVFADNGQRLLFTQGKTDVFHRFNMLAPEQPGAVAVGFAQVAHFQQGFHYWLSIFSGKWQA

SEQ ID NO: 228371 - protein, 183 aa, Glycine max
  Coding DNA Sequence Number=SeqID_111593
  Gene Ontology: Mol. function=RNA-directed DNA polymerase activity; Biological process=RNA-dependent DNA replication
MHVGHILLGHPWQFHCKVTHDGYKNRYALVLNNCNIMLTPLRSAEAYVDQSECKLREEQLNIQEKERKEIKNESEQKKEKNKKEDKEEKNKKVSAFAKKREVESTLMAREQLLVLMYNDVYFTNDFNSSLPCEIVSLLQEFVDVFLEEIPYGLPLLRGQPIGKVQKKQRRFKAKLMSSCKRDL

SEQ ID NO: 228372 - protein, 212 aa, Glycine max
  Coding DNA Sequence Number=SeqID_111594
  Homolog annotation: Hit_ID=Q1SPQ1; Match level="QueryCoverage=32%, HitCoverage=14%, E-value=8e-08, Identity=47%"; Hit description =Polynucleotidyl transferase, Ribonuclease H fold
MEAIFAGEHFQNLHGPAELERPYDSSYSDPRATKVFWKELFQILGTQLAHRSLDHPQTDGQIKNPMKQFYGPLWILRRIGIVAYELKLLASSRSHPVFFVSLLKTCHGQLASQVVPLPVDNTNHVIPEPLCILGKDKFQTLKGNLLDAPIPNSLVHCLKLDILSRNYLSGEIPMQLAINGKLYGPPLNEKLDEKLSRMLPRQECGRLACTID

SEQ ID NO: 228373 - protein, 107 aa, Glycine max
  Coding DNA Sequence Number=SeqID_111595
  Homolog annotation: Hit_ID=Q1STK9; Match level="QueryCoverage=88%, HitCoverage=80%, E-value=1e-16, Identity=50%"; Hit description =Gonadotropin, beta chain; Peptidase aspartic, active site
MDHCDSEISLKESQSLKQLYPYNDINSLNGKNVKGHLESNYLNHQWDIRAKPSIFNVCYVAHHDLKWFRRCGYNVQKFHNTVFQNFIVCSGKVDQGWLVEIGESGLG

SEQ ID NO: 228374 - protein, 212 aa, Glycine max
  Coding DNA Sequence Number=SeqID_111596
  Gene Ontology: Mol. function=RNA-directed DNA polymerase activity; Biological process=RNA-dependent DNA replication
  Homolog annotation: Hit_ID=Q1T0R3; Match level="QueryCoverage=76%, HitCoverage=72%, E-value=4e-19, Identity=32%"; Hit description =Hypothetical mitochondrial protein atmg00310
MMRRIGFRPYGGVPTKQRIVTGRSHCTIPIFYCSRSIEWSYEASFAKGILVGVARKITRLQREFLWGGNDGVKKIASVKWDVVCRSREQGELGIKNIKLFNIALLGKWRWRLLREERLLWSLVLKSKYGELVKMLVRKVSNLDSIWWRDLVETCGERREESWFDNNITWKLGDGKRLNFWHNIWVGNQTLASKFNRLFLNSMQKEGFIGDVG

SEQ ID NO: 228375 - protein, 122 aa, Glycine max
  Coding DNA Sequence Number=SeqID_111597
  Gene Ontology: Mol. function=beta-galactosidase activity; Cellular component=beta-galactosidase complex; Biological process =carbohydrate metabolic process
  Homolog annotation: Hit_ID=Q5CCP8; Match level="QueryCoverage=53%, HitCoverage=7%, E-value=4e-21, Identity=68%"; Hit description=Beta-D- galactosidase
MKRTICQVCSPCKLSYLFHGKPVYCLLSPNGSTPSLKNLIENEYGAQSKLQGATGQNYVNWAAKLAVEMGTGVPWVMCKEDNAPYLVINTCTGFYCDKFVSSAVDIKNHEIFFTSIVYFFLR

SEQ ID NO: 228376 - protein, 981 aa, Glycine max
  Coding DNA Sequence Number=SeqID_111598
  Gene Ontology: Mol. function=protein binding; Cellular component =membrane; Biological process=defense response
  Homolog annotation: Hit_ID=Q1SWU6; Match level="QueryCoverage=98%, HitCoverage=97%, E-value=0.0, Identity=54%"; Hit description=Disease resistance protein
  Pfam annotation: Domain name=LRR_1; Domain location=594-615; Score =14.7; E_value=0.34; Accession=PF00560.23; Description=Leucine Rich Repeat
  Pfam annotation: Domain name=LRR_1; Domain location=617-639; Score =9.8; E_value=4.2; Accession=PF00560.23; Description=Leucine Rich Repeat
  Pfam annotation: Domain name=LRR_1; Domain location=641-663; Score =11.0; E_value=2.5; Accession=PF00560.23; Description=Leucine Rich Repeat
  Pfam annotation: Domain name=LRR_1; Domain location=775-796; Score =4.1; E_value=49; Accession=PF00560.23; Description=Leucine Rich Repeat
  Pfam annotation: Domain name=LRR_1; Domain location=865-886; Score =6.4; E_value=18; Accession=PF00560.23; Description=Leucine Rich Repeat
  Pfam annotation: Domain name=LRR_1; Domain location=888-910; Score =9.2; E_value=5.3; Accession=PF00560.23; Description=Leucine Rich Repeat
  Pfam annotation: Domain name=NACHT; Domain location=192-345; Score= -39.3; E_value=0.067; Accession=PF05729.3; Description=NACHT domain
  Pfam annotation: Domain name=NB-ARC; Domain location=151-453; Score =266.4; E_value=5.8e-77; Accession=PF00931.13; Description=NB-ARC domain
  Pfam module annotation: Pfam domain module=LRR_1::LRR_1::LRR_1::LRR _1::LRR_1::LRR_1::NACHT::NB-ARC; Domain location=594-615::617 -639::641-663::775-796::865-886::888-910::192-345::151-453
MAEFVIETLLGNLNSLVQKELQPFLGFDQDLERLSGLLTTIKATLEDAEEKQFSNKDIKDWLGKLKHAAHNLDDIIDECAYEVMRLEYEGVKCGPLNKLQCYCLSSFHPKRVVFHYKISKKMKRISERLREIDEERTKFPLIEMVHERRRRVLEWRQTVSRVTEPKVYGREEDKDKILDFLIGDASHFEYLSVYPITGLGGLGKTTLAQFIFNHKRVINHFELRIWVCVSEDFSLERMMKAIIEAASGHACTDLDLGSQQRRIHDMLQRKRYLLVLDDVWDDKQENWERLKSVLSCGAKGASILVTTRQSKVATILGTVCPHELPILPDKYCWELFKQQAFGPNEEAQVELADVGKEIVKKCQGVPLAAKALGGLLRFKRNKNEWLNVKDSKLLELPHNENSIIPVLRLSYLNLPIEHRQCFSYCAIFPKDERIGKQYLIELWMANGFISSNEKLDVEDVGDDVWNELYWRSFFQDIETDEFGKVTSFKMHDLVHDLAESITEDVCCITEENRVTTLHERILHLSDHRSMRNVDEESTSSAQLHLVKSLRTYILPDLYGDQLSPHADVLKCNSLRVLDFVKRETLSSSIGLLKHLRYLNLSGSGFEILPESLCKLWNLQILKLDRCIHLKMLPNNLICLKDLKQLSFNDCPKLSNLPPHIGMLTSLKILTKFIVGKEKGFSLEELGPLKLKRDLDIKHLGNVKSVMDAKEANMSSKQLNKLWLSWERNEDSELQENVEGILEVLQPDTQQLRKLEVEGYKGARFPQWMSSPSLKHLSILILMNCENCVQLPPLGKLPSLKILRASHMNNVEYLYDEESSNGEVVFRALEDLTFRGLPKFKRLSREEGKIMFPSLSILEIDECFSRLWKLWLSNCRDVGDLQALQDMTSLKVLRLKNLPKLESLPDCFGNLPLLCDLSIFYCSKLTCLPLSLRLTNLQQLTIFGCHPKLEKRCEKETGDDWLNIAHIPHISVGYKHYDHISD

SEQ ID NO: 228377 - protein, 400 aa, Glycine max
  Coding DNA Sequence Number=SeqID_111599
MVKRQNQTQTTQVDPDFKNNPSSASSEDVLGITVKLSVETIAQAISCKRRSTKFMNSWWNELKDHIGLKGLLVQCPQVPFVPLDGGHYLLSNTQVDDSILSELHQKFGLNTGQDDQLDAVWEKATKEEDRVDVDTSQAEKRTKKKMNANSSKVASAPQRPPPTLVAPKGTDGFEFRKRKVAPPSIENNVTQVKKVKPTPKTSTVSQLEISLRRIKVIHLRKRKVTESNVDMDNEVPHQAPLSPIHLDRFEHQGPPVIDPSLNAEDIARLFVLVDFLSENAYNIKKKTGCEIPTFNRLDGLKSFLHQLGSAFILREVVNYDKDIIGWCQKIDAQHIDPSSNDLLPLFMCPKHIQLYTPSQIAMRLPPLDLRKKKGKVPPHTKPMPHLGPKGNTALCPTPYD

SEQ ID NO: 228378 - protein, 263 aa, Glycine max
  Coding DNA Sequence Number=SeqID_111600
  Gene Ontology: Mol. function=DNA binding; Cellular component =chromatin; Biological process=DNA integration
MSSDFNCKLKGHEVLKELPLEIVKLYEEIETLRDKLGKFVGDHEALNKIIKDKLGKFDSKCHSGILLRYSKSSKAYRVEETIHLVSNTLVDDQPEEAREPTEHLLRKHHLESRIIGDPKDKVQTRNSLKHTTLLSGTEPKHIDDAMSDEHLVKAMEEELEQFQKNDVWKLLELPKGNTNVGAKWVFKNKLDETALYGLKQAPRAWYEKLSSFLTKNGFISGKVDTTLFRKDYGSQFLIIQLYVDNIIFDATNDSLCEDFSKLM

SEQ ID NO: 228379 - protein, 37 aa, Glycine max
  Coding DNA Sequence Number=SeqID_111601
MEPYTHNFVIIRAIKNLESMTLEELIRILKVHEQELA

SEQ ID NO: 228380 - protein, 82 aa, Glycine max
  Coding DNA Sequence Number=SeqID_111602
MVMSGVRGMTLYSMRKYPLTSIHVYRPNHHSGIVATYPSAGGRRVTRGMRVPRKEYARSRHQRLFEENVGKTGKDVIYKFFK

SEQ ID NO: 228381 - protein, 111 aa, Glycine max
  Coding DNA Sequence Number=SeqID_111603
MCSYGAVKVLVAVLKRGTVTVKENESCVLFGYRKIGRKKGSDDREGTCYTFFLLLGTSVRKTLAPIFDVFLEVVDVEASKPITVVYNRIRSSNKRKKDKGKVVVVPLKITF

SEQ ID NO: 228382 - protein, 88 aa, Glycine max
  Coding DNA Sequence Number=SeqID_111604
MPARSRDALCQEFMMKHEYESLKEEDKAWGKKLNFIADQDIVDYYWMIVFIPSMIVFVLSVVYLIAGRSSQTVIVAPISRTHWLFYIN

SEQ ID NO: 228383 - protein, 57 aa, Glycine max
  Coding DNA Sequence Number=SeqID_111605
MKKKNTESRRDEDENIQSKNGPLRGAKPFFLSPSRHFIAKMRVVAAQLAQASLVAST

SEQ ID NO: 228384 - protein, 76 aa, Glycine max
  Coding DNA Sequence Number=SeqID_111606
MGKGRRWKLKVLSCNGKWVWEDNLSRVKHEVEEIKEAVWDYDGDKCLRLDGYNFTFVKTNWHILHEDFTKVVQEFH

SEQ ID NO: 228385 - protein, 204 aa, Glycine max
  Coding DNA Sequence Number=SeqID_111607
  Gene Ontology: Mol. function=RNA-directed DNA polymerase activity; Biological process=RNA-dependent DNA replication
  Homolog annotation: Hit_ID=Q1SKV6; Match level="QueryCoverage=59%, HitCoverage=25%, E-value=1e-15, Identity=42%"; Hit description=RNA -directed DNA polymerase
MGGRFMLNGVMVANEVTDEWIRGCVESASISVLVNGSPMEEFGMQRGLRKGGPLAPLLFLCVAEVLARLMREAEEKRLIKGVKGVLWGKGEEGGKITWLKWDKFCCPNMGSPIEKGRGTGVGSYLGGEKDLNGKRRWRINYLKMPYDYERNAFGQNPNKKELAKEKSGTTKQQLFVPLVLSAFGKCTTSLPRLHFFTGSVVFVF

SEQ ID NO: 228386 - protein, 80 aa, Glycine max
  Coding DNA Sequence Number=SeqID_111608
MAKMLLFGLSILSPRLLNNKKLHKMVLKPDTSIASKDHLRYGETVLGHMDLEVSFKDIFYIGFFRTDIENPSKHTIQHRF

SEQ ID NO: 228387 - protein, 171 aa, Glycine max
  Coding DNA Sequence Number=SeqID_111609
  Gene Ontology: Cellular component=extracellular region
  Homolog annotation: Hit_ID=Q1SNF1; Match level="QueryCoverage=63%, HitCoverage=83%, E-value=1e-31, Identity=61%"; Hit description =Expansin 45, endoglucanase-like
  Pfam annotation: Domain name=DPBB_1; Domain location=94-168; Score =29.2; E_value=1.4e-05; Accession=PF03330.8; Description=Rare lipoprotein A (RlpA)-like double
MVSFALLHLGVMGSVLTVLTTTLRRSKVTMAPHMEAKIMALSHLEVGNHGGNASRRFFYLTEIVLASIVGVFEAHAATACDGNRLGQFPPGNLFVTVNEGLWDNGAVCGRRYKISCVSGNNRPCKGGSINVKVVDSCSRSPCPNTLLMSKDAFVAISHFPHAKINIEYTRI

SEQ ID NO: 228388 - protein, 485 aa, Glycine max
  Coding DNA Sequence Number=SeqID_111610
  Gene Ontology: Mol. function=RNA-directed DNA polymerase activity; Cellular component=chromatin; Biological process=chromatin assembly or disassembly
  Subcellular localization annotation: CTP_CleavageSite=77; ConfidenceScore=5.24e-01
MAPIPALEASVSITNGAEKSGRAKIGAWHKASFSLVNALSASGNPESPRNPRRFRTDRGGGHCCTAVTFSGTGSTPRAETMSAQVLQMIREGLIIDQNIIKKYDEEFPQVRSKNGVHSFLKGRRGVAKPKRHYQKLVMAVVVNTEAPCPVPLLDEEYWGGEGTCNGADDAILKHCIDLRFDFLLLEVGISGWELADNDKDSGLGTWWGYGRRQSWGGLMAVNSVSDEPFNSINLPLCMNFMTRKNMQVNGEIDSLNVDCNIRTNLGALYCVAIADKHTKGSSGLIRHEGLFGPGADRAGPGGSGLSILGLGVLSAGSSSARRSRNREGQRWPLVNFSLQWKHSPHSRRLAISSGVKHLMGKGGGLVGEGSNGRLSVGDTTERGCVRALAAGGPELRDRRQESGPGGKLMVSGHPLKQREGWTIHVEGRDREPLGLRGVAEEDDGEGVGLAVFSRFVTAVNKFIKFFSHGALSMKAPVVMNWHWEI

SEQ ID NO: 228389 - protein, 229 aa, Glycine max
  Coding DNA Sequence Number=SeqID_111611
  Subcellular localization annotation: CTP_CleavageSite=44; ConfidenceScore=5.72e-01
MSTVHPQELSRPTSYDQSTTSPLVPFSSPNPQRQSKSSLSLPTPALHKPATAIAPLTWPVSTQIATTHSVATPPPSIPIDIINCTLVGKTLNQIHNTTFCKKLVLWHSNGVARIILGCGDVDKRKIKGAVGVAIACLSSVAAGNVGVTLLPCRDHLFILAIKACTEGFHESVFKLQENISHHQQDFCNSGYASVEHHERVLRMLNFGRLNVSSKPVKWYTMPKKFCITG

SEQ ID NO: 228390 - protein, 558 aa, Glycine max
  Coding DNA Sequence Number=SeqID_111612
  Gene Ontology: Mol. function=RNA-directed DNA polymerase activity; Cellular component=chromatin; Biological process=chromatin assembly or disassembly
  Pfam annotation: Domain name=Chromo; Domain location=464-521; Score =16.2; E_value=0.012; Accession=PF00385.14; Description='chromo' (CHRromatin Organisation MOdifier
  Pfam annotation: Domain name=rve; Domain location=173-317; Score =85.7; E_value=1.5e-22; Accession=PF00665.16; Description=Integrase core domain
  Pfam module annotation: Pfam domain module=Chromo::rve; Domain location=464-521::173-317
MAQAVQTPEQPVYLARLMKYDYTIHYCVGKHNLAADALSRLPDSPQNLPDTTQGQELKMELTANDEFRAKRKQIQEEPEKHSDYIIRDELILQHDHIWLPRDLHLLPTILAEFHSTPTGGHMRIMKTMARIHENFTWASMKQDIQCYITNCITYQQIKTDHRHPPGLLCPLPIPARPWEDLSLNFIMGLPSYHEKLVILVIVDRFSKGIHLGSLPQHHTAFSVAQLFMEISGKLHGMPRSLVSDKDPLFLSRFWQELFKMSGTKLRMSSAYHPQSDGQTESMNRNLATWGRFLVWAEWSYNTSVHSATGLTPYEVTFGKQPPSLPQYLARNLNVQAVDEWLTQRETIIASLIKKLTKAQQRMKEITDKRRRDVSYEEGDTVLVKLLPRRQTSVIGEAYLKLTKRYYGPFQIVKKIGSVAYQLNLPSSSRIYPVFHCSLLKPYHSSNTEVPLDLPASSEGNEPLITPLAILDTKWENTPTGRQLLILVQWTGLVPEDTSWEKWEPLKRDYNLEDKVVLEAGRNVMNPKLTRRTEQFKGKEAGAKRRISRPKYLDDYMAK

SEQ ID NO: 228391 - protein, 148 aa, Glycine max
  Coding DNA Sequence Number=SeqID_111613
  Gene Ontology: Mol. function=transmembrane receptor activity; Cellular component=membrane; Biological process=defense response
  Homolog annotation: Hit_ID=Q1SI46; Match level="QueryCoverage=75%, HitCoverage=10%, E-value=1e-27, Identity=54%"; Hit description =Leucine Rich Repeat, putative
MNKAKKIYRLRELNFIGALELFHLIIFNQSYYRREYDDLSKRMVHYAKGIPLVVKVLARRLCGKSKEVWESELDKLKKMPPTKVYDVMKLSYDDLDRTERQMFLDLSLFIKNLAKTLEVVVGCRMLMTFVKYFKATRVMRALEAYKLT

SEQ ID NO: 228392 - protein, 61 aa, Glycine max
  Coding DNA Sequence Number=SeqID_111614
  Gene Ontology: Mol. function=glutamate-ammonia ligase activity; Biological process=nitrogen compound metabolic process
  Homolog annotation: Hit_ID=O82560; Match level="QueryCoverage=64%, HitCoverage=11%, E-value=6e-14, Identity=90%"; Hit description =Glutamine synthetase cytosolic isozyme 2
MVAMKSSAIAKLEKRHKEHIAAYGEGNEHRLTGQHEIADMNTFVWDVLQATRMQLDSKVSN

SEQ ID NO: 228393 - protein, 300 aa, Glycine max
  Coding DNA Sequence Number=SeqID_111615
MTTYSNNKRQYITLKALSHLASKRGCPMLKEILSCQGRFSDVEVNSLVNVFATVATSLLSASVEATNAIVMPPPPTSAPSIPLSSVLAATLPSLSSHPMSPCITCTPPTKLIHYGARVSGSCMHVTREAARTGNAVSCFCIRVTRGVACTEDVVVCSCICNTHGMVCTNDTMACSYIHLTHGTTLTGDVVACSCIRLTRGVACTRNMRLTKDGLWVYEPSTCAMLLHACNSWSGTGSPRADLGFDEPSTCVMLLHTCHSWSGTYWIHGAFGELTRELSVLGFGETYQSWTLDLMSLAHIS

SEQ ID NO: 228394 - protein, 108 aa, Glycine max
  Coding DNA Sequence Number=SeqID_111616
MALYSVSALLVATTFCVLALVTKLPHTRGKSEYPSQKILREPESEPQIRQNIPLGVIGAIVDPAFIVVSKSAPVLIAGKSIVLKPPTQKSFIYTNRLIESTSKTKAYF

SEQ ID NO: 228395 - protein, 198 aa, Glycine max
  Coding DNA Sequence Number=SeqID_111617
MDLSCGLGCVQPWEDQKELFYDQMPEARAIVVIAGLYVVLWDGDGGSSVQLYAKECSKLLLHVLKRGPSKKDDEVVTSIGDEKENYDVVRQGLEKEDDILREQIGVHGTEKSIDSCDQRFVACFSNAPDSRLNISSGEEDSNIPINCKVDSYHCQLIIMEISVVVFGIVWGVSGALVKAEFNNGGNVAKLWFACMVEL

SEQ ID NO: 228396 - protein, 90 aa, Glycine max
  Coding DNA Sequence Number=SeqID_111618
MAAYLLLDSSSRLATEGSNNELKLQREERDQSRMEGMILKDELKTCLMSKRSLSQQLSETKANMLAIIGKHKEELGLATTHEHKVADEYA

SEQ ID NO: 228397 - protein, 313 aa, Glycine max
  Coding DNA Sequence Number=SeqID_111619
  Gene Ontology: Mol. function=receptor activity; Biological process =protein amino acid phosphorylation
  Homolog annotation: Hit_ID=Q84KS6; Match level="QueryCoverage=82%, HitCoverage=78%, E-value=2e-21, Identity=31%"; Hit description =Membrane located receptor-like protein
RKLRPSGVVGGARTLVSIFAAILLLFQPNCIAKQQHQPCPPSSCGIIGNISFPFRLKDDPSHCGDTRYQLDCVNNATLLTLFSGKYHVQDIDYKRYKIKVSDAGAVEDSNCFIPRNFLWDGNFRPTGLVGPDDFGSQPFVLDLDFTRIGYFNCANPVTGDPRYVKVDTTHTSRCATQGQGHVYALLEPSYLEYRVKDITVGCDLMVATLANWSLSEAEKGNFTYDEIHKRIIEGFQLSWLPVICENRCGKGTKCVINESNGEVQCDRHFCHYAYHTTDKCGMNGSLTVTLRHGKKTRTRGYPPESVPTLTGNT

SEQ ID NO: 228398 - protein, 434 aa, Glycine max
  Coding DNA Sequence Number=SeqID_111620
  Gene Ontology: Mol. function=protein kinase activity; Cellular component=cell surface; Biological process=protein amino acid phosphorylation
  Homolog annotation: Hit_ID=Q1S8T2; Match level="QueryCoverage=81%, HitCoverage=54%, E-value=1e-122, Identity=60%"; Hit description =Protein kinase
  Pfam annotation: Domain name=Pkinase; Domain location=118-388; Score =172.3; E_value=1.3e-48; Accession=PF00069.15; Description=Protein kinase domain
  Pfam annotation: Domain name=Pkinase_Tyr; Domain location=120-388; Score=146.4; E_value=7.5e-41; Accession=PF07714.7; Description =Protein tyrosine kinase
  Pfam module annotation: Pfam domain module=Pkinase::Pkinase_Tyr; Domain location=118-388::120-388
MTCFYTYTKPLQQFWGYTRAYLRGIIFGIGSRITFSTKQLDNAVGLQYFDGGIFVGRNVIPIFLAARYLIGVVLLFVLLIYKWRRRHLSIYENIENFLLDSNLNPIRYGYKEIKKMTGGFKVKLGQGGFGSVYKGKLRSGLDVAVKILTKSNDNGQDFINEVATIGTIHHVNVVRLIGYCVEGKKRGLVYEFMPNGSLDKYIFSKEKGIPLSHEKIYEISLGIAGGIAYLHEGCDMQILHFDIKPHNILLDVNFVPKVSDFGLAKLHAENDGVVNLTAARGTLGYMAPELFYKNIGGVSYKADVYSFGMLLMEMASRRRNSNPHAEHSSQHYFPFWIYDQFKEEKNINMNDASEEDNILSKKMFMVALWCIQLNPSDRPSMSRVVEMLEGKIESLELPPRPSFHKNQTYVHDDDDIVSDQTSFTNSTYSDSYLG

SEQ ID NO: 228399 - protein, 61 aa, Glycine max
  Coding DNA Sequence Number=SeqID_111621
ACARQGDLDSYCLVFLSESVMWKRLGYFLGDVMIVNPYSWEQNDNSRIHEVRFFCGAAEPM

SEQ ID NO: 228400 - protein, 125 aa, Glycine max
  Coding DNA Sequence Number=SeqID_111622
MSNRKYESGYEKLKKKRKVEKLIESQRGALDKFIIIHKNDAEASSIGENVIEQPLIDHTDNEENVIEQPPIDNTDNGVEQPPRDDTNNGENMIEQPPINNTDNTNSHNFNLELEDYFRNRSRREC

SEQ ID NO: 228401 - protein, 89 aa, Glycine max
  Coding DNA Sequence Number=SeqID_111623
METISKRFEQLDVCGKVHLKSKLREIAYPDMNSMCPPPEKGKTKADANCGHQAIAALLGVWVDKDLASQRSILRKLLKEATRKLLEEAS

SEQ ID NO: 228402 - protein, 320 aa, Glycine max
  Coding DNA Sequence Number=SeqID_111624
  Homolog annotation: Hit_ID=Q1SKD7; Match level="QueryCoverage=43%, HitCoverage=44%, E-value=5e-07, Identity=26%"; Hit description =Ankyrin
ERRVQLIEDKYSDFQEEIAHRHWTPLVTPMAKFNPEIVLEFYANAWPTEEGDDHRCKFSQRRDQASSFDEEVIAQLLCIPRQDFAQTAAGRRVWIMRTSMTTLTQIRMTLLLSNILPSGHNFDLPLPKCQMVYTILTLMTVHVAQIIADAIYLFAGTAPTRHPLDPERSNRALGFSALITGLCQFYGVLVIPSKVIQPPITRVFIEKHCTPRQAKGDTQQAADAPPPQQPDPVIPLSVEQYLRHMVRQQTANNRVQGQGSPPFVRPTPEQFKAKVAWPGDWPTEEGTGPAGSPGEAEEAHMDEDMTDLLGYLGEGGATRP

SEQ ID NO: 228403 - protein, 76 aa, Glycine max
  Coding DNA Sequence Number=SeqID_111625
MVITQALCNRYTKTQSYMQCGIMSVKNLVGPLGVHDKTNHILLGQATLTRMLQLCGISTDLKEHSNRVYLPPMVRL

SEQ ID NO: 228404 - protein, 232 aa, Glycine max
  Coding DNA Sequence Number=SeqID_111626
  Gene Ontology: Mol. function=RNA-directed DNA polymerase activity; Cellular component=intracellular; Biological process=RNA-dependent DNA replication
MVKKANNKWQICIDYTNLNKACPKDAYHLLNIDRLVDGAFRFQVLSFLEAYYGYNQIKIYASNEEKKEFITKYANFYYKVMPFGLKNAGTTYYRWIDRIIKQQSHSIAQHVANLGEDFGELCKYNMCLNSEKCTFKVDGGKFLGFMITHRGIETNLNKCIAILEMQSPTNVQEVQKLNGTLASSSKFLPKLAEKEKSLYKLIKKTKPFLWDKTCEQAFLAFKKTIRFCESLN

SEQ ID NO: 228405 - protein, 77 aa, Glycine max
  Coding DNA Sequence Number=SeqID_111627
MAGQVPVELLALPKFGSKIQLDELFNRLSSFKLVWLGKLPGGKIGCHFYAFYIALWCLLLICCDCHDLSCQGGQLHI

SEQ ID NO: 228406 - protein, 157 aa, Glycine max
  Coding DNA Sequence Number=SeqID_111628
  Gene Ontology: Mol. function=DNA binding; Biological process=DNA integration
  Homolog annotation: Hit_ID=Q1T192; Match level="QueryCoverage=53%, HitCoverage=16%, E-value=5e-09, Identity=34%"; Hit description =Polynucleotidyl transferase, Ribonuclease H fold
MAYGRPYLHMRYFQVNFTSLVIIFRSGLASIHLVKKKGAQTAEIVRRGVWSVCKLLASSSCLCEVKGMSLEHLLDDSLEVSGLFGVGQLGEQVCSCATFPEYEVHLKAFEIFNKSFGNMVVLEQHCLLGDIVKAFKDDSFPASLNVGHAVNVDAPPV

SEQ ID NO: 228407 - protein, 577 aa, Glycine max
  Coding DNA Sequence Number=SeqID_111629
  Homolog annotation: Hit_ID=Q84UR3; Match level="QueryCoverage=45%, HitCoverage=32%, E-value=4e-77, Identity=53%"; Hit description =Proline-rich protein family-like
  Subcellular localization annotation: CTP_CleavageSite=64; ConfidenceScore=5.49e-01
MKQEPLASPTTSSLPQPTITTKNVIKIQNSLTPSRLRLPSKYREPPKTPPEVVNNGMVSTPLRRAKSVTPELKHNSRIKKGLVLNKAKPNEEVLGTTQRGREVEEAKVVSRFVRPHAVEQFSRPRSGVGDFAFKRDKEDPDGKSKKELMEKLEASESLIKNLQSEVLALKAELEKVKGLNVELESNNRKLTEDLAAAEAKVVSLSGNEKEPNGEHQSPKFKLIQKLIADKLERSIVKKESITNGGFVKASIPAQTAIPEVTTTRTGRKPTCNSCLPPPPPPMPPSIPSRPIAKANNTQRAPAFVKLFHTLKNQEGMKSTTGSGKQQRPVAVNVHSSIVGEIQNRSAHLLAIRADIETKGEFINDLIKKVVEAAYTDIEDVLNFVNWLDGELSSLADERAVLKHFNWPERKADAIREAAVEYRELKSLEQEISSFKDDPEIPCGASLRKMASLLDKSESSIQRLIKLRNSAMRSYQEYKIPTAWMLDSGIMTKIKQASMTLVKMYMKRVTMELGSARNSDRQSSQESLLLQGMHFAYRAHQFAGGLDAETLCAFEEIRQHVPAHLAGSRELLAGIASS

SEQ ID NO: 228408 - protein, 167 aa, Glycine max
  Coding DNA Sequence Number=SeqID_111630
MEQRYEEELRKLKADHDQLDARVRRPQGDEHSTYTLPKCTQGDSQSTLKMIQVSPTSTILQVDIPLGWKPLNLERYDETIDLDEHQDVFLTQANLYTNDNAILRHVFLTSIKEATLISYGGLPPRSIDNFDTLSRILSEQSEEKLEKSQGTAIDAAIVVGRHVSPLR

SEQ ID NO: 228409 - protein, 91 aa, Glycine max
  Coding DNA Sequence Number=SeqID_111631
CQFYRVPVAPSKFIRPRINWAFIKKYCAPRQAQGETPQQPRDGRQWATNALPPPLEFTSAHPQTVIRRPAQDVKEALLGGNLVPFKSLLVI

SEQ ID NO: 228410 - protein, 71 aa, Glycine max
  Coding DNA Sequence Number=SeqID_111632
  Subcellular localization annotation: CTP_CleavageSite=5; ConfidenceScore=5.14e-01
VASLRSFHEKTSLRSFLEKTSLRSFLEKTSLRSFFEKTSLRSKNLATHTPLITKLTSLRSFLKKIPKEARA

SEQ ID NO: 228411 - protein, 364 aa, Glycine max
  Coding DNA Sequence Number=SeqID_111633
AWTRYTDNVVGRHILAERKVEIYHIELDEFKGELERCNFHKRLTNLADSSINLVLVKEFYANLYSPEGPSPKQVRIRGHLIRIDVDSLNEFLETLVVLAEGEYLPAYSRYCRMPTDTREIEAALCIPNRGFILNAEGHPGKILRKDLIILAQVWSVLSYSNLAPTSHTSDLTMDRASLTPALITTLCRTRGVAFDSLVFERLSPIINLAYIRKNCWNPDDPTIIIKGTRRPRASPAETPSTSMAPHLASTSAAPPPTRITAAPFTPHTADFQHSIPTVEQFNEWVAWPGTQPPPHRDDEDPAAQVPHQSSDESSESSTPEPLIRKRRIVVTQEAATTPEKSPEATPEPLTPMADTTSPQLAADP

SEQ ID NO: 228412 - protein, 179 aa, Glycine max
  Coding DNA Sequence Number=SeqID_111634
  Homolog annotation: Hit_ID=O04892; Match level="QueryCoverage=47%, HitCoverage=21%, E-value=7e-22, Identity=53%"; Hit description =Cytochrome P450 like_TBP
RGGRCKTQGASPGGAVVGADLGGTGEARLIALCARTPKGNRPAHPGNGSAGGRVQRLEEHRTSRGVRLWVDGTMYARESRQNGSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 228413 - protein, 77 aa, Glycine max
  Coding DNA Sequence Number=SeqID_111635
MHSQQVTRDRQRQQVSVDIEQVSPELETGRQQLYPAVVHHPCYFTVKAVTTTAILKHFMMACTVATRGLRVHAVMGY

SEQ ID NO: 228414 - protein, 133 aa, Glycine max
  Coding DNA Sequence Number=SeqID_111636
  Gene Ontology: Mol. function=serine-type endopeptidase activity; Cellular component=chloroplast thylakoid membrane; Biological process=proteolysis
  Homolog annotation: Hit_ID=Q9FL12; Match level="QueryCoverage=88%, HitCoverage=19%, E-value=9e-41, Identity=70%"; Hit description =Protease Do-like 9
MQTPVPSFAETQKLRYGKDYEFDAPVKLLEKHLHSMAQSVDEQLVVVSQVLVSDINIGYEEIVNTQVLAFNDKPVKNLKSLANIVESCDDDYLKFDLEYQQKVVLKTSTAKAATLDILTTHCIPSAMSDDLKT

SEQ ID NO: 228415 - protein, 382 aa, Glycine max
  Coding DNA Sequence Number=SeqID_111637
  Gene Ontology: Mol. function=serine-type endopeptidase activity; Cellular component=chloroplast thylakoid membrane; Biological process=proteolysis
  Homolog annotation: Hit_ID=Q9FL12; Match level="QueryCoverage=90%, HitCoverage=66%, E-value=1e-150, Identity=73%"; Hit description =Protease Do-like 9
  Pfam annotation: Domain name=Trypsin; Domain location=87-274; Score =66.5; E_value=8.5e-17; Accession=PF00089.16; Description=Trypsin
MARTKRKRGRKPKNATDEETASQDYSTASKNGANEPSDPDSQEPRRGRPKKIMVASLERCSSRLADSKGDCTAAVKVVPSMEAVVKVFCVHTEPNFSLPWQRKRQYSSSSSGLIVGGRRVLTNAHSVEHHTQVKLKKRGSDTKYLATVLAIGTECDIAMLTVSDDEFWEGVSPVEFGDLPALQDAVTVVGYPIGGDTISVTSGVVSRMEILSYVHGSTELLGLQIDAAINSGNSGGPAFNDKGKCVGIAFQSLKHEDVENIGYVIPTPVILHFIRDYEKNGAYTGFPILGVEWQKMENPDLRMSMGMGPDQKGVRIRRIEPTAPESHVLKPSDVILSFDGVNISNDGTVIIHYIAATFDLVRENIQGGGPIRSEPVNTYMYI

SEQ ID NO: 228416 - protein, 1140 aa, Glycine max
  Coding DNA Sequence Number=SeqID_111638
  Gene Ontology: Mol. function=protein serine/threonine kinase activity; Cellular component=integral to membrane; Biological process=protein amino acid phosphorylation
  Homolog annotation: Hit_ID=Q6YVY8; Match level="QueryCoverage=95%, HitCoverage=95%, E-value=0.0, Identity=51%"; Hit description =Putative receptor-like protein kinase
  Pfam annotation: Domain name=LRRNT_2; Domain location=43-86; Score =46.7; E_value=7.6e-11; Accession=PF08263.3; Description=Leucine rich repeat N-terminal domain
  Pfam annotation: Domain name=LRR_1; Domain location=148-170; Score =9.8; E_value=4.2; Accession=PF00560.23; Description=Leucine Rich Repeat
  Pfam annotation: Domain name=LRR_1; Domain location=172-194; Score =15.2; E_value=0.24; Accession=PF00560.23; Description=Leucine Rich Repeat
  Pfam annotation: Domain name=LRR_1; Domain location=196-218; Score =17.2; E_value=0.059; Accession=PF00560.23; Description=Leucine Rich Repeat
  Pfam annotation: Domain name=LRR_1; Domain location=220-239; Score =8.9; E_value=6.1; Accession=PF00560.23; Description=Leucine Rich Repeat
  Pfam annotation: Domain name=LRR_1; Domain location=241-263; Score =8.6; E_value=7.1; Accession=PF00560.23; Description=Leucine Rich Repeat
  Pfam annotation: Domain name=LRR_1; Domain location=266-288; Score =12.4; E_value=1.3; Accession=PF00560.23; Description=Leucine Rich Repeat
  Pfam annotation: Domain name=LRR_1; Domain location=290-312; Score =9.9; E_value=4; Accession=PF00560.23; Description=Leucine Rich Repeat
  Pfam annotation: Domain name=LRR_1; Domain location=314-336; Score =13.9; E_value=0.59; Accession=PF00560.23; Description=Leucine Rich Repeat
  Pfam annotation: Domain name=LRR_1; Domain location=409-431; Score =9.5; E_value=4.7; Accession=PF00560.23; Description=Leucine Rich Repeat
  Pfam annotation: Domain name=LRR_1; Domain location=433-455; Score =9.3; E_value=5.1; Accession=PF00560.23; Description=Leucine Rich Repeat
  Pfam annotation: Domain name=LRR_1; Domain location=456-477; Score =6.7; E_value=16; Accession=PF00560.23; Description=Leucine Rich Repeat
  Pfam annotation: Domain name=LRR_1; Domain location=576-598; Score =8.0; E_value=9.1; Accession=PF00560.23; Description=Leucine Rich Repeat
  Pfam annotation: Domain name=LRR_1; Domain location=601-623; Score =15.9; E_value=0.14; Accession=PF00560.23; Description=Leucine Rich Repeat
  Pfam annotation: Domain name=LRR_1; Domain location=625-647; Score =16.2; E_value=0.12; Accession=PF00560.23; Description=Leucine Rich Repeat
  Pfam annotation: Domain name=LRR_1; Domain location=649-671; Score =14.7; E_value=0.34; Accession=PF00560.23; Description=Leucine Rich Repeat
  Pfam annotation: Domain name=LRR_1; Domain location=673-695; Score =19.9; E_value=0.009; Accession=PF00560.23; Description=Leucine Rich Repeat
  Pfam annotation: Domain name=LRR_1; Domain location=697-719; Score =12.1; E_value=1.6; Accession=PF00560.23; Description=Leucine Rich Repeat
  Pfam annotation: Domain name=LRR_1; Domain location=721-740; Score =6.3; E_value=19; Accession=PF00560.23; Description=Leucine Rich Repeat
  Pfam annotation: Domain name=Pkinase; Domain location=861-1132; Score= 134.4; E_value=3.2e-37; Accession=PF00069.15; Description=Protein kinase domain
  Pfam annotation: Domain name=Pkinase_Tyr; Domain location=861-1132; Score=83.1; E_value=8.8e-22; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::Pkinase::Pkinase_Tyr; Domain location=...
  Pfam module annotation: Domain location=43-86::148-170::172-194::196 -218::220-239::241-263::266-288::290-312::314-336::409-431::433 -455::456-477::576-598::601-623::625-647::649-671::673-695::697 -719::721-740::861-1132::861-1132
  Subcellular localization annotation: CTP_CleavageSite=40; ConfidenceScore=5.79e-01
MFSFSSSFSSSSSSHSSSVIKWNSLAQFLFLVFFLFFASRNDAVSDKSTLLRLKASFSDPAGVLSTWTSAGAADSGHCSFSGVLCDLNSRVVAVNVTGAGGKNRTSHPCSNFSQFPLYGFGIRRTCSGSKGSLFGNVSSLSLIAELTELRVLSLPFNALEGEIPEAIWGMENLEVLDLEGNLISGYLPLRVDGLKNLRVLNLGFNRIVGEIPSSIGSLERLEVLNLAGNELNGSVPGFVGRLRGVYLSFNQLSGVIPREIGENCEKLEHLDLSVNSMVGVIPGSLGNCGRLKTLLLYSNLLEEGIPGELGSLKSLEVLDVSRNILSSSVPRELGNCLELRVLVLSNLFDPRGDVADSDLGKLGSVDNQLNYFEGAMPAEILLLPKLRILWAPMVNLEGGLQRSWGGCESLEMVNLAQNFFSGKFPNQLGVCKKLHFVDLSANNLTGELSQELRVPCMSVFDVSGNMLSGSVPDFSDNACPPVPSWNGTLFADGDLSLPYASFFMSKVRERSLFTSMEGVGTSVVHNFGQNSFTGIQSLPIARDRLGKKSGYTFLVGENNLTGPFPTFLFEKCDELEALLLNVSYNRISGQIPSNFGGICRSLKFLDASGNELAGPIPLDLGNLVSLVSLNLSRNQLQGQIPTSLGQMKNLKFLSLAGNRLNGLIPTSLGQLYSLKVLDLSSNSLTGEIPKAIENMRNLTDVLLNNNNLSGHIPNGLAHVATLSAFNVSFNNLSGSLPSNSGLIKCSSAVGNPFLSPCHGVSLSVPSVNQPGPPDGNSYNTATAQANDKKSGNGFSSIEIASITSASAIVSVLIALIVLFFYTRKWKPRSRVVGSIRKEVTVFTDIGVPLTFETVVQATGNFNAGNCIGNGGFGATYKAEISPGILVAVKRLAVGRFQGVQQFHAEIKTLGRLHHPNLVTLIGYHACETEMFLIYNYLSGGNLEKFIQERSTRAVDWKILYKIALDIARALAYLHDTCVPRVLHRDVKPSNILLDDDFNAYLSDFGLARLLGTSETHATTGVAGTFGYVAPEYAMTCRVSDKADVYSYGVVLLELLSDKKALDPSFSSYGNGFNIVAWACMLLKQGRAKEFFTAGLWEAGPGDDLVEVLHLAVVCTVDSLSTRPTMKQVVRRLKQLQPPSC

SEQ ID NO: 228417 - protein, 57 aa, Glycine max
  Coding DNA Sequence Number=SeqID_111639
MEKSLLASCGGSEVSDEAATMAMHKGYGIFFKPSKLKGMTHSEKLAVKQPHWHLFVE

SEQ ID NO: 228418 - protein, 134 aa, Glycine max
  Coding DNA Sequence Number=SeqID_111640
MVSKTASGMRPRSLRDLDEAKKDKIRCSHCNATRHKKETCFELHSYPEWFLEKRRQKRAKGKRSGQAKLIDYVAGIAAVATSQEFVHPRALNLLLSEREIGRYQTGDKKLSVVANIFAKIWDECGWKMDQIQNN

SEQ ID NO: 228419 - protein, 167 aa, Glycine max
  Coding DNA Sequence Number=SeqID_111641
  Homolog annotation: Hit_ID=Q1SVR0; Match level="QueryCoverage=42%, HitCoverage=33%, E-value=2e-08, Identity=40%"; Hit description=Helix- loop-helix DNA-binding
MSTRCPKMKIYMAMKLKQNLWHQLIHVAKPTQPSKWDIVAERFNFYLLNLLCKNKTWGLIITPLCSRKEYNKANGKGLYSAEITNTGKKKNKTQAIYSLKNNYSKAHQPKKASLSLLDKATLRGDMIIHLKELKTNAAQASEGLMIPKNNDKIRVEEGGFLHSVLYL

SEQ ID NO: 228420 - protein, 102 aa, Glycine max
  Coding DNA Sequence Number=SeqID_111642
MVSCMLQSHLSIELARMINSQQHGHSEQRQSREQRQSRDVWLWYVHILKQLNMCCSSSWKSSTTCEAEADAVLEALSWIGQLNMQHVTIELDCKIVVRGRVK

SEQ ID NO: 228421 - protein, 44 aa, Glycine max
  Coding DNA Sequence Number=SeqID_111643
MSSFLILCPIDTNPEIEVPANRLSVGTTSSIVVDPLLALGKIAK

SEQ ID NO: 228422 - protein, 179 aa, Glycine max
  Coding DNA Sequence Number=SeqID_111644
ISLIAQSNSSRLGFPTLIIALCKARGVTSDSLTYESLSPAINLAYIKKNCWNLDDPSVTFLRTCKSRARGSKAPSSSAAPAPPTSAPSTSALPLALAAPVLPGPFAQSSEPFMSMLQSLHQGQLLIMQSLQDVVQQRSVMSMEMFLQQVAWPRVLPSPLGRGEASAAQEPQPDQEDDSS

SEQ ID NO: 228423 - protein, 61 aa, Glycine max
  Coding DNA Sequence Number=SeqID_111645
MKADMEALKDQMTSMIEAMLSMKRIIESNMAATATEADPTHPSAINQANQPIPDVLGQGGE

SEQ ID NO: 228424 - protein, 299 aa, Glycine max
  Coding DNA Sequence Number=SeqID_111646
  Homolog annotation: Hit_ID=Q8TGM6; Match level="QueryCoverage=40%, HitCoverage=97%, E-value=2e-09, Identity=43%"; Hit description =Protein TAR1
MAHLELSIPWRGSTEQPHRPTYLNYPEGNFGGNQLLDGSISLSPLYPSQTNDLHVCSHSNPSQKIRVGRRCNPQGGSHQSASLRLYGFTRPLTRTHVRLLGPCFKDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGIL

SEQ ID NO: 228425 - protein, 48 aa, Glycine max
  Coding DNA Sequence Number=SeqID_111647
MTLEEEFRFEIIDNEAESLCFLYCDSGGIINQRVRSNKGTYTRSRKGG

SEQ ID NO: 228426 - protein, 151 aa, Glycine max
  Coding DNA Sequence Number=SeqID_111648
  Gene Ontology: Mol. function=hydrolase activity
  Homolog annotation: Hit_ID=Q6D2W5; Match level="QueryCoverage=92%, HitCoverage=50%, E-value=1e-40, Identity=57%"; Hit description =Probable hydrolase
  Pfam annotation: Domain name=Lactamase_B; Domain location=54-151; Score=7.0; E_value=0.042; Accession=PF00753.17; Description=Metallo -beta-lactamase superfamily
MSQAIFSYTTGKYQVSAISDGTMQASLSLLTDIHHDDAVDLQRQAGIAQPGDIHVFCYLLRGQGRVILVDTGMGKRDAHSGKLLPHLQLAGVTPDDIDTLLLTHAHPDHIGGLLDSSGQPVFRHARLCLSHSEAAFWQDDAAINQLSERAQ

SEQ ID NO: 228427 - protein, 119 aa, Glycine max
  Coding DNA Sequence Number=SeqID_111649
  Gene Ontology: Mol. function=hydrolase activity
  Homolog annotation: Hit_ID=Q6D2W5; Match level="QueryCoverage=86%, HitCoverage=36%, E-value=6e-27, Identity=54%"; Hit description =Probable hydrolase
MADEEISPGIRALALPGHTPGHCGFRIDSDGERLLIWGDIVHYPPVQLACPQVSIAFDIDPVMARETRRRILQQVAAENTVIAGMHFGASGFARIVALENGGYTASYVSACHDGEAGEP

SEQ ID NO: 228428 - protein, 205 aa, Glycine max
  Coding DNA Sequence Number=SeqID_111650
  Gene Ontology: Mol. function=transcription factor activity; Biological process=regulation of transcription, DNA-dependent
  Homolog annotation: Hit_ID=Q1BII2; Match level="QueryCoverage=96%, HitCoverage=66%, E-value=2e-21, Identity=34%"; Hit description =Transcriptional regulator, LysR family
  Pfam annotation: Domain name=HTH_1; Domain location=5-36; Score=30.3; E_value=6.8e-06; Accession=PF00126.17; Description=Bacterial regulatory helix-turn-helix protein, lysR family
  Pfam annotation: Domain name=LysR_substrate; Domain location=60-205; Score=-17.5; E_value=0.013; Accession=PF03466.10; Description=LysR substrate binding domain
  Pfam module annotation: Pfam domain module=HTH_1::LysR_substrate; Domain location=5-36::60-205
MTLTPLSRQIQQLESELGMVLFHREKKRLRLTDEGKRFLTEVTPFLQHHERLKEYAQHLQQGDVGRLDIGYVEAAIHSRLLPAALARLAPGAGIDVRLHALRSAQQIARLEAGAIDIAIVHTLPHDDADFVHKKIATEPLLLAMPASSALTAPVAADLHGRAWIADQENLNPAARARLLAACQRAGFQPDIRFEVNGPLAAPCLR

SEQ ID NO: 228429 - protein, 67 aa, Glycine max
  Coding DNA Sequence Number=SeqID_111651
MTEHSASPILVPKRCFRAWTLHADVDAGVGAGAGVAEEEETSDGLTLALLAPRKATVRSSTFQQFFL

SEQ ID NO: 228430 - protein, 193 aa, Glycine max
  Coding DNA Sequence Number=SeqID_111652
  Gene Ontology: Mol. function=binding; Cellular component=endoplasmic reticulum
  Homolog annotation: Hit_ID=Q00TV4; Match level="QueryCoverage=95%, HitCoverage=81%, E-value=5e-35, Identity=42%"; Hit description=[S] KOG3060 Uncharacterized conserved protein
MAMARGDGEEAEKIIRDIESSRDGDADGRASRARVAAKKSAGDDAGALRALTEYAERYGGDERGWLELGRAHAVKCAYEEALFCYEEVMCAMPFDPSAHRRCAETLYSMGGERNLRDAKNHFAAALDFTNGRDVRAMYGVVLCAKKLREYAEGGRAEGRELASAAAERLLQRYVEENESLLGVARPQLKGATS

SEQ ID NO: 228431 - protein, 258 aa, Glycine max
  Coding DNA Sequence Number=SeqID_111653
  Gene Ontology: Mol. function=ARF guanyl-nucleotide exchange factor activity; Cellular component=intracellular; Biological process =regulation of ARF protein signal transduction
  Homolog annotation: Hit_ID=Q010G4; Match level="QueryCoverage=99%, HitCoverage=21%, E-value=1e-120, Identity=82%"; Hit description=[U] KOG0929 Guanine nucleotide exchange factor
  Pfam annotation: Domain name=Sec7; Domain location=93-258; Score =220.9; E_value=2.8e-63; Accession=PF01369.11; Description=Sec7 domain
MYYDCGLTKPNVFEEVTSVLAQSSYPGDAELGPMHLLSLEGLLSIVQTVSNRTPSATPRPTFDFTNTTVVDPWSLADGMNDSGPARFEALSRIKYFKCRLLGAAEHFNRSYKKGLTFMQEIKLLPDPLEPAAVARFLKYAPALDKEVVGDYLGEPDEFIIAVLDEYAKLFDFRDVTLDRALRSFLSGFKLPGEAQKISRILECFAARYYEANPDSVADADSAYVLSYSIIMLNTDRHNAQVKNKMTLEQFIRNNRGTN

SEQ ID NO: 228432 - protein, 256 aa, Glycine max
  Coding DNA Sequence Number=SeqID_111654
  Gene Ontology: Cellular component=cytoplasm; Biological process =apoptosis
  Homolog annotation: Hit_ID=Q016B7; Match level="QueryCoverage=92%, HitCoverage=31%, E-value=2e-41, Identity=41%"; Hit description=[R] KOG2061 Uncharacterized MYND Zn-finger protein
DARTDEDEERERCTCNACARGCRGDDAWTCVRATGREEEEEEEEEDGQRSNGASVEGKSAGFGTMDVDGRGEETTGVAERAPTMEDSWDDPKSSAWCAEDVGAEALSAELDAMLMSVDSKASSSARAIEAEAKVEARRDGAAAAGRGGTKARATRDAYDDACSKQFVEYYLLADVEPRGTRAMSGKVTARARTLLARYAEREGVTVDDIVANAKEDSEWTGEAYERGEATNVDDAYLKFTKRLSRAPDQCARYDVS

SEQ ID NO: 228433 - protein, 44 aa, Glycine max
  Coding DNA Sequence Number=SeqID_111655
  Homolog annotation: Hit_ID=Q8GRZ5; Match level="QueryCoverage=93%, HitCoverage=15%, E-value=5e-08, Identity=69%"; Hit description =Phosphoenolpyruvate carboxylase kinase
MGDTEAVPVCDGFQKVLHERGGLRLRDSTINHAVENRVRLVEKR

SEQ ID NO: 228434 - protein, 83 aa, Glycine max
  Coding DNA Sequence Number=SeqID_111656
  Subcellular localization annotation: CTP_CleavageSite=41; ConfidenceScore=5.03e-01
MDRKQGFFSALKDEVVHGISPAWSRAKSPARSASPISSLLRCRNLMVNEFVYKIWYANECQCLFPTTSFQSMWKVDGVGVFGH

SEQ ID NO: 228435 - protein, 154 aa, Glycine max
  Coding DNA Sequence Number=SeqID_111657
  Gene Ontology: Mol. function=nucleic acid binding; Biological process= DNA integration
  Homolog annotation: Hit_ID=Q1SRN1; Match level="QueryCoverage=74%, HitCoverage=7%, E-value=2e-22, Identity=43%"; Hit description =Integrase, catalytic region
MVSASQSFVSHSFPNSIAKKLDDSNYLHWQQHVESVIKSQKLQCFVVNPVVPPRYLTEDDRIADHVNPEYEAWEVQDQTPLVWLQSTLSKSVLLRVLGLNHSYQVWEKIHEQFSLHTKSCARQLRCAQFRLKFGFAMRNTLTRSLKASCPITCW

SEQ ID NO: 228436 - protein, 84 aa, Glycine max
  Coding DNA Sequence Number=SeqID_111658
  Gene Ontology: Mol. function=DNA binding; Biological process=DNA integration
  Homolog annotation: Hit_ID=Q1SXQ3; Match level="QueryCoverage=98%, HitCoverage=13%, E-value=6e-11, Identity=34%"; Hit description =Integrase, catalytic region
MDDAKEMKTSIHPSTYLGLDEESKKVDKAQYTAMIRSLLYLTASRHDIMFKRRSTSGSYHFISSNLVSWICKKQGSTALSTVEA

SEQ ID NO: 228437 - protein, 391 aa, Glycine max
  Coding DNA Sequence Number=SeqID_111659
  Gene Ontology: Mol. function=DNA binding
  Homolog annotation: Hit_ID=Q9LW00; Match level="QueryCoverage=66%, HitCoverage=92%, E-value=2e-29, Identity=34%"; Hit description =Arabidopsis thaliana genomic DNA, chromosome 3, P1 clone: MSJ11
  Pfam annotation: Domain name=MBD; Domain location=105-171; Score =22.8; E_value=0.00016; Accession=PF01429.10; Description=Methyl-CpG binding domain
MDNRVSSLEKLTSEHGAKLPELKCNIGYIKEHVPDMKQIKDILECMMTKKKKPSTSRHWSNTLQLLFVFTVAVQLLSPPSCCHRPPSTPTFVFSAFLDRDLGFQLHFQNSGGTQLFIPKKAGTPKKNEIVFTAPTGEEINNRKQLEKYLKAHPGGPAVSEFDWGTGETPRRSTRISEKAKAAPPTQREPPKKRTKRSSASQKEISQEEKEEETKEAEMQEADDTTKGDNDIEKEKVVVNENHDKSVEDTDVNKSTRYGEEAKAGENVEVPIEEEKSNAADGELPALKDKADDKVTEGSEVFLRKDEEKIEQPQEETKEYSGFGEPEKLETCTTADKTVEVEGVNKEDHVKSTHEFEVGEIEGTKVNGEEHHKLDEINKAEAELTVNGTHES

SEQ ID NO: 228438 - protein, 152 aa, Glycine max
  Coding DNA Sequence Number=SeqID_111660
  Gene Ontology: Mol. function=RNA-directed DNA polymerase activity; Biological process=RNA-dependent DNA replication
MHLPGSNSSHHSGDKTTAKVLQSVFFWPSIFKDAHDYVRHCDKCQRTGGISRRNEMPLQNITETNSQAEISNRELKRIFEKTVASSRKDWALKLDDTLWAYRTAFKTPIGLCPFWLVYGKACHLPVEMEHKAYWTLKLLNIDEAASRERRKL

SEQ ID NO: 228439 - protein, 85 aa, Glycine max
  Coding DNA Sequence Number=SeqID_111661
MTFHCFPLDLNSKPDEEEEPISCSEEASANVGGKCETRAATSASDDNIRGRAEAAIIDRVNVVERGSDFENKFYYLELTKCSMRI

SEQ ID NO: 228440 - protein, 266 aa, Glycine max
  Coding DNA Sequence Number=SeqID_111662
  Gene Ontology: Mol. function=catalytic activity; Cellular component =intracellular; Biological process=Mo-molybdopterin cofactor biosynthetic process
  Homolog annotation: Hit_ID=Q010H5; Match level="QueryCoverage=91%, HitCoverage=33%, E-value=7e-83, Identity=58%"; Hit description =Chromosome 10 contig 1, DNA sequence
  Pfam annotation: Domain name=MoeZ_MoeB; Domain location=106-194; Score=105.5; E_value=1.6e-28; Accession=PF05237.3; Description =MoeZMoeB domain
  Pfam annotation: Domain name=ThiF; Domain location=1-90; Score=34.3; E_value=4.6e-09; Accession=PF00899.11; Description=ThiF family
  Pfam module annotation: Pfam domain module=MoeZ_MoeB::ThiF; Domain location=106-194::1-90
VGHARASVGTSKCASLAARCRSINDGVDVIEHETYATNVNADALIESYDVVCDCSDNPRTRYALSDACAARGTPLISASCVGYEGQLTTLCATWIWSEDGERIGRRRAPCYRCLFPRPPASGDAGTCGASGVLGPAPGVMGTFQAIEAIKTLSGVGESMRGKLMMFDALSARPTRTLEVRDEPDPACERCGAGANFGDVAAYDYDAFLSSTPCSSRAAAAARLREGGVDLTAPPAHGSGDALDDDVSRASAWSRVSARDFATTLDS

SEQ ID NO: 228441 - protein, 180 aa, Glycine max
  Coding DNA Sequence Number=SeqID_111663
  Homolog annotation: Hit_ID=Q010V7; Match level="QueryCoverage=81%, HitCoverage=29%, E-value=2e-23, Identity=54%"; Hit description=[I] KOG1737 Oxysterol-binding protein
  Subcellular localization annotation: CTP_CleavageSite=56; ConfidenceScore=5.34e-01
MDPYNADPYAPAPVMYPTSSYVAVSPGNHGSAVMAGAYDGQRGAQTPSSTVASGARAAKPSEIPGAPSGNVRYRCMSLPTADGDDIEDVIVQMGLDGVKCFAGDDVTRTRQTFELPRIAKWSVVDSTILTIYAKDSSGERMFSLSADSGTISALVDVLTTSAFQWCELNGFDAMDTIVSS

SEQ ID NO: 228442 - protein, 238 aa, Glycine max
  Coding DNA Sequence Number=SeqID_111664
  Homolog annotation: Hit_ID=Q00XY8; Match level="QueryCoverage=80%, HitCoverage=68%, E-value=8e-61, Identity=60%"; Hit description =Homology to unknown gene
  Pfam annotation: Domain name=F-box; Domain location=72-119; Score =37.5; E_value=4.5e-08; Accession=PF00646.23; Description=F-box domain
MKEEPEDDTCSEDDEFEEEVLRELAAQARAVKREREADVEGDAEEIERGGRPQKSARVDSEVDPSMTCAVAGAFSRLPEDVVSLILRRLAPNELVSLAMTCKFFSKRCDQDFLWRQCFIERFGNTKQARQTNVKRLYFAADMREIDRETRQAPKGFEKICGEAFAAKRSQVCANLAPMSGGTPMYLAAVEWKGRRKFVAEEGHLCSRRAGCSYHELPGKVFVCEKTGNIHVCDETCAH

SEQ ID NO: 228443 - protein, 260 aa, Glycine max
  Coding DNA Sequence Number=SeqID_111665
  Gene Ontology: Mol. function=transporter activity; Cellular component= membrane; Biological process=transport
  Homolog annotation: Hit_ID=Q013P1; Match level="QueryCoverage=99%, HitCoverage=34%, E-value=1e-115, Identity=81%"; Hit description =Chromosome 08 contig 1, DNA sequence
  Pfam annotation: Domain name=PLAC8; Domain location=164-253; Score =0.1; E_value=0.0045; Accession=PF04749.7; Description=PLAC8 family
MSSNRTASWRDRSQALILIAVSLYFITSSDSGSYVDDLISAMGYENPPVLQKVYWCFTEGALATALVYSGGLKMVQAVSIVAGFPYTLALNFMCLSLWRALLDEGGDEAHRRKRKSFNTCLFDFLEVFKPLDAGANAPGAQERALCSLKNLIFPYEAIVKCKEAIGSDKNVAMLNGAVVTGLLWTFIGLLASTGAEANTHGVAWLMFFIFVFCVANIRRELREKRNIIGGVMEDFTSVMALWPFAIAQMEHEADADDKMA

SEQ ID NO: 228444 - protein, 253 aa, Glycine max
  Coding DNA Sequence Number=SeqID_111666
  Gene Ontology: Mol. function=nucleoside-triphosphatase activity; Cellular component=integral to membrane; Biological process=cell division
  Homolog annotation: Hit_ID=Q00UG9; Match level="QueryCoverage=100%, HitCoverage=32%, E-value=1e-124, Identity=87%"; Hit description=[O] KOG0730 AAA+-type ATPase
  Pfam annotation: Domain name=AAA; Domain location=115-253; Score =125.7; E_value=1.3e-34; Accession=PF00004.19; Description=ATPase family associated with various cellular activities (AAA)
  Pfam annotation: Domain name=AAA_2; Domain location=111-249; Score= -37.5; E_value=0.0065; Accession=PF07724.4; Description=ATPase family associated with various
  Pfam annotation: Domain name=AAA_5; Domain location=115-252; Score =8.0; E_value=0.00044; Accession=PF07728.4; Description=ATPase family associated with various
  Pfam module annotation: Pfam domain module=AAA::AAA_2::AAA_5; Domain location=115-253::111-249::115-252
MNIRPWNYAVHGARNWLMAGTFFWFIGAVVESAYTADRSSDVLRKRAKAQKAQNERDALAEQMGKSKAKLMKHQSSVRFKDVAGQDMVVREFQTIIDIMKGSPKYKGRFVEPPKGILLEGPPGTGKTLLAKAVAGEAGLPFFYANGSEFVEMFVGVAASRMRNLFKRARLNAPSIIFIDELDTIGRSRAANEFRDSSTSEREQGLMQMLVEMDGFNNKETGEAVLVIGATNLAAQLDPALLRSGRFDRVYHIG

SEQ ID NO: 228445 - protein, 205 aa, Glycine max
  Coding DNA Sequence Number=SeqID_111667
MSTAVGAAHGGGASMDEGPAQMHYMPARFRSLAGGGWVTISSSDVRKSLMPMPGMGGGGEGANESAVSGGAMKHEVKINLAHGDPDGERSCDLVHYKSSSNKLVCSPRAVDCCLDGLTAQELARVSHGCPSVKPELNVEVNGQRLTWGRVGRHGRNTLTDKSLEVRYGQTPTIVAVEPAEVRPGELITVYGRTCFGDVWKKDEDD

SEQ ID NO: 228446 - protein, 210 aa, Glycine max
  Coding DNA Sequence Number=SeqID_111668
MRDGRIVNADAFSKGGRCRTNICASGCYGESRWEFRGPAKYLPCQDAYEDFLRMLDESAHEGVRSKRGRGWREDGAHPWAHPKRESCDSQLLRKDPYKEKIRKCPECIDGGNTFEKGISNFWGCKLSPENVEKKRKECDRLAAAAAAEKKNQCLAQPALGSSLWIDGVDTMSFALGALVACTLGVVVYFVRRTRGTKITDSRAYGATAVQ

SEQ ID NO: 228447 - protein, 256 aa, Glycine max
  Coding DNA Sequence Number=SeqID_111669
  Gene Ontology: Mol. function=oxidoreductase activity, acting on single donors with incorporation of molecular oxygen, incorporation of two atoms of oxygen; Cellular component=chloroplast
  Homolog annotation: Hit_ID=Q01CB9; Match level="QueryCoverage=99%, HitCoverage=43%, E-value=1e-135, Identity=89%"; Hit description=[Q] KOG1285 Beta
MLYKGAFAIGNPKGDSFYNPFDFDVKNVANTGVVNWGGETYALWEGGKPHKMRSSDLGTVGEVEEVLGTKLRVPQMAAHYRIWEGETEADKRLIGFSIESQPSKFPWTSNSAAFYEWDAEGKSTVVNNFDVPNATFAFAHDCLVTENWYFLFQNPTSLNPQKLLTEYMFAECALAETICMVDGKSALLHCLPRTEKARKIGQKAIELKPQFFFHHINAFERENGDIVLDSLPWVFMDFSMNLDSVNPAFFNGGSRV

SEQ ID NO: 228448 - protein, 49 aa, Glycine max
  Coding DNA Sequence Number=SeqID_111670
LIRKVYEVLISSFSLSQSAALARHPLSAPLLRLSAPLLQLSARKNLEEG

SEQ ID NO: 228449 - protein, 177 aa, Glycine max
  Coding DNA Sequence Number=SeqID_111671
MVEADDATRTLMNYLTPKVGEIQWRFPKGPHDALEEVLKHESGLVHFQRIALPIGPNVPMPSFEVSSHNMTGLDVCQGNLIMKPTVNAIIIIEDMCSNPYHNYGVRRIMKTLDQPAKSQVPISTPPNHTCDRCGCVHGLGECTVEGELAQAMDELNYVRGRNNHYEQFFNNNNFHQG

SEQ ID NO: 228450 - protein, 140 aa, Glycine max
  Coding DNA Sequence Number=SeqID_111672
  Gene Ontology: Mol. function=cyclin-dependent protein kinase regulator activity; Biological process=cell cycle
  Homolog annotation: Hit_ID=Q5SCA8; Match level="QueryCoverage=78%, HitCoverage=74%, E-value=2e-11, Identity=39%"; Hit description =Cyclin-dependent kinases regulatory subunit
MTTRDAQARGVTAGYREDVAEESFVVRGARGDARGERRDVGWMGTDEWASFPQTGAGDEDAADADDETDRGRAMIADGVAWIGRATIERVDSLRCERERVERAAAHHALQEEEERGINERRMERDDADGTSFIPPTRRLL

SEQ ID NO: 228451 - protein, 93 aa, Glycine max
  Coding DNA Sequence Number=SeqID_111673
  Homolog annotation: Hit_ID=Q015G2; Match level="QueryCoverage=96%, HitCoverage=9%, E-value=6e-18, Identity=58%"; Hit description=[J] KOG0188 Alanyl-tRNA synthetase
  Pfam annotation: Domain name=DHHA1; Domain location=12-85; Score =41.6; E_value=2.7e-09; Accession=PF02272.9; Description=DHHA1 domain
VAAEDLAARLGDGAAVVLGSANGQNVGLVALFDDTVQKLGHLKAGQVLGAAAKKCGGGGGGKPGFAQAGGRDASQLDGALRDALDTVTDALSS

SEQ ID NO: 228452 - protein, 250 aa, Glycine max
  Coding DNA Sequence Number=SeqID_111674
  Gene Ontology: Mol. function=N-acetyltransferase activity; Biological process=metabolic process
  Homolog annotation: Hit_ID=Q00VI4; Match level="QueryCoverage=88%, HitCoverage=27%, E-value=8e-59, Identity=53%"; Hit description =Chromosome 15 contig 1, DNA sequence
MPWERCDPGEVERRLAPRGWCSWCGASSRHRVTRASGRRGTYLSHCSSCARATHKCERCADGFAKIGDGRCAVCAGWVSDWDVDAETFARRTRVVAWCSWCGEKCAHVGRGVRGEVNGVNDAARDAVARFECMVCGGGTTPCARCGDAGVMRKRSRPGGGGSCARCVVADERMKKINIGGYVSVPTIGALTKSLARAFTKRRDGGADGARGSDDETEDEEIARRWNVRVARRDAADEQASFIFDVLDRES

SEQ ID NO: 228453 - protein, 195 aa, Glycine max
  Coding DNA Sequence Number=SeqID_111675
  Homolog annotation: Hit_ID=Q01B16; Match level="QueryCoverage=99%, HitCoverage=16%, E-value=5e-49, Identity=53%"; Hit description =Chromosome 04 contig 1, DNA sequence
MECGTGSIVYDSTVYPSDSPGRESTPQQCHGDATFMQVSWHYNARLTAGDYTCLYADGMLYDKLSVSRSNPNIAGYSEVSGGLYAATNFTDIRPVSGTFEDVQESLIANFLFDGDGSDELISASPCVSGQQGTKPKLLPVGTVRDIKTCTGGNGGLCLSAVASSSVGSNQFGYAYTSDEVFADDMALSTWIYRKC

SEQ ID NO: 228454 - protein, 84 aa, Glycine max
  Coding DNA Sequence Number=SeqID_111676
MYVLRRNKLARKVLERWTPQDGDQCLMMPPLQTGKEKKVSRSCNSCMIETSVGCSCVASLLLLLGGVLLLPHRTSSNFPTHSAI

SEQ ID NO: 228455 - protein, 98 aa, Glycine max
  Coding DNA Sequence Number=SeqID_111677
  Subcellular localization annotation: CTP_CleavageSite=21; ConfidenceScore=5.08e-01
MASSEASSGRMDVASEHWTTRSATPNAVSMAFDGMMIASASARSGDSRKRRGVEPTAMDEDDDCVNVNGLSQEFERELAVGRAPKRACSQVDVRDAGR

SEQ ID NO: 228456 - protein, 121 aa, Glycine max
  Coding DNA Sequence Number=SeqID_111678
  Homolog annotation: Hit_ID=Q00US0; Match level="QueryCoverage=29%, HitCoverage=48%, E-value=8e-10, Identity=80%"; Hit description =Chromosome 15 contig 1, DNA sequence
  Subcellular localization annotation: CTP_CleavageSite=51; ConfidenceScore=5.50e-01
MTRYRRVASRRASLALFTRFVNRPVSIDRFVVVLARPSRVPRAPEFLTETRARRVAVGRARRMRARAPAHVFDRAFYAKIAGVSFIVGAAFEGFMLATDFYPKVLAIEAERRREAAKTRDA

SEQ ID NO: 228457 - protein, 439 aa, Glycine max
  Coding DNA Sequence Number=SeqID_111679
  Homolog annotation: Hit_ID=Q00RX4; Match level="QueryCoverage=22%, HitCoverage=6%, E-value=4e-25, Identity=60%"; Hit description =Chromosome 20 contig 1, DNA sequence
  Pfam annotation: Domain name=GCC2_GCC3; Domain location=236-281; Score=11.1; E_value=0.0066; Accession=PF07699.3; Description=GCC2 and GCC3
  Subcellular localization annotation: CTP_CleavageSite=73; ConfidenceScore=5.51e-01
AGYWGAAGAVDGGGAYTSHAGTVTACTATFTNGGSTAGITSTASTTTTARNACKTAPGYIITSNANAADTAIRVAQVPPGKYAAGGTALVTHPTNANTGTAAETPTNCATGTTSDAGSAFCGKVAAGYWGAAGAVDGGGAYTSHAGTVTACTATFTNGGSTAGITSTASTTTTARNACKTAPGYIITSNANAADTAIRVAQVPPGKYAAGGTALVTHPTNANTGTAAETPTNCPAGKYSDAGAFACINCAAGKYSAAGAASCTNCDAGTYSAAGASACTACAEGKTNAAGSAFCGTVAAGYYGAAGAASGGVYTAHAGTVAACTDTFSDSSTGSRAHTGHAVLTTLHVRGLTRLLPLWPRGVTVQIIGGAGSTTASSGDTFSYTTYWKTFSNVKAANAYSQTWTEITDTGVNTGIGVYIKWESGVSVTAGDEWRLHVAD

SEQ ID NO: 228458 - protein, 49 aa, Glycine max
  Coding DNA Sequence Number=SeqID_111680
MNIHLPDEIPVANPRWPPGSIRALGQGQLLSVTLDGSIHLMLGTVSGIL

SEQ ID NO: 228459 - protein, 164 aa, Glycine max
  Coding DNA Sequence Number=SeqID_111681
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q6YXZ6; Match level="QueryCoverage=60%, HitCoverage=19%, E-value=2e-12, Identity=39%"; Hit description =Putative beta-1,3-glucanase
  Pfam annotation: Domain name=X8; Domain location=5-93; Score=64.0; E _value=4.8e-16; Accession=PF07983.3; Description=X8 domain
YLKKQWCVVSQDANVDDPKMEDSLKIACDGSTGSTTLGNGSSCEWLDNRTKASYAFNAYYQLVTNQSINGCEFNGLASMTDKDPSPPKGTCKFDIGLEVVEQLATSPSPTSAPTTTEPGPDKPNLESRASDPRSKKSLAVETRQPNLIVIVAMVVFSLMLTIIL

SEQ ID NO: 228460 - protein, 511 aa, Glycine max
  Coding DNA Sequence Number=SeqID_111682
  Gene Ontology: Mol. function=enzyme inhibitor activity; Cellular component=cell wall; Biological process=cell wall modification
  Homolog annotation: Hit_ID=Q43062; Match level="QueryCoverage=92%, HitCoverage=89%, E-value=1e-149, Identity=57%"; Hit description =Pectinesterase PPE8B precursor
  Pfam annotation: Domain name=PMEI; Domain location=4-152; Score=45.6; E_value=1.7e-10; Accession=PF04043.6; Description=Plant invertasepectin methylesterase inhibitor
  Pfam annotation: Domain name=Pectinesterase; Domain location=200-497; Score=669.4; E_value=2.7e-198; Accession=PF01095.10; Description =Pectinesterase
  Pfam module annotation: Pfam domain module=PMEI::Pectinesterase; Domain location=4-152::200-497
  Subcellular localization annotation: CTP_CleavageSite=47; ConfidenceScore=5.40e-01
MAVFSTKQLSTSTLTTTFIIFFVRSEFAGLGGLRVSPSEFIGSVTTVGDVLQNVTSILKSEFVSNVNNNEFHLYDAAAIFACLDLLDLSADELSWSISAVQSPQGNDNSTGNLSSDLRTWLSAVLANTDTCMEDFEGTNGNVKGLISTEIDQAKWLLQKLLTQVKPYVNDFSSRNSRDKFPSWVEAEDKLLLQTNVVSADAVVAADGTGNFTKVMDAVEAAPVYSMKRFVIHIKKGVYTENVVIKKKKWNLVVIGEGMDVTIISANLSRNENLTTFKTATFAVNGRGFIAKGITFRNTAGPKRNQSVALRSDSDLSVFYRCGIYGYQDSLYAHSLRQFYRECKISGTVDFIFGHANAVFQNCTILAKKGLQSQKNTITAQGETYTDQSSGFTIQFCNISADYDLLPYLNTTSTYLGRPWKPYSRTIFMQSYISEVLNPKGWLEWNGTMYLDTLYYAEYKNFGPGARLDNRVKWPGYHVMNDSSQAFNFTVTNLILGELWLPSTGVTFIPGL

SEQ ID NO: 228461 - protein, 228 aa, Glycine max
  Coding DNA Sequence Number=SeqID_111683
  Gene Ontology: Mol. function=oxidoreductase activity; Cellular component=membrane; Biological process=electron transport
  Homolog annotation: Hit_ID=Q9SML3; Match level="QueryCoverage=90%, HitCoverage=48%, E-value=7e-57, Identity=52%"; Hit description =Cytochrome P450 monooxygenase
  Pfam annotation: Domain name=p450; Domain location=1-227; Score= -160.6; E_value=0.0012; Accession=PF00067.12; Description=Cytochrome P450
KAEELKDLVTNIIKLVGTPNLVDFFPVLKMVDPQSIKRRQSKNSKKVLDMFNHLVSQRLKQREDGKVHNDMLDAMLYISNDNKYMDNMIEHLSHDIFVAGTDTTTSTLEWAMTELVRNPDVMSKAKQELEQMISKGNNPIEEADIGKLPYLQAIVKETLRLHPPVPFLLPPKAGKDVDIGGHTISKDAKVLVNMWTICKDPTLWDSSNYTSHVVASKSLQLAETSLFF

SEQ ID NO: 228462 - protein, 84 aa, Glycine max
  Coding DNA Sequence Number=SeqID_111684
MVVSDEASYTCWGTWAMGPSPSLSREGWAPGQATLSKNYSTDKMDPRGATLSAEVDAGVGVGAAEVDGISADLALTLLAPRKAT

SEQ ID NO: 228463 - protein, 51 aa, Glycine max
  Coding DNA Sequence Number=SeqID_111685
MEFAQKVVLQASMHFSFLKADVCPELSLFTLSFVCLLPMLIKMSKQTSEYT

SEQ ID NO: 228464 - protein, 153 aa, Glycine max
  Coding DNA Sequence Number=SeqID_111686
LASHLKEVSLAIRELLKEVFSKKLLKKVFSKKLLKEVFSRKLLKEHPLQASYPRHSLGGETPSSMAYSLVDGASSHLFSFVFRCISMPPLKLHKQASINVMLGDKVECDSSLPVCYLCLDPVMISNLVFVGADELVDDDYEEPHARGHGNTML

SEQ ID NO: 228465 - protein, 118 aa, Glycine max
  Coding DNA Sequence Number=SeqID_111687
  Homolog annotation: Hit_ID=Q60EP7; Match level="QueryCoverage=46%, HitCoverage=7%, E-value=5e-07, Identity=52%"; Hit description=Unknow protein
MVFFGHFSNNRKVKHLGLDENVGPQIRKFYAEVLAQLWPSGYMDNDGIKLGICKAKERHIALYNKHKVHLDIARGREKTKLKRECKRMIFFPTLLEWKKEKLMCLTKIKQLNPIETPS

SEQ ID NO: 228466 - protein, 139 aa, Glycine max
  Coding DNA Sequence Number=SeqID_111688
  Subcellular localization annotation: CTP_CleavageSite=24; ConfidenceScore=5.03e-01
MGMTLFEAPRSSMAFVKLQSPMVQGMKKVSGSLRFCGKVDAGMQDHAKDVMTTMEVWTSLIEVEMKLKSSKTITEDPKWKLSKMWECRCIVIIRSLTIATYPSVGGRCETHGCVFQERKNAQSRHQRLFEKNVGKTGKV

SEQ ID NO: 228467 - protein, 187 aa, Glycine max
  Coding DNA Sequence Number=SeqID_111689
  Gene Ontology: Mol. function=transferase activity
  Homolog annotation: Hit_ID=Q1SE38; Match level="QueryCoverage=97%, HitCoverage=53%, E-value=1e-49, Identity=48%"; Hit description =Transferase
MRIQVQKKMCTTTRFMFGFESISSLRVEAKDGDYDESSKPLTRYEVLAAFIWKHMKPTCKMESNRTRPAVAIHIVDMRRRIGEPFSRYTIGNILWPVMHSQRKFGNLSIEWFLRVKSDPNILGSTQCMDLTQGGDKETLPDEVVIMEIDEAIEAWLTMEMQHIANLERDIEFLILALPNASVSNIWF

SEQ ID NO: 228468 - protein, 205 aa, Glycine max
  Coding DNA Sequence Number=SeqID_111690
  Homolog annotation: Hit_ID=Q1SHA0; Match level="QueryCoverage=37%, HitCoverage=15%, E-value=1e-12, Identity=44%"; Hit description=DNA -directed DNA polymerase B
MLNFFPRISYYLGLIPRLVIGLCVLAVVLVVYVIVGILGSIVGGAAYGFLPPIFATFEVVQEGKVTNLSTGKSLVFVLSLISIPFTTFSNLAKFFVVVLWPPSTSPSLYPMPIYGEASNHRYRGCEPLVLSCLPALAHLTAHFERQRPTSVALEEAEYNFWHKLCCHKCLDVKISPVMIANQVKRQAERISHPELAPVVVSMISV

SEQ ID NO: 228469 - protein, 278 aa, Glycine max
  Coding DNA Sequence Number=SeqID_111691
  Gene Ontology: Mol. function=4 iron, 4 sulfur cluster binding; Cellular component=intracellular; Biological process=base-excision repair
  Homolog annotation: Hit_ID=UPI00005F8B84; Match level="QueryCoverage =95%, HitCoverage=71%, E-value=1e-138, Identity=86%"; Hit description= COG1194: A/G-specific DNA glycosylase
  Pfam annotation: Domain name=HHH; Domain location=115-144; Score =30.9; E_value=4.6e-06; Accession=PF00633.13; Description=Helix -hairpin-helix motif
  Pfam annotation: Domain name=HhH-GPD; Domain location=51-183; Score =86.9; E_value=6.4e-23; Accession=PF00730.15; Description=HhH-GPD superfamily base excision DNA repair protein
  Pfam module annotation: Pfam domain module=HHH::HhH-GPD; Domain location=115-144::51-183
MLQSRFIFCRITTLLMMQAQQFAQVVLDWYQRYGRKTLPWQLEKTAYQVWLSEVMLQQTQVATVIPYFQRFMARFPNVRALAEAPLDEVLHLWTGLGYYARARNLHKAAQTIVAQHGGEFPTTFAEIADLPGVGRSTAGAVLSLALGQHYPILDGNVKRVLARCYAVEGWPGKKEVENRLWKISEEVTPAQGVGQFNQAMMDLGAMVCTRSKPKCELCPLNVGCLSYANHSWANYPGKKPKQALPEKTAYFLLLQHGERVWLEQRPAVGLWGGLFCFP

SEQ ID NO: 228470 - protein, 204 aa, Glycine max
  Coding DNA Sequence Number=SeqID_111692
PVSFRGLHVLTFQGLHALAIRGLHALTLRGLRVLAFRGLHALAFIPGPPPDIGGGPTVRAQSEREAITQLLCIPGQDFTRAAAKRQRPQCRSPPADVSVGLCHPDIGKYAYGSTDFLYHPLFAGIVPARHPVDPEKSNRVLGFPALITDFCQFYEVSVTPDKVIRSPINQAFIKKYCAPRQAQGETPQQPEMAGSGQQTHRHHL

SEQ ID NO: 228471 - protein, 542 aa, Glycine max
  Coding DNA Sequence Number=SeqID_111693
  Gene Ontology: Mol. function=enzyme inhibitor activity; Cellular component=cell wall; Biological process=cell wall modification
  Homolog annotation: Hit_ID=Q69Y54; Match level="QueryCoverage=81%, HitCoverage=76%, E-value=1e-118, Identity=47%"; Hit description =Putative pectin methylesterase
  Pfam annotation: Domain name=PMEI; Domain location=33-185; Score =106.5; E_value=7.9e-29; Accession=PF04043.6; Description=Plant invertasepectin methylesterase inhibitor
  Pfam annotation: Domain name=Pectinesterase; Domain location=232-528; Score=700.7; E_value=1e-207; Accession=PF01095.10; Description =Pectinesterase
  Pfam module annotation: Pfam domain module=PMEI::Pectinesterase; Domain location=33-185::232-528
  Subcellular localization annotation: CTP_CleavageSite=35; ConfidenceScore=5.45e-01
MAYSSHKLFFLLFAIFFSHASAVNSSDASTTIHTNLSSIKSFCTTTAYPEVCFNSLKLSISINISPNIINYLCQSLQVAISETTKLSNLFHNVGHSKNIIEKQRGSVQDCRELHQSTLASLKKSLSGIRSSNSKNIVDARSYLSAALTNKNTCLEGLDSASGTMKPSLVKSVINTYKHVSNSLSMLPKPEMGTPKVKKNNNQPLKNAPKWVSSSDQRLFQDSDGEDYDPNEMLVVAADGTGNFSTITEAINFAPNNSMDRIVIYVKEGIYEENVEIPSYKTNIMMLGDGSDVSFITGNRSVGDGWTTFRSATLAVSGDGFLARDIAIENSAGPEKHQAVALRVNADLAAFYRCAIYGYQDTLYVHSFRQFYRECDIYGTIDYIFGNAAAILQECNIISRKPMPGQFTVITAQSRDSPDEDTGISFQNCSIIATLDLYSNSSSFKSYLGRPWRIYSRTVYLESYIDDFIDPKGWTKWSNEQGLETLYYGEYDNYGPGSSIDKRVQWLGYHLMDYGDAYNFTVSEFINGDGWLDTTSVPYDDGI

SEQ ID NO: 228472 - protein, 358 aa, Glycine max
  Coding DNA Sequence Number=SeqID_111694
  Gene Ontology: Mol. function=enzyme inhibitor activity; Cellular component=cell wall; Biological process=cell wall modification
  Homolog annotation: Hit_ID=Q9MBB6; Match level="QueryCoverage=55%, HitCoverage=33%, E-value=3e-83, Identity=73%"; Hit description =Pectin methylesterase
  Pfam annotation: Domain name=Pectinesterase; Domain location=164-358; Score=334.4; E_value=2e-97; Accession=PF01095.10; Description =Pectinesterase
MSYQQTCIDGFPKGKIKDELSNMFNESKELVSNSLAVVSQFSSFFSIFQGAGELHLPWEITSDDAPAPTTASASAVGAGFGSIFGSGSSSFGSASAPGVAPTTTGVASAPGVSPTTAGAALAPGVAPGPVPSWAAGSIPAWAGPVPVWAGPAEFIGSNEKPTPNVTVAKDGSGNFKTISEALAAIPPKYDGRYVVYVKEGVYDETVTVTKKMLNVTMYGDGQQKSIITGNKNFVDGVRTFQTASFVVLGGGFLAKDMGFRNTAGAEKHQAVAARVQADQAIFFNCAFEGYQDTLYAQTHRQFYRDCYISGTIDFIFGDASAVFQNCTMVVRKPLDNQQNIVTAQGRLDKQENTGFVLQ

SEQ ID NO: 228473 - protein, 44 aa, Glycine max
  Coding DNA Sequence Number=SeqID_111695
MEAHFEGGAARMRRWKVKRTIRIAARGKHFREAAIRGHQMDPIE

SEQ ID NO: 228474 - protein, 127 aa, Glycine max
  Coding DNA Sequence Number=SeqID_111696
  Gene Ontology: Mol. function=protein-methionine-S-oxide reductase activity
  Homolog annotation: Hit_ID=Q10S38; Match level="QueryCoverage=81%, HitCoverage=85%, E-value=4e-28, Identity=60%"; Hit description =Expressed protein
MTVKNRLYSLLKEASSHQRNHGFRVQLYGLRLQPEFELRLCVPSGLLHRSRQQGLRLLLRRRRHQVQIRQGGQDSSLLRNRQLLGNPEEEDQDQVQHLLPIVPVSFTWVPAKSSPERPDIGSFQTCC

SEQ ID NO: 228475 - protein, 140 aa, Glycine max
  Coding DNA Sequence Number=SeqID_111697
  Gene Ontology: Mol. function=binding
  Homolog annotation: Hit_ID=Q5G7T2; Match level="QueryCoverage=56%, HitCoverage=41%, E-value=3e-11, Identity=47%"; Hit description=U-box and ARM repeat protein
MGRLEISLTILIPDLIKRRIRINIYFINCIKQNSPVIREGAEGIERRGGFFSFPSLSVAEECHEGVDGAREGFDGGLVNVEDDKAGEEGGGESMTVEGGGVGEEALDDEADLGIIVQGEVEEEGEGAVAEVGGGDVLEAG

SEQ ID NO: 228476 - protein, 149 aa, Glycine max
  Coding DNA Sequence Number=SeqID_111698
MEMKTNKTRNELKVSNSKTYRLKNEERTKNGRRTVKNDGKSLQNFSRKTSKLHDESKLIQRSFDDNKGDDKKLKGQEHFMITKMMISRIKDEFKMESRTLQSSKRKFDFKNQVSRFKFQESRSRFKTQDSRIKRRLNQDKYEKVFSKTE

SEQ ID NO: 228477 - protein, 169 aa, Glycine max
  Coding DNA Sequence Number=SeqID_111699
MTSSHGALFTLFNQSWKKFKTRLFRDRPNPIYPDHKKLFYKPDEVTRRFPLYWQDEDQRFKSQGSEFITTDRFLTKVDLKLMDYVGANNSLDSTEVFLYILVVSICHWRTTYDELETNGRRKIEIIDGLQQKIVDHEKMVSMKVVENEILVKAIESINKKFSIEIKDLT

SEQ ID NO: 228478 - protein, 1813 aa, Glycine max
  Coding DNA Sequence Number=SeqID_111700
  Gene Ontology: Mol. function=DNA-directed RNA polymerase activity; Cellular component=DNA-directed RNA polymerase II, core complex; Biological process=transcription from RNA polymerase II promoter
  Homolog annotation: Hit_ID=P18616; Match level="QueryCoverage=83%, HitCoverage=83%, E-value=0.0, Identity=85%"; Hit description=DNA -directed RNA polymerase II largest subunit
  Pfam annotation: Domain name=RNA_pol_Rpb1_1; Domain location=12-336; Score=472.6; E_value=4.9e-139; Accession=PF04997.3; Description=RNA polymerase Rpb1, domain 1
  Pfam annotation: Domain name=RNA_pol_Rpb1_2; Domain location=338-506; Score=361.0; E_value=1.9e-105; Accession=PF00623.11; Description=RNA polymerase Rpb1, domain 2
  Pfam annotation: Domain name=RNA_pol_Rpb1_3; Domain location=509-673; Score=244.3; E_value=2.5e-70; Accession=PF04983.8; Description=RNA polymerase Rpb1, domain 3
  Pfam annotation: Domain name=RNA_pol_Rpb1_4; Domain location=698-804; Score=196.1; E_value=8.1e-56; Accession=PF05000.7; Description=RNA polymerase Rpb1, domain 4
  Pfam annotation: Domain name=RNA_pol_Rpb1_5; Domain location=811 -1404; Score=534.4; E_value=1.2e-157; Accession=PF04998.8; Description=RNA polymerase Rpb1, domain 5
  Pfam annotation: Domain name=RNA_pol_Rpb1_6; Domain location=877 -1061; Score=347.7; E_value=1.9e-101; Accession=PF04992.5; Description=RNA polymerase Rpb1, domain 6
  Pfam annotation: Domain name=RNA_pol_Rpb1_7; Domain location=1146 -1280; Score=294.8; E_value=1.6e-85; Accession=PF04990.3; Description= RNA polymerase Rpb1, domain 7
  Pfam annotation: Domain name=RNA_pol_Rpb1_R; Domain location=1522 -1536; Score=12.3; E_value=1.5; Accession=PF05001.4; Description=RNA polymerase Rpb1 C-terminal repeat
  Pfam annotation: Domain name=RNA_pol_Rpb1_R; Domain location=1537 -1550; Score=20.0; E_value=0.0085; Accession=PF05001.4; Description =RNA polymerase Rpb1 C-terminal repeat
  Pfam annotation: Domain name=RNA_pol_Rpb1_R; Domain location=1551 -1564; Score=20.5; E_value=0.006; Accession=PF05001.4; Description =RNA polymerase Rpb1 C-terminal repeat
  Pfam annotation: Domain name=RNA_pol_Rpb1_R; Domain location=1565 -1578; Score=19.4; E_value=0.013; Accession=PF05001.4; Description =RNA polymerase Rpb1 C-terminal repeat
  Pfam annotation: Domain name=RNA_pol_Rpb1_R; Domain location=1579 -1592; Score=17.1; E_value=0.065; Accession=PF05001.4; Description =RNA polymerase Rpb1 C-terminal repeat
  Pfam annotation: Domain name=RNA_pol_Rpb1_R; Domain location=1593 -1606; Score=17.1; E_value=0.065; Accession=PF05001.4; Description =RNA polymerase Rpb1 C-terminal repeat
  Pfam annotation: Domain name=RNA_pol_Rpb1_R; Domain location=1607 -1620; Score=18.8; E_value=0.02; Accession=PF05001.4; Description=RNA polymerase Rpb1 C-terminal repeat
  Pfam annotation: Domain name=RNA_pol_Rpb1_R; Domain location=1621 -1634; Score=20.8; E_value=0.0048; Accession=PF05001.4; Description =RNA polymerase Rpb1 C-terminal repeat
  Pfam annotation: Domain name=RNA_pol_Rpb1_R; Domain location=1635 -1648; Score=17.1; E_value=0.065; Accession=PF05001.4; Description =RNA polymerase Rpb1 C-terminal repeat
  Pfam annotation: Domain name=RNA_pol_Rpb1_R; Domain location=1649 -1662; Score=17.1; E_value=0.065; Accession=PF05001.4; Description =RNA polymerase Rpb1 C-terminal repeat
  Pfam annotation: Domain name=RNA_pol_Rpb1_R; Domain location=1663 -1676; Score=18.8; E_value=0.02; Accession=PF05001.4; Description=RNA polymerase Rpb1 C-terminal repeat
  Pfam annotation: Domain name=RNA_pol_Rpb1_R; Domain location=1677 -1690; Score=19.8; E_value=0.0098; Accession=PF05001.4; Description =RNA polymerase Rpb1 C-terminal repeat
  Pfam annotation: Domain name=RNA_pol_Rpb1_R; Domain location=1691 -1704; Score=17.1; E_value=0.065; Accession=PF05001.4; Description =RNA polymerase Rpb1 C-terminal repeat
  Pfam annotation: Domain name=RNA_pol_Rpb1_R; Domain location=1705 -1717; Score=7.5; E_value=12; Accession=PF05001.4; Description=RNA polymerase Rpb1 C-terminal repeat
  Pfam annotation: Domain name=RNA_pol_Rpb1_R; Domain location=1718 -1730; Score=2.6; E_value=97; Accession=PF05001.4; Description=RNA polymerase Rpb1 C-terminal repeat
  Pfam annotation: Domain name=RNA_pol_Rpb1_R; Domain location=1731 -1744; Score=19.1; E_value=0.016; Accession=PF05001.4; Description =RNA polymerase Rpb1 C-terminal repeat
  Pfam annotation: Domain name=RNA_pol_Rpb1_R; Domain location=1745 -1758; Score=15.5; E_value=0.2; Accession=PF05001.4; Description=RNA polymerase Rpb1 C-terminal repeat
  Pfam annotation: Domain name=RNA_pol_Rpb1_R; Domain location=1759 -1772; Score=9.2; E_value=5.8; Accession=PF05001.4; Description=RNA polymerase Rpb1 C-terminal repeat
  Pfam annotation: Domain name=RNA_pol_Rpb1_R; Domain location=1773 -1785; Score=9.7; E_value=4.8; Accession=PF05001.4; Description=RNA polymerase Rpb1 C-terminal repeat
  Pfam annotation: Domain name=RNA_pol_Rpb1_R; Domain location=1786 -1799; Score=10.1; E_value=4.1; Accession=PF05001.4; Description=RNA polymerase Rpb1 C-terminal repeat
  Pfam module annotation: Pfam domain module=RNA_pol_Rpb1_1::RNA_pol _Rpb1_2::RNA_pol_Rpb1_3::RNA_pol_Rpb1_4::RNA_pol_Rpb1_5::RNA_pol_Rpb1_ 6::RNA_pol_Rpb1_7::RNA_pol_Rpb1_R::RNA_pol_Rpb1_R::RNA_pol_Rpb1 _R::RNA_pol_Rpb1_R::...
  Pfam module annotation: Pfam domain module=RNA_pol_Rpb1_R::RNA_pol _Rpb1_R::RNA_pol_Rpb1_R::RNA_pol_Rpb1_R::RNA_pol_Rpb1_R::RNA_pol_Rpb1_ R::RNA_pol_Rpb1_R::RNA_pol_Rpb1_R::RNA_pol_Rpb1_R::RNA_pol_Rpb1 _R::RNA_pol_Rpb1_R::...
  Pfam module annotation: Pfam domain module=RNA_pol_Rpb1_R::RNA_pol _Rpb1_R::RNA_pol_Rpb1_R::RNA_pol_Rpb1_R::RNA_pol_Rpb1_R; Domain location=12-336::338-506::509-673::698-804::811-1404::877-1061::1146- 1280::1522-1536::...
  Pfam module annotation: Domain location=1537-1550::1551-1564::1565 -1578::1579-1592::1593-1606::1607-1620::1621-1634::1635-1648::1649 -1662::1663-1676::1677-1690::1691-1704::1705-1717::1718-1730::1731 -1744::1745-1758::...
  Pfam module annotation: Domain location=1759-1772::1773-1785::1786 -1799
MDIRFPFSPAEVAKVRMVQFGILSPDEIRQMSVVQIEHGETTERGKPKVGGLSDPRLGTIDRKLKCETCTASMAECPGHFGHLELAKPMFHIGFLKTVLTIMRCVCFNCSKILADENDHKFKQALRIRNPKNRLKKILDACKNKSKCEGGDEIDIPGQDTEESVKKSRGGCGAQQPKITIEGMKMIAEYKAQRKKSDDQEQLPEPVERKQTLSAERVLGVLKRISDEDCQLLGLNPKYARPDWMILQVLPIPPPPDDLTHQLAMIIRHNENLKRQERNGSPAHIISEFAQLLQFHIATYFDNELPGLPRATQRSGRPIKSICSRLKAKEGRIRGNLMGKRVDFSARTVITPDPTINIDQLGVPWSIALNLTYPETVTPYNIERLKELVEYGPHPPPGKTGAKYIIRDDGQRLDLRYLKKSSDHHLELGYKVERHLNDGDFVLFNRQPSLHKMSIMGHRIKIMPYSTFRLNLSVTSPYNADFDGDEMNMHVPQSFETRAEVLELMMVPKCIVSPQSNRPVMGIVQDTLLGCRKITKRDTFISKDVFMNILMWWEDFDGKVPAPAILKPEPLWTGKQVFNLIIPKQINLIRYSSWHSESERGSITPGDTMVRIEKGELLTGTLCKKTLGTYSGGLIHVIWEEVGPDAARKFLGHTQWLVNYWLLQNAFSIGIGDTIADASTMETINQTISAAKEKVKQLIREAHEKKLEAEPGRSMMDSFENRVNQTLNRARDDAGNSAQKSLSESNNLKAMVTAGSKGSFINISQMTACVGQQNVEGKRIPYGFIDRTLPHFTKDDLGPESRGFVENSYLRGLTPQEFFFHAMGGREGLIDTAVKTSETGYIQRRLVKAMEDIMVKYDGTVRNSLGDVIQFLYGEDGMDAVWIEKQMLDSLKMKKTEFDRVFRYEFDDENWKPTYMLEEPVEDLKTIREFRNVFEAEVQKLEADRFQLATEIATTGDSSLFLPVNLKRLIWNAQKTFKVDFRRPSDMHPMEIVEAIDKLQERLKVVPGEDLLSQEAQKNATLLFNILLRSTFASKRVLEEYRLSREAFEWVVGEIESRFLQSLVASGEMIGCVAAQSIGEPATQMTLNTFHYAGVSAKNVTLGVPRLREIINVAKRIKTPSLSVYLRPDVGKTKERAKSVQCALEYTTLRSVTQATEVWYDPDPMSTIIEEDVDFVKSYYEMPDEEVALEKISPWLLRIELNREMMVDKKLSMADIAEKINLEFDDDLTCIFNDDNAEKLILRIRIMNDEAPKGEIQDESAEDDVFLKKIESNMLTEMTLRGIPDINKVFIKNTKVQKFDENQGFKPNEEWMLDTEGVNLLAVMCHEDVDVTRTTSNHLIEVIEVLGIEAVRRALLDELRVVISFDGSYVNYRHLAILCDTMTYRGHLMAITRHGINRNDTGPMMRCSFEETVDILLDAAVYAETDYLRGVTENIMLGQLAPIGTGECALYLNDEMLKNAIELQLPSYMDGLDFGMTPARSPISGTPYHEGLMSPSYLLSPNLRLSPTTDAQFSPYVGGMAFSPTSSPGYSPSSPGYSPSSPGYSPTSPGYSPTSPGYSPTSPTYSPSSPGYSPTSPAYSPTSPSYSPTSPSYSPTSPSYSPTSPSYSPTSPSYSPTSPAYSPTSPAYSPTSPAYSPTSPSYSPTSPSYSPTSPSYSPTSPSYSPTSPSYSPTSPAYSPTSPGYSPTSPSYSPTSPSYSPTSPSYNPQSAKYSPSLAYSPSSPRLSPSSPYSPTSPNYSPTSPSYSPTSPSYSPSSPTYSPSSPYNSGVSPDYSPSSPQFSPSTGYSPSQPGYSPSSTSQYTPQTSDKDDRGTR

SEQ ID NO: 228479 - protein, 68 aa, Glycine max
  Coding DNA Sequence Number=SeqID_111701
  Subcellular localization annotation: CTP_CleavageSite=51; ConfidenceScore=5.41e-01
MEKLFQVKRNFLKFLTKQPAAALVVAFQNPTRMSPCRSPARVVSIIPKEARRKHKGETFSAREPTSPK

SEQ ID NO: 228480 - protein, 282 aa, Glycine max
  Coding DNA Sequence Number=SeqID_111702
  Gene Ontology: Mol. function=enzyme inhibitor activity; Cellular component=cell wall; Biological process=cell wall modification
  Homolog annotation: Hit_ID=O04886; Match level="QueryCoverage=96%, HitCoverage=50%, E-value=5e-29, Identity=30%"; Hit description =Pectinesterase-1 precursor
  Pfam annotation: Domain name=PMEI; Domain location=7-161; Score=41.3; E_value=3.3e-09; Accession=PF04043.6; Description=Plant invertasepectin methylesterase inhibitor
  Pfam annotation: Domain name=Pectinesterase; Domain location=204-282; Score=-190.0; E_value=3e-07; Accession=PF01095.10; Description =Pectinesterase
  Pfam module annotation: Pfam domain module=PMEI::Pectinesterase; Domain location=7-161::204-282
MSDGLVGGHQEHAHNECNLTRYPNLCAETLMELGLGNQNVDNNIEALVNKTIFETSLPSSYFAEFKTGEAQPAHSVVADYCEELMSMSLKRLDQSLRALKSPKRNTNDIQTWLSASLTFQQSCKDHVHAHTSTLSTDDHLMERMSNKMDYLSQLGSNSLALVNQMSTTTSHNIGDNNNEKEHEFPIWVSSKGRKLLQGATIKANAIVAQDGSGNYKTVSEAIEAASGTTRFVIYVKEGVYKEKINTNKDGITLIGDGKYSTLIVGDDSVAKGAILPDSATFS

SEQ ID NO: 228481 - protein, 447 aa, Glycine max
  Coding DNA Sequence Number=SeqID_111703
  Pfam annotation: Domain name=F-box; Domain location=19-66; Score =42.4; E_value=1.5e-09; Accession=PF00646.23; Description=F-box domain
MAATISPSSPNYHASISNTTINNLFDDSLTEIFCKLPCKSLFTCKSVSKRWLTLISNPNFHSLFLTHQHTLFQKTQALGEDLDQPSFILKPYNALVITPNSPSLQLGPLENHLSLSFLGPNFEPTNIVPQLRSVLKFVFACSNGLLVYGNPRPRHRCIYHIRNPLTKDSLELPCALTLCDHAGVLVGFTCDPYYHLETDKTKNAKVSIFSASQRRFRVVRIPAFSDTRSAFDVEVFYSETGKWKNFLVSCPKGFACGFFLTASSVEHEGKLYFMGGGRVLVYDPYENERVASVIELPRGFGEAYRGCLGVSCGTLQLSEFPISPSSAFEAYSGRVWELKHCGKGEETTTTTTTWELVHEFCLPEVVGPGFEELKANESENVKGCSRILAFHPYVRDTVFLKFGDNIICCNLLTRRFKVSKYGGLSLLFYPVIPIVIPWWPTPIPALP

SEQ ID NO: 228482 - protein, 93 aa, Glycine max
  Coding DNA Sequence Number=SeqID_111704
MAPPKEIVTVIYHNGHITDDSVQGLTRYISAQLLDNDDLRGAVEIILQNTQLNFVKFYAVTDLIPQPQPSSPQHSCPQLQLPPPQYFIHTTII

SEQ ID NO: 228483 - protein, 42 aa, Glycine max
  Coding DNA Sequence Number=SeqID_111705
METRSLRAMTLSSVSVGGGVWTTPMRNPMLFLEMRAILTECD

SEQ ID NO: 228484 - protein, 904 aa, Glycine max
  Coding DNA Sequence Number=SeqID_111706
  Gene Ontology: Mol. function=protein serine/threonine kinase activity; Cellular component=spindle pole body; Biological process =protein amino acid phosphorylation
  Homolog annotation: Hit_ID=UPI000034F1DC; Match level="QueryCoverage =76%, HitCoverage=92%, E-value=0.0, Identity=58%"; Hit description =ATP binding / kinase/ protein kinase/ protein serine/threonine kinase/ protein-tyrosine kinase
  Pfam annotation: Domain name=Pkinase; Domain location=11-269; Score =239.8; E_value=5.7e-69; Accession=PF00069.15; Description=Protein kinase domain
  Pfam annotation: Domain name=Pkinase_Tyr; Domain location=11-269; Score=80.8; E_value=4.1e-21; Accession=PF07714.7; Description =Protein tyrosine kinase
  Pfam module annotation: Pfam domain module=Pkinase::Pkinase_Tyr; Domain location=11-269::11-269
MGGYSTNPADYKLLEEIGYGATATVYRAMYLPFNQLVAIKSLDLDRCNINLDDLRREAQTMSLIDHPNVVRAHCSFAVERSLWVVMPFMDQGSCLHLIKIALSHGFQEDAIGSILKETLKALHYLHRHGHIHRDVKAGNILLDTSGAVKLSDFGVATCLYDAVDRQRCRNTFVGTPCWMAPEVLQPAGSGYNSKADIWSFGITALELAHGHAPFSKYPPMKVLLMTMQNAPPGLDDRDKKFSKEMVAMCLVKDQTKRPSAEKLLKHSFFKHAKPPELSVKKLFADLPPLWNCVKSLKLKDAAQLAVKKMPSADEEAISQSQYQRGVSAWNFDIDDLKAQASLVMDDNDNAEMREDENKFFTNYKASAIDSQSGTVKMNTEKSPQNKITSLVGAFDIKQTEQNEYLNKKEKNLESDLQEPGLPRNIIWKRNGSIMEATTSTIEKDIGMSHQTQSGLPGTVLSHSASERRRTLERLENGNQLLGEKNNREARQPPSFSGPLMLPTRASANSLSAPIKSSGGFRDSLDDKSKATLVQIKGRFSVTSENLDLVKDIPVSSVSRQSSQGSVSPLRKSASVSDWMLDSKQMATEDSATDSISASLLTTHLQNLLQQTSIQQDLIMNLLNSVQSAEAIEVSQNGKLPPLPRSSEINGSVDTAASERERLLLLKILELQTRIITLTDELTAEKLKYMQPVLSHCDVGLEWKQLPFLVTLRQNGPHLQEQHRVPHRSCPHTATHGYALCCQGKMQYLDNVMALKLLVSIYFRSIWEELDNYRPVTPCACLTRSYHQQDLVIRFLKGLDERFFVVHSQVLLMDPLPTVNKFAPTMAEPDILSMNAMLNMDTPWHPRYHGRPWYHNPSNNYTVNSAATSNIEEGDKKEEASPSSSLKITAAQHERLIASHSGAFF

SEQ ID NO: 228485 - protein, 105 aa, Glycine max
  Coding DNA Sequence Number=SeqID_111707
MAALLGMGEELWSLVHNHLLKELTSWSKEYINLVTMDKWMNITDMGYVIASRYNVIVVSFSRQQSMTFFSLKSFVMRPLSFTTSDVVVEYTLSFSGKAVTHSVHR

SEQ ID NO: 228486 - protein, 146 aa, Glycine max
  Coding DNA Sequence Number=SeqID_111708
  Gene Ontology: Mol. function=transition metal ion binding; Cellular component=cytoplasm; Biological process=fucose metabolic process
MGNHRACQQSLRLSRFKEAFVFGVQIFHKVVSGVTLVNLKARFGWSDKSFIELLLLLKKMLLEDNMSPKNHYEEKKILCPVGMEHQKIHACPNDCILYKNEFAKICNCPTCGVSWYIVNDGECSVDAIANNRCPTRCVVSSNNTKV

SEQ ID NO: 228487 - protein, 180 aa, Glycine max
  Coding DNA Sequence Number=SeqID_111709
MALKEAIKKELSHKGSPESLLIQPDIQQLGAPVNTNGSNVVINVQPSWEHGGDVIPMMGLYVQRKDGTLGLVAMGKIMEGDSVIHTVAYADDVVRDVEIIPHNEDAHVPKPANVDADDPLRGLIKYSFDIYEKPVEINFDGSCFGIADAPTSIFITYSDVSEIIAGDKTLNISVQQLWLM

SEQ ID NO: 228488 - protein, 104 aa, Glycine max
  Coding DNA Sequence Number=SeqID_111710
MERNRHGEDEEEPYGGRPVNIFGRDNDYAEEENWTKVVSRRSMKVMQKSSLAGRQSQNLEIGDNNKHYRLNWRNNADITSFYFTHFPDEANAELLWRHFKKWGD

SEQ ID NO: 228489 - protein, 130 aa, Glycine max
  Coding DNA Sequence Number=SeqID_111711
  Gene Ontology: Mol. function=structural molecule activity; Cellular component=extracellular region; Biological process=keratinization
  Homolog annotation: Hit_ID=Q28658; Match level="QueryCoverage=82%, HitCoverage=71%, E-value=9e-14, Identity=36%"; Hit description=Small proline-rich protein 3
MRSTVHEPQANLGADQKALGTNTHPFRGLYAFTFRGLHVLTFKGLHALAFRGLHVLTFRGLHALAFRGLHTLAFRGLHVLTFRGLHALTFSGLHVLTFERLHVLAFRGLPVLAFRGIHVLAFRGLHALAF

SEQ ID NO: 228490 - protein, 197 aa, Glycine max
  Coding DNA Sequence Number=SeqID_111712
KLPDQVLPETYSEEDSASKTSCSYRSSCIHKIKLFHRKIRLLQTLRKNLLPNHHIVGAPDNYANGQNPPDSSSGKMFFRKNNLCSTGRTFFRKNLLPEAFRKKVLPKEQIVVLSEEGSSGKFPEEGSSGRTIYSSERRFFRMNNLFYRKNLLPNKLPEELLPTKLPKTHPHLRPAIPLQDRDKDENETQGVLVKVLS

SEQ ID NO: 228491 - protein, 603 aa, Glycine max
  Coding DNA Sequence Number=SeqID_111713
  Gene Ontology: Mol. function=phospholipase D activity; Cellular component=membrane; Biological process=phosphatidylcholine metabolic process
  Homolog annotation: Hit_ID=Q9C5Y0; Match level="QueryCoverage=87%, HitCoverage=57%, E-value=0.0, Identity=70%"; Hit description =Phospholipase D delta
  Pfam annotation: Domain name=PLDc; Domain location=448-475; Score =41.5; E_value=2.9e-09; Accession=PF00614.12; Description =Phospholipase D. Active site motif
  Pfam annotation: Domain name=PLDc; Domain location=74-109; Score =35.3; E_value=2.2e-07; Accession=PF00614.12; Description =Phospholipase D. Active site motif
  Pfam module annotation: Pfam domain module=PLDc::PLDc; Domain location=448-475::74-109
  Subcellular localization annotation: CTP_CleavageSite=50; ConfidenceScore=5.60e-01
MGLPIWVFTPHRKRVQKTQTNTSKSTKGTDVRKQKTVSENRNRARPKFLRLATRGCSLNVVCVLDLDNNNVVGTVFTHHQKCVIVDTQAAGNNRKITAFIGGLDLCDGRYDTPEHRLFRNLDDVFDGDFHNPTFSAGTRVPRQPWHDLHCRIDGPAAYDVLINFEQRWRKATKWKEFAILFKKSSQWHDDALIRIERISWILSPSGAATLKDKSDDYTVPEDDPLVWVSSEDDPENWHVQIFRSIDSGSLKGFPKRVDVALSQNLICAKNLVIDKSIQTAYIQAIRSAQHFIYIENQYFIGSSYAWPAYKDAGADNLIPMELALKIASKIRAKERFAVYIVLPMWPEGDPKTGAMQEILFWQGQTMQMMYDAVARELKSMQLTDVHPQDYLNFYCLGNREHFNEDSSSTNGAQLSATVEDEIFFILTTIIVRASPGAAVSTAYKYRRFMIYVHAKGMIVDDEYVIIGSANINQRSMAGTKDTEIAMGAYQPHYTWSAKKRHPHGQIYGYRMSLWGEHLGMLDETFEEPERLECVHKVNKIADNNWKLFASEDFSLLQGHLLKYPVQVDSDGKIRSLPDCENFPDAGGKILGAHSTTIPDILTT

SEQ ID NO: 228492 - protein, 120 aa, Glycine max
  Coding DNA Sequence Number=SeqID_111714
  Gene Ontology: Mol. function=RNA-directed DNA polymerase activity; Biological process=RNA-dependent DNA replication
  Homolog annotation: Hit_ID=Q2HS45; Match level="QueryCoverage=99%, HitCoverage=24%, E-value=6e-27, Identity=40%"; Hit description=RNA -directed DNA polymerase
MAPFAKDVFREALFHMHPDKSPALDGLNLPFYRRFWHLCGDELTLACSSRIKDGVFPPNVNDTTIVLIPKCVVPLCMKDLQPISLCNVIYKFLSKVLAWRGRVGDMTLKVNVSKDYDRVD

SEQ ID NO: 228493 - protein, 254 aa, Glycine max
  Coding DNA Sequence Number=SeqID_111715
  Gene Ontology: Mol. function=DNA binding
  Homolog annotation: Hit_ID=Q9FKX7; Match level="QueryCoverage=70%, HitCoverage=50%, E-value=4e-39, Identity=46%"; Hit description =Arabidopsis thaliana genomic DNA, chromosome 5, TAC clone:K2A18
  Pfam annotation: Domain name=DUF151; Domain location=52-190; Score =31.1; E_value=5.8e-07; Accession=PF02577.5; Description =Uncharacterised ACR, COG1259
  Subcellular localization annotation: CTP_CleavageSite=46; ConfidenceScore=5.70e-01
MPPPPPAPFRAPSPSTSRRSTSHRSGPAAADPSSFPAIPPAVDPAPATLTTTTTIISKLLSFSQRFKNPTIFLRISCDGDYILPIVVGQIAIEKLMDAESEHESVECPDQYQFVENLVGRLDHEVIMVRITERVVSTYFARLYLSQPGKTDLISVDARPSDAINVANRCKAAIYVSKEIVFTDAIRIGYGMGGVCNKKTIYDVLLDSAVDGPDLVAQELSMMHNMRIAIKQERFKDAAIWRDKLANLRKSAHEL

SEQ ID NO: 228494 - protein, 58 aa, Glycine max
  Coding DNA Sequence Number=SeqID_111716
MKLIWSLCTSDEPWAFCAILDFLRNQARFESGPFQYEHIVHKVMSTALISGNYSNGMD

SEQ ID NO: 228495 - protein, 127 aa, Glycine max
  Coding DNA Sequence Number=SeqID_111717
MSAPSIVSSSAMRCIVDAIPSKEWEKLQRILFVSAKDFSIGAGLKGGLTLFAILARLHCFITFTITDVIRSFRKEIVVSNDEAILAALKETLRYGLFLETFVGTFVSTDEVIGSIVDHHRHVLFLSC

SEQ ID NO: 228496 - protein, 130 aa, Glycine max
  Coding DNA Sequence Number=SeqID_111718
MSVKNHPGRLGVHNKTHHKMGCVRSLSLSKIIGRPVRVTLFCKNAPTTWDWHRLKGAFKPGEFTPKAYTPKSPGQMSYRMSRHHASEHADYMRPYEQIKQVNNTRELLTQFGATSPTSGGYQAREEIHSQ

SEQ ID NO: 228497 - protein, 84 aa, Glycine max
  Coding DNA Sequence Number=SeqID_111719
  Subcellular localization annotation: CTP_CleavageSite=63; ConfidenceScore=5.18e-01
MKSKPEIEDASHSVSLARTLLEFLCALSHSRRYRRCLLLPWKVPSAAVEASFRRRSLRRRRFLAPSRTQGNSTRPFASPMMMRF

SEQ ID NO: 228498 - protein, 145 aa, Glycine max
  Coding DNA Sequence Number=SeqID_111720
  Gene Ontology: Mol. function=nucleic acid binding; Biological process= DNA integration
  Homolog annotation: Hit_ID=Q1S0A6; Match level="QueryCoverage=98%, HitCoverage=19%, E-value=1e-16, Identity=55%"; Hit description=Zinc finger, CCHC-type; Peptidase aspartic, catalytic; Polynucleotidyl transferase, Ribonuclease H fold
MAGSKESIDISSMWRELCNFKEVYPLNFGVNGGTNTTEVVVTDTIMFPKPPDIQIPNAHDENEPLGRGYHVKYPCTWLQDYVIHTIQKLSPSTCSSAQSYFSRAPYPITHYVNCEKFSLPHRHFLATITTEKEPLNFHETVKDAR

SEQ ID NO: 228499 - protein, 188 aa, Glycine max
  Coding DNA Sequence Number=SeqID_111721
  Gene Ontology: Mol. function=nucleic acid binding; Biological process= DNA integration
  Homolog annotation: Hit_ID=Q1S0A6; Match level="QueryCoverage=99%, HitCoverage=22%, E-value=5e-27, Identity=56%"; Hit description=Zinc finger, CCHC-type; Peptidase aspartic, catalytic; Polynucleotidyl transferase, Ribonuclease H fold
MSYLETAKELWDDIKERFSVVNGPRIQQLKSDLAQCKQGGLSMAARVVLQQNLKNAEKKNEGDRPKNDDKAGGQRRGQNRTRVRAHAVQNLGSNISGDVENSGMTGLSKEQWETLIELLNNSKVTPNESMTGKTKLNSWILDSGASNHMTGTLQHLCDVRKVPGCPVGLTNGHTATSTKEGTIRLAGG

SEQ ID NO: 228500 - protein, 1055 aa, Glycine max
  Coding DNA Sequence Number=SeqID_111722
  Gene Ontology: Mol. function=transmembrane receptor activity; Cellular component=membrane; Biological process=defense response
  Homolog annotation: Hit_ID=Q1SI46; Match level="QueryCoverage=98%, HitCoverage=95%, E-value=0.0, Identity=51%"; Hit description=Leucine Rich Repeat, putative
  Pfam annotation: Domain name=LRR_1; Domain location=630-651; Score =9.4; E_value=5; Accession=PF00560.23; Description=Leucine Rich Repeat
  Pfam annotation: Domain name=LRR_1; Domain location=653-676; Score =11.7; E_value=1.8; Accession=PF00560.23; Description=Leucine Rich Repeat
  Pfam annotation: Domain name=LRR_1; Domain location=677-700; Score =12.9; E_value=1.1; Accession=PF00560.23; Description=Leucine Rich Repeat
  Pfam annotation: Domain name=LRR_1; Domain location=720-741; Score =3.7; E_value=59; Accession=PF00560.23; Description=Leucine Rich Repeat
  Pfam annotation: Domain name=LRR_1; Domain location=743-764; Score =10.7; E_value=2.9; Accession=PF00560.23; Description=Leucine Rich Repeat
  Pfam annotation: Domain name=LRR_1; Domain location=766-787; Score =11.6; E_value=1.9; Accession=PF00560.23; Description=Leucine Rich Repeat
  Pfam annotation: Domain name=LRR_3; Domain location=607-626; Score =28.5; E_value=2.4e-05; Accession=PF07725.3; Description=Leucine Rich Repeat
  Pfam annotation: Domain name=NACHT; Domain location=206-357; Score= -1.0; E_value=6.8e-05; Accession=PF05729.3; Description=NACHT domain
  Pfam annotation: Domain name=NB-ARC; Domain location=162-463; Score =101.3; E_value=2.9e-27; Accession=PF00931.13; Description=NB-ARC domain
  Pfam annotation: Domain name=TIR; Domain location=14-144; Score =144.2; E_value=3.6e-40; Accession=PF01582.10; Description=TIR domain
  Pfam module annotation: Pfam domain module=LRR_1::LRR_1::LRR_1::LRR _1::LRR_1::LRR_1::LRR_3::NACHT::NB-ARC::TIR; Domain location=630 -651::653-676::677-700::720-741::743-764::766-787::607-626::206 -357::162-463::14-144
MSDNNTTPQIKYDVFVSFRGKDIRQDFLSHLVEAFDMKRIYAFVDNKLEKGEKIWKSLVEAIEGSLISLIIFSQGYASSHWCLEELEKIHECKEKYGQIIIPVFYHLEPTHVRYQSSDAFEKAFAKHGKKYESKVQQWRDILKKSADLSGIESSNFKTDAELVKKITNVVQMRLHKTHVNLKRLVGIGKKIADVELLIRKEPEDIRLIGLWGMGGIGKTILAEQVFIKLRSGYGGCLFLANEREQSRKHGMLSLKEKVFSELLGNGVKIDTPNSLPDDIVRRIGRMKVLIVLDDVNDSNHLEKLLGPLGNFGSGSRIIVTTRDMQVLKANKADEVYPLREFSLNQALELFNLNFFNQCDDQREYDNLSKRVVNYAKGIPLVLNELAYLLRARNKEEWGSELDKLEKIPLPEVYDRMKLSYDDLDPKEQQIFLDLAFFFGRSHTEIKVDYLKSLLKKDGESGDSVFIVLERMKDKALITSSKDNFISMHDSLQVMAQEIVRRKSSNTGSHSRLWDLDDIHGEMKNDKVTEAIRSIQINLPKIKEQKLTHHIFAKMSSLKFLKISGEDNYGNDQLILAEELQFSASELRFLCWDHCPLKSLPKSFSKEKLVMLKLLRSKIEKLWDGVQNLVNLKEINLSGSEKLKELPDLSKATNLEVLLLRGCSMLTSVHPSVFSLIKLEKLDLYGCGSLTILSSHSICSLSYLNLERCVNLREFSVMSMNMKDLRLGWTKVKELPSSFEQQSKLKLLHLKGSAIERLPSSFNNLTQLLHLEVSNCSNLQTIPELPPLLKTLNAQSCTSLLTLPEISLSIKTLSAIDCKSLETVFLSSAVEQLKKNRRQVRFWNCLNLNKDSLVAIALNAQIDVMKFANQHLSPPSQDLVQNYDDYDANHRSYQVVYVYPGSNVPEWLEYKTTNAYIIIDLSSGPPFPFLGFIFSFVIGEYLHTDTKGRLEVSITISDDESEGNQDSVRMYIDFEGRKIESDHVCVVYDQRCSSFLSSKVKNQTRLKIKVTMGVPDYALPQGYNRGVRFGVSPISTSAYESFIQQMKLRNSISQFH

SEQ ID NO: 228501 - protein, 113 aa, Glycine max
  Coding DNA Sequence Number=SeqID_111723
MLIVQEILAQMKNVDVQLNNVIFDVGHTYGIQKFEVEKNIGHYKATRHGFKINFVKETKVTPHEIPKTMYNFTMFDDIMLLVRLLRLGRGIYNERWMWKYHELSFMGVTGYGV

SEQ ID NO: 228502 - protein, 181 aa, Glycine max
  Coding DNA Sequence Number=SeqID_111724
  Homolog annotation: Hit_ID=Q10S76; Match level="QueryCoverage=48%, HitCoverage=28%, E-value=1e-19, Identity=51%"; Hit description =Expressed protein
  Pfam annotation: Domain name=VKOR; Domain location=14-145; Score= -8.6; E_value=0.0029; Accession=PF07884.4; Description=Vitamin K epoxide reductase family
  Subcellular localization annotation: CTP_CleavageSite=50; ConfidenceScore=5.24e-01
MATTFFTLASLSLPSSSRVSIGGAPIRDHRSPNQIRLLPPLKCSSSEPETAMHAPSDRTHKLISGVAGIDSSKPCIPLALFGMAAYGIEKSTAQVVLLGATTSMAAASAYFLYILTTRFSDSSCSYCLLSAFLSFTLFYVTVKDIGLQEVSKQLGMQLLVASLVILSLNTSYSNSKSASSR

SEQ ID NO: 228503 - protein, 79 aa, Glycine max
  Coding DNA Sequence Number=SeqID_111725
ECICVTVATICKLVVANRWIYDGCPKYNKSADEVGSPFVCVGCGNNLLGFVCCKDGVFDARDIPEKLDRVLGKNISIQI

SEQ ID NO: 228504 - protein, 996 aa, Glycine max
  Coding DNA Sequence Number=SeqID_111726
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=78%, E-value=0.0, Identity=44%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=458-621; Score =138.3; E_value=2.1e-38; Accession=PF00665.16; Description=Integrase core domain
  Pfam annotation: Domain name=zf-CCHC; Domain location=205-222; Score =31.4; E_value=3.3e-06; Accession=PF00098.13; Description=Zinc knuckle
  Pfam module annotation: Pfam domain module=RVT_2::rve::zf-CCHC; Domain location=765-996::458-621::205-222
MKAILGSQDVSDIVEQGLSTLLDGAMEEQKAAHKENKMKDCKAMVLFHHSREAWKILERCNVGAKQLKKVKLQTLRRQYELMQMEENERIVVYLNRIISHTNATKVEELQGSLEAHEQRLTERSMARSGDQVLQDTVSKKGGSGGRSSFRNRGRGRDQRGGGFKNSQNFSQDQERSDQDRPESSNKKGTSSKWHGGRKMVDRKNLKCFNCNKIGHFSTECTAPPGQNDNRGKHHEETHLAKEGTETNLEEKPLMLMMVTNHNPKDDERWYNDSGSSSHMTGHNNWCLNLDETKKNIVRFIDNRVIQAEGIGEVLIKRDDESSVILSECLYVPNMKSNLISLGQLVEKKFHIDIHNGYLAIFEPVIEKLVIRTKMASNKTFQVSLRNLESQCMTAEILAKDTWLWHLRLGHLNFRDLSMLRNKEMVLGLPAIQIPSKVCDSCLISKQPRNSFSNFTPSRANDLLHIVYSDVCDPFDAPSLGGSKYFVTFIDDLSRKIWIYPIQLRSEVFSVFKNFKALVEKQSGKCIKIFRTDGDGEFTSKEIEDFCKDQCIVHEVTVPYTPQHNGIAERRNITFLNMKRSMLRSKKLPHSFWAEAATTVVYVLNRCPIKKLDGKVPEEAWSGVKPSVRHFRIFGSLCYRHIPYQKRKKLDDKSEAMIFVGYNSIGSYKLYNPKKSEVVLNRDVNFDETQAWNWEKSQERLTSEFQIDEARPQRQRNLPARLRDFEVYPDNAISKDGDLVQHMALLADTGPVSFEEAITSRVWRDAMLEEIKSIEKNNTWELVSLPVEKTPIVVKWIFKLKLKPDGTIAKHKARLVAKGFMQKEGLDYSKVFAPMARLETIRLLVALASWKGCILWQLDVKSTFLNGLFEEEVSVTQAPGFTNKGSEDQVLRLKKTLYGQKQAPRVWNRRIDSFLAKTRFHKCSVEHGMYVKQLSQKARNLYICLYVDDLLITGSSASEIEALKENLKGEYEKTDLGVLSYFLGLKFQKHDCGLFMH

SEQ ID NO: 228505 - protein, 148 aa, Glycine max
  Coding DNA Sequence Number=SeqID_111727
MGLNQAHVFKERFIKSRKEHALQSPYHTYARARVMSEIKDDVAPCGACRPWIFFINGFLCFLRSDCSGMEKEKDECVEAKLHDESRLIQRCFDDAKESRVKQSFKQRFKNQVSCYKIQDSRIKFQESRITKINIQDSRFKNQEKTQSR

SEQ ID NO: 228506 - protein, 233 aa, Glycine max
  Coding DNA Sequence Number=SeqID_111728
  Gene Ontology: Mol. function=helicase activity; Biological process =viral genome replication
  Homolog annotation: Hit_ID=Q94LS3; Match level="QueryCoverage=95%, HitCoverage=19%, E-value=6e-37, Identity=34%"; Hit description =Putative helicase
MGASKYRCWRPCKDGNTIGKLNWVPPSTGELYYLRMMLVVVKGLTTYEQIHTVNGQLYSSFREACFAMGLLLDDKEYIEALREACHWGIGQFLRRFFVIMLISNSIERPNQVWTETWECLIDDEQRHIFNLTINVVNGQAGGMFFLYGYGGIGKTFMWKALASALRSKDNSTCNIHQGTKQAELLKETKLIIWDEAPMAHKYCFEALDKTLNDIMCMSNSDSVPFGRKVVVWR

SEQ ID NO: 228507 - protein, 112 aa, Glycine max
  Coding DNA Sequence Number=SeqID_111729
LDQSLIGKHLLFLIERESTEGRCLQDVVNSPNAYTVHQIYHRKQVLRMFHSKEFLTVAQELGAKIVAQRSSIENAKIIITHPAPPIVLIEWIKKQKEDLMCQGFGGSKNDAS

SEQ ID NO: 228508 - protein, 141 aa, Glycine max
  Coding DNA Sequence Number=SeqID_111730
MDMHLGSFISSQITLMAQHNSSRLGVPVLITALCKARGVHSDFLTLESLSPAINLAYIKKNYWNLDDPIVTFRGPRKARGKRFEAPSTTPPAPAPSPAAAEEETTPAQSPQPSPLSAPAPKEIQPSALDLNEDQPQEEQDV

SEQ ID NO: 228509 - protein, 118 aa, Glycine max
  Coding DNA Sequence Number=SeqID_111731
MASHKRKATTLVSQADSSGYGARGELASYSRFPKLRPDPQELAARLCIPGTGFVLNVEGLSWKFLRKDLTTLAQTWSVLSYSNLAPTSHTSDLNLDRAKLVYGLVMKMNMNSGSLISG

SEQ ID NO: 228510 - protein, 146 aa, Glycine max
  Coding DNA Sequence Number=SeqID_111732
MVIFHHGDAAEGKGEEERGGASPPRIALDKKLEVDALMEEKKERRGEHEIEGIKEGEKWNFESGPNLDPWAHKSTLRFMRTLRPSLSTLAQSSWSLLLMALRIYDALFILDESSNLCEVLCIQIMVVVNMVFMFQLKRSEIGAIIG

SEQ ID NO: 228511 - protein, 171 aa, Glycine max
  Coding DNA Sequence Number=SeqID_111733
MSNFTMFDDIVSGSINKLFDSGSIMSCTLWESLTLEFKDCFDKHVSGLVVLLLSLAKIKEAKGTYSIAIQNSMYGSQIFVNTDMKEILEFKDRFHVDDRAVQPNESVILTLWDRECYALIKETANEIKKKMIDEDEVFDARDILEELDRVLGKTLAFRFKVVPGNKRHSMS

SEQ ID NO: 228512 - protein, 168 aa, Glycine max
  Coding DNA Sequence Number=SeqID_111734
MSSSKKKPEEVVQPHFELRRDIEISNGENARKLVANMLFKFHDDPTVNESEIVIYLRQPGAENLLRAATLKFEKLKRECYRHAMKLDGEECQQANLGLEENEELDNVEDEEDAAEGNDSDEEWEEEHELDLFVNFPPNEIDCDYVQANVSEEEYQIYGEDSEGNYSDE

SEQ ID NO: 228513 - protein, 314 aa, Glycine max
  Coding DNA Sequence Number=SeqID_111735
  Homolog annotation: Hit_ID=Q1S062; Match level="QueryCoverage=92%, HitCoverage=94%, E-value=9e-38, Identity=34%"; Hit description =Arabidopsis conserved protein
  Pfam annotation: Domain name=DUF241; Domain location=56-307; Score =196.6; E_value=6e-56; Accession=PF03087.5; Description=Arabidopsis protein of unknown function
  Subcellular localization annotation: CTP_CleavageSite=46; ConfidenceScore=5.10e-01
ATMASTFSPKHSRGYAIRSISLPTRSHPSTVPIEEELNKLKSWETSSSSEVERIFFGLSGLANLYKCMEDLLKLPLTQQALSHHHNQKWVDELLDCPVRFLDILGETRDAIMQMKGNVRGLQSALRRRKVGDLVVESHVSSYWILRRNTRKQCTKSLVLLKHSTEGSSFGASPPLDLNHHLSAVVRVLREASLITSSIFQSLVGFLSSPILRSKINNKWTFVSRVMRKGVLQLQCNNQVENVNELEKVDLALCRMVMDNATKDFEAENIQFAQKELEAVVVVIEGLENGLDCLFKHLINTRVSFLNIVSPSGRI

SEQ ID NO: 228514 - protein, 314 aa, Glycine max
  Coding DNA Sequence Number=SeqID_111736
  Homolog annotation: Hit_ID=Q1S066; Match level="QueryCoverage=86%, HitCoverage=91%, E-value=2e-34, Identity=31%"; Hit description =Arabidopsis conserved protein
  Pfam annotation: Domain name=DUF241; Domain location=46-267; Score =160.5; E_value=4.4e-45; Accession=PF03087.5; Description=Arabidopsis protein of unknown function
MANKFHVRSISFPNGSHPSTIAVEEELSNLKTWEATSTSTSKSIGVGLSLLQDLHTCLEDLLNMGSTQKLISNHQGEKCMEELLDGSVRILDICGITRDTMLQIKENVQSLHSALRRRRKGDSSIEKIIAEYNFFSKKMKKNAKKLITSLKQMESKHGVSPLLNQDKQLAALIKVLREVIVMNMSIFKSLLAFLAVPASKSKATKWLLVAKLLHKGVIACEENQENYNELQCVEASLSTLLSEGTNVAKMQGAHERLEALENAIESIENGVFQSSKPKEICHPKTATANNIAPNQQHQPTTEFYQQSIKLGSSK

SEQ ID NO: 228515 - protein, 291 aa, Glycine max
  Coding DNA Sequence Number=SeqID_111737
  Homolog annotation: Hit_ID=Q1S066; Match level="QueryCoverage=90%, HitCoverage=88%, E-value=2e-33, Identity=30%"; Hit description =Arabidopsis conserved protein
  Pfam annotation: Domain name=DUF241; Domain location=46-288; Score =205.5; E_value=1.3e-58; Accession=PF03087.5; Description=Arabidopsis protein of unknown function
  Pfam annotation: Domain name=DUF793; Domain location=2-289; Score= -230.6; E_value=0.046; Accession=PF05633.2; Description=Protein of unknown function (DUF793)
  Pfam module annotation: Pfam domain module=DUF241::DUF793; Domain location=46-288::2-289
MASLYHVRSNSFPSGSHPSSIRKEEELSKMKTWEATSTSTSKSIGTGLSLLEDLYICLEDLLNVASTQKVISNHQGEKCMEELLDGSVGILDICGITRNTMPQVKENVQALHSALRRRKGDSSIEKSVAEYNFFTKKMKKNAKQLMTSLKQMESKFGVYPILNQDQDLAAVIRVLREVITMNMSILQSLLSYMAGPASKSKSTKWLMVARLMHKKRVISCEEDSQNFNELQCVEASLSTLLSEGTNVSKVQSVRDRLEALENAIESLENGLERMFRRLVRTRANLLNIMTQ

SEQ ID NO: 228516 - protein, 288 aa, Glycine max
  Coding DNA Sequence Number=SeqID_111738
  Homolog annotation: Hit_ID=Q1S066; Match level="QueryCoverage=95%, HitCoverage=92%, E-value=4e-34, Identity=30%"; Hit description =Arabidopsis conserved protein
  Pfam annotation: Domain name=DUF241; Domain location=46-279; Score =178.1; E_value=2.2e-50; Accession=PF03087.5; Description=Arabidopsis protein of unknown function
MANKIHFRSNSFPNGSHPSTITVEEELNKLKTWEATSTSTSKSIGIGLSLLQDLHTCLEGLLNMGSTQKLISNHQGEKCMEELLDGSVRILDICGITRDTMLQIKENVQSLHSALRRRKGDSSIEKIIAQYNFFSNKMKKIAKKLITSLKQMERKFGVSPLLNQDQQLVALVRVIREVIVMNMSIFQSLLSFLTVPASKSKATKWLLVAKLMHKGVTACDENQVNSNELLCVEASLSTLVSEGTNVAKMQGAHERLEALENAIESIENGLDSVFRRMGIPGKHKGDLY

SEQ ID NO: 228517 - protein, 905 aa, Glycine max
  Coding DNA Sequence Number=SeqID_111739
  Gene Ontology: Mol. function=sucrose synthase activity; Biological process=sucrose metabolic process
  Homolog annotation: Hit_ID=Q9FX32; Match level="QueryCoverage=88%, HitCoverage=86%, E-value=0.0, Identity=67%"; Hit description=Sucrose synthase, putative
  Pfam annotation: Domain name=Glycos_transf_1; Domain location=549 -739; Score=107.8; E_value=3.2e-29; Accession=PF00534.10; Description= Glycosyl transferases group 1
  Pfam annotation: Domain name=Sucrose_synth; Domain location=11-546; Score=819.3; E_value=2.1e-243; Accession=PF00862.10; Description =Sucrose synthase
  Pfam module annotation: Pfam domain module=Glycos_transf_1::Sucrose _synth; Domain location=549-739::11-546
  Subcellular localization annotation: CTP_CleavageSite=33; ConfidenceScore=5.13e-01
MASTAPNSALKRSDSITDSMPEALKQSRFHMKRCFARFVASGKRLMKQQHVMDDVEKTVEDKAERKKFLDGMLGYIFSCTQEAAVVPPYVAFAVRPNPGFWEYIKVNADDLQVEGIEAVEYLKYKEMIFDEKWANDENALELDFGAIDFSTPQMVLSSSIGNGLNFTTKILTSRLSGSSQSINPLLDYLLSLNYQGENLMIKDTLNTMPKLQQALKVAEAYVSALNKDTAYQKFEDRFKEWGFDKGWGNTAGRVKETMKLLSEVLESADPVKLESLFSRLPNMFNIVILSIHGYFGQADVLGLPDTGGQVVYILDQVRALEEELLHKIELQGLDVKPQILVVTRLIPDAKGTTCNQELEPVTNTKHSNILRVPFYTDKGMLRQWDATAKIFDLMEDKPDLIIGNYTDGNLVSSLMASKLGVTQATIAHALEKTKYEDSDAKWMAFDEKYHFSCQFTADIISMNAADFIITSTYQEIAGSKQKPGQYETHTAFTMPGLCRAVSGINVFDPKFNIAAPGADQSVYFPSTAKEQRLTSFHPAIEELLYSKDDNEEHIGLLEDMKKPIIFSMARLDKVKNLSGLVEWYARNKRLRSLVNLVVVGGFFNPAKSKDREETEEIKKMHFLMKEYNLKGQFRWIAAQTDRYRNSELYRCISDTKGAFVQPALYEAFGLTVIEAMNCGLPTFATNQGGPAEIIVDGVSGFHIDPYNGDESSDKIADFFEKCKTDSQHWNRMSKAGLQRINECYTWKIYAKKVLNMGSIYGFWRRLNREQKLAKERYIHMFYNLQFRNLAKQVPIPSETPQDPTQMPKPSAPAPSRRSAAKARPKKVSEHWIVGAPLTLLTAAATPKIKDHPTPSGEGVSEGTATSEQSGGGGLFGLRWLVPIIAFVCAIHYFLKNLDRLFTREQ

SEQ ID NO: 228518 - protein, 93 aa, Glycine max
  Coding DNA Sequence Number=SeqID_111740
WNEDKGYVGVRELNLKSGTWRYVAGVRRPWGRQGDRALVIDYQLGVIDLWRSICGHAGSPTLLITLKPHLEFSSFRDALSLVVPIATMYYLRG

SEQ ID NO: 228519 - protein, 105 aa, Glycine max
  Coding DNA Sequence Number=SeqID_111741
MEAMKEQMTTMMEAMMSIRKMMEVNTATVIAASTTTEVDSTHLSGFNQGGKALGSAGGPHFVQVQNKHSFPPYGLPPNYTPPNVTHTPNENVNNSAPIPIESQQP

SEQ ID NO: 228520 - protein, 144 aa, Glycine max
  Coding DNA Sequence Number=SeqID_111742
  Gene Ontology: Mol. function=peptidase activity; Cellular component =integral to membrane; Biological process=proteolysis
  Homolog annotation: Hit_ID=Q9M1S8; Match level="QueryCoverage=89%, HitCoverage=18%, E-value=9e-47, Identity=64%"; Hit description =Probable glutamate carboxypeptidase 2
  Pfam annotation: Domain name=Peptidase_M28; Domain location=32-144; Score=-33.8; E_value=0.0014; Accession=PF04389.7; Description =Peptidase family M28
MATVKLKLDSVWVKRRWPQNIFAVIKGSKDDRYVLLGNHRDAWTYGAVDPSTRTAALLDIARRFSALLDLGWKPSETIIFCSWDAEEFGMIGSTEWVEHNLIKLGSKAVPYLNVDCAVQGPGFFVGSTPQLDSLILEVTKMVFS

SEQ ID NO: 228521 - protein, 91 aa, Glycine max
  Coding DNA Sequence Number=SeqID_111743
DVTTFKVLLNEYKATCSSLDIPSSMYYFMKEKRFTQLNITDYVECHIVYNDWQKMAKIGSGWRDFSKAQSFKADMELVFEFPDPNVNYAFI

SEQ ID NO: 228522 - protein, 294 aa, Glycine max
  Coding DNA Sequence Number=SeqID_111744
MTEENHPPRVTLKDHATYTGPLHFNTIEASIHQCAPFVKINHVLDEALRLCLFPFYLAEDAISWLRSFPPNNLTRTQSKLMLDASAGEKIFLNTPKKAIEIIEKMATNAKKILSDRAMVPLKRLLEVSTQDGLLAQQKLLTRKIEELTQQNNNFLNNSSFKQLLQTINSNNNQGYKPYGSIGQEQGSSSNAMPRHNLYEKTRKLEETLTQFMQVSLSIRKSIEASIKEILKSSIKCQARDIKEVLLVRQPKNFKHLHHQKYGAKLIHGGEALSTCKLTPAERDLATMKALEWQQ

SEQ ID NO: 228523 - protein, 169 aa, Glycine max
  Coding DNA Sequence Number=SeqID_111745
MKVLEKHDLDVEALDKFNKEEVARLGSALATTERENNAEREEKLQIEQITYNDAYEPHECSFNHCLRQGETTTPELVFLCFFVKLMADNAIFSISYGFSLLRTLGISIHWKKMLSSILAKEGIWEGTCIDAILPRKGPITRTMSKRLQEDWARAAEEGPRVLMNLRIDF

SEQ ID NO: 228524 - protein, 122 aa, Glycine max
  Coding DNA Sequence Number=SeqID_111746
MGCRRELQHLLLHPLQLFMPKIFVLERFRLAILMIMALLVILGFIFSLGLFRSKGWYPPGGLDLEFARFIVTSQFSIHLSCSPQFTNAFYPSSYKVANSKLLARYLIPCTYRLKKSTLMVEN

SEQ ID NO: 228525 - protein, 413 aa, Glycine max
  Coding DNA Sequence Number=SeqID_111747
  Gene Ontology: Mol. function=nucleic acid binding; Cellular component= intracellular
  Homolog annotation: Hit_ID=P93716; Match level="QueryCoverage=87%, HitCoverage=88%, E-value=7e-26, Identity=28%"; Hit description =Tapetum-specific zinc finger protein 1
  Pfam annotation: Domain name=zf-C2H2; Domain location=37-59; Score =19.7; E_value=0.01; Accession=PF00096.16; Description=Zinc finger, C2H2 type
  Pfam annotation: Domain name=zf-C2H2; Domain location=92-114; Score =21.6; E_value=0.0028; Accession=PF00096.16; Description=Zinc finger, C2H2 type
  Pfam module annotation: Pfam domain module=zf-C2H2::zf-C2H2; Domain location=37-59::92-114
MEKDQEAQHHRENQGSLVTTVKVEGSEAVNNNEHRSWVCHICKKGFGSGKALGGHMRIHNLSKKQQVHRAKQGTTIVAKPKTNKWVFVSGNPTCSLCGKSFSSMKSLFGHLRSHPERMRKGIQNNTPSINGASSNSTSSSTLSDDSTAVDLSQALRGCWSVSAKRGRRSPSCSKSNSGLEDDGEIEPRMQEAVYNLMLLASGNPKREEELDGDQIEEKKLLNPVFGDSDEMKRDRKRVTKKMKLTELEAAEEGDKLCRICNTTFPSPQVLEGHLCSSKIFKNIQVMDESESDGVLATKEEHHAKKPTMQGEETTVLGGNAVEAIRGYHCKIFIKTFSTGQVFGDHKISNWTSTAEAQSSAQATSSPVGNAQNCSKILTFDLNQLPAMDGQDGVQSDLFIPANIVTSFSYGSSS

SEQ ID NO: 228526 - protein, 97 aa, Glycine max
  Coding DNA Sequence Number=SeqID_111748
LIRKRLTDQVIRKQPNNFPMAISAIDDNNGGRRSNAKEKHTSRKKLSVEDEAETRRRTTPTVLRRNAKKMPRSRNANSSEEDGIAAAHKKKIEESDE

SEQ ID NO: 228527 - protein, 155 aa, Glycine max
  Coding DNA Sequence Number=SeqID_111749
  Gene Ontology: Mol. function=protein dimerization activity
  Homolog annotation: Hit_ID=Q1RTL4; Match level="QueryCoverage=99%, HitCoverage=44%, E-value=5e-24, Identity=43%"; Hit description=Zinc finger, TTF-type
MSTRKYESCNSKLQKKRRVEALIASQKGAMYKFIKTDEKNGLENTGRCSLNEQDNNLDISENNNREVVSDEDNYNSDSQTHDNKEEIGRLDDSTFENIYDPSQWKNIDTTLRDLLVKNGPIKVTDMDFPKGKYSRHFSSSNYIQKLPNGEKHERK

SEQ ID NO: 228528 - protein, 99 aa, Glycine max
  Coding DNA Sequence Number=SeqID_111750
MSDGFCGTHLQIMVRTRGLGRALGQRVAVTAEHVDEPVIADPDVQDDPMEAPAAVEDIPADAGAEAAEDQPQGFPDGPSDPSVLTAYADHVACSVWTGE

SEQ ID NO: 228529 - protein, 76 aa, Glycine max
  Coding DNA Sequence Number=SeqID_111751
MFGEDKWLYQRTNDGHRGRKWSERGAPIIITGAPSILEKSQNYPYLVFHFRISLIRKRLTDQLTDQADPEVSYGST

SEQ ID NO: 228530 - protein, 59 aa, Glycine max
  Coding DNA Sequence Number=SeqID_111752
MEDHGLYNNEDFFRCKVAENKNVVCLEWWRRSTSTEAMVSSVDGGYGVWRPQKKLQGLE

SEQ ID NO: 228531 - protein, 114 aa, Glycine max
  Coding DNA Sequence Number=SeqID_111753
MTRRMKSGGKNNEINTAMEEIWHHLRMCFVPEPFPGNKVIEQGNHTRLTMKAMELGYFGIPYKSDDNGVVAQMIQGHCGVTLVIVGGMHGRCRRRGHYGRNVHDNIIHLDESKD

SEQ ID NO: 228532 - protein, 67 aa, Glycine max
  Coding DNA Sequence Number=SeqID_111754
MSRQEKWWYTFYPLPVPLLRLAVSTIPPLALAVQASHQCRWRYPLALKLEVSAGFKVAYEEIHGIQI

SEQ ID NO: 228533 - protein, 132 aa, Glycine max
  Coding DNA Sequence Number=SeqID_111755
  Homolog annotation: Hit_ID=Q1RYI2; Match level="QueryCoverage=59%, HitCoverage=12%, E-value=7e-07, Identity=49%"; Hit description =Ribonuclease H
MATCVNQILPQKFLNHDSKESGFQIESPEAHLAPQSINLIWKQRQKKTRSLWSLKNSTCNCNTPLLLNKTITIKLVLTAGRRHRRKGNGSSPFPFSSISSISSIFISFWKNKSNGDMINRGISSKACGVGKH

SEQ ID NO: 228534 - protein, 249 aa, Glycine max
  Coding DNA Sequence Number=SeqID_111756
  Gene Ontology: Mol. function=protein binding; Cellular component =integral to membrane; Biological process=multicellular organismal development
  Homolog annotation: Hit_ID=Q011S8; Match level="QueryCoverage=86%, HitCoverage=47%, E-value=4e-50, Identity=48%"; Hit description=[R] KOG2489 Transmembrane protein
  Pfam annotation: Domain name=CLPTM1; Domain location=1-249; Score= -343.9; E_value=0.00052; Accession=PF05602.3; Description=Cleft lip and palate transmembrane protein 1 (CLPTM1)
SVDETPALRVSGVGLGTETVETRELDLSAHEAVVEAVRKNLTLRMYAVVSRRARTIFEEDEAYDARDVLVASVDLTTRRRKKIVKTRKLLGAKSSDEGETVTESVDDGVEDEGEEDASRETVMTYFKPNATLTVVDDFVAYNPTTLPDILASQMRFTDERRSSYDPTVYFNEFWMIKSYLRQFNETSAATLKVNFNFEVLSQLRWQMYTSMEQSWKTQRDFGAAGENDADNIKRVFLEGNPVLLAVTSV

SEQ ID NO: 228535 - protein, 256 aa, Glycine max
  Coding DNA Sequence Number=SeqID_111757
  Gene Ontology: Mol. function=transition metal ion binding
  Homolog annotation: Hit_ID=Q00T18; Match level="QueryCoverage=70%, HitCoverage=24%, E-value=1e-64, Identity=68%"; Hit description=[S] KOG3758 Uncharacterized conserved protein
MKEQLTSVIGSKSARPKWAGDAFSLNCLLAIREPLRTYPAAGAKVDELSRAIATKISHVADAEAGKILSASGLSDALELVVLYQEQGFSSGSSVMANDPALKIDALATALSSLVDAVGTDAPEFEQVQSPAVRRDVVARYNSQLVEAYTRVYAAVLNPSAGYGADARSKIRHGPDALSTVLGADGVERASGVERVARAAGRAMDGGARSTSTHGMSRRQPSGSRGASGARASGKRETSRLEMLEALERELDETESL

SEQ ID NO: 228536 - protein, 194 aa, Glycine max
  Coding DNA Sequence Number=SeqID_111758
MRFGVARLLEGFGNKGLDEMRVAESESQKRVKQTQFEKKHNVGLYNIDLQHWVTSGFEKPKHTRKILKEAIREICKIHQLSAFNSLHMDGSCFGQPGTAGFQAIYSSRSYKKMVEGLLWRYWGSRLIISKWRFQCCVLDCNLLGVPNLGIFYASRSDSLHAVKLVQQSVRGFIFYVGAAIDTGGKLEPPVPMAG

SEQ ID NO: 228537 - protein, 158 aa, Glycine max
  Coding DNA Sequence Number=SeqID_111759
  Homolog annotation: Hit_ID=Q9LJH6; Match level="QueryCoverage=31%, HitCoverage=4%, E-value=2e-10, Identity=54%"; Hit description =Arabidopsis thaliana genomic DNA, chromosome 3, P1 clone: MAG2
MEMSCLDAWYSDRDGTLECPTTYIVKGLCRWCCLPKVILYCMQSWLAILKLTFFTCLVNNNYRQDYNFTFLKETLEALCFKLHPLCVSRKVMRPIVVFFSLLSSTHMSNWMETDMISVMNQPIHSTDKGKELLDKDETIMHPRNKIRIISKFVSASTI

SEQ ID NO: 228538 - protein, 96 aa, Glycine max
  Coding DNA Sequence Number=SeqID_111760
  Gene Ontology: Mol. function=actin binding; Cellular component=F -actin capping protein complex; Biological process=actin cytoskeleton organization and biogenesis
  Homolog annotation: Hit_ID=Q9M9G7; Match level="QueryCoverage=87%, HitCoverage=26%, E-value=3e-11, Identity=47%"; Hit description =Probable F-actin capping protein subunit beta
  Subcellular localization annotation: CTP_CleavageSite=65; ConfidenceScore=5.30e-01
MWRIPPKHAETALSALLSLMPHSSSKLLSQVNQPPSLPFSFSPTFFHFPQFLVLCNVECDKEFILCEYNRDVDSYKFISFFIIIPPVSGFCWIQYA

SEQ ID NO: 228539 - protein, 64 aa, Glycine max
  Coding DNA Sequence Number=SeqID_111761
MEKVLMMGSSVPERVERLPSKQNQHTPYDLHPLSLNIKLPLLLYKSLPQLFNNFIIALTFNLLF

SEQ ID NO: 228540 - protein, 118 aa, Glycine max
  Coding DNA Sequence Number=SeqID_111762
MYAMRHLNSENILHLFHDCGPIKVAWALLIQGRVDGIFFVETNWQVIDAKKVIYMDNMIGSSVIVQQDIHWVPPKCGEVSLNCDASVTDMGQHVVALLGKWMMFLFVILLLKLGNVLF

SEQ ID NO: 228541 - protein, 99 aa, Glycine max
  Coding DNA Sequence Number=SeqID_111763
MAAHIIRAGIIDFKECDGQIDGLTFSEQSQSGRRNKRNFGIDLGEVAASLGKVRAKEKEEGKKGEGKKKKNRVGRCVKNCFRQEHASEIGGMRYGGPIK

SEQ ID NO: 228542 - protein, 128 aa, Glycine max
  Coding DNA Sequence Number=SeqID_111764
MIFHSPLLQNATQTLTPPSPPPTTTGGCHELPLLVVEPPHQEEHLNQSRILLKDSVEKVPPILHFKASLSDLVGYSCWGKKSVSYEEEYLYLGACHSIWNSLKTQADHREGGGGGLPVHDRVTLTLTV

SEQ ID NO: 228543 - protein, 44 aa, Glycine max
  Coding DNA Sequence Number=SeqID_111765
MVRALALPKMVKSTKLREYEMKNRIWCKCRDRTLTLGWSLADDG

SEQ ID NO: 228544 - protein, 119 aa, Glycine max
  Coding DNA Sequence Number=SeqID_111766
MLRFHCYANSDAHYKLRVRGRGTNLFAEKKKKALARLAEKKLHGEEKKQVPGEEEAVPGEKKLCSGTGEKKNLFEKNWQNGTFNQLLGAPAIMLGARSNSRVAYASWVKFSRVRKVMNH

SEQ ID NO: 228545 - protein, 142 aa, Glycine max
  Coding DNA Sequence Number=SeqID_111767
  Subcellular localization annotation: CTP_CleavageSite=35; ConfidenceScore=5.12e-01
MVTLGGADQHKKSRAPFSLRALKQATEFMSDLGCLSSTSPSCSPSDPPIVQVVAATVADSPALPSPHIQVVPAPPSTVLTVSTPLAILVSISPTSIAILLLSAGVTTNVLGHLSHPSLAFPSPALTVLPLTMPSSSLHPNVS

SEQ ID NO: 228546 - protein, 77 aa, Glycine max
  Coding DNA Sequence Number=SeqID_111768
  Subcellular localization annotation: CTP_CleavageSite=35; ConfidenceScore=5.29e-01
RIPTLFEVSFVMWFPGSFPFTSYPNFVNINQCTLRVRLIASEPNLRSCLMDEGLTGWLTVRDEFSITQDKRVASESE

SEQ ID NO: 228547 - protein, 60 aa, Glycine max
  Coding DNA Sequence Number=SeqID_111769
MAARGGHQWSWVVEKEVLGELVLLRRSPLFSLSMQILAQRNFLYTMARSAGQFSLNAIPS

SEQ ID NO: 228548 - protein, 157 aa, Glycine max
  Coding DNA Sequence Number=SeqID_111770
MEDSIGKITKITFPSQDGPLLTVKNTLENGGFNRENNKDNISQSRGSALDGEEHIGEYRNPIGKITNIIFPSQEGPLFTVKNTLENGGFNRENNKDHISQSRGSALDGEEHIGERRNPIGKITKITFPSQDGPLSSLSIPSTSRGGPVPTFVPFSEG

SEQ ID NO: 228549 - protein, 123 aa, Glycine max
  Coding DNA Sequence Number=SeqID_111771
  Gene Ontology: Mol. function=DNA binding; Biological process=DNA integration
MLLRYYNVVKNLVDDFDCFEMYHIPRENNTRAYLLSKVATKKTGHLKTIIRETLQAPTIDTKEVMGCYYVILDGELFKIRMTTPLLKCLNNQQVDYVMWKLHKGNCDLHTGGRSLATKVVCSG

SEQ ID NO: 228550 - protein, 81 aa, Glycine max
  Coding DNA Sequence Number=SeqID_111772
MEDCLEGPHLGNHETQLQTRRWRTHEQRKAITFIGLRKRGRMEDCLEGGVGYRQSRTTLNGNLKGRDTKNGFSFAGNPLPC

SEQ ID NO: 228551 - protein, 454 aa, Glycine max
  Coding DNA Sequence Number=SeqID_111773
  Gene Ontology: Mol. function=RNA-directed DNA polymerase activity; Biological process=RNA-dependent DNA replication
  Subcellular localization annotation: CTP_CleavageSite=26; ConfidenceScore=5.12e-01
MTSLVSMVGAWSVSRMMVLRCPVFLVATLESNYMSVFVTGEVPTELSTLSRPLLIASPRGQGLCWGFFVHAHDLTVTATRGGMRLAWLPKIRSNLQAFSIPLSGLLSVCLDNYDFSDQGWELHLKYTCGTTLVDEDFRHHEIGDDNGDNHGIILVDPFEIFVSECYGREASWLLYVDPVDVCLLALAKVDVHASRSDAYVSLPPLFGPSFYQHLGSCNGRPSAPRPYFLFGCHQAFLRIGIVIGYVQSRSRRRLLQEWWLDLLSKACDARTLVPSEKANPLARSHSSSMLLGGFLYKLSTNLLGRKANSMECKATSRFRFLIWTVIQSNLSINLLSDSSSTWRKLAKAVDVQRFIIALRVEQFPTNGQVDLHDVIYKRMSTSRSSFMAMYVQDVVVAVATCPIAGERRRGSRVCFPKEERCAESPPTFICGKRREKPKEIGQNENSKFRSCIYA

SEQ ID NO: 228552 - protein, 105 aa, Glycine max
  Coding DNA Sequence Number=SeqID_111774
PSNNSSGGFSNRGPQQHQAQLDRMSKMEDTLTQFMQDNNEKKNKEGIEKENEINDEVVTSEKVVIEEEKNKSNEQTTDKVKAIEEDEDMAELVDYFIGGDWAPQP

SEQ ID NO: 228553 - protein, 123 aa, Glycine max
  Coding DNA Sequence Number=SeqID_111775
MTPKKQESTRIPRIINEEDAKRTFPEKINLPNIIFYYWSRALKDHFNSKRKEKPIPYCMYFTQIMKNIRVDMSTFAPFEGLNQFTSSTFIKMGIVEIFLDWTKHHIKRKVKKEPQSIEECRRI

SEQ ID NO: 228554 - protein, 91 aa, Glycine max
  Coding DNA Sequence Number=SeqID_111776
MASILTYLPSLKVASSKLEELFGDVSSDPLLEGKSIDNMFGIQQVLLKGLEALGHTFTKAKINLDMLDNFPKMWEPNTTTIQEAKNMKTLS

SEQ ID NO: 228555 - protein, 102 aa, Glycine max
  Coding DNA Sequence Number=SeqID_111777
  Gene Ontology: Mol. function=RNA-directed DNA polymerase activity; Biological process=RNA-dependent DNA replication
MGACQRGLEDNNIKEFNEWIVDLEVEGVLWVGRKFTWFRLNGSAKNKLDKIFVSLEWLAKWPRSTQFTLDRNFSDHCPILLRSKHIDWGPKPFRILDCWFKT

SEQ ID NO: 228556 - protein, 251 aa, Glycine max
  Coding DNA Sequence Number=SeqID_111778
  Gene Ontology: Mol. function=RNA-directed DNA polymerase activity; Cellular component=nucleus; Biological process=RNA-dependent DNA replication
  Homolog annotation: Hit_ID=Q1RTD3; Match level="QueryCoverage=96%, HitCoverage=41%, E-value=7e-61, Identity=43%"; Hit description=IMP dehydrogenase/GMP reductase
MAAQSHESLLRKKARLRWIKEGDCNSRYFQMLMNVNRRNNSLKGMMIDGSWIDEPGRVKEATIGQQQNDILVGRFHEDEIKKAVWECGSEKSPSPNRLNFKFTKEFWKVIKPDVIRFLDEFYVNGIFPKGCNTSFIALIPKVAGPQNLNEYRPISLIGCMYKIVAKLLAERLKKVLPAIIDERQSAFIGGRHLLHSVIIANEVVEEAKRSQKPCMVFKVDYEKAYDSVSWDFLIYILRRLGFCSKWIQWIE

SEQ ID NO: 228557 - protein, 127 aa, Glycine max
  Coding DNA Sequence Number=SeqID_111779
MLVVANVTNYFMNYIVKNQCRDSSMTGDVSSIGACRPRIFFINGFLCFLEDEWQQNGERKRERRRHFKEKMSLEEAHHHRRPLITAWRKKKMNEGRGREEHEILCSKRALKSEVNIQMIKVPKNAHT

SEQ ID NO: 228558 - protein, 121 aa, Glycine max
  Coding DNA Sequence Number=SeqID_111780
MSLNQDPVKRKKAEWCDKNTEIMLKVCIEEDREKKTIAASDEWWEAKIQGKMVKFGKAESEVRNSGVDGFYKFLGCEYGKRSIYKLAKRRERKSETNRRTGAMMLAFALLCCLGFKKSTRK

SEQ ID NO: 228559 - protein, 200 aa, Glycine max
  Coding DNA Sequence Number=SeqID_111781
MDNVTVCADGDKYCSPMKKARGSTGDAMKQRREDQYDNTHRCIMCRVHKLHAPRPAWGHVQRCFELAAHMDSVTVFSDRQQRSKVRAPKKRCWEVCQKRANESQNGPKLTGLCAPQSLNEKLVRAPAAASGRGEKSPEGQRHKSSLERGNRSPEDGKTSRKVHRNVKIDKNVVNKATSSATSFATLHSRLGHPSVPAMKI

SEQ ID NO: 228560 - protein, 402 aa, Glycine max
  Coding DNA Sequence Number=SeqID_111782
  Gene Ontology: Mol. function=protein serine/threonine kinase activity; Biological process=protein amino acid phosphorylation
  Homolog annotation: Hit_ID=Q9FGC1; Match level="QueryCoverage=70%, HitCoverage=37%, E-value=7e-71, Identity=51%"; Hit description =Protein kinase-like
DDGEIEGDVNHRIQAGWMKWRKASGVLCDAKVPIKLKGKFYRTAVRPAILYGTECWAVKSQHENKVGVAEMRMLRWMCGKTRQDKIRNEAIRERVGVAPIVEKMVENRLRWFGHVERRQPVVQNIKVDNHPGGGHWFAAGLSPNVSGKSRASLYSSPHFQMVQHPPANSYGSVGSHGSYNDSVGLGSSYGSYGESSNMFAYYSPIGPSGMNMHNQGSMSMLGNSPDARRRVKYQPGNGLGISPSAGNFAPLPLGASPSQFTPPSSYSQVSVSSPGHYGPTSPARGTSHGSPLGKTAAVSQFNRRKNWGHSGSPQTQETFSSHWPGQYPDSTSHTEGTSQALGSSPSYLQSNSNPGNWKQRGSGGLSANQNISSLMKPSASMNPQSTEVVHDNAETGISLPDP

SEQ ID NO: 228561 - protein, 66 aa, Glycine max
  Coding DNA Sequence Number=SeqID_111783
MTRWIALRNHVLKDVETQRSDRMWHWGIGFYRRPCLSRKGVTMDELKDLIKQVAPRGIPLYGVDET

SEQ ID NO: 228562 - protein, 264 aa, Glycine max
  Coding DNA Sequence Number=SeqID_111784
  Gene Ontology: Mol. function=RNA-directed DNA polymerase activity; Biological process=RNA-dependent DNA replication
  Homolog annotation: Hit_ID=Q1SUI8; Match level="QueryCoverage=50%, HitCoverage=50%, E-value=5e-18, Identity=38%"; Hit description=Beta tubulin
MTTRSGGQVNKGTQKSGGQVNKVAEEFSMGGCVGAKQNSLDPLENGVLAKRRWRVIESKYGGWRNLSEARSANNESTWWRDLKIVDQHPQQGQLLNSSIAWKQNYFIQQMGEFKDSGWEWDFKWRRPLFDNEIDMAVSFLQVLEGNRIRSHRADQWVWVADSSGHYTVRSAYNVLREDLLQEDQDGEFKELWKVKVPSKVAVFAWRLLKDRLPTRDNLRRKHVELQDFMCPFCRTIEESADIIFFSTYMEHLKEYSWTDGRGGG

SEQ ID NO: 228563 - protein, 176 aa, Glycine max
  Coding DNA Sequence Number=SeqID_111785
MVVEKFMKIPPHLNSSNRCENSSATFDELLLQEDGSDESSLTTEFGRSMNLGSTETWAGFGRFNHVSSTSTPIIMQRLNAPSQAFTNVEMGSLPTHDLQTTYVPSMSKHFHLMPHILQNSPSRFGHQSVQRFTHGRPPQGAEWNQIKIQATSSGFSSVGPRSPRNNSFTNSMTWGI

SEQ ID NO: 228564 - protein, 131 aa, Glycine max
  Coding DNA Sequence Number=SeqID_111786
  Gene Ontology: Mol. function=metal ion binding; Cellular component =nucleus; Biological process=regulation of transcription, DNA -dependent
  Homolog annotation: Hit_ID=Q9SB61; Match level="QueryCoverage=60%, HitCoverage=34%, E-value=7e-14, Identity=48%"; Hit description=ZF-HD homeobox protein At4g24660
MCNLWWVVQHVGYSMQALLRGLGCRRRRWLRGQAGCATTSKRGRLHSVVDGGNLVVDLLAVEIPMVVAGNADDGLQRVILSGRQELATVVGGMAAEAHDVVLLAFSAPHLHRRRTECALPPLTAAKFQPCR

SEQ ID NO: 228565 - protein, 262 aa, Glycine max
  Coding DNA Sequence Number=SeqID_111787
MESNSFHLKFLIPPRIRITWQTHIDVGSSRSVITTPCAIIIINRRNSLSVRKNFSFPKLLKVVKKWEEAKKCQPQGFIKNETDSEDIDEDEDFIFRQKMFSTINKENSDIDGTENLIEKIDLQDSYEKEINLKNTLEITSKIDETKSLVSFPESYKSLMADTSSTSSNFIPQFDYSMEDYQMGFLPREKFVTLADLSLGDNIKSKGKTFPIVPVFNMSSLLLNIGSIDPQLLTNYIEQWTSAVIRDYRVNHENHVTNFIIPN

SEQ ID NO: 228566 - protein, 164 aa, Glycine max
  Coding DNA Sequence Number=SeqID_111788
  Homolog annotation: Hit_ID=Q10KN0; Match level="QueryCoverage=75%, HitCoverage=20%, E-value=5e-36, Identity=57%"; Hit description =Expressed protein
  Pfam annotation: Domain name=NCA2; Domain location=28-164; Score= -129.2; E_value=0.02; Accession=PF08637.1; Description=ATP synthase regulation protein NCA2
MWLVIKHKKPRKITQYWIRYTCGAVGLSVCSIWLLRHSRLVGSSDLDNWVEEARNSTYSFFKNHVEEPILSIRDELFDTFKKRHQGIMDVEEVQLTSNSLHRMLLAFSEQTKGQKFPVNASDQEMMEIVMDSKGSLVIAWLFSGFSTKIVLHANDFLRNEDTAL

SEQ ID NO: 228567 - protein, 227 aa, Glycine max
  Coding DNA Sequence Number=SeqID_111789
  Homolog annotation: Hit_ID=Q10KN0; Match level="QueryCoverage=57%, HitCoverage=19%, E-value=6e-20, Identity=40%"; Hit description =Expressed protein
  Subcellular localization annotation: CTP_CleavageSite=70; ConfidenceScore=5.05e-01
MAVPTSESESVENRTLLSQFYSHYLVNRIKTLYPYFSTNFFSNFALRFRSTQRRECLPLPLPSSSLDSPVLMTKRSRVHDVVEDILERVLINLHSVQKNLHFWQSRAKSTDSEKARFMIFERGPRAFIDETVKLLCGLTVQGSSTQNLSQSASDYIGERVGFLNSLRYSLATFLAQMWGSSSSGISHDSVYMEVDKIGEELVEDPETKLPLLLKLQLDICMQRVRFI

SEQ ID NO: 228568 - protein, 56 aa, Glycine max
  Coding DNA Sequence Number=SeqID_111790
MTYPKKSADGLIYCGGEHGVVDDLVELLHAEIVEENTMLYEEVVHDGIVNVAHSDG

SEQ ID NO: 228569 - protein, 106 aa, Glycine max
  Coding DNA Sequence Number=SeqID_111791
  Subcellular localization annotation: CTP_CleavageSite=63; ConfidenceScore=5.18e-01
MARKLRQDFSISKAKKFRSFSLTLTLLFLPFSSTIEASIKAPNFTHHFYSKSQKEAIFGVVKRTSTLWDFKFQVWVDFFSHDFVGIGCLGDMMGSFTRFMSYGSYL

SEQ ID NO: 228570 - protein, 64 aa, Glycine max
  Coding DNA Sequence Number=SeqID_111792
  Subcellular localization annotation: CTP_CleavageSite=32; ConfidenceScore=5.26e-01
MSHFMLFSLAFGGTICQVINVNSFPVGRLSINRMVEWSQQLNVRHLAFQFTFPLADTCTFVFYI

SEQ ID NO: 228571 - protein, 141 aa, Glycine max
  Coding DNA Sequence Number=SeqID_111793
  Gene Ontology: Mol. function=oxidoreductase activity; Biological process=electron transport
  Homolog annotation: Hit_ID=Q1K0Y8; Match level="QueryCoverage=78%, HitCoverage=19%, E-value=3e-16, Identity=43%"; Hit description=FAD dependent oxidoreductase
MEDFSQISSVGSIIHAFNPLSCLQAMQLVMRTLVHFGAPKQILIDGKPHLGTDRLVPLLRNVRQHLQDLGVTIKFGTKVDDLVIKDRHVLGVMVSESADKLHLTSQKMEYDAVILAVGHSARYIYEVLLAHNVELIPKDFT

SEQ ID NO: 228572 - protein, 253 aa, Glycine max
  Coding DNA Sequence Number=SeqID_111794
  Gene Ontology: Mol. function=oxidoreductase activity; Biological process=electron transport
  Homolog annotation: Hit_ID=Q012U1; Match level="QueryCoverage=81%, HitCoverage=34%, E-value=4e-37, Identity=38%"; Hit description =Homology to unknown gene
MGRIYFIATNFGGKEEYAELASEVCHGRGKIPVADYKVANYIDKEDFNDVSDSGVTNRSCYSFCMCPGGQVVLTSTSPSEICINGMSFSRRASKWANAALVVTVTTKDFEALNYYGPLAGVKFQRVFEQRAAMMGGGNFIVPVQTVTDFLENKLSDFLTFQLPGFICNDALLHGVETRTSSPIQIPRNGDSYECTSVKGLYPVGEGAGYAGGIISAAVDGMHAGFAVAKKFSLFHGDVESVLGKAQNVGVVKY

SEQ ID NO: 228573 - protein, 160 aa, Glycine max
  Coding DNA Sequence Number=SeqID_111795
  Gene Ontology: Mol. function=oxidoreductase activity; Biological process=electron transport
  Homolog annotation: Hit_ID=Q012U1; Match level="QueryCoverage=85%, HitCoverage=21%, E-value=1e-21, Identity=48%"; Hit description =Homology to unknown gene
  Pfam annotation: Domain name=Pyr_redox; Domain location=77-160; Score= 3.5; E_value=0.0077; Accession=PF00070.17; Description=Pyridine nucleotide-disulphide oxidor
MDVQKLISLEPRCWDFISRLEPKVGLVERVHDERDFGDLASIIHDCKENKEVALKGGNGHSIFSTELCKNQATRKPKIAVVGSGPSGLFAALVLAELGADITLIERGQPVEKRGRDIGALVVRRILDLERWCSAGTWSDGKLVTRIGRNSGSVLAVSFLM

SEQ ID NO: 228574 - protein, 74 aa, Glycine max
  Coding DNA Sequence Number=SeqID_111796
MSEIKEVHEQMKANMEAIKQQMTTMMEAMMSMRKMMEDNTATVVAVSTAIEMDLIHLADFNQVNRLVSDVVCQG

SEQ ID NO: 228575 - protein, 90 aa, Glycine max
  Coding DNA Sequence Number=SeqID_111797
  Gene Ontology: Mol. function=RNA-directed DNA polymerase activity; Biological process=RNA-dependent DNA replication
MGEERCKPVREEVDKLLNANFIREVRYSTWLTNIVMLKKANEKWFQVLSFLNAYSGYNQIKMHAPDEEKMEFIIDDAHFFYKVMPFGLKM

SEQ ID NO: 228576 - protein, 81 aa, Glycine max
  Coding DNA Sequence Number=SeqID_111798
  Subcellular localization annotation: CTP_CleavageSite=43; ConfidenceScore=5.61e-01
MSPPLLEPHNHSNSSQALRTTSSSSSVLCSSSFFQILPHAQPRSVALSGWLAKPEDWVNEGMKISTSQTCLINLKLRGNGY

SEQ ID NO: 228577 - protein, 93 aa, Glycine max
  Coding DNA Sequence Number=SeqID_111799
MGVQGGNKGGIGTVLLDELEVIIRNFNLRRREFPAEAPLGRRKQCCPNLTCKPKRGHPITRYDFSGRSWRCCIGLCLCGLKVKTEGVTCDLRR

SEQ ID NO: 228578 - protein, 192 aa, Glycine max
  Coding DNA Sequence Number=SeqID_111800
  Subcellular localization annotation: CTP_CleavageSite=38; ConfidenceScore=5.41e-01
MNCVFVHVSSTLKLGAMRSDSLGQFSIVNFFRNPMNCVFVHVSSTFELGAMGSDCLVQFSIVNLFRSPMNCVFVHVSSTFKLGAMRSDCLGQFFIVNLFRNPMNCVFVHVSSTFEFGAMRSDCLVQFFIVNLFRNPMNCVFVHVSSTFEFGAMRSDCLVQFCIINLFRSPMNCVFVHVSSTHAFGAMRTDCL

SEQ ID NO: 228579 - protein, 60 aa, Glycine max
  Coding DNA Sequence Number=SeqID_111801
MVNIGKCSSFCLSALKGLDDTPQTKSKAGARWIVVKYFNDARPLELERLKVFCIQWAKYY

SEQ ID NO: 228580 - protein, 295 aa, Glycine max
  Coding DNA Sequence Number=SeqID_111802
  Gene Ontology: Mol. function=chitin binding; Cellular component =extracellular region; Biological process=chitin metabolic process
  Homolog annotation: Hit_ID=UPI000044A8F0; Match level="QueryCoverage =75%, HitCoverage=99%, E-value=3e-26, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=62; ConfidenceScore=5.43e-01
RPPHQRTTRPRLQRTTHPCLQRAARPHLQRTTRPRLQRTPCPHLHRATRTRRQRTARPRLQRAAHPRYRGQHILAIRGLHALSFRGIHVVAFRGLHVLVFRGLLALAFRGLHVLTIRALYALTFRGLHVLTVRGLYALTFRGLHVLAIRGLHALTFRGLYILAIRGLGLHALTFRGLHVLTFRGLHALTFRGLHVLAIRWLHALAFRVLHVLTFNGLHVLTFRGLHALTLRGLHVLTFKGQYTLAFKGRHILNFKGLHALMFRGLHALTFRGLHALPFRGLHVLAIRGLHALTFR

SEQ ID NO: 228581 - protein, 232 aa, Glycine max
  Coding DNA Sequence Number=SeqID_111803
  Gene Ontology: Mol. function=metalloendopeptidase activity; Cellular component=outer membrane; Biological process=proteolysis
  Homolog annotation: Hit_ID=Q8UC34; Match level="QueryCoverage=99%, HitCoverage=33%, E-value=1e-116, Identity=90%"; Hit description =Peptidyl-dipeptidase
MPSKTTLYPSLVTWDGHNGLPKFDAVKDEDFAPAFEAALLSHEQEIDAIAGNAQAPSFENTVTALEIAGDELSRISALFWNRAGANTNGVIQALEREIAPKMSRHYSKIGMNEALFKRIDTLWEKRETLGLTGEESRVLERHWKGFVRSGAKLPKDRQERLAAINEELAGLGAKFGQNVLADEKNWKLLLSTEEDLPAFPAFCATQWRVRPVSMARMACSPSPFPVPSSSPS

SEQ ID NO: 228582 - protein, 98 aa, Glycine max
  Coding DNA Sequence Number=SeqID_111804
MVPNALLTRKWCFFGHLNLNITFSMHSIRILESFISMKGCRSIGDQKCHSLNYGVEPSSCFYEKVHQVKLKYGSNHLAKIGAKDGLGYITASSTAKHI

SEQ ID NO: 228583 - protein, 82 aa, Glycine max
  Coding DNA Sequence Number=SeqID_111805
  Subcellular localization annotation: CTP_CleavageSite=57; ConfidenceScore=5.03e-01
MESSSVTTYPMTGVRGEKKKEHVPKRKMRGSRHQRLFKKNVRKTKTRSGTFENKGSRVVYAWGRVLPLLLRILRCDEKSRST

SEQ ID NO: 228584 - protein, 300 aa, Glycine max
  Coding DNA Sequence Number=SeqID_111806
  Gene Ontology: Mol. function=gluconate transporter activity; Cellular component=integral to membrane; Biological process=gluconate transport
  Homolog annotation: Hit_ID=Q46892; Match level="QueryCoverage=100%, HitCoverage=65%, E-value=1e-108, Identity=68%"; Hit description =Inner membrane permease ygbN
  Pfam annotation: Domain name=GntP_permease; Domain location=1-300; Score=173.3; E_value=6.1e-49; Accession=PF02447.7; Description=GntP family permease
MTGGMGGVLGSVTIIIGLGAMLGRMIEHSGGAESLAQRFNQGLGPKRTVAALTLAAFILGIPVFFDVGFIILAPIIYGFAKVAKVSPLKFGLSMAGVMLTVHVSLPPHPGPVAAAGLLNADVSWLTIIGLAICIPVGAIGYFAASYLNRKTYPLSIEVLEQLQLAAPEPRPEGQAPLSDRINPPGAGLVAALIVIPIAIIMLGTVSATLLPAGSALRDTLSLLGSPAVALMIALLLAFYFLALRRGWSLQHASDVMGAALPTAAVVILVTGAGGVFGKVLVESGVGNALVEVLTAIGLPL

SEQ ID NO: 228585 - protein, 232 aa, Glycine max
  Coding DNA Sequence Number=SeqID_111807
  Gene Ontology: Mol. function=DNA binding
  Homolog annotation: Hit_ID=Q1S0F5; Match level="QueryCoverage=54%, HitCoverage=24%, E-value=5e-15, Identity=37%"; Hit description=IMP dehydrogenase/GMP reductase
MIDAFLAYRDHKERPVVAMLADLYDTFDRRCEKSSMRIVCCTPALYVWLVLHLFRQEMRHACPLESHRSCTKKGGANWDQLLANKEGASVNWFPRWKEGRIGVLISCGGFPNVPLMGTRGCISYNPVLAIRQLGYPMRGGTSRGRAHACHVTRGINNGPVGGYRKWLKAHMQGLDWLPSLRIAKREEVEVPEEDEEVQALRAELEQAQTVKERARKEEHGREKFRGALWGSN

SEQ ID NO: 228586 - protein, 59 aa, Glycine max
  Coding DNA Sequence Number=SeqID_111808
MQCGTMSLSLSKIIGRPVRVTMFCQNAPTIRDQHRLKGALKPGDPQGLHSEESVRASPS

SEQ ID NO: 228587 - protein, 85 aa, Glycine max
  Coding DNA Sequence Number=SeqID_111809
  Homolog annotation: Hit_ID=Q1SKW6; Match level="QueryCoverage=75%, HitCoverage=12%, E-value=2e-07, Identity=44%"; Hit description =Integrase, catalytic region
MVAIFWQIYRSSMEVLEIVEKEYSPLAEDATKEHKVAYNENKKNDYKALCLIYPSVDNAHFEKIVGAKTSLETWKILEKGNEGAE

SEQ ID NO: 228588 - protein, 751 aa, Glycine max
  Coding DNA Sequence Number=SeqID_111810
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=90%, E-value=1e-123, Identity=44%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=142-297; Score =43.1; E_value=9.5e-10; Accession=PF00665.16; Description=Integrase core domain
  Pfam module annotation: Pfam domain module=RVT_2::rve; Domain location=368-601::142-297
MEENERVAEFFNRVFTLTNAMKSCGEKVTDITIVEKVLRILNPKFDHIVVAIKKSRNLEILKVEELQGSLEAHEQRILERSGGGHKGKGCDRVAKDNLEINNETQEHFRTEQDVPKSSRRGGYKGIGHFSSECQYPIQNQNNERQGNEANMAKEAYSKDDVLFKKLWTYPLKDKNEVFDTFKVFKILVEKQSGKSLKILRTDGGGEFTSGEFENFCRDNGIIHEITTPYTPQHNAVETANYILNRCPTQNSVSLVPEQVWSGRKPSVQHLRVFGTLCYTHVPDQKRRKLDDKSEAMIFNGYHPTDRDNQKEQATISVQVPMENSVRHQDESIPHGEGNAEQITEQIRSGRMMSMPVRLRDYHMFPDSAIIDEGEFVNIALMTATKPELVTLPIGKTPIAVKWVYKTKLKPDGSIAKHKARLVTSKLDLLEELENLVDVKSAFLNGPLDEEVYIQQPPVYEVIGSEDKVFRLRKTLYGLKQVPRAWNKRIDSFLNYEDFKKCTLEHGIYVKATKNGGVLLICLYVDDLLITRSNPVEIEKLKGNPKSEFEMLDLGLLSYFLGIEFAKTKDGIVMHQKKYIKEVLKRFSMDQCNKVDTPMEGNLKLDTGDHEASVDAILFRQLVGCLRFVCHTYSDSDWCGDKVERKSTSAEYISACSVACQALWILSLISELNLKTDDFVELQVDNKSTIDLARNLVSHGHSKHIETKFHFIRDQVNKGRIRLKHCGTNLQLVDIMAKALKADIFKLLRNML

SEQ ID NO: 228589 - protein, 36 aa, Glycine max
  Coding DNA Sequence Number=SeqID_111811
MDSEGFGSLREKRKLRCEQHFSYLRHCFTNSNVGNV

SEQ ID NO: 228590 - protein, 48 aa, Glycine max
  Coding DNA Sequence Number=SeqID_111812
MGLTWKINIVLPCNCVMPGDTFYEEDIDFKNPEARVVLPVSALGRQVK

SEQ ID NO: 228591 - protein, 58 aa, Glycine max
  Coding DNA Sequence Number=SeqID_111813
MMIMIRPNGVVTLFSSQKSSSFLKISHEKMHYGYGESTMTIIEMALKLWAVMNHDPLG

SEQ ID NO: 228592 - protein, 44 aa, Glycine max
  Coding DNA Sequence Number=SeqID_111814
MALGVMAARPEELGSKYKDTNFVRAILLFDRATGKNQGSETEKT

SEQ ID NO: 228593 - protein, 203 aa, Glycine max
  Coding DNA Sequence Number=SeqID_111815
  Gene Ontology: Mol. function=isomerase activity; Cellular component =membrane; Biological process=protein folding
  Homolog annotation: Hit_ID=Q1S411; Match level="QueryCoverage=94%, HitCoverage=19%, E-value=3e-73, Identity=72%"; Hit description =Peptidyl-prolyl cis-trans isomerase, cyclophilin type
  Pfam annotation: Domain name=Pro_isomerase; Domain location=8-190; Score=201.8; E_value=1.6e-57; Accession=PF00160.11; Description =Cyclophilin type peptidyl-prolyl cis-
MAKKKNPLVFMDVSIDGDPVERMVFELFYDIAPKTAENFRALCTGEKGVGPNTRKSLHYKGSFFHRIKGSFAQVGILLIEMLSKLQALFHFHDSYDNGTGGESIYGSKFPDESPRLKHDGPGLLSMAVADRDMLGSHFTLTFKADPHLDRKHVVFGKLVQGHDVLKKIEEVGDEEGLPSVTVKIINCGEHNEGENSSALYGEY

SEQ ID NO: 228594 - protein, 635 aa, Glycine max
  Coding DNA Sequence Number=SeqID_111816
  Gene Ontology: Mol. function=isomerase activity; Biological process =protein folding
  Homolog annotation: Hit_ID=Q1S411; Match level="QueryCoverage=68%, HitCoverage=45%, E-value=4e-41, Identity=36%"; Hit description =Peptidyl-prolyl cis-trans isomerase, cyclophilin type
  Subcellular localization annotation: CTP_CleavageSite=59; ConfidenceScore=5.37e-01
MESSESNSDSDSDVSSSSYTSSSSDDRRRKRKRSRKNKLRRGKRRDKHRDKRQRKQDKRSKLRSRRELASHTNSDSGSRSDNNSDGKSGAAQAKDKKHKGHSQRHAEGQPSVVAEKELHHMHLEKREKPNMLEEEEFPKENGEWHSNSTGANHRSDRREGRQPDVMDDQLGKSRNQSRSPKRTMSMSISPRSDRKSPSIDPKRRLSRSPGGSRSPHAPLWRSLSRSPNRRSIKRSPVRGRKGRSVSRSPVSTHNHGSISRSPVRSRDHRSGSASSVKSLSQGRRRSLPRAPSRRSISRSPVKSHGHRILSRSPVRSRGHRSVSASPVGSLSRSHRSSPRAPSQRSISRSPVRTQNHRSVSRSPVRSCDHRIVSASPVRSLSRSCQRSSPREPSCRSISRSPVRTCSDKSVSRSPMGSHGNRNGSASPVRSLYLSHRRSSPRAPSGRSISRSPVRVSRKSISRNPVRSSARSLSRSSGRVPLRSISRSSVRAPSRVNRRSYSRSRSPVCRARTPRGRSLSRSVSPDVSPKHHTAIVAIVDEVTVTDIQVTEGTPLGVTGAHCHAEELHRVGGAGHPLYHAAHVTELDNIAEVVAWSAVVHLLIHIDLMWRGAGHRPKAGVHHDPGQNHSLHQKRAE

SEQ ID NO: 228595 - protein, 70 aa, Glycine max
  Coding DNA Sequence Number=SeqID_111817
MALEEEFAIAYLKVLQPTLLRTSEAKLMGASSIGGKCAESPPTFIERKTLEKPKETGQEEYSRFGSYLYV

SEQ ID NO: 228596 - protein, 80 aa, Glycine max
  Coding DNA Sequence Number=SeqID_111818
MSGFTRNSPQISASPHQLDLAPYASEPYNAQWNAPGLLHDMHMLRSSRILRKMEVVFVIGSAVDRLCGWFRDGPLWITGW

SEQ ID NO: 228597 - protein, 59 aa, Glycine max
  Coding DNA Sequence Number=SeqID_111819
  Gene Ontology: Mol. function=amino acid transporter activity; Cellular component=membrane; Biological process=amino acid transport
  Homolog annotation: Hit_ID=Q9LZ20; Match level="QueryCoverage=75%, HitCoverage=7%, E-value=1e-08, Identity=66%"; Hit description=Amino acid transport-like protein
MTATATKSISLKPLGRDRTVRRHLAEEIPIMVPRYAIKPLATMALEKGGVEGAKAGNGN

SEQ ID NO: 228598 - protein, 73 aa, Glycine max
  Coding DNA Sequence Number=SeqID_111820
  Gene Ontology: Mol. function=serine carboxypeptidase activity; Biological process=proteolysis
  Homolog annotation: Hit_ID=Q1EP77; Match level="QueryCoverage=87%, HitCoverage=13%, E-value=4e-16, Identity=70%"; Hit description =Serine carboxypeptidase (Carboxypeptidase D), putative
MKLHSLASYLSQEILAEQEVDRVHGLPAQHPVKFNNMVVISLSMKLKEEHCSIGFSRPLTNQNKNPFSYGSME

SEQ ID NO: 228599 - protein, 134 aa, Glycine max
  Coding DNA Sequence Number=SeqID_111821
  Gene Ontology: Mol. function=RNA-directed DNA polymerase activity; Biological process=RNA-dependent DNA replication
  Homolog annotation: Hit_ID=Q1SL34; Match level="QueryCoverage=89%, HitCoverage=21%, E-value=1e-10, Identity=35%"; Hit description =Endonuclease/exonuclease/phosphatase
VVTVKECEGDLVESSCDGNEVVENAMDEQGIVMPQISPLEEAKWAFQGIWYLWYLDILQVDVISNYDQMVHMRVRWRNAQPWFLIVVQCPQFARRQSLWEALMEVSFDLDGQWVVMGDFNCTLLPSEKVGGNSE

SEQ ID NO: 228600 - protein, 170 aa, Glycine max
  Coding DNA Sequence Number=SeqID_111822
  Gene Ontology: Mol. function=cellulose synthase (UDP-forming) activity; Cellular component=membrane; Biological process=cellulose biosynthetic process
  Homolog annotation: Hit_ID=Q2HT19; Match level="QueryCoverage=50%, HitCoverage=10%, E-value=2e-10, Identity=41%"; Hit description =Cellulose synthase
MVRILRIGLRMWCSNFTMIQRFGRLREKERILRGEGKNENEGKKRHLYENWDATPLMTIQNHLKRCDRWELFSKIPHWKIRRKDLEQQFGSSKEFIISTTQALGGSAYSANDITPSNFIESTTQVANCEYEDDTFWDGASTYLIANELHAGANEMLERWEKRSKCGPRHK

SEQ ID NO: 228601 - protein, 94 aa, Glycine max
  Coding DNA Sequence Number=SeqID_111823
MYSVVANARIHKRLLSSKVDVSLSELNALSECHPLSEASTRLADRRNLEGNLSRRHILSALSTHSVSYLSPSRLSVGLALSENSLTRAKREKWR

SEQ ID NO: 228602 - protein, 122 aa, Glycine max
  Coding DNA Sequence Number=SeqID_111824
MEMLELVSDGVVKVYGILGGGTFNEVHVSRDDVSSISRSNNIESNSSDDSGPTKGKQLDDEMVMRLGAVSVKETLHQITEDWTTYTKDKSTGLDDKCCRPTISIIHRPTIKNLHIISIIFLN

SEQ ID NO: 228603 - protein, 117 aa, Glycine max
  Coding DNA Sequence Number=SeqID_111825
MSSFSSLDFLDVILQILSHLTIERQSLVTFAGTSSSTQEVRSTGFVPHGRQDVLTAAIGRPEHPGRVCATGAGVTIKQYFGSAPWMFRSSSSLPPEEFQQLTQQIKDQLEESITKKK

SEQ ID NO: 228604 - protein, 287 aa, Glycine max
  Coding DNA Sequence Number=SeqID_111826
  Gene Ontology: Mol. function=N-acetyltransferase activity; Biological process=metabolic process
  Homolog annotation: Hit_ID=Q1T0F6; Match level="QueryCoverage=55%, HitCoverage=55%, E-value=1e-50, Identity=64%"; Hit description=GCN5 -related N-acetyltransferase
  Pfam annotation: Domain name=Acetyltransf_1; Domain location=61-149; Score=42.4; E_value=1.6e-09; Accession=PF00583.14; Description =Acetyltransferase (GNAT) family
MIPDRRTRFLDQQLDRFRTAKGLFGISMAIDTRNEATWTSKVAPKHTSAINAGATAENLVAELLDTRELVGVVRGIIKNVGTLSGPFLKMGCILGLRVSPTYRRKRVALRLVTATEEWMVRNGVEYALLATENNNDASKNLFTIKSNYVNLSSLVIFVQPTSSLTKKISMDIKIDKVDIDLAISLYKRTMRTKDLYPLDMDVILKEKLNLRTWKYYKEKYSLVIPEPGSSKECKEALSQKAIGYKAWKQELEHERKEYTTTVKEESRCRSTKNKEHKEHVCRSTKLQ

SEQ ID NO: 228605 - protein, 65 aa, Glycine max
  Coding DNA Sequence Number=SeqID_111827
  Homolog annotation: Hit_ID=Q945U4; Match level="QueryCoverage=96%, HitCoverage=8%, E-value=3e-18, Identity=78%"; Hit description=Acyl -CoA oxidase
AFRKDDRATLDRKELFKNTLRKAAYAWKRINELRLNGEFSVALEQEAYKLRSFVDQAAFTDLHWV

SEQ ID NO: 228606 - protein, 856 aa, Glycine max
  Coding DNA Sequence Number=SeqID_111828
  Gene Ontology: Mol. function=RNA-directed DNA polymerase activity; Cellular component=chromatin; Biological process=RNA-dependent DNA replication
  Pfam annotation: Domain name=rve; Domain location=531-669; Score=3.4; E_value=0.0031; Accession=PF00665.16; Description=Integrase core domain
  Pfam annotation: Domain name=zf-H2C2; Domain location=513-554; Score =15.9; E_value=0.0028; Accession=PF09337.1; Description=His(2)-Cys(2) zinc finger
  Pfam module annotation: Pfam domain module=RVT_1::rve::zf-H2C2; Domain location=56-225::531-669::513-554
MASYGVASPLSLPFSIPLPFIFQEAKESIDEEDPRPTSSNGACIMLRRQLIRPSRSPYSSPVLLVKKKDGTWRFCMDYRALNEVTIKDRFPLPTIDELLDDLGHSSWFSKLDLAQGFHQIRMADPDIPKTMFHTYQGHYEYVIMPFSLCNTPSTFQATMNDLLRSFIRKFVLVFFDDILIYSRDFHTRLDHLERVLQTLQQSDFHLKASKCIFGQRRIEYLGHFVSLRGVEPDPSKLQAMQQWPTLTSPRQLRGFLGLTGFYRRFVKNYARIAEPLTQILRKDQFAWSTEAQSAFDDLKAAMTSTPVLSVPDFTIPFVVETNASGTGMGAVLMQRGHPIAYFSKQFCPKLLRSSTYIRELHAITSAVKCWRQYLLGHPFVILTDYKSLRELMTQPIQTPEQHVYLAKLLGYNYSIQYKAGHSNVVADALSRLTEDDNTAAMYSILSIPHPKFLEDLKRELASSEEFHDLRKSVTDDPHQHPVFTLRDGLLLYKGRIWINCSSSFIALLLEEFHKSPLGGHMGLAKTLSRLQQSFYWEGIRQDTQKFIKQCVDCLQTKYVPQKPAGLLQPIPPLSRPWEDLALDFITGLPNSQGATELFRLCGTKLRISTAYHPQTDGQTEVLNRVLEQYLRSFVHHKPTQWGKFLSLVEWCYNTTCHSSTNLSPFEVTYGKPPPTIIDYLPGSSSVEAVDFLLSSRHHLFETLRRKLERTQAKMKTLADTHRRDANFNIGDWVYVKLRPYRQTSIADKYQKLGKHFYGPYQITDSIGKVAYRVALPPSAKIHPVFHCSKLKLHQGPITTDHSLPPTSWDNNPVIEPLTIMDHKWDTNDPPQLLVLVQWADLQPEDSSWENWAELKT

SEQ ID NO: 228607 - protein, 67 aa, Glycine max
  Coding DNA Sequence Number=SeqID_111829
  Homolog annotation: Hit_ID=Q1SGV7; Match level="QueryCoverage=83%, HitCoverage=5%, E-value=3e-20, Identity=84%"; Hit description =Transcriptional factor B3; Auxin response factor; Aux/IAA_ARF _dimerisation
MERKSGSVLMENDILLVGDDPWEEFVSCVQSIKILSSAEVQKMSLDRDLGHVPVPNQACSGIDNNNA

SEQ ID NO: 228608 - protein, 376 aa, Glycine max
  Coding DNA Sequence Number=SeqID_111830
  Gene Ontology: Mol. function=metal ion binding
  Homolog annotation: Hit_ID=Q2QY21; Match level="QueryCoverage=97%, HitCoverage=59%, E-value=2e-52, Identity=34%"; Hit description=Kelch motif family protein
  Pfam annotation: Domain name=F-box; Domain location=48-95; Score =45.2; E_value=2.2e-10; Accession=PF00646.23; Description=F-box domain
  Pfam annotation: Domain name=Kelch_1; Domain location=143-181; Score =1.4; E_value=2.6; Accession=PF01344.15; Description=Kelch motif
  Pfam annotation: Domain name=Kelch_1; Domain location=183-225; Score =48.9; E_value=1.7e-11; Accession=PF01344.15; Description=Kelch motif
  Pfam annotation: Domain name=Kelch_1; Domain location=227-293; Score =5.9; E_value=0.82; Accession=PF01344.15; Description=Kelch motif
  Pfam annotation: Domain name=Kelch_1; Domain location=320-367; Score =4.5; E_value=1.2; Accession=PF01344.15; Description=Kelch motif
  Pfam annotation: Domain name=Kelch_2; Domain location=183-225; Score =27.4; E_value=4.9e-05; Accession=PF07646.5; Description=Kelch motif
  Pfam annotation: Domain name=Kelch_2; Domain location=227-293; Score =2.7; E_value=17; Accession=PF07646.5; Description=Kelch motif
  Pfam annotation: Domain name=Kelch_2; Domain location=320-367; Score =1.6; E_value=24; Accession=PF07646.5; Description=Kelch motif
  Pfam module annotation: Pfam domain module=F-box::Kelch_1::Kelch _1::Kelch_1::Kelch_1::Kelch_2::Kelch_2::Kelch_2; Domain location=48 -95::143-181::183-225::227-293::320-367::183-225::227-293::320-367
MGSDRERESCNSRHFAWLMKSCFPNPNDAVAKLASPPQSHRNSPVPATTISSLPDDIVLDCLSRVPTSSLPALSLVCRRWSRLLSSPDFSDLRRHRLLLRHTAVAIAGTNLGLSSATLLDGAWHPSLFVPCYDAHSLDNFHSLLAHARACSVGPRIYLVGRNNTLLYDTWTATVSTRASMIFPRKKFALAAVGGKIYVSGGSSGTSAVEEYDPETDTWSVVCNAPRKRYGCLGTSFQGVFYVIGGLRIGATEQNLPNLFPRASRGVEAHAAYASSMDLFDVEARVWLRSRTVPGGGCVVAACAAVGIKSPPLPAQVRVDSRIRFSCVGIGDKVILIQSLNEVRGVKEGFVFVYDCVAEEWGRGVDLPEVYRRAAYV

SEQ ID NO: 228609 - protein, 200 aa, Glycine max
  Coding DNA Sequence Number=SeqID_111831
  Homolog annotation: Hit_ID=Q1S1P8; Match level="QueryCoverage=37%, HitCoverage=20%, E-value=2e-09, Identity=46%"; Hit description =Cyclin-like F-box
MCSTIHKPSSHRGYTQQSSELGSCHIRNLAEGKRVDVFSVAYHLVSCLGGIVKDGNSGRKDSVKDMATIENRLQKFKLPEPVLCIGGVLLVELLGRVQKQEMDELFYICISHVQVMGRLLFPEFDVKIHHWSGKCTLKYCPQTDCYMSSPTSSPRSNSSNPSRLRTITSSIMQRGVRRWEQFLLGALLGTGPVVVDNEDQ

SEQ ID NO: 228610 - protein, 150 aa, Glycine max
  Coding DNA Sequence Number=SeqID_111832
  Gene Ontology: Mol. function=protein binding; Biological process =ubiquitin cycle
  Homolog annotation: Hit_ID=Q1S0J2; Match level="QueryCoverage=99%, HitCoverage=52%, E-value=8e-53, Identity=67%"; Hit description =Cyclin-like F-box; Galactose-binding like
  Pfam annotation: Domain name=F-box; Domain location=24-71; Score =18.8; E_value=0.02; Accession=PF00646.23; Description=F-box domain
MGAGVSTTAIENDDGGTFSLSTKTTLDDIPENCISSMMMSFDPQEICTLARVNKAFHRASSADFVWESKLPPSYKFLLNKVLGEQNLGSMTKKEIYAKLCRPNFFDGANKEVWLDRSRGQVCMFISSKSFKITGIDDRRYWNNIPTEESR

SEQ ID NO: 228611 - protein, 54 aa, Glycine max
  Coding DNA Sequence Number=SeqID_111833
  Homolog annotation: Hit_ID=Q75I89; Match level="QueryCoverage=98%, HitCoverage=21%, E-value=3e-17, Identity=90%"; Hit description =Expressed protein
MAVLCGIDKASWYSLPGHRHICRSFKTGLNTSSSAEKGVDFKSYYKLILHSSLQ

SEQ ID NO: 228612 - protein, 79 aa, Glycine max
  Coding DNA Sequence Number=SeqID_111834
  Homolog annotation: Hit_ID=Q75I89; Match level="QueryCoverage=85%, HitCoverage=17%, E-value=3e-24, Identity=77%"; Hit description =Expressed protein
MMINKTLFLTYVYLFIYILLSSGVILYNKWVLSPKYFNFPLPITLTMIHMAFSGAVAFFLVRVFKLTAMHPTLSASWYM

SEQ ID NO: 228613 - protein, 127 aa, Glycine max
  Coding DNA Sequence Number=SeqID_111835
MVGVFSQNRVTLTSHLMISLSEGDLTYPLCGMSCYVLLGALVLFFINMKVSQTTTTIAEDIEHVDDVVDKAHEEPHDLVTKDERTKLKLASHGRKVEKLARFAPEIEGLVADTDLSSLITCSLDRGD

SEQ ID NO: 228614 - protein, 76 aa, Glycine max
  Coding DNA Sequence Number=SeqID_111836
GNSGSNKDRRKSLKVYQSHTVHGEKVASAQDFVGNQRKKTTLGRGQGLTFSPWVKVYDKLGFWLKACRTAGHDICQ

SEQ ID NO: 228615 - protein, 50 aa, Glycine max
  Coding DNA Sequence Number=SeqID_111837
VRKPPRHPPMVHDPTTIMPHPPMLPDVIATRPHPHATSPIDIEMPQHVVV

SEQ ID NO: 228616 - protein, 171 aa, Glycine max
  Coding DNA Sequence Number=SeqID_111838
  Gene Ontology: Mol. function=nucleic acid binding
  Homolog annotation: Hit_ID=Q1SKA8; Match level="QueryCoverage=77%, HitCoverage=52%, E-value=7e-12, Identity=31%"; Hit description=Zinc finger, CCHC-type
  Pfam annotation: Domain name=zf-CCHC; Domain location=95-112; Score =19.7; E_value=0.00056; Accession=PF00098.13; Description=Zinc knuckle
MSLATLFGKLQEHEMELMRLHQHEENDKKRKGITFKASSSFIQEESDKEDLNEIEEDDDFRVFVKRFNMFLRNKRNQRKANINPKKKGEDSSLPPKCYECDQPEHLRFNCPILKGRMKKSDKRNFKEKKAYITWEDNDMDSSEDSSSDSENKIINSGLIAKDYENEEELAH

SEQ ID NO: 228617 - protein, 248 aa, Glycine max
  Coding DNA Sequence Number=SeqID_111839
  Gene Ontology: Mol. function=prephenate dehydrogenase (NADP+) activity; Biological process=tyrosine biosynthetic process
  Homolog annotation: Hit_ID=Q1RX89; Match level="QueryCoverage=97%, HitCoverage=89%, E-value=1e-105, Identity=60%"; Hit description =Prephenate dehydrogenase; NADP oxidoreductase, coenzyme F420- dependent
  Pfam annotation: Domain name=F420_oxidored; Domain location=33-176; Score=-55.6; E_value=0.097; Accession=PF03807.7; Description=NADP oxidoreductase coenzyme F420-dependent
  Pfam annotation: Domain name=NAD_binding_2; Domain location=31-165; Score=-83.1; E_value=0.057; Accession=PF03446.5; Description=NAD binding domain of 6-phosphogluconate dehydrogenase
  Pfam annotation: Domain name=PDH; Domain location=36-243; Score= -84.5; E_value=0.00057; Accession=PF02153.8; Description=Prephenate dehydrogenase
  Pfam module annotation: Pfam domain module=F420_oxidored::NAD_binding_ 2::PDH; Domain location=33-176::31-165::36-243
MLLHIRIKSSDVVKLYNYKSNGANQSDDNTKLKIAIVGFGNFGQFLAKTFVSHGHRVLAYSRSDYTHVAQELGVSYFNNIDDLCEQHPEVILLCTSILSTEKVLKSLPVQRLKRIRIGIDESRTSRCDRFLDIFASEGCRMVEMSCAEHDWHAAGSQFITHTTGIFLEKLELERTPIDTKGYETLLSLVENTAGDSFDLYYGLFLYNINAMEQIERFDRAFESVKKQLFDRLHGFYRQQVFKHEEKLP

SEQ ID NO: 228618 - protein, 56 aa, Glycine max
  Coding DNA Sequence Number=SeqID_111840
MWDWECRSSGKFSVNSAYKVLHAQEVGSQEVVLIKAKVSNISESDLNRNIKVFKCL

SEQ ID NO: 228619 - protein, 131 aa, Glycine max
  Coding DNA Sequence Number=SeqID_111841
  Gene Ontology: Cellular component=exocyst; Biological process =exocytosis
  Homolog annotation: Hit_ID=Q9FFX6; Match level="QueryCoverage=70%, HitCoverage=17%, E-value=5e-24, Identity=48%"; Hit description =Putative leucine zipper protein
MELLDTNLEGKAKLYKEVPLSCIFMMNERTYHKNYQVETWSKILSSLSPKGLNENGKVHKSMLKERFKSLNMVFEKIHKTQNAWVVYNEQLRNAEGGVVVVNGALVVPLGLFSEGSQELGWNGERGFEKPR

SEQ ID NO: 228620 - protein, 122 aa, Glycine max
  Coding DNA Sequence Number=SeqID_111842
MKKMNSTLLFSVKEQSLETRKLRKPLAKEEEEEVEEDVQRDSKETGNQLPESKNSGKLGSKCRGHPVVHRQLHTPPPAHGDQLESQGSSKQSDMPPSTTISPHEKLQVLTDKVYAISMQYEV

SEQ ID NO: 228621 - protein, 81 aa, Glycine max
  Coding DNA Sequence Number=SeqID_111843
MIGWPNSRNRWRCYKGRRRNYLLKNSHGTCHIKCELQLHSFIEKIGHLNQKPTNMTLQFSNGSKKKALWKAVNVTIKEDLS

SEQ ID NO: 228622 - protein, 542 aa, Glycine max
  Coding DNA Sequence Number=SeqID_111844
  Gene Ontology: Mol. function=calcium ion binding; Cellular component =mitochondrion; Biological process=protein amino acid phosphorylation
  Homolog annotation: Hit_ID=Q1RSC2; Match level="QueryCoverage=92%, HitCoverage=91%, E-value=1e-117, Identity=37%"; Hit description =Pentatricopeptide repeat
  Pfam annotation: Domain name=PPR; Domain location=129-163; Score =18.6; E_value=0.022; Accession=PF01535.11; Description=PPR repeat
  Pfam annotation: Domain name=PPR; Domain location=164-198; Score =37.1; E_value=6.3e-08; Accession=PF01535.11; Description=PPR repeat
  Pfam annotation: Domain name=PPR; Domain location=199-233; Score =47.2; E_value=5.6e-11; Accession=PF01535.11; Description=PPR repeat
  Pfam annotation: Domain name=PPR; Domain location=234-268; Score =50.6; E_value=5.3e-12; Accession=PF01535.11; Description=PPR repeat
  Pfam annotation: Domain name=PPR; Domain location=269-303; Score =51.6; E_value=2.6e-12; Accession=PF01535.11; Description=PPR repeat
  Pfam annotation: Domain name=PPR; Domain location=304-338; Score =48.9; E_value=1.7e-11; Accession=PF01535.11; Description=PPR repeat
  Pfam annotation: Domain name=PPR; Domain location=339-373; Score =36.8; E_value=7.3e-08; Accession=PF01535.11; Description=PPR repeat
  Pfam annotation: Domain name=PPR; Domain location=374-408; Score =38.6; E_value=2.2e-08; Accession=PF01535.11; Description=PPR repeat
  Pfam annotation: Domain name=PPR; Domain location=409-443; Score =50.0; E_value=8.1e-12; Accession=PF01535.11; Description=PPR repeat
  Pfam annotation: Domain name=PPR; Domain location=444-478; Score =56.1; E_value=1.1e-13; Accession=PF01535.11; Description=PPR repeat
  Pfam annotation: Domain name=PPR; Domain location=479-513; Score =37.1; E_value=6.1e-08; Accession=PF01535.11; Description=PPR repeat
  Pfam annotation: Domain name=PPR; Domain location=59-93; Score=19.6; E_value=0.011; Accession=PF01535.11; Description=PPR repeat
  Pfam annotation: Domain name=PPR; Domain location=94-128; Score=23.3; E_value=0.00087; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=129-163::164 -198::199-233::234-268::269-303::304-338::339-373::374-408::409 -443::444-478::479-513::59-93::94-128
MPSFSFLRTLRLSLFPPYPPIAIPTATLHYQSHSQPHYHHHAVASFNLMLLMRPPPPTFLFNNILSSLVKNKRYPTVISLFKQFEPNGITPDLCTLSILINCFCHQAHITLAFSVFANILKRGFHPDAITLNTLIKGLCFRGEIKKTLYFHDQVVAQGFQLDQVSYGTLINGLCKAGETKAVARLLRKLEGHSVKPDVVMYNTIINSLCKNKLLGDACDVYSEMIVKGISPDVVTYTTLIHGFCIMGHLKEAFSLLNEMKLKNINPNLCTFNILIDALGKEGKMKEAFSLLNEMKLKNINPDVYTFSVLIDALGKEGKVKEAFSLLNEMKLKNINPDVCTFNILIDALGKKGRVKEAKIVLAVMMKACVEPDVVTYNSLIDGYFLVNEVKHAKYVFYSMAQRGVTPNVQCYTIMINGLCKKKMVDEAMSLFEEMKHKNMIPDIVTYNSLIDGLCKNHHLERAIALLKEMKEHGIQPDVYSYTILLDGLCKGGRLEIAKEFFQHLLVKGCHLNVWPYNVMINGLCKAGLFGEAMDLKSKMEGK

SEQ ID NO: 228623 - protein, 88 aa, Glycine max
  Coding DNA Sequence Number=SeqID_111845
  Subcellular localization annotation: CTP_CleavageSite=75; ConfidenceScore=5.49e-01
MSPPPLEPHNHSQTYLKLSGRLPLQARFSIGGLVVAFALSATMDRSTLISGFQLSMCFLRLANMHSASFFQILPRAQLKQWCAQCMAR

SEQ ID NO: 228624 - protein, 178 aa, Glycine max
  Coding DNA Sequence Number=SeqID_111846
MAKAQSLKKVVNCGGHGVDGSGKFELIGGEFCDGCFDACRSKLHDDEPSNFDDAKSPSTSFVVQVEHTSTWVVILRTRDDISLVDQFKSLDPTMRSIMESATSTWKFLSIFGCKMGDNGGRVRSIPNKPSKCVRGIGPAEIGAGGWLCGTDVVGRGGLGWHSSHGRQPLKLNESTKLL

SEQ ID NO: 228625 - protein, 207 aa, Glycine max
  Coding DNA Sequence Number=SeqID_111847
MALVVKHVLLFNGSGIEELDYYGLVAQVLIQLATIVPGHDLHIISVFLLDTTNEFWLAAEPGFVKEHPSDPHVSTCEKAAKIISRICDIVLPQALTYTNAYFGSAAQTCGIFEGYPKKSMLRDPGQEGFRQAQAPYYEKLDTDSKKPLYTGYTKYTRLSRVLALVNLKVRFGWSVSQHALRGRARARLTGALSKGGKMRGVATNVYL

SEQ ID NO: 228626 - protein, 98 aa, Glycine max
  Coding DNA Sequence Number=SeqID_111848
MKKRHELSIVSTLVCPMGATSFPQRSKDLSEIDEEDEGLVQLALQKRQAAALVAPAPKRAKKALDLLHQWSPLLLEDLAAKWRMRKDDWRCHFKEKMS

SEQ ID NO: 228627 - protein, 41 aa, Glycine max
  Coding DNA Sequence Number=SeqID_111849
MLCSIPSNLRRICDLVLKAPIRPASCSSPRRVGCLWLKKSY

SEQ ID NO: 228628 - protein, 125 aa, Glycine max
  Coding DNA Sequence Number=SeqID_111850
PAVDALDFLEGDEDPLLEVDSPEEVMLASEADSTEDGGPGEMAISGGSSSYPLIQDQVQDSPLSVLRCHEALSAKRNTHGLSTRKTLEEDELYRGSLDWDSKLCMTRDSRERKRLELEAGAGLRA

SEQ ID NO: 228629 - protein, 95 aa, Glycine max
  Coding DNA Sequence Number=SeqID_111851
MTGTFFLLRQQNSLEIMSDYYHQTSHYFGDATFFTPYIMPAKGEFFLAKGEGNEKMNSTSFQGLENQKNFGKLLAQRRRRRRRRSSKRFKACKEL

SEQ ID NO: 228630 - protein, 362 aa, Glycine max
  Coding DNA Sequence Number=SeqID_111852
  Gene Ontology: Mol. function=nucleic acid binding; Biological process= DNA integration
  Homolog annotation: Hit_ID=Q1SDG1; Match level="QueryCoverage=31%, HitCoverage=9%, E-value=1e-16, Identity=39%"; Hit description =Integrase, catalytic region; Zinc finger, CCHC-type
  Pfam annotation: Domain name=zf-CCHC; Domain location=208-225; Score =13.5; E_value=0.0058; Accession=PF00098.13; Description=Zinc knuckle
MEEGFSTNKPPLFRGIKYDYWKERMIAHFELIHIDLWGMVENGDYISYDDQLNEVPRGQWMKGQRLRFMLNCKAQNVMLCALLEEEYTNVTMLRALKNLDCMSIEELASTLKVHEQEPQQDEGTKREKYLALSSQKNKKASSFREPVLRSSSKDLKVDDSSKEDLDEDELAFIAQKIHKMWRRKRGSKWRNFSRRTSKEKKDKDKSSIIFYECKKPGHFKFECQKLKKSHDKKKFFKTRENKGLMSTWEDLDNTSSDEDYEVNFDDPESLRKAYHEILSNSSILSKAYKNLQKYFKNLTIDHLKLEKTLQDQVDVSLDESTQTCEACITLKEKDSKSCLEIETSARERAILLKNVQKLKNKL

SEQ ID NO: 228631 - protein, 321 aa, Glycine max
  Coding DNA Sequence Number=SeqID_111853
  Gene Ontology: Mol. function=DNA binding; Biological process=DNA integration
MSYKDDLLCEACQKGKQIENYFTSKNIVSTSRPLQLLHLDMFGPTRTASSSGKRKNPETEASTQQKVQEEVREPIGRIMRRNHLENQIIGYLAHHIQTRSSLRTQGHIALISKMKPKNIDDATQDDNWLVELQKGKKVVGAKWGFFNKLDENGKVVRNKARLVAKGYSQQEDEFELSMMEKLKFFLGFQIKQTPKGIYIHQTKYVKEEKVKHICRYPIGTSNLRLMFKRSESFRLTSYCDVGDKVERKSTCGSCHFIGVNLLTWICKKKGLTALSTAEAEYMSATSYYAQLLGIKNQLEDYNICESKISIYCDNKTAISLS

SEQ ID NO: 228632 - protein, 135 aa, Glycine max
  Coding DNA Sequence Number=SeqID_111854
  Gene Ontology: Mol. function=DNA binding; Biological process=DNA integration
  Homolog annotation: Hit_ID=Q1S3H4; Match level="QueryCoverage=96%, HitCoverage=24%, E-value=6e-30, Identity=45%"; Hit description =Integrase, catalytic region
MSPYRVVFGKACHLPVEIEHKAYWAVKTCNFSIDQVGEERKLQLSELEDIHLEAYENSKFYKEKTKKFHDSLVAKKDFVVGQKVLSYNSRLRLMSVKIKNESTDKSFKVNGHRLKPFLTNPSLVGVVVGGDLQIY

SEQ ID NO: 228633 - protein, 198 aa, Glycine max
  Coding DNA Sequence Number=SeqID_111855
MGSDIYPKVHENPRAFFSSSSPILLEPLAHGSSDWSLPRKDCINLSLGSKTTRGHIDVVIRLPGQGSTPSMPLELLMELIILCNLHLNIPLEEDVHGMNVLLISLSGDLRNESSGIVRLLRSRSGSTSLSGGHLHQNKQKKRSEAGLAKPYSKIEKKLRLASMIRLAHVQKSTELNFLGLSETDSLSPGLFTIRGMLA

SEQ ID NO: 228634 - protein, 352 aa, Glycine max
  Coding DNA Sequence Number=SeqID_111856
  Subcellular localization annotation: CTP_CleavageSite=23; ConfidenceScore=5.02e-01
MQNGFRLKTTPATKRGPHQGFVSCRSTKRDIGLSETTISSFGRVNVILSIIPNDGIWAIKAPRSHTLDCEYPLLKGQEKGPSKQKTLTLKQVHELGENERVKRVRWNLILIEWSGSCGARRPCSCVRAEMEGWHVYWSATRNFVSSIVALTSKRVVSLLSPKHGQVLSDVDGDNLDRYASCRSFKLVKAPSRDKRMLRTGVTFAYVSLVEWARTGDTVFFLLIVSFISHSTMGMGGSDSGGLIQQPLVDREVIPINDSSEEETRHGASDNKSSSSKRLTILHCVGGGTSRLRRRALPSVASLDGEPVPITTILPPSTFGRVKRNGGKDIMASPRVCRSHSAGSPSSPPTIAG

SEQ ID NO: 228635 - protein, 234 aa, Glycine max
  Coding DNA Sequence Number=SeqID_111857
  Gene Ontology: Mol. function=3'-5' exonuclease activity; Cellular component=intracellular
  Homolog annotation: Hit_ID=Q8GWN3; Match level="QueryCoverage=96%, HitCoverage=40%, E-value=2e-47, Identity=45%"; Hit description =Putative nucleolar protein
  Pfam annotation: Domain name=PMC2NT; Domain location=29-115; Score =0.2; E_value=0.0026; Accession=PF08066.2; Description=PMC2NT (NUC016) domain
  Subcellular localization annotation: CTP_CleavageSite=70; ConfidenceScore=5.20e-01
MNVDHDQPPSVAKAQALQTLTAGSLSSSVAKLAASSRCIPSDKDFHFYRNFEEFKVPVDEIARESRSMLEAFGAVAAHAAFPGDVDDDAAYDWLVNANDDILERFDVSADEFRKVLQEEEARRPAMHSMEEDGFQLVSGRKKKGGRGNVTLAATDSETVASPGVTVATKDKKTMGPKSKVPFHIPTIRRPQDEYSIVVNNANMPFEHVWLQRSDDGLRFIHPLVSYLVHLPSAW

SEQ ID NO: 228636 - protein, 136 aa, Glycine max
  Coding DNA Sequence Number=SeqID_111858
  Subcellular localization annotation: CTP_CleavageSite=21; ConfidenceScore=5.12e-01
MFGKRKTPKISNANMSTTYPLAGGRRETHGCVFQERKMRGVAINVFSRKTSKKPERCGLRTLIVKGSGVVFTHGKEFCGLCNNACFSFQNVAKLYGLRNDACFSFRNVAKLYGLRDSALFDFRNVAELYGLHNNAC

SEQ ID NO: 228637 - protein, 201 aa, Glycine max
  Coding DNA Sequence Number=SeqID_111859
  Gene Ontology: Mol. function=methyltransferase activity; Cellular component=cellulose and pectin-containing cell wall
  Homolog annotation: Hit_ID=Q1S0J0; Match level="QueryCoverage=73%, HitCoverage=23%, E-value=6e-58, Identity=67%"; Hit description =Generic methyltransferase
SVHGGSDRAVTEVDEVGNVVDVLIGSVGEHGAASGEVEPVAVVADPVLDGLLHRELAVGHVGVPRHVAARRPGEGVPVAVRRGDTAFQNLVVPRTVSLAVDHSSARVLEGARVVLAGGVLAERHVARREMEGHGVVVVVVIVVLVVVPWYAPRRRSGIGVEHGGGGGGGGGGVVQKWGVVSRKVKGCVSPMLGCVSVAGGE

SEQ ID NO: 228638 - protein, 177 aa, Glycine max
  Coding DNA Sequence Number=SeqID_111860
  Homolog annotation: Hit_ID=Q1S0I9; Match level="QueryCoverage=39%, HitCoverage=74%, E-value=2e-19, Identity=63%"; Hit description=Plant lipid transfer/seed storage/trypsin-alpha amylase inhibitor
  Pfam annotation: Domain name=Tryp_alpha_amyl; Domain location=31-90; Score=44.8; E_value=3e-10; Accession=PF00234.12; Description =Protease inhibitorseed storageLTP f
  Subcellular localization annotation: CTP_CleavageSite=57; ConfidenceScore=5.36e-01
MAAATKSLLSLILLLVVSHETQMAMTQSSTCSSQLSDLNVCAPFVVPGVNTNPNATCCNALQAVDRDCLCNTIRIASQLASQCQIPSLSCDIFNEGNWNLNICSSTRLNQAVRDIINNTFLAADLHAIYNGLKLAWQTGFKDIICVTDSKCAIELIASSTHHHAPLVNAIRDLLAKD

SEQ ID NO: 228639 - protein, 447 aa, Glycine max
  Coding DNA Sequence Number=SeqID_111861
  Homolog annotation: Hit_ID=Q1S0I7; Match level="QueryCoverage=99%, HitCoverage=92%, E-value=1e-101, Identity=51%"; Hit description=IQ calmodulin-binding region
  Pfam annotation: Domain name=IQ; Domain location=127-147; Score=34.5; E_value=3.8e-07; Accession=PF00612.17; Description=IQ calmodulin -binding motif
  Pfam annotation: Domain name=IQ; Domain location=149-169; Score=19.5; E_value=0.012; Accession=PF00612.17; Description=IQ calmodulin -binding motif
  Pfam module annotation: Pfam domain module=IQ::IQ; Domain location =127-147::149-169
  Subcellular localization annotation: CTP_CleavageSite=76; ConfidenceScore=5.34e-01
MGFLRRLFGGKKHHNPPPSSDASKPSKDKKTWSFVKHSTRYKPNTLPTTLNNNSNFDPSTSSSPFPESLDANKHAIAVAAATAAVAEAALAAAHAAAEVVRLTSSTGCASSLPAAAPQSRRVANETTAAAVKIQSAFRGYLARRALRALKALVKLQALVRGHIVRKQTSDMLRRMQTLVRLQSRARATRGNLSDNMHSFKSSLSHYPVPEDYQHSLRAYSTKFDGSILKRCSSNANFRDIDVEKARFGSHWLDSWMEENSWRQTRDASLKNGHLDDEKSDKILEVDTWKPHLNSHHSSGSSFQTSSHHYLSSDYNNENFVAYESPSKRSSKALNPSLSSREVLPFGSLKSHKGKEEAALQNVEDSPQAFSASSRLGSDARRGPFTPTKSECAWSFFSGYPGHPNYMANTESSRAKVRSHSAPRQRMEFERYGHSTRRSLQGLWEAGP

SEQ ID NO: 228640 - protein, 404 aa, Glycine max
  Coding DNA Sequence Number=SeqID_111862
  Gene Ontology: Mol. function=methyltransferase activity; Cellular component=cellulose and pectin-containing cell wall
  Homolog annotation: Hit_ID=Q1S0J0; Match level="QueryCoverage=98%, HitCoverage=62%, E-value=0.0, Identity=81%"; Hit description=Generic methyltransferase
  Pfam annotation: Domain name=DUF248; Domain location=1-391; Score =741.3; E_value=6.3e-220; Accession=PF03141.7; Description=Putative methyltransferase
  Pfam annotation: Domain name=Methyltransf_11; Domain location=6-90; Score=8.2; E_value=0.0086; Accession=PF08241.2; Description =Methyltransferase domain
  Pfam module annotation: Pfam domain module=DUF248::Methyltransf_11; Domain location=1-391::6-90
VASWGAYLLSRDIITVSIAPRDTHEAQVQFALERGVPALIGVLASKRLPFPSRAFDMAHCSRCLIPWAEYDGLYLNEIDRILRPGGYWILSGPPIRWKKHWKGWERTKEDLNKEQTKIENAAKSLCWNKLVEKDDIAIWQKAKNHLDCKSNRKLTQNRPFCKAQNNPDKAWYTDMQTCLSPMPEVSSKEETAGGALKKWPERLKATPPRISRGTIKGVNPETFSKDNELWKKRVAYYKKANNQLGKAGRYRNLLDMNAYLGGFAAALVDLPVWVMNVVPVQAKVDTLGAIYERGLIGTYHNWCEAMSTYPRTYDLIHADSLFSLYNDRCELEDILLEMDRILRPEGSVIIRDDVDILVKVKSIVNGMDWDSQIVDHEDGPLEREKLLFAVKNYWTAPAASDKNS

SEQ ID NO: 228641 - protein, 316 aa, Glycine max
  Coding DNA Sequence Number=SeqID_111863
  Gene Ontology: Mol. function=serine-type endopeptidase activity; Cellular component=integral to membrane; Biological process=beta -lactam antibiotic catabolic process
  Homolog annotation: Hit_ID=Q9CAN1; Match level="QueryCoverage=97%, HitCoverage=88%, E-value=2e-69, Identity=46%"; Hit description =Membrane protein, putative; 61952-60281
  Pfam annotation: Domain name=Rhomboid; Domain location=111-279; Score= 175.6; E_value=1.2e-49; Accession=PF01694.12; Description=Rhomboid family
MSSTTRRDLESGGANKNYNNISYSAAPTSYVYDPEVHWTSWLVPLFVAVNVVVFVVAMYLNDCPRKNLGFEGECVARFLGRFSFQPLRENPLFGPSSSTLTKMGALRWDDVVNHHQAWRLVTCIWLHAGVVHLAANMLSLVFIGIRLEQQFGFVFMFFCVLQILLLNGYDLTFFKTAVRIGIIYLLSGFGGSVLSSLFIRNNISVGASGALFGLLGAMLSELITNWSIYTNKAAALFTLLFIIVINLAIGMLPHVDNFAHIGGFLTGFLLGFILLLRPQFGWLEQRRPPAGVRLKSKYKAYQYVLWIVSAILLIVG

SEQ ID NO: 228642 - protein, 56 aa, Glycine max
  Coding DNA Sequence Number=SeqID_111864
MLGVTRNCQRVLVCWVTGLTGIVDCGRGMRCFAFGESHVVLWLGTWDAFMGFTFYF

SEQ ID NO: 228643 - protein, 136 aa, Glycine max
  Coding DNA Sequence Number=SeqID_111865
  Homolog annotation: Hit_ID=Q1SMF0; Match level="QueryCoverage=60%, HitCoverage=15%, E-value=4e-07, Identity=34%"; Hit description =Tetratricopeptide-like helical
MVCYLHCRNGLLPALPSLSLSLSLWWVLWWQRSGDTGEELVVVENIDCSYAFNTSQVFPTSEDVLQWARTVTYDIGFMTMIMRSDTSTGKRGRTSFVLIGCEMSGKYRAYKKYLVPTMTSTRKCGCLFLSCEQNQS

SEQ ID NO: 228644 - protein, 253 aa, Glycine max
  Coding DNA Sequence Number=SeqID_111866
  Gene Ontology: Mol. function=ferrochelatase activity; Biological process=heme biosynthetic process
  Homolog annotation: Hit_ID=Q1SPB9; Match level="QueryCoverage=61%, HitCoverage=26%, E-value=6e-15, Identity=31%"; Hit description =Transposase
MMHLGNTTTNRSRCGCIMRTTYSLSCACKLARYDVGSIPLDTVHMFWQRLRFSDQGLSEPEVCITQEMEAIFKRYKDLDICCKVALRSKLQELAYLDLTSMCAPFENVKTKGAQKKWMTKRQRSTKRDMSYFEYVDALHSVQDSSSTLNGLDHHLNKQNQKGTCQCWIYFIHACRISLKTLLMSKLMVTMDKWMNITNMGYVIASRYNVILVSLSLRQSMIFFPLRSQPPRDSYVHRIICIDHVYGNHFVQVL

SEQ ID NO: 228645 - protein, 169 aa, Glycine max
  Coding DNA Sequence Number=SeqID_111867
MYPPVATYPSAGGRRVTRGMRVPRKEYARSRHQRLFEENVGKTGKDAIYELLSERFGSCIYARGRSKNDEERMKNVEERSKTFAKFLTENVTETFRKRLGLDFLHGNNFSKQIRKRENKIGEVVAAQLAQASSARPSEPGCFLQKQQPSGGKFWRAQVGLGAICTPHFY

SEQ ID NO: 228646 - protein, 159 aa, Glycine max
  Coding DNA Sequence Number=SeqID_111868
MKKAQARRAAINKVPEQVILSEVRRMVEEMQALNKKLEETEAAVEDYFKPLDKEAELIMKMQLQGEEKTSEMMMKALEKQASLQQVEAEKNASKHQVDNSETNLNESEMMEEEKTLKEMLKALQQEVLLEKADAESSDNVHQADKSHIDLTSASTTTPK

SEQ ID NO: 228647 - protein, 134 aa, Glycine max
  Coding DNA Sequence Number=SeqID_111869
MDIDTLGCSGQRGSKNLRELASSDYLAFGALIWYRSSGVTLATTNFGGGHGESLFFGHNVNQRPTRSTYHQDSTIEVHEDVGDFSDDEDLTPSKIAFYQDVIGEEILKGELLSSDKEWDSSGDEGDPFEDITLP

SEQ ID NO: 228648 - protein, 259 aa, Glycine max
  Coding DNA Sequence Number=SeqID_111870
  Gene Ontology: Mol. function=helicase activity; Biological process =viral genome replication
  Homolog annotation: Hit_ID=Q9LW42; Match level="QueryCoverage=98%, HitCoverage=16%, E-value=2e-62, Identity=46%"; Hit description =Helicase-like protein
MARDRLQDVQVNNIKLKLIANHEKDGRTYNVPTVPEVAALIVGDFDANSKRDIIIETQHGQLQRIHELHSSYLALQYPLLFPYGEDGYRPDILHSSRSDGKKWKRNRLTMREWFSYRLQCISNESITLLNSKRLFQKFVVDGYTMVDKFCSLQHSLDNGSRRGLNKGKRVILPSTFVGSPRYMDQLYFDGMVICSHVGFPNLFITLTCNQNWPEIHRLLSPLNLKAVDRSDIISRVFKLKYEKMLIDLTKNHMLGKVIA

SEQ ID NO: 228649 - protein, 85 aa, Glycine max
  Coding DNA Sequence Number=SeqID_111871
MQVSITHYEKYRREYKAFVEYSLKGHFHCEQKSHVIVCTMDKILSLQRLTCCLILLCETMMRILKLAKYRLKAQVEKDEGLSGEG

SEQ ID NO: 228650 - protein, 119 aa, Glycine max
  Coding DNA Sequence Number=SeqID_111872
IFLIYITIIPINCTLDDNLPDLLSTPIVELELVSMAKITFLKEFVPRESDILVTDAFVEHNYIPLQWRSESSENCHMITTMDKALCDRGWKLLCVFLLHGAFCIFAGLMVECSGGQILK

SEQ ID NO: 228651 - protein, 174 aa, Glycine max
  Coding DNA Sequence Number=SeqID_111873
DAIEIPGFYQCQWLPNYPEIVEFKYDGETYQIQVRQHKGQLYFADGLTRLRTKLQIYESVMINFLACNHPSKFDLHCTPPLDQQKCKRRRATRKHIWTYEISQSMLGAPYPLQLPASVTQCLIHCGDHMTILRRFRPPLQWNVVVLDKGISDKYVTLPWYKFLQEGDFSHGDEL

SEQ ID NO: 228652 - protein, 97 aa, Glycine max
  Coding DNA Sequence Number=SeqID_111874
  Subcellular localization annotation: CTP_CleavageSite=49; ConfidenceScore=5.44e-01
MEYICPSNSHPKPNCVRSMSFGSSSGSFRILIIPSVATYPSAGGRRVTRGMRVPRKEYARSRHQRLFEENVGKTGKDAIYELLSERLGSCIYARGRY

SEQ ID NO: 228653 - protein, 238 aa, Glycine max
  Coding DNA Sequence Number=SeqID_111875
MVQVNRGPRPNLPLRFEPTDYNTLLTYKFLIQSMIVLHLFAAPLPSCTTITCSKHFSHDNHFVRSSTVPRLSLSHVRTRIFLCSARNRQKDLNGRDFSIDIVKEDQELEDDGDDGFLAQGMYARRDAKDIDEEEAQENEDDDSGYSGRGPYTGRPGKDYDRDPELGNILGSFLEDPQAAQSKLEDRLRKKRSKILHTKTGSGKPMKVSFNNLMSVYVALSRGTLVLPDWSVYHSAFTW

SEQ ID NO: 228654 - protein, 156 aa, Glycine max
  Coding DNA Sequence Number=SeqID_111876
RSSGSRNTNGDRGGSGDSGGGDGSDVGGGSCDDVGGGYGGSDGDSGGGGDNAGGNGDGDEDGGGGGSGAGSCGGDNDGGVAVVAMMKVAFDMVKYRVRSKAIVQIHSNHEDLQQCKDITELSYRGLRSCISYSKIQVHNANSKRERNQTRQKQKRK

SEQ ID NO: 228655 - protein, 241 aa, Glycine max
  Coding DNA Sequence Number=SeqID_111877
LRLPAIRKPLILQFKAVFHCDKDAIEIPGFYQRQWLPNYPEIVEFKYDGETYEIQVRQHKGKLYFVNGLTRLRTELQIYESVTINFLACDHPSKFDLHFTPPLDQQKCKRRRATRKHIWTYKITQSMLGAPYPFISSIQILISMPNSFFSLQQLPASVTQCLIHCGDHITILRRFGPPLQWNVVVLDKGIGDKYVTLPWYKFLQEGDFSHENELSFYYRRAEKIWEVVIRHAIDWDDSDID

SEQ ID NO: 228656 - protein, 80 aa, Glycine max
  Coding DNA Sequence Number=SeqID_111878
MEMYCVLCVTNVKKLSANHLFVSCKFAHDTWKRWYSLLGKSSTLPHAAIDHVYQNSHGIWYILAWTFGGLWGGVRLFGTF

SEQ ID NO: 228657 - protein, 79 aa, Glycine max
  Coding DNA Sequence Number=SeqID_111879
MGMSQLGLFDLVPCISKQRRMEGHSEMGLMGESFDTSNLLGRMRDDEYESRAGSDNFDGGSGDDQDAGDHQHIKRREIP

SEQ ID NO: 228658 - protein, 367 aa, Glycine max
  Coding DNA Sequence Number=SeqID_111880
  Gene Ontology: Mol. function=catalytic activity; Biological process =protein amino acid phosphorylation
  Homolog annotation: Hit_ID=Q689D6; Match level="QueryCoverage=93%, HitCoverage=84%, E-value=1e-147, Identity=73%"; Hit description =Plant-specific family protein RPD1
  Pfam annotation: Domain name=DUF860; Domain location=45-367; Score =501.6; E_value=8.8e-148; Accession=PF05898.4; Description=Plant specific of unknown function (DUF860)
MRVFASRTSNLFKLNVEHFLLIHNPNFNSVREFSQSTAIPKKQLRVRDHGYDNYMEVEKKTRKVLKFQNLILSEPSQSLPISRLETLARRFGFTRHESGAFVLKFPHVFEIFEHPVQRILFCRLTRKAILQIEQERRALAAELPRAVTRLRKLLMMSNHGRLRLEHVRIARAAYGLPDDFENSVVLRYPQFFRLIDAKETRNKYIEVVERDPGLGTCAIEEARERVYRERGSDAEDIRFSFVIDFPPGFKIGKYFRIAMWKWQRLPYWSPYEDVSGYDLRSIEAQKRMEKRAVATIHELLSLTVEKKITLERIAHFRMAMNLPKKLKDFLLQHQGIFYVSTRGNQGKLHTVFLREAYRKGELIEPNE

SEQ ID NO: 228659 - protein, 692 aa, Glycine max
  Coding DNA Sequence Number=SeqID_111881
  Gene Ontology: Mol. function=sequence-specific DNA binding; Cellular component=nucleus; Biological process=regulation of transcription, DNA-dependent
  Homolog annotation: Hit_ID=Q1S0I1; Match level="QueryCoverage=99%, HitCoverage=90%, E-value=0.0, Identity=62%"; Hit description=Lipid -binding START; Homeodomain-related
  Pfam annotation: Domain name=Homeobox; Domain location=1-40; Score =36.2; E_value=1.1e-07; Accession=PF00046.19; Description=Homeobox domain
  Pfam annotation: Domain name=START; Domain location=217-442; Score =240.8; E_value=3e-69; Accession=PF01852.10; Description=START domain
  Pfam module annotation: Pfam domain module=Homeobox::START; Domain location=1-40::217-442
FFKECPHPDEKQRTDLSKRLGLENKQVKFWFQNRRTQMKNKLLKINIIVISCYLFGGSQMKTQLERHENMILRQENDKLRAENSVMKDALANPICNNCGGPAIPGQISLEEHQTRMENARLKDELNRICALANKFLGRPLSPLASPMALPPSNSGLELAIGRNGLGGSSNFGMPLPMGFDVGDGALGSSPAMSTMGARSPMGMMGNEIQLERSMLLDLALSAMNELIKMAQPDTSLWIKSSDGRNEVLNHDEYARLFSPYIGSKPAAGYVTEATRGTGVVSASSLGLVEILMDADQWSEMFSSMIASAATVEVLSSGTGGTRSGALQVMLAEVQLLSPLVPARQVSFLRFCKKHAEGLWAVVDVSVDIGRNVTNSHPLMSCRRLPSGCVIQDMPNGFSNITWVEHSQYDESVIHQLYRPLVSSGIGFGAQRWIATLLRQCDCLAILRSPQGPSEDPTAQAGRTNMMKLAQRMTECFCSGICASSACKWDILHIGNLADDMRIMARKIDDPTEAPGIVLSASTSVWMPVSRKRVFDFLRDENLRGEWDLLSKDGPMKEMLHIAKGQDRGNCVSILHSANSECNVLYLQESWSDASGSMVVYSPINMQALQMVMSCGDSSFVPLRPSGFAILPDGTSNNGDGSDGGGSCLLTVGLQMLPNGNHQSAKFTMESVDAVNNLISFTIQKVKDALGVA

SEQ ID NO: 228660 - protein, 58 aa, Glycine max
  Coding DNA Sequence Number=SeqID_111882
MNPLFFARILSGNKFVNASVGKAHFLYSLPCSEAYSMLVGIYTDYAFTSKASEDDGRG

SEQ ID NO: 228661 - protein, 57 aa, Glycine max
  Coding DNA Sequence Number=SeqID_111883
  Gene Ontology: Mol. function=DNA binding; Cellular component=nucleus; Biological process=regulation of transcription, DNA-dependent
  Homolog annotation: Hit_ID=Q6R074; Match level="QueryCoverage=62%, HitCoverage=13%, E-value=4e-13, Identity=86%"; Hit description=MYB transcription factor
  Pfam annotation: Domain name=Myb_DNA-binding; Domain location=17-56; Score=20.7; E_value=0.0053; Accession=PF00249.21; Description=Myb -like DNA-binding domain
MAGHMGRGVIEEQVWRKGPWTAEEDRLLVEYVRLHGEGRWNSVARLAILVNLYVIRS

SEQ ID NO: 228662 - protein, 63 aa, Glycine max
  Coding DNA Sequence Number=SeqID_111884
MMKWPTWFNQLQLFNQEKMEFRIHFRMTLSIIAISIGVILMMKTFVVWRCHLLLMLGKNYMLV

SEQ ID NO: 228663 - protein, 354 aa, Glycine max
  Coding DNA Sequence Number=SeqID_111885
  Gene Ontology: Mol. function=protein binding; Biological process =protein modification process
  Homolog annotation: Hit_ID=Q1S0J6; Match level="QueryCoverage=89%, HitCoverage=93%, E-value=1e-112, Identity=68%"; Hit description =Ubiquitin; Apoptosis regulator Bcl-2 protein, BAG
  Pfam annotation: Domain name=BAG; Domain location=159-237; Score =36.5; E_value=8.9e-08; Accession=PF02179.6; Description=BAG domain
  Pfam annotation: Domain name=ubiquitin; Domain location=69-138; Score= 9.4; E_value=0.029; Accession=PF00240.13; Description=Ubiquitin family
  Pfam module annotation: Pfam domain module=BAG::ubiquitin; Domain location=159-237::69-138
  Subcellular localization annotation: CTP_CleavageSite=32; ConfidenceScore=5.12e-01
MMKMKNISSSNNNNRTNGLSSIMNGGGSGGCRSEPGSKEWEMRPGGMLVQMRTADSDRNPALVPTIRVRVKYGSIYHEVNISSQATFGELKKMLSGPTGLHHEDQKLLYKDKERDSKAFLDMVGVKDKSKIVLMEDPISQEKRLLERRKNAKMEKAAKSISEISLEIDRLAGRVSAFESIISKGGKVVETDVHNLIELLMNQLLKLDGIMADGDVKLQRKMQVKRVQKYVETLDVLKVKNSMPSSNGDHAPVQPQQKHSNGQQQKYSNGHHRLALVPIQEQQQEQPRNSNENSLELYQEQQHQPSRNSTSGVVVTTNWELFDSVPPLIPVQSTSPPSSVTNNSGPPKFNWEFFD

SEQ ID NO: 228664 - protein, 360 aa, Glycine max
  Coding DNA Sequence Number=SeqID_111886
  Gene Ontology: Mol. function=protein binding; Biological process =protein modification process
  Homolog annotation: Hit_ID=Q1S0J6; Match level="QueryCoverage=81%, HitCoverage=89%, E-value=1e-100, Identity=65%"; Hit description =Ubiquitin; Apoptosis regulator Bcl-2 protein, BAG
  Pfam annotation: Domain name=BAG; Domain location=158-236; Score =36.3; E_value=1e-07; Accession=PF02179.6; Description=BAG domain
  Pfam annotation: Domain name=ubiquitin; Domain location=68-137; Score= 11.6; E_value=0.017; Accession=PF00240.13; Description=Ubiquitin family
  Pfam module annotation: Pfam domain module=BAG::ubiquitin; Domain location=158-236::68-137
MMKMKNINSSNNNKTNGLSSIINNGGSDGNRAEPGSKEWEMRPGGMLVQMRTTDSDRNSALVPTIRVRVKYGSIYHEVNISSQATFGELKKMLSGPTGLHHEDQKLLYKDKERDSKAFLDMVGVKDKSKIVLVEDPISQEKRLLERRKNAKMEKAAKSISEISLEVDRLAGRVSAFESIISKGGRVVETDLLNLIELLMNQLLKLDGIVADGDVKLQRKMQVKRVQKYVETLDVLKVKNSMPSSNGGHAPVQPQQKHSNGQRQGPVQEKKQQKHSNGHHRLALAPIQEQEQQQPSRNSTSGVVVTTNWELFDSVPPLIPVPSTSPSPHPPAIPHLETFPSLASSKDREAGGVKNKRVSIC

SEQ ID NO: 228665 - protein, 169 aa, Glycine max
  Coding DNA Sequence Number=SeqID_111887
MRRQNLVIPHPFAIQTQSCPMARRDKIWSFCILCHPKAAGPMTCGDKVWSFRTPLPFRHSRVRWRAETKFGYSAPFVIQRRWPDDMRRQNLVIPHPFAIQTQSCPMARRDKIWSFCTLCHPEAAGPMTCGDKIWSFRTPLPFRHSRVRWYAERKLGHSAPFVIQRRRAR

SEQ ID NO: 228666 - protein, 105 aa, Glycine max
  Coding DNA Sequence Number=SeqID_111888
  Subcellular localization annotation: CTP_CleavageSite=29; ConfidenceScore=5.15e-01
MSSLARWLGQESSLLLREGVRPLQPKSLCPRMRTSLSPLSLSFMIQMQRFLRRRQHHQSLFLSNPHHQLQFLKTYNRLHQHRCLISPLFSIYQLHRCWILMSMHK

SEQ ID NO: 228667 - protein, 86 aa, Glycine max
  Coding DNA Sequence Number=SeqID_111889
  Gene Ontology: Mol. function=RNA-directed DNA polymerase activity; Biological process=DNA integration
MAMTEEIESLQKNQTWDLVVLPESFEVEGKDNLVCRLKRSLYGLKQSPRQWYKRFDEFIVFHWYIRNPYNSYDMLIASQMLEYIGI

SEQ ID NO: 228668 - protein, 80 aa, Glycine max
  Coding DNA Sequence Number=SeqID_111890
MELSKVSNSQNGRCPTWPLLCAQPLETSPDVVSPLELVGLGSSSMDSFASWNMNGSGIEKEKREETPLQGEDESKRSSPP

SEQ ID NO: 228669 - protein, 69 aa, Glycine max
  Coding DNA Sequence Number=SeqID_111891
MSSLPNKEIGPFSEDEDKALCNQPQKDDEKETKLGSSITTVQPYYVPPHMHNYEESNFEDSKYGHNLDR

SEQ ID NO: 228670 - protein, 60 aa, Glycine max
  Coding DNA Sequence Number=SeqID_111892
MPPQGGHKVEGFVKFHCLFGSFKSFIDGFQYCKPMAQFNGTWLHDRYESIKSFYSRPDSG

SEQ ID NO: 228671 - protein, 167 aa, Glycine max
  Coding DNA Sequence Number=SeqID_111893
  Gene Ontology: Mol. function=protein serine/threonine kinase activity; Cellular component=integral to membrane; Biological process=protein amino acid phosphorylation
  Homolog annotation: Hit_ID=Q1T003; Match level="QueryCoverage=99%, HitCoverage=23%, E-value=7e-70, Identity=79%"; Hit description =Protein kinase; Concanavalin A-like lectin/glucanase
MLDEGFIARLGDFGLARQTEHDKSPDATMAAGTMGYLAPEYVLTGRASEKTDVLSYGVVVLEVANGRRPIEKDAPAAGNGKVGISSNFVEWIWSLRQEGKLLIVADPRLEGEFEEGEMRKVLLVGLACSHPDSIARPTMRGVVQMLLDEAEVLIVPRTKPSTSYSTS

SEQ ID NO: 228672 - protein, 81 aa, Glycine max
  Coding DNA Sequence Number=SeqID_111894
  Homolog annotation: Hit_ID=Q9FJY3; Match level="QueryCoverage=61%, HitCoverage=8%, E-value=5e-08, Identity=66%"; Hit description =Photoreceptor-interacting protein-like
MVILNLPLEKSSKVATTMRFLFRLLRAANILNAFEAYRDALEKKIGLQLKEATLGNHGSRLGHPLTQASCLLIDEVRFLAQ

SEQ ID NO: 228673 - protein, 135 aa, Glycine max
  Coding DNA Sequence Number=SeqID_111895
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q1SP46; Match level="QueryCoverage=94%, HitCoverage=33%, E-value=2e-56, Identity=78%"; Hit description =Protein phosphatase 2C
MSKDHRPLCIKERKRIKSLGGYIDNGYLNSQLGVTHALGNWNLQGMKEINGMGGPFSVESKLKLITLTKEDEFFIIGSDGIWDVFHSQNAIHFARRSLQEHNDVKQCCEEVIGEAIKRGATDNLTVVMISLTKTV

SEQ ID NO: 228674 - protein, 151 aa, Glycine max
  Coding DNA Sequence Number=SeqID_111896
  Gene Ontology: Mol. function=monooxygenase activity; Cellular component=membrane; Biological process=electron transport
  Homolog annotation: Hit_ID=Q7X9B3; Match level="QueryCoverage=74%, HitCoverage=29%, E-value=3e-24, Identity=47%"; Hit description=9/13 hydroperoxide lyase
MKEKDKENGLKEVQRKGRKRVSLELDEAGAIEADFCFIEVFVGEEAEEEVEGGGINEVFREVVAKEREECVVFGGSSTWRKCVGGFSGVLEGAHTIVVVEGDGQHESAIKNIALFDLGVVEEDGEGPSAMLVLKEWRRSFVVGEWMYNLSS

SEQ ID NO: 228675 - protein, 115 aa, Glycine max
  Coding DNA Sequence Number=SeqID_111897
MAARKIKLSGKPGPFRIAARLPWWHCRMKLPENAQQLPLADMEKSSEQAAATEPQSRRRRSDSAWETSFVNPNLFGEEEEATLREREFIDANLSATLDSLRGTELPPIHLTNAVT

SEQ ID NO: 228676 - protein, 103 aa, Glycine max
  Coding DNA Sequence Number=SeqID_111898
MDANHRAQMLLFEHLKGIIANVHLDINSHLRRRLRLLLIGPFSLDTRDMRAKGVVQQPMRMLLKVRRLELGTLPLRRPEKMMGVGTDGAANDMTPLAIGVEEL

SEQ ID NO: 228677 - protein, 68 aa, Glycine max
  Coding DNA Sequence Number=SeqID_111899
  Homolog annotation: Hit_ID=Q1SAJ3; Match level="QueryCoverage=57%, HitCoverage=9%, E-value=9e-12, Identity=85%"; Hit description=WD-40 repeat
MHSLVLYRYAGNLLEGFSQTQISTLAVKDNLLVAGGFQGELTCKAIDTSLSWGQGIAIVVTSLANMII

SEQ ID NO: 228678 - protein, 120 aa, Glycine max
  Coding DNA Sequence Number=SeqID_111900
  Gene Ontology: Mol. function=unfolded protein binding; Cellular component=centrosome; Biological process=protein folding
  Homolog annotation: Hit_ID=Q00NU9; Match level="QueryCoverage=49%, HitCoverage=9%, E-value=6e-24, Identity=86%"; Hit description=Heat shock protein 90
MRVHEREDQMDNTHALILLVWRSYHYVQQLCCKQEVGSKAKNRNFYIPTLAITEDINIHFEEDYNKFYEGFSKDLKLGIHEDSQNKTKLAELLRYDSSKSGDEMTSLKDYVTRMKEGQNE

SEQ ID NO: 228679 - protein, 94 aa, Glycine max
  Coding DNA Sequence Number=SeqID_111901
MTVTWQNDMAKRTKPGFGAAEAELWKRLIKRNERKIKEKQAQGLICNERGARIQRVRPQGAKYFELKPVGAEYFEHVPNYFFPPITTGFNLNPL

SEQ ID NO: 228680 - protein, 215 aa, Glycine max
  Coding DNA Sequence Number=SeqID_111902
MTSKAAKEIADKIASQDFFVTHGCQDVLTAAIGRLEHPSRVRGARPGVMIKKYFGPASRTSRTSSSMASKDLEKLTQKIRDQLEESITKKSCVDPLGLYVKENPPHLVALGKLFKGSTTIHNIPLLLDQVKVGVEEVRDADAPIPVPIEKVMWDATVFGVFNENFPLYIKHEDLSKIAPVVNVSASLLYSCGFRKHMTKTSMRAGNAEVYGFLKP

SEQ ID NO: 228681 - protein, 333 aa, Glycine max
  Coding DNA Sequence Number=SeqID_111903
  Gene Ontology: Mol. function=serine carboxypeptidase activity; Cellular component=cellulose and pectin-containing cell wall; Biological process=proteolysis
  Homolog annotation: Hit_ID=Q6W6R6; Match level="QueryCoverage=98%, HitCoverage=73%, E-value=1e-150, Identity=73%"; Hit description =Putative serine carboxypeptidase
  Pfam annotation: Domain name=Peptidase_S10; Domain location=1-322; Score=443.1; E_value=3.6e-130; Accession=PF00450.12; Description =Serine carboxypeptidase
PGCSSLGYGAFEELGPFRVNSDGKTLFHNKYAWNEVANVLFLESPAGVGFSYSNTTSDYDRSGDKSTAKDAYVFLINWLERFPEYKTREFYITGESYAGHYVPQLAYTILVNNKFSQQSINLKGIAIGNALIDDVTTIKGIFDYFWTHALNSDQTHHLIKKYCDFTSENISAACINATISSILEKGSIDSSNIYAPLCYDSSLKNGSTGSVYDFDPCSAYYVEAYLNRPEVQKALHAKPTNWTHCSGDTDATVPVTSSRYSINTLRLPIQVDWHPWYSGNEVGGYVVGYKAVTFVTVRGAGHFVPSWQPARSLTMISSFLSGTLPPASPYDGF

SEQ ID NO: 228682 - protein, 198 aa, Glycine max
  Coding DNA Sequence Number=SeqID_111904
  Homolog annotation: Hit_ID=Q9FJ81; Match level="QueryCoverage=86%, HitCoverage=57%, E-value=7e-43, Identity=52%"; Hit description =Arabidopsis thaliana genomic DNA, chromosome 5, P1 clone:MSG15
MWPMYVAAIVVAEGAQPVDEKTIPDGTEQIFVMSTDRVDGLKEDLAWASYVLLCNTNAIAMSIWITQPAELTELIFIQGEICARGYWNIPDDTSKEILPGWFKKKIENAGLYDLKDTLYFPQDADSEFQDLVPIGTRCLLIQPVLQVSNESDTGLQKPGGFILLASTTRYAFSNKDKAWIAAVANKFRGNSISMFEDL

SEQ ID NO: 228683 - protein, 231 aa, Glycine max
  Coding DNA Sequence Number=SeqID_111905
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=100%, E-value=1e-40, Identity=30%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Subcellular localization annotation: CTP_CleavageSite=47; ConfidenceScore=5.64e-01
MTCSPLKVRTCSPQKVKTCSPLKVRTCRPLKARGCSPLKARACCPLKATTSSPLKARAFKPLKARTFSPLNARACSPLKVRTCSPLKVRTCSPLKARGCSPLKERACCPLKARTCSPLKARACRPLKVRTCSPLKARTFSPLQGRTCTPLQGRTCSPQKARPCSLLKVRLCSPLKVRTCSPLKARACSPLKARTCSPLKARACSPLKVRTCSPLKVRMCSPLKVRTCSPLQ

SEQ ID NO: 228684 - protein, 111 aa, Glycine max
  Coding DNA Sequence Number=SeqID_111906
  Gene Ontology: Cellular component=integral to membrane
  Homolog annotation: Hit_ID=UPI00005F943B; Match level="QueryCoverage =98%, HitCoverage=61%, E-value=9e-37, Identity=72%"; Hit description =COG3803: Uncharacterized protein conserved in bacteria
  Pfam annotation: Domain name=DUF924; Domain location=1-93; Score= -80.9; E_value=4.1e-06; Accession=PF06041.2; Description=Bacterial protein of unknown function (DUF924)
RFGKIWRAAAAGELAHWRAPIEGRLAEVIVLDQFSRNLFRGTPQSFACDGMALILGAGGDPQRRVRTAEPRAARFPLSAVHAFGIAADPPAGAGAVHRAQQRRPAGVRASA

SEQ ID NO: 228685 - protein, 166 aa, Glycine max
  Coding DNA Sequence Number=SeqID_111907
MGKAEEVQEQMKADMEAMKEKMAKMMEAIISMKKIKEVDTVAVSATSVVAKVNPMPPSGLNQMNHPTSNMDVNNSAPILIEMSLNPWGEAHEIPHHNLADFEPCLGYATEGQAIGAPPAMAEKGKVDHLKERLRAIEEGEDYAFANLEELFLIPKHGHSQVQGAGL

SEQ ID NO: 228686 - protein, 550 aa, Glycine max
  Coding DNA Sequence Number=SeqID_111908
  Homolog annotation: Hit_ID=UPI00003CC7C3; Match level="QueryCoverage =34%, HitCoverage=55%, E-value=7e-62, Identity=63%"; Hit description =COG1988: Predicted membrane-bound metal-dependent hydrolases
  Pfam annotation: Domain name=TetR_C_3; Domain location=171-297; Score= 198.3; E_value=1.9e-56; Accession=PF08362.2; Description=YcdC-like protein, C-terminal region
  Pfam annotation: Domain name=TetR_N; Domain location=124-170; Score =61.6; E_value=2.6e-15; Accession=PF00440.13; Description=Bacterial regulatory proteins, tetR family
  Pfam module annotation: Pfam domain module=TetR_C_3::TetR_N; Domain location=171-297::124-170
MAGGSVRVAAGEGLQVVVPEFGFAAEAAQLNHRQGKVEVIVLSLEHNRFVELKGRLVLRGMRGDEPAIVANRNENANFHGTALGRKQGVCYDAISQDGRGNSVKSDEKKPGRRSRAVAAKRAAILEAALAFFSQFGIHGTSLDKVAERADVSKTNLLYYYPSKEVLYVAVLKEILDVWLAPLRALRHDQDPLVAIRNYIRLKLEVSRDHPQASRLFCLEMLQGAPLLKGELAGDLKALVDDKAAIIEQWIAEGRIAGVQPQHLFFLLWATTQHYADFARVHGFAITTNAGRGGDRGRNGQTRAAVAGGAGGGGRGHAAGPRRVYRPRRCHPQHDAAPHREPRAAVADAGGTVIWLAGGWRDAQPAALARLVPRHLAGIDHASAAGPDHGVRHAARAAADRLPVRHRQHVHHRSALHAAAADRPDRRTVAAGCVRAALESGRIAHQYAVPGLEHGGADATGKPGGRYCRPIVPYRSAGTIAIPRGIAPFKGQWHAERVAWFSHGFYAMRQQGNETLIVDLRMGEEPDYTFTFNLGSAAAPAAAPQREDSLR

SEQ ID NO: 228687 - protein, 108 aa, Glycine max
  Coding DNA Sequence Number=SeqID_111909
  Gene Ontology: Mol. function=nucleic acid binding
MEGGIGPILDLTPKEEKRIEDNVEPYLDWEMKVEQLFACHHISEERKVPLATLSFQGYAFYCWTSSVREKRIHGDPLVEYWNDLKSALRKRHISSYYERVLMDKLQRL

SEQ ID NO: 228688 - protein, 211 aa, Glycine max
  Coding DNA Sequence Number=SeqID_111910
  Gene Ontology: Mol. function=chitin binding; Cellular component =extracellular region; Biological process=chitin metabolic process
  Homolog annotation: Hit_ID=UPI00006A17C9; Match level="QueryCoverage =70%, HitCoverage=100%, E-value=9e-20, Identity=32%"; Hit description= UPI00006A17C9 related cluster
  Subcellular localization annotation: CTP_CleavageSite=25; ConfidenceScore=5.09e-01
GEPLGTSTLTSRGLHVLAFRGLHVLAVKGSCTFTFVGLHALTFRGLRALAFVGLHALTFRGLHVLTFRGLHALAFVGLHALTFRGLHELTFRGLHVLAFKGQHVLALTFRGLHVLTFRGLHVLAFRGLHVLTFSGLHALAFKGLHALTIRGLRVLTLSGLHIHTVREFKVPGPPPDPGGGPTMQVQPEEEAIVQLLYVATCPFAGERCEAH

SEQ ID NO: 228689 - protein, 115 aa, Glycine max
  Coding DNA Sequence Number=SeqID_111911
MSVLYWYCLMKAVIKSFHECIGEASKLVYQMAAAPAKISWKKCISSFLSLDYAPIFWQYIFRSSFSLPSTAGGGPLLRNAAVAEGWVEELPQYWVEDMGQSHLGHALEVLHGRLL

SEQ ID NO: 228690 - protein, 97 aa, Glycine max
  Coding DNA Sequence Number=SeqID_111912
MGVFAKYIVSSRAKVPSRHSISTRSWISCAAIAIYKKEKERGRLFHERSNCGSNTMRPITTTCKLKGISRLFISGNRLHFIGNRLPEAKLELHSFRM

SEQ ID NO: 228691 - protein, 119 aa, Glycine max
  Coding DNA Sequence Number=SeqID_111913
MARKGLGQLTQKTRDRLEESITEKMQSHELTFPPKPEVGPPASRVGTKESCVDPSGHDPDTGDLEKYGLYVDENPPRLVALGRLYKGSTTIHNIPLGNDQVKVGVEEVQNVDARIPIPT

SEQ ID NO: 228692 - protein, 121 aa, Glycine max
  Coding DNA Sequence Number=SeqID_111914
  Subcellular localization annotation: CTP_CleavageSite=38; ConfidenceScore=5.53e-01
MNCVFVHVSSTFEFGAMRSNSLVQFSILNLFRSPMNCVFVHVPSTFEFGAMRSDCLVQFSILNLFRSPMNCLFVHASYTFEFGAMRSDCLVQFSILNPFSEPHELRFRSCVLHLRVWSHAL

SEQ ID NO: 228693 - protein, 165 aa, Glycine max
  Coding DNA Sequence Number=SeqID_111915
MAHEHKVADEYAKCTRKRRLEEGKNTITKRAPRHPYRTRSKSRTMGDQEETQEQMKADMSALKEQMASMMEAMLGMRQLMEKNMATAAGVSSAAEADPTLLATAHYAPPNAVGRERSTLGHTSNPHLGYNRVAYPYGLPPNYTPPVMHDDVGHVSSPILEGEPPR

SEQ ID NO: 228694 - protein, 122 aa, Glycine max
  Coding DNA Sequence Number=SeqID_111916
MLAIITKYQEELSLATAHEHRVADEYAQVYAEKEARGWVIDSLHQEATMWMDRFSLTLNGSQELSRLLAKAKAVANTYSAPEEIHELLSYCQHRIDLMAHMIRNRQEVCIVAQILTSYKLSE

SEQ ID NO: 228695 - protein, 358 aa, Glycine max
  Coding DNA Sequence Number=SeqID_111917
  Gene Ontology: Mol. function=DNA binding; Cellular component=nucleus; Biological process=regulation of transcription
  Homolog annotation: Hit_ID=Q1SQ90; Match level="QueryCoverage=87%, HitCoverage=83%, E-value=1e-113, Identity=62%"; Hit description =Homeodomain-related
  Pfam annotation: Domain name=Myb_DNA-binding; Domain location=117 -161; Score=26.7; E_value=8.5e-05; Accession=PF00249.21; Description =Myb-like DNA-binding domain
  Pfam annotation: Domain name=Myb_DNA-binding; Domain location=238 -286; Score=14.3; E_value=0.18; Accession=PF00249.21; Description=Myb- like DNA-binding domain
  Pfam module annotation: Pfam domain module=Myb_DNA-binding::Myb_DNA -binding; Domain location=117-161::238-286
METKKNAKADTGESPNPAHSGSSKPKRVTFSDQVDVCCDGLIRGKRFTPEEDEKIKLAVFDYIESHGLGDEGLDMVLHCKSHPEIRDCWKEIGAALPQRPYVSVYTRAHILFERGEDRKWTPEEYEFLRKVKEQHGSDWKSVAEALGKHRFHVKDAWRRIKLTNTNQGRWTQEEYQNLFDLVNLDLRVRASQDYRKSKHGMLRDNIGWEAIGDKLTTRSSVLCCKKWYDKLTSPMVANGVWSDTDDYRLVNALFTLDACCMEEVDWDNLLEHRPGDVCRKRWNQMVQYIGEHGGKSFAEQVEILAKRFCPDLLEIFQWGTGLYVENATMHAYRQHAWRDAGGRGFAIPSGDLACLCHY

SEQ ID NO: 228696 - protein, 93 aa, Glycine max
  Coding DNA Sequence Number=SeqID_111918
  Gene Ontology: Mol. function=binding; Cellular component=thylakoid; Biological process=photosynthesis
  Homolog annotation: Hit_ID=Q10CT3; Match level="QueryCoverage=54%, HitCoverage=15%, E-value=2e-11, Identity=60%"; Hit description=TPR Domain containing protein, expressed
MSGFCMYFVYGMETSNMKLGCSYTGNTPFELAFVSRYLTSSPKWIKVNERRTLHDVLKEPNFIIPGIPVFYVVSKRSSFYGKFKAGKWAPPSI

SEQ ID NO: 228697 - protein, 147 aa, Glycine max
  Coding DNA Sequence Number=SeqID_111919
  Gene Ontology: Mol. function=3-oxoacyl-[acyl-carrier-protein] synthase activity; Cellular component=mitochondrion; Biological process=fatty acid biosynthetic process
  Homolog annotation: Hit_ID=Q8L3X9; Match level="QueryCoverage=51%, HitCoverage=16%, E-value=1e-26, Identity=72%"; Hit description=3 -oxoacyl-[acyl-carrier-protein] synthase, mitochondrial precursor
MACWVPRPPRLHHENGFSDSRGWHSEHQAWGRRLKITGEKGALNTHRFVQIVLSTIDFPPPPVVSSRRVVVTGMVTPLGCGVDTTWKRLVGGECGVRALSLEDLKMNAFDRETQLSTFDQLTSKVAAVVPTGTNPGEFDHQIWLNSK

SEQ ID NO: 228698 - protein, 70 aa, Glycine max
  Coding DNA Sequence Number=SeqID_111920
MKDKGLNKSRGVELALKKNEEEYQRKMDEKKATKHCPRWGGINCDCRTFCFYKTMVGKLLAWGSTSGCSE

SEQ ID NO: 228699 - protein, 97 aa, Glycine max
  Coding DNA Sequence Number=SeqID_111921
  Subcellular localization annotation: CTP_CleavageSite=73; ConfidenceScore=5.15e-01
GIAPTRHPVDPKKSTGPWGFQLWLRASVSPTGCPFPQRGCPFPPARSRHHDIGIAPARHPVDPKKSNRVLELSSSNYGSLSVLRIACHLQQGHQAPY

SEQ ID NO: 228700 - protein, 280 aa, Glycine max
  Coding DNA Sequence Number=SeqID_111922
  Gene Ontology: Mol. function=ribokinase activity; Biological process =D-ribose metabolic process
  Homolog annotation: Hit_ID=Q1SXC4; Match level="QueryCoverage=93%, HitCoverage=60%, E-value=4e-59, Identity=51%"; Hit description =Carbohydrate kinase, PfkB
MIPDDLSKSSLLSALDGVKIAYFDGSLPDTALVVAQEAVRKNTPILIDAERPREGLDDLLKLADYVVCSANFPAASTIPQALVSMLLMLPNIKFVIVTLGKDGCIMLERSVDDTSFHGRSGCRQLIGIIGVKKEYDGDEDVAVDVVWACREKTGRLCSEESRPDGEKTNNSRQRKTQKDYKRGRGDRNSSGKLYVETAESIPPLELVDTTGAGDAFIGAVIYGKCNSFALSFPYAICAKITPETMISFAANVAGAKCRDLGARSGLPYRADPRIASFVLE

SEQ ID NO: 228701 - protein, 80 aa, Glycine max
  Coding DNA Sequence Number=SeqID_111923
  Gene Ontology: Mol. function=ribokinase activity; Biological process =D-ribose metabolic process
  Homolog annotation: Hit_ID=Q1SXC4; Match level="QueryCoverage=97%, HitCoverage=23%, E-value=5e-20, Identity=62%"; Hit description =Carbohydrate kinase, PfkB
EGIEESVCGRLYYGTSEKIPPSELVDTTGAGDAFVGAVLYCTCNLFIKPLHMQAAANCRALGARRGLPYRTNPRLASFTE

SEQ ID NO: 228702 - protein, 173 aa, Glycine max
  Coding DNA Sequence Number=SeqID_111924
  Gene Ontology: Mol. function=ribokinase activity; Biological process =D-ribose metabolic process
  Homolog annotation: Hit_ID=Q1SXC4; Match level="QueryCoverage=98%, HitCoverage=41%, E-value=7e-48, Identity=56%"; Hit description =Carbohydrate kinase, PfkB
MVQGGGNNGNTMTCAARLGLKPRIISKVSNDGPGKTMLEELEAEGVDTSFFVSEELRVTSTWRFFLLQMQKREGKKVSKEGTSPFSYIIVDNQSKTRTCIFTPGYPEMVPQDLSRANLLSALDGARVVYFDARMPDNALVIAQEAFHQNISILIDAERPREGLNDLLSLADYV

SEQ ID NO: 228703 - protein, 71 aa, Glycine max
  Coding DNA Sequence Number=SeqID_111925
MVILRLVSTKRNEFDNIRMMLVVVSYLYFPFISNKRQVKRGNRHTLISSGDHLFVGMRPSFNHFEVLGTHR

SEQ ID NO: 228704 - protein, 229 aa, Glycine max; identical to SEQ ID NO: 211870
  Coding DNA Sequence Number=SeqID_111926

SEQ ID NO: 228705 - protein, 119 aa, Glycine max
  Coding DNA Sequence Number=SeqID_111927
MTTDSPPLLMFPWTQHQRVIYKNVRQVKRKPTKEEVIILHEIRRPNSLKAIPSGVANYRNLPFSGRATRDSRVRLPWEENAWSRHQRLFEENVGKTGKVWSTNFNRERFGSYFYARGRY

SEQ ID NO: 228706 - protein, 65 aa, Glycine max
  Coding DNA Sequence Number=SeqID_111928
  Homolog annotation: Hit_ID=Q1RT73; Match level="QueryCoverage=98%, HitCoverage=11%, E-value=6e-22, Identity=69%"; Hit description=IMP dehydrogenase/GMP reductase
VPYLQLISNPTWHSRASSWTIYMEVPQSILRGSQTKTSDYYELVVNDDCINVKAEGSPNVAGLFK

SEQ ID NO: 228707 - protein, 291 aa, Glycine max
  Coding DNA Sequence Number=SeqID_111929
  Gene Ontology: Mol. function=hydrolase activity, hydrolyzing O -glycosyl compounds; Cellular component=lysosome; Biological process =carbohydrate metabolic process
  Homolog annotation: Hit_ID=Q1XL84; Match level="QueryCoverage=85%, HitCoverage=31%, E-value=4e-40, Identity=39%"; Hit description =Glycoside hydrolase family 2, immunoglobulin-like beta- sandwich:Glycoside hydrolase ...
  Homolog annotation: Hit description=family 2, TIM barrel:Glycoside hydrolase family 2, sugar binding precursor
  Pfam annotation: Domain name=Glyco_hydro_2; Domain location=9-108; Score=18.9; E_value=1.1e-05; Accession=PF00703.11; Description =Glycosyl hydrolases family 2, immunoglobulin-like beta-sandwich domain
  Pfam annotation: Domain name=Glyco_hydro_2_C; Domain location=114 -290; Score=-67.7; E_value=1.9e-06; Accession=PF02836.7; Description =Glycosyl hydrolases family 2, TIM barrel domain
  Pfam module annotation: Pfam domain module=Glyco_hydro_2::Glyco_hydro_ 2_C; Domain location=9-108::114-290
MDNYASSGVFISTPSVSEESASVQIRGKVSVSKKVKITTTIYDKEGKEVAVSETDPDKGGSFTVQVKNIKKPNLWSPENPYLYKVVNVLRDAKNEIVYDEVVNPLAFRWYHFDAEKGFYLNGNPYKIMGASRHQDFKGMGSALSDALHINDVQWLKDMGGNFLRVSHYPQDPAVMEACDRLGILTAVETPGNNQITESEGYTHNMLDMQREMIRQNYNHPSVIIWSYMNEVLIQPLYKDKTPEREKYWKNLHELALKMENLCQDEDKERYTMIAFHGDFDKKQKSWTYRYT

SEQ ID NO: 228708 - protein, 204 aa, Glycine max
  Coding DNA Sequence Number=SeqID_111930
  Pfam annotation: Domain name=Transposase_23; Domain location=104-174; Score=-4.9; E_value=0.0039; Accession=PF03017.5; Description =TNP1ENSPM transposase
MTLEATKEIAEKIASQEHPGRVRATGANVTIKQYFRSAPQSSHNSSFIPPKELEQLTQQIRDQLEESIIEKGLALPPEPEVGPSTAHVSTKGSCVNPSPTDPKMGDSDKCGLYIEENLSCLVALGRIYEGSTIVHNILLLHGQVKVGVKEVKDEEALVPVPTDEVQLVGQALNTFLAWSTHLMKRVSKHAAVSPAKPPDRPDPE

SEQ ID NO: 228709 - protein, 53 aa, Glycine max
  Coding DNA Sequence Number=SeqID_111931
MEKTQFDQRGPRDGDGPIYLIRVRSGADWPGPLPMRAYAGGPHAGRADPLTHP

SEQ ID NO: 228710 - protein, 392 aa, Glycine max
  Coding DNA Sequence Number=SeqID_111932
  Gene Ontology: Mol. function=protein serine/threonine kinase activity; Cellular component=membrane; Biological process=protein amino acid phosphorylation
  Homolog annotation: Hit_ID=Q2N1D8; Match level="QueryCoverage=98%, HitCoverage=68%, E-value=1e-158, Identity=74%"; Hit description=CMV 1a interacting protein 2
  Pfam annotation: Domain name=Pkinase; Domain location=1-266; Score =127.7; E_value=3.3e-35; Accession=PF00069.15; Description=Protein kinase domain
  Pfam annotation: Domain name=Pkinase_Tyr; Domain location=1-266; Score=116.9; E_value=5.8e-32; Accession=PF07714.7; Description =Protein tyrosine kinase
  Pfam module annotation: Pfam domain module=Pkinase::Pkinase_Tyr; Domain location=1-266::1-266
GEGGFGRVYCGTLDDGNEVAVKLLTRDGQNGDREFVAEVEMLSRLHHRNLVKLIGICIEGPRRCLVYELFRNGSVESHLHGDDKKRSPLNWEARTKIALGSARGLAYLHEDSTPPVIHRDFKASNVLLEDDFTPKVSDFGLAREATEGNSHISTRVMGTFGYVAPEYAMTGHLLVKSDVYSFGVVLLELLTGRKPVDMSQPQGQENLVTWARPLLRSREGLEQLVDPSLAGSYDFDDMAKMAGIAFMCVHPEVNQRPFMGEVVQALKLIHNDTNESNKESSAWASDFGGELVFSDSSWLDAEELAPRLAYGQASTLITMDFNSDHLEMMENRPFSASSFNGDEISLPMGHQVRSDPLRTAQSKLTFYKLTRCQSEHVVHPSKRVWNDDGYWV

SEQ ID NO: 228711 - protein, 243 aa, Glycine max
  Coding DNA Sequence Number=SeqID_111933
  Gene Ontology: Mol. function=sequence-specific DNA binding; Cellular component=intracellular; Biological process=regulation of transcription, DNA-dependent
  Homolog annotation: Hit_ID=Q984M5; Match level="QueryCoverage=54%, HitCoverage=99%, E-value=1e-27, Identity=51%"; Hit description =Transcriptional regulator
  Pfam annotation: Domain name=AsnC_trans_reg; Domain location=61-132; Score=10.9; E_value=0.01; Accession=PF01037.11; Description=AsnC family
  Subcellular localization annotation: CTP_CleavageSite=32; ConfidenceScore=5.54e-01
PLHAIFALFLFSPPAAHARHRPGLLRPRHSRRAAARQPHATAPHRRARAPFRAGRAAAHQAAAGAGRDRGQRGRGRSGAHRPAADRAHQRAAADYSLIVTAADMEEYQALAARLFAGDDNIRRYTTSIALERNAITGRETSMSAPHPDSMANLVAIRTLDKYENDYFPKRDRITIAFRGDLAEQFKYDKIRPLSPAQRHGHRVVIEAESQKTGTTGHYCIECNSWNLIEAVGTWAPEPEQAAG

SEQ ID NO: 228712 - protein, 517 aa, Glycine max
  Coding DNA Sequence Number=SeqID_111934
  Gene Ontology: Mol. function=protein serine/threonine kinase activity; Cellular component=membrane; Biological process=protein amino acid phosphorylation
  Homolog annotation: Hit_ID=Q6K6B8; Match level="QueryCoverage=98%, HitCoverage=65%, E-value=1e-146, Identity=56%"; Hit description =Putative receptor protein kinase PERK1
  Pfam annotation: Domain name=APH; Domain location=261-438; Score= -8.9; E_value=0.024; Accession=PF01636.13; Description=Phosphotransfer ase enzyme family
  Pfam annotation: Domain name=Pkinase; Domain location=259-515; Score =130.0; E_value=6.8e-36; Accession=PF00069.15; Description=Protein kinase domain
  Pfam annotation: Domain name=Pkinase_Tyr; Domain location=259-510; Score=120.8; E_value=3.9e-33; Accession=PF07714.7; Description =Protein tyrosine kinase
  Pfam module annotation: Pfam domain module=APH::Pkinase::Pkinase_Tyr; Domain location=261-438::259-515::259-510
MKIRLVLDVAPLAVFPVIDELEIELASATYLKQSQVRIMGVTSDSQSQGRTIVDINLVPLGEKFDNTTAVLLCKRFWHNEVPLIRSLFGDYAILYITYPGSCFIAPNDIYFILIICYCSRLKQLVSGIPSALPPETIIGRGHMPRESVNVLPITADMNSENEKMNLRTIIIIALSSVILLLVLVGAFYIILKWREIRRPSGAVGPAFKSYLNKRSGMEYMLSSRIMSSRSMSLVSTLAHSILSVKTFSFSELEKATAKFSSQRVLGEGGFGRVYCGTLDDGNEVAVKLLTRDGQNRDREFVAEVEILSRLHHRNLVKLIGICIEGPRRYLVYELVHNGSVESHLHGDDKKKSPLNWEARTKIALGAARGLAYLHEDSIPRVIHRDFKASNVLLEDDFTPKVSDFGLAREATEGKSHISTRVMGTFGYVAPEYAMTGHLLVKSDVYSFGVVLLELLTGRKPVDMSQPQGQENLVMWARPMLRSKEGLEQLVDPSLAGSYDFDDMAKVAAIVSMCVHPE

SEQ ID NO: 228713 - protein, 244 aa, Glycine max
  Coding DNA Sequence Number=SeqID_111935
  Gene Ontology: Mol. function=electron carrier activity; Biological process=electron transport
  Homolog annotation: Hit_ID=P65367; Match level="QueryCoverage=51%, HitCoverage=84%, E-value=2e-43, Identity=63%"; Hit description =Hypothetical protein yqcA
  Pfam annotation: Domain name=Flavodoxin_1; Domain location=1-117; Score=56.1; E_value=1.2e-13; Accession=PF00258.15; Description =Flavodoxin
AVLEAQGHEVKVFEDPSLADWQAYSNEVALIVTSTTGQGDFPDNIARLYVQVRDELGYQPELRYGVIALGDSSYDHFCGAGKTFDATLQEQQAQRIGEVLLVDATENPEPESVTSPWVESWGMKLNGSPEQLPLPPGLRTSRHRCRIEYCQLNQLKQPPADLFNTLFTRRDGAGIDVHQIMPAVRQRAARRHFDHRNCRQAVRRAAPGGEHLQRNAGSHLLGATDKIAGRRGGVNQPALRRALS

SEQ ID NO: 228714 - protein, 110 aa, Glycine max
  Coding DNA Sequence Number=SeqID_111936
IAPTRHPVDPETSNRTMGFPALVTGLYQSYRVPVPPRQEIAPAGHPVDPKKSNMVLGFPGLITGLCQFYGVPVTPSKVIRPPTNRAFIKRYCAPRQAQGETPQQPGDGQQ

SEQ ID NO: 228715 - protein, 91 aa, Glycine max
  Coding DNA Sequence Number=SeqID_111937
  Gene Ontology: Mol. function=RNA-directed DNA polymerase activity; Cellular component=chromatin; Biological process=RNA-dependent DNA replication
MGLLFWSLDDLSQEFFQALMISEDYKRMSEEVMPPFAHRRRNGITVPIAKPDASVSRVNGIEKSGGSKTGAWVIACFSLSKASWDSDVHKN

SEQ ID NO: 228716 - protein, 420 aa, Glycine max
  Coding DNA Sequence Number=SeqID_111938
  Gene Ontology: Mol. function=RNA-directed DNA polymerase activity; Cellular component=chromatin; Biological process=chromatin assembly or disassembly
MVLTLGLSPTETTPFKVTVGNGDELHCHQLCQAVTVQIQDHSFTINFHILPLCDADVVLGVQWLKTLGPVLTYYTTLTMKFIIVGKLIELHRDREKNFELVLPSQLRRLLHTNTSCTFFHIRLDPPTTSESTVESTPSAITQFTTKYADLFQPLNTLPPSRPTNHTITLLPNFTPMNVRPYRYPYFQKQDIEDQVASMLASGFIQPSSSPFSSPVLLVKKKDGSWRFCVDYRALNTIIVHDHFSIPTIDEFLVELGGARWFSKLDLMQGYHQILMNEADINKIAFRTHHGHYEFRVMPFGLCNAPSSFQATMNQLFQPFLRKFIIVFFDDILIYSRSFSDHLLHLESAFQVLRNGKFSLKLSKCTFAQQQLEYLGHLVSGEGVRPMSRKVQAIQQWPTPRSPQALRGFLGLAGFYQRFIK

SEQ ID NO: 228717 - protein, 137 aa, Glycine max
  Coding DNA Sequence Number=SeqID_111939
  Gene Ontology: Mol. function=RNA-directed DNA polymerase activity; Cellular component=chromatin; Biological process=RNA-dependent DNA replication
  Subcellular localization annotation: CTP_CleavageSite=64; ConfidenceScore=5.30e-01
MSVEASETKKTMQISGRGWVFGISSSAIRIWWKPYRRSNFKNHNAAPSSSRSSSMVGMGNLSVMGMAFRALNKAGIEHGLDLILQFSLLAMEIMVGFDINGVGVGWWVVLDMERVCEEVWVNPELAGGTDCHHHHLL

SEQ ID NO: 228718 - protein, 112 aa, Glycine max
  Coding DNA Sequence Number=SeqID_111940
VAWPSAQPSLSGGGGASATQEPEPEEPAAAAEGEDELTPPEPFYFDSGVQMAQKDETSTDQIRKPSPVPIPDESMPSSPASELEQHIPQNSPAAQLLDLNEHAQEQSQEQDI

SEQ ID NO: 228719 - protein, 113 aa, Glycine max
  Coding DNA Sequence Number=SeqID_111941
MSYAQIRSVDPNARAAPAARTPATNDGDTAAAGEVGLGAGASAAEMTATNTDITTARNNALEKAIVRVLFEKRRKQRFYIEGEREETLRAVRVAARLPEVQTGNRSVASCIYF

SEQ ID NO: 228720 - protein, 93 aa, Glycine max
  Coding DNA Sequence Number=SeqID_111942
MSSKRGTSNFIRWLVSAMEPAEGPDYNEDDKIIDFGGHGEVRSGEFSNSLLQVIGGRGRCFRAGGARYGNESTNDTLGFRGPSTLPELKIRDS

SEQ ID NO: 228721 - protein, 308 aa, Glycine max
  Coding DNA Sequence Number=SeqID_111943
  Pfam annotation: Domain name=DUF1639; Domain location=233-282; Score =96.0; E_value=1.2e-25; Accession=PF07797.4; Description=Protein of unknown function (DUF1639)
MDKESHNNGNSVRERDKVGGGGDNSSGAGSLLLRGGSDGMRQATTSDLGLQWGNRKRLRCMKVQVKHDSSSSNNPVQRTTTTTVRVDRRVVRTEKDSSSNIISRPLPTINNISNNITNNNFHNNNNQSNNGYLNLRQRPPSPQQPPPRILRNSETSSAMRGGQSNGSVRGIASPDRGAHDKKGTHNNHLNDNNNNKSVVSSDTAHESKKGGGSPSGSGDVAPPVWPPKFVIALTNKEKEEDFLLLKGSKLPQRPKKRAKFIQRTLNLVSPGTWLCDLTLERYEVREKKISKKRPRGLKAMGNMDSESE

SEQ ID NO: 228722 - protein, 384 aa, Glycine max
  Coding DNA Sequence Number=SeqID_111944
  Gene Ontology: Cellular component=integral to membrane
  Homolog annotation: Hit_ID=Q9CHY6; Match level="QueryCoverage=61%, HitCoverage=91%, E-value=4e-21, Identity=28%"; Hit description =Hypothetical protein yfhH
  Pfam annotation: Domain name=DUF1295; Domain location=133-365; Score =289.9; E_value=5e-84; Accession=PF06966.3; Description=Protein of unknown function (DUF1295)
  Pfam annotation: Domain name=ICMT; Domain location=257-351; Score= -19.6; E_value=0.025; Accession=PF04140.4; Description=Isoprenylcystei ne carboxyl methyltransferase (ICMT) family
  Pfam module annotation: Pfam domain module=DUF1295::ICMT; Domain location=133-365::257-351
MVDLELQDKVNFFHIREMEMRINIVHGVAVWGATIVLNSLFGGSAPSILESYKSGSHNERTDGAEDKMGSVSYSNLKNAMIAFLVPLPSILFYLSFQSAISTPSSWSSLWTWCYHHPLLLANVLFFFNVNFLFWLIGLIQSSHWMIDPYWTVIPVMLVHYYSTHPLAQYQWWRSRIVTLLTWAWSVRLIHNYFRREKWQWGAREDWRFTDLSHRYGRHWWWASFFAIYVPQQVFLIGLSLPFYVIHSVNQPLSMWDLVAIVVCVSGIVTAYIADTQLYNFVSRKNKEVPILDKGLWYYSRHPNYFGEQVWWWGMAVFAWNLGHGWAFIGALANTMCLAYVTKLVEDRMLKQDSRAEAFRLYQKTTSLWIPWFKSSPLGLKSKDA

SEQ ID NO: 228723 - protein, 64 aa, Glycine max
  Coding DNA Sequence Number=SeqID_111945
MYGSSEGKREPSDQRSTVNNFRSVAEDVYKQRAFRSITESKDEEETPSVCIRQVFVRITLLILF

SEQ ID NO: 228724 - protein, 92 aa, Glycine max
  Coding DNA Sequence Number=SeqID_111946
  Subcellular localization annotation: CTP_CleavageSite=69; ConfidenceScore=5.41e-01
MGFYKQISHQFSTPSESYHRASTVFTPPLPKTPPTPPPVQTRPHMKLDSPDLTVRTPLCIPEAERLTVSAFYMEGPALSWYQWMYLNGFLTS

SEQ ID NO: 228725 - protein, 371 aa, Glycine max
  Coding DNA Sequence Number=SeqID_111947
  Gene Ontology: Mol. function=glutamyl-tRNA reductase activity; Biological process=tetrapyrrole biosynthetic process
  Homolog annotation: Hit_ID=Q6AVG1; Match level="QueryCoverage=83%, HitCoverage=78%, E-value=1e-136, Identity=71%"; Hit description =Expressed protein
  Pfam annotation: Domain name=DUF266; Domain location=138-249; Score =245.6; E_value=1.1e-70; Accession=PF03267.4; Description=Arabidopsis protein of unknown function, DUF266
GKERINQSNKPLRPVRLLVLFFALCVLFSVISIYTVKHFGIESVVTTMSSSFQPCYYEEPGGLDKWIRPPSSLIHNMSDEELLWRASFVPRIKGYPYPRVPKIAFMFLTKGPLPLAPLWERFLKGHEKFYSIYIHSLPSYQPQFPPSSVFYSRQIPSQVSEWGRMSMCDAERRLLANALLDISNEWFILLSESCIPLYNFSFVYHYIMKSKHSFVGAFDDPGPYGRGRYNEHMAPLVNVTKWRKGSQWFEVNRKLAITIVEDTTFHPIFEQYCRPACYVDEHYFPTMLTIQAANVLANRSITWVDWSRGGAHPATFGRNDITEEFFNRVRRGHTCLYNNRNSSVCALFARKFAPSALEPLLHMVDSKVLDF

SEQ ID NO: 228726 - protein, 308 aa, Glycine max
  Coding DNA Sequence Number=SeqID_111948
  Gene Ontology: Mol. function=hydrolase activity; Cellular component =endoplasmic reticulum; Biological process=metabolic process
  Homolog annotation: Hit_ID=Q9M3Z3; Match level="QueryCoverage=74%, HitCoverage=58%, E-value=9e-96, Identity=75%"; Hit description =Putative PTS protein
  Pfam annotation: Domain name=Metallophos; Domain location=39-292; Score=29.7; E_value=1e-05; Accession=PF00149.18; Description =Calcineurin-like phosphoesterase
MALRLRGKWVLIPFFWFCLIPFCFSQQKLRLRFGKNGEFKILQIADLHFANGKTTHCLDVLPSQYASCSDLNTTAFIQRIILSEKPNLIVFTGDNIFGYDASDPAKSMDAAFAPAIASNIPWVAVLGNHDQEGSLSREGVIKYIAGMKNTLSIVNPPEVHIIDGFGNYNLEVGGVEGTDFENKSVLNLYFLDSGDYSKVPFIPGYGWIKPSQQLWFQRTSQKLRFVDLLLAIQTKTAAGPEESLEGPFIWMTTFEDHWKFPAPYQAIMRELVESSWIFELQWGPLMVIFHHGDAAEDKGEEVRGGAIS

SEQ ID NO: 228727 - protein, 409 aa, Glycine max
  Coding DNA Sequence Number=SeqID_111949
  Gene Ontology: Mol. function=chitin binding; Cellular component =extracellular region; Biological process=chitin metabolic process
  Homolog annotation: Hit_ID=UPI000044A8F0; Match level="QueryCoverage =55%, HitCoverage=99%, E-value=7e-37, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLGTSTLTFRGLHVLTFRRLHALTFRGLHALAFRGLHVLAFRGLHVLAIRGEHVLAFRGLHVITIKGLHGYAASPSEGYMHALRGLRVLTFRGLHALAFRGLHALTFRGLHVLTFRGLHVLAFRGLHILAIRGQHVLAFRGLHVLAIRGLHALAFKGLRILTFIGIHALAFRGLHALTFSGLHVLTFKGLHVLAIRGLHVLAFRGLHTFTFRGLHVLTFRGLHVLAFRGLHTLSFRLRVLPFSGLHIRTLREFKFLGHPADPGGGPTVRAQLEEEAIVQPLCILGKDFTRAVTKRRVWIMCTNMTTLTQRHPVDPKKSTGPWGFQFGLRASVSPTGCPSPPARSYHRDIGIAPARHPVDPKKSSRVLGFLALITGLCQFYEVPVAPNKRATDTPPPPLEFTSAHPKK

SEQ ID NO: 228728 - protein, 656 aa, Glycine max
  Coding DNA Sequence Number=SeqID_111950
  Gene Ontology: Mol. function=endonuclease activity
  Homolog annotation: Hit_ID=Q109Y3; Match level="QueryCoverage=74%, HitCoverage=84%, E-value=1e-85, Identity=40%"; Hit description =NUMOD3 motif family protein, expressed
  Pfam annotation: Domain name=NUMOD3; Domain location=191-204; Score =18.7; E_value=0.021; Accession=PF07460.2; Description=NUMOD3 motif
  Pfam annotation: Domain name=NUMOD3; Domain location=223-236; Score =8.1; E_value=8.8; Accession=PF07460.2; Description=NUMOD3 motif
  Pfam annotation: Domain name=NUMOD3; Domain location=311-324; Score =0.5; E_value=1.9e+02; Accession=PF07460.2; Description=NUMOD3 motif
  Pfam module annotation: Pfam domain module=NUMOD3::NUMOD3::NUMOD3; Domain location=191-204::223-236::311-324
ETVQQINESLFVIVAEESDIVPAKRAGNGICGDILVATLAFLLQRFGIDTLHNNLLHHHHDYATTFGLCIFEQLRTMAVRVVIMLALVLHVTIDENNTLSYLVRLCGVRASSSNALLNCTDPSSHAFVSLRIRNLNVIKAVATLDAKPRLDLDAPHPPGFLLEFSDPPDDREKLRRLRISKANKGNTPWNKGRKHTPETLQKIKERTRLAMQNPKVKMKLINLGHAQTTETRKKIGVGVRRRWEKRRGKKMVQESCCTEWQNLIAEASRQGYVGQEELQWNSYETVNEQLKQDWLMSVEQRKQMARTPSSKRAPKSPEQRRKIAEAIAAKWADPSYMCSKFKQLVTPNVEYRERVCSALAKYHGSEVRAERKPRRRPSDGTQPTKKKPAKKRDIDTSAHVKNDSKTRKPILLKKSKSPAYKDPLVNSKLEMIKNIRAQRVAAETTQTQAIEQASYWPLCFYGHGGYTKHWSIEFGLFWRLGHRNTAEKAAKALEVAATKSPIAQSSLIETRKLIAEAIQSLESIDTQAITEEKGSAFEVLNQSQMAQVNGHTMLSSSDYKFSEDFGKFSLEKPVNGDAELLLTNGCTSLPFSLNSQMNESSPSNQQREAEQDQRSEYETDPSPTVMGIHSLENQTMSVVTKKWVRGRLVEVAEEKQ

SEQ ID NO: 228729 - protein, 116 aa, Glycine max
  Coding DNA Sequence Number=SeqID_111951
MYKLLDEYVATPTQQLDLSWECGVHMEKTRVVLMIGRSIPGYWKPLTSKASNRAAVHEPPVPHILLLGLDNQKRKEEVEKEIQKAKQEKEAKRKQIEDTIESHINNSTKSESCSAH

SEQ ID NO: 228730 - protein, 218 aa, Glycine max
  Coding DNA Sequence Number=SeqID_111952
  Gene Ontology: Mol. function=transferase activity, transferring glycosyl groups
  Homolog annotation: Hit_ID=Q6ZL29; Match level="QueryCoverage=54%, HitCoverage=21%, E-value=2e-28, Identity=54%"; Hit description =Putative GDP-fucose protein-O-fucosyltransferase 2
  Subcellular localization annotation: CTP_CleavageSite=57; ConfidenceScore=5.04e-01
MERDLIHENAPPSSSSFSPFISNLRNSQIQQVLVQQWIRSCQKEEPLSGSLRLINMVAVCVWGQMSNRLICLEKHMLFAALLNRVLVIPSSKLDYKYNRVLDIDHINKCTQANNKVLISFQEFSSIKKRMHLLCYFSLPKPCYLDQEHLSKLKSFGMRMPGSPIRGPLKMFFQGTAHLCPYILSSCGNGGNNCSGGGGEATEEGKESDGLKVVLIIKE

SEQ ID NO: 228731 - protein, 176 aa, Glycine max
  Coding DNA Sequence Number=SeqID_111953
  Gene Ontology: Mol. function=RNA binding
  Homolog annotation: Hit_ID=Q9C552; Match level="QueryCoverage=51%, HitCoverage=12%, E-value=1e-16, Identity=48%"; Hit description =Putative RNA-binding domain; 80649-84245
MLAVRSDLSKTKQGSYLLRKLDIDGFAASPDHWRSKQASQESTYKDFYTMFGSSDTKLTKNYAFLADTSNNKSNKKTVKEMSKEIDQSLGSGAPFLSTQNFKKNPKKEKHKSKKNAQTSGDDDNSNRKKKRSNKEKVESGFDIAATAATKKTLKKRRRDGDLSEASLKKVKASNAE

SEQ ID NO: 228732 - protein, 335 aa, Glycine max
  Coding DNA Sequence Number=SeqID_111954
  Gene Ontology: Mol. function=translation initiation factor activity; Cellular component=eukaryotic translation initiation factor 2B complex; Biological process=cellular metabolic process
  Homolog annotation: Hit_ID=Q8W4G0; Match level="QueryCoverage=99%, HitCoverage=100%, E-value=1e-122, Identity=63%"; Hit description =Putative translation initiation factor EIF-2B alpha subunit
  Pfam annotation: Domain name=IF-2B; Domain location=80-323; Score =149.6; E_value=8e-42; Accession=PF01008.8; Description=Initiation factor 2 subunit family
MWWRSASFIMDRQQQQNQGDSSNPNISAYYETRAAHHGVVTSDWLAQAQAAIGPEPQPQPQLSPDPDKPFSVIDQFNSWRKQPHLAEAVAAIRALAAVIRSSQATTMMQLEIELKKASDSLKSWDTSSISLTAGCDLFMRYVTRTSALEYEDFNSAKSRLIERAENMYLWHLHCGLHFNLCVYKFTEGRPDRTGLRLSNELAKLDVPVKLLIDSAVAYTMDEVDMVFVGADGVVESGGIINMMGTYQIALVAHSMNKPVYVAAESYKFARLYPLDQKDLAPALRPIDFGVPIPSKVEVERSARDYTPPQYLTLLFTDLGVLTPSVVSDELIQLYL

SEQ ID NO: 228733 - protein, 768 aa, Glycine max
  Coding DNA Sequence Number=SeqID_111955
  Gene Ontology: Mol. function=identical protein binding; Cellular component=cellulose and pectin-containing cell wall; Biological process=negative regulation of enzyme activity
  Homolog annotation: Hit_ID=Q8LGA0; Match level="QueryCoverage=98%, HitCoverage=98%, E-value=0.0, Identity=67%"; Hit description =Subtilisin-like serine protease
  Pfam annotation: Domain name=PA; Domain location=360-457; Score =111.2; E_value=3.1e-30; Accession=PF02225.12; Description=PA domain
  Pfam annotation: Domain name=Peptidase_S8; Domain location=110-600; Score=66.8; E_value=6.9e-17; Accession=PF00082.12; Description =Subtilase family
  Pfam annotation: Domain name=Subtilisin_N; Domain location=26-102; Score=80.7; E_value=4.7e-21; Accession=PF05922.7; Description =Subtilisin N-terminal Region
  Pfam module annotation: Pfam domain module=PA::Peptidase _S8::Subtilisin_N; Domain location=360-457::110-600::26-102
MAYSHSRIMILLFLLSLGTASEEKKTTYIVQVQQEAKPSIFPTHRHWYQSSLALADSTASILHTYQTVFHGFSARLSPAEANRLQSLSHVISLIPEQLRQLHTTRSPQFLGLNTADRAGLLKETDFGSDLVIGVIDTGISPESQSFNDRHLALPPPKWKGHCVAAKDFPPTSCNRKLIGARYFCAGYEATNGKMNDTLESRSPRDSDGHGTHTASIAAGRYVFPASTMGYAKGMAAGMAPKARLAVYKVCWNAGCYDSDILAAFDAAVADGVDVVSLSVGGVVVPYHLDVIAVGAFGASEAGVFVSASAGNGGPGGLTVTNVAPWVTTVGAGTIDRDFPADVVLGNGKVIGGMSVYGGPGLTPGRLYPLVYAGSDGYSSSLCLEDSLDPKSVRGKIVVCERGVNSRAAKGQVVKKAGGVGMVLTNGPLDGEGLVADCQVLPATSVGAEGGDELRRYMAFAAQLRTPATATIIFKGTRLGIKPAPKVASFSARGPNPESPEILKPDVIAPGLNILAAWPSTLSPSGLPSDERRSQFNILSGTSMACPHVSGLAALLKAAHPDWSPAAIRSALITTAYTLDNGGGPLLDESNANVSSVFDHGAGHVHPDKAINPGLVYDISTYDYVDFLCNSNYTSHNIRVITRKAAVCSGARSAGHSGNLNYPSLAAVFQQYGKQHMSTHFIRTLTNVGDPNSLYKVTVAPPPGTEVTVVPDTLAFRRLGQKLNFLVRVQTRAVKLSPGTSTVKTGSIVWSDAKHTVTSPLVVTMQQPL

SEQ ID NO: 228734 - protein, 156 aa, Glycine max
  Coding DNA Sequence Number=SeqID_111956
  Homolog annotation: Hit_ID=Q9LUL9; Match level="QueryCoverage=43%, HitCoverage=46%, E-value=2e-07, Identity=42%"; Hit description =Arabidopsis thaliana genomic DNA, chromosome 3, P1 clone: MLN21
MGQSDTNFILPHGELWRNLIDGCKLYFLNSNPNSEIWIISQVPQQKIDVQTQLCPNEKGIGTEDHSIHQEQEIFLVYEDHSQGIICYQDEFGEIVCEGYDEGPCFQRIPETTNRPRDAQITKNLLLRQSWIQIVKGENSNDGLQKDLNCNGFNSFC

SEQ ID NO: 228735 - protein, 299 aa, Glycine max
  Coding DNA Sequence Number=SeqID_111957
  Gene Ontology: Mol. function=transcription factor activity; Cellular component=nucleus; Biological process=regulation of transcription, DNA-dependent
  Homolog annotation: Hit_ID=Q8GTE5; Match level="QueryCoverage=89%, HitCoverage=86%, E-value=4e-84, Identity=59%"; Hit description =Transcription factor EREBP-like protein
  Pfam annotation: Domain name=AP2; Domain location=53-117; Score =145.0; E_value=2.1e-40; Accession=PF00847.10; Description=AP2 domain
MCGGAIISDFILLFETSNILRVFWENWLKNGSTTAKSVAFQVRAEKFANRKRKNQYRGIRQRPWGKWAAEIRDPRKGVRVWLGTFNTAEEAARAYDAEARRIRGKKAKVNFPEEAPGTSVKRSKVNPQENLSHKFGAGNNHMDLVEQKPLVNQYANMASFPGSGNGLTSLPSSDDVTLYFSSDQGSNSFGWSEQGPKTPEISSMLSAPLDCESHFVQNANQQPNSQNVVSMEDDSAKRLSEERVDIESELKFFQMAYLEGSWGDTSLESLLSGDTTQDGGNLMNLWSFDDIPSMSSGVF

SEQ ID NO: 228736 - protein, 175 aa, Glycine max
  Coding DNA Sequence Number=SeqID_111958
MTVKCLSMFANICSSASSENPHATLNKFFALQQLMDQPNGTTQSKDKPLQLYKIPTAAEKHKSGKTAGVMPVKSTSKTPKPLTNLSRTEKQEWAKEDGTKEINELKEVFLNETRSWFLMYLKKTLDAGFSIGSQEKGKESRDNAGRQMEQTNHLALTLSHLKHANEWLDKIEKQF

SEQ ID NO: 228737 - protein, 366 aa, Glycine max
  Coding DNA Sequence Number=SeqID_111959
  Gene Ontology: Mol. function=hydrolase activity, acting on ester bonds; Cellular component=cellulose and pectin-containing cell wall; Biological process=lipid metabolic process
  Homolog annotation: Hit_ID=Q8L8G1; Match level="QueryCoverage=90%, HitCoverage=89%, E-value=1e-94, Identity=53%"; Hit description =Lipase SIL1
  Pfam annotation: Domain name=Lipase_GDSL; Domain location=36-347; Score=162.5; E_value=1.1e-45; Accession=PF00657.12; Description=GDSL- like LipaseAcylhydrolase
MASLKFSFLVLFVCCGILIPTCCLGDMCQPKENAALFVFGDSLFDVGNNNYINTTADNQANYSPYGETFFKYPTGRFSDGRVIPDFIAEYAKLPLIQPYLFPGNQQYVDGVNFASGGAGALVETHQGLVIDLKTQLSYFKKVSKVLRQDLGDAETTTLLAKAVYLISIGGNDYEISLSENSSSTHTTEKYIDMVVGNLTTVIKGIHKTGGRKFGVFNLPAVGCVPFVKALVNGSKGSCVEEASALAKLHNSVLSVELEKLKKQLKGFKYSYVNYFNLTFDVINNPSKYGFKEGSVACCGSGPYKGYYSCGGKRAVKDYDLCENPSEYVLFDSLHPTEMAHQIVSQLIWSGNQTIAGSYSLKTLFEE

SEQ ID NO: 228738 - protein, 105 aa, Glycine max
  Coding DNA Sequence Number=SeqID_111960
  Gene Ontology: Mol. function=ubiquitin-protein ligase activity; Cellular component=intracellular; Biological process=protein modification process
  Homolog annotation: Hit_ID=Q9AUK0; Match level="QueryCoverage=83%, HitCoverage=12%, E-value=3e-32, Identity=79%"; Hit description =Putative ubiquitin protein ligase
MAGKISEPGSRAIEIVAGLDYGGLSKEFLTDISKAAFSPETFSQTSTSDRLLIPTASTRYLENGLQMIEFLGRVVGKALYEGILLDYSFSHVFVQKLLGRYNFLD

SEQ ID NO: 228739 - protein, 60 aa, Glycine max
  Coding DNA Sequence Number=SeqID_111961
MAKLCFIVTWCSDLKSIDIVRFPYSRCLGGLRGKGVYRRFLTSVPKRCRTLWLLEHLANV

SEQ ID NO: 228740 - protein, 256 aa, Glycine max
  Coding DNA Sequence Number=SeqID_111962
  Homolog annotation: Hit_ID=Q6Z4U2; Match level="QueryCoverage=36%, HitCoverage=26%, E-value=7e-16, Identity=45%"; Hit description =Putative CRS2-associated factor 1
MAEYIKRITVPVAFDELCHLHLTKRFSENPVPLLLDPLPVRFTLNRSGNTGPFPVDPARPKGGELGRFAEADGPNGRVGLRIRVSEVERKVRLERKGERRVVLVVGNEVAEKTTLMEWSSATKAPDWLEAAIRDSKMDSMETSTSSSSGRAIRIVSVILCEHGKKYLAQKVVIMDLFTFCGGLSLYCCHIVTIDMEFGWQIVVGTFVGFCVATFGSVGGVGGGGIFVPMLSLIVGFDEKSSTAKHKIRNAHAEIKT

SEQ ID NO: 228741 - protein, 184 aa, Glycine max
  Coding DNA Sequence Number=SeqID_111963
  Gene Ontology: Mol. function=RNA binding; Cellular component =ribonucleoprotein complex; Biological process=mRNA processing
  Homolog annotation: Hit_ID=Q6Z4U2; Match level="QueryCoverage=50%, HitCoverage=25%, E-value=1e-17, Identity=47%"; Hit description =Putative CRS2-associated factor 1
MQSRILCFSTRRLPLHQRRFLSHFIPDHQYDPPFSPSPKPYYKSKKNHAEKKKKNNSENGDPNKNGAPKLPFKSNLPFDFRYSYSESDPSVGPISFRESPKFSPFGPGRIDRKWTGVSAPVQGEPDRERVEEERNRILGEPLSEVEVAELIERYRHSDCARQINLDGYSCYAYIWVNILSEMLL

SEQ ID NO: 228742 - protein, 189 aa, Glycine max
  Coding DNA Sequence Number=SeqID_111964
QRSTRDVPSLVLFETLVDVPSTRTDPQEMYPLLFSVKPKEREESKEFSDCVVLNSLTREKGDTKEFRRLVLCSFGKGRRETQKEFRRLVLGEFFLAKGEEMKRMNSTSIQGLENQKTLESFWQKEEEEEVQRDSEINVEKTPLELVGLGSSSSMDSFAPWKMNGSGMEKEEREETPLQGEDESRRSSPP

SEQ ID NO: 228743 - protein, 171 aa, Glycine max
  Coding DNA Sequence Number=SeqID_111965
MGLCFARETSHPCMHIASMHGERSLQGICQGGWRFGTPLSPLCLAICLWRANDAGFVQRVQARGSRAMLVSQLGMAICVEPKSPLVLAICDDDKKLKGQSKNEFKMFKIESRTLQDSRRKLKNTSRFKRKVDFKNQKSRFKDQAFKNQDQDSRIKRRFNQDKYEKVFSKTE

SEQ ID NO: 228744 - protein, 61 aa, Glycine max
  Coding DNA Sequence Number=SeqID_111966
  Homolog annotation: Hit_ID=Q153F8; Match level="QueryCoverage=66%, HitCoverage=11%, E-value=4e-10, Identity=75%"; Hit description =Pectin acetylesterase
MLEDNPGFFPQTTKVKCLSDAGLFLDAIDVSRGHTIRNFFSGDVRLQVFHQISVGTYIVCS

SEQ ID NO: 228745 - protein, 278 aa, Glycine max
  Coding DNA Sequence Number=SeqID_111967
  Gene Ontology: Mol. function=helicase activity; Biological process =viral genome replication
  Homolog annotation: Hit_ID=Q1SN45; Match level="QueryCoverage=99%, HitCoverage=18%, E-value=2e-59, Identity=42%"; Hit description=AAA ATPase
MGFLQDDKEFIEAIKEAKDWGSAHYIRKLFVLLLLTATMSKPEQVWDQTWHWMADDIVYNYKKSSTSPALQLDDRTLQNLVLLEIEELLQANQRSLRDYPSMSYPEDANCPAYLDNSLILAELNYNNEELRSEFEHLFSHKTDEQASIYNEIVEAPLAGIASLLLPGGRNARSKFKIPVPIFEDSTCNIHQGTQLAELLNQTSLIIWDEAPMAHKLCFEALDHSLRDIIKHNSKDNKIFGGKVMVFGGDFWQIPPVIPRGSRSDIVNATINSSYLWDH

SEQ ID NO: 228746 - protein, 217 aa, Glycine max
  Coding DNA Sequence Number=SeqID_111968
MPWSLAGRLFKWGWEKITRLWLLKTYQKSHEYKFRRYHLGAHWKPLGEHLEYSVRLAHSADHESVKSRVAFRAKGALVENLSLYFEASGHGIRYQQKIELANLDQSVLIVNLNQIPRQELMEVSERGIYFSITEIKFIQCVITLPGGKKQPSFNSQRFSLMHGWLLRDTWKRRWGVVWNCNAIEDAKTEMKSFWRWRLGEYRYFSLNYPSFRPLTLN

SEQ ID NO: 228747 - protein, 36 aa, Glycine max
  Coding DNA Sequence Number=SeqID_111969
STPCVFMGCMDRISHPELALVVGVNLKFEQVYGSEK

SEQ ID NO: 228748 - protein, 207 aa, Glycine max
  Coding DNA Sequence Number=SeqID_111970
  Gene Ontology: Mol. function=RNA-directed DNA polymerase activity; Biological process=RNA-dependent DNA replication
MVWKVEHGDKFKFWEDNWTGGHTQLSEKYPRLYSISDQQNQLIQHMGVHKDTGWEWDLKWRRPLFDSEIDMAVSFLQEVEGFRIRAHIGDHWMREADSSGQYSVRSAYSLLRQHVAEEVQVEEFRELWKLKVPSKVAVFAWRLLKDKLPTRDNLRKKQIDLGDSWSFVLSLHQSYSGVVGIAVMGECGGCLSTSTKTTFCPAHESNI

SEQ ID NO: 228749 - protein, 381 aa, Glycine max
  Coding DNA Sequence Number=SeqID_111971
  Subcellular localization annotation: CTP_CleavageSite=65; ConfidenceScore=5.22e-01
MSSAKSMHLGAISWICSVRTSKIKGRRETYQAQKHTATPGLVRGSFADVVARREPRIQQRRTSAVQNAKTNTSRSEVHLDRPMTAPKWLQDAWVGRLKNLALLDRVEENMLWDWGLDVVPKYIGDDMVLLPGLTEDKAKQMMEEGNAGREVMFYSVERWNKKMRAGSRLTWVQCWGVPLVAWDSTHIREIVTAIGEVVEVDEEMEDLRKMDRARLLVRTPWKPLIQHTVSVHIETEVFQDICSEESEMGSLSELMTAKPQSGSQKVETLEERRATSEADTAPEDENDMQGPTASTSFQLLSNGRITTSEPLDNNLDWGIEDESRCRVSRESYGATKSQMGMYGEARAAVTRCDSGAERIIGAITPVGKGKAKHEQGNKKAG

SEQ ID NO: 228750 - protein, 117 aa, Glycine max
  Coding DNA Sequence Number=SeqID_111972
  Gene Ontology: Mol. function=actin binding; Cellular component =cytoplasm; Biological process=cytoskeleton organization and biogenesis
  Pfam annotation: Domain name=Transposase_21; Domain location=55-117; Score=-143.5; E_value=0.023; Accession=PF02992.5; Description =Transposase family tnp2
MHKCPRCRISWYKVKDDDECSSDESTKKGPLAMLLWYLPIMSRFKRLFANTDDTKDLTWHAYGRNCDGMFYHLADSSQWKKINSLYLDFGKKEKNLWLGLTSDGMNLYGSLSSQHSS

SEQ ID NO: 228751 - protein, 139 aa, Glycine max
  Coding DNA Sequence Number=SeqID_111973
  Subcellular localization annotation: CTP_CleavageSite=58; ConfidenceScore=5.34e-01
MWYHSSRILPKHVHMTLSLKKARQQVSRSCAQATPPPPMVISLSLKGVSKLRSQDCLREATKERIEGFFFIESLKWIMRIPLQLKCSSQCGGSAASNGDSWWSPVVVGGGRGVSRVISLRELVSLSRSPLLVLSVNFHA

SEQ ID NO: 228752 - protein, 367 aa, Glycine max
  Coding DNA Sequence Number=SeqID_111974
  Gene Ontology: Mol. function=RNA-directed DNA polymerase activity; Cellular component=intracellular; Biological process=RNA-dependent DNA replication
  Subcellular localization annotation: CTP_CleavageSite=43; ConfidenceScore=5.40e-01
LLESKNREGLGFASSAGSATNSVGSSSITSTFCSAGFINNSPEANAVLEDAPEEIVLAFVTPGKLVRNWDAVDIPSVVHASKLGIYEPVEHNNPALSPNYESPVYEAEEEEDDEIPEELARLLEYEKKTIQPHEELVEVINLGTEEDKKEVKIGASLEATVKRKGYARLGSRIVEHRLPLKPECPPVKQKLRRTRPDMALKIKEEVQKQIDAGFLVTSEYPQWLANIVPVPKRDGKVRMCVDYRDLNKASPKDDFPLPHIDVLVDSAAKSKVFSFMDGFSGVMPFGLINAGATYQRGMTTLFHDMMHKEIEVYVDDMIVKSGTEEEHVEYLLKMFQRLRKYQLRLNPNKCTFGVRSGKLLGFIVSQK

SEQ ID NO: 228753 - protein, 136 aa, Glycine max
  Coding DNA Sequence Number=SeqID_111975
NEDKGYVGVHELSWRWATGDGGLYMICGCGESFCTIARPPPSTTCDGVVPGDMSRGSGDLGDVRQAPGNQQIKGTKTTKQEGLCGGWPAEAKMVSGNRLPRECNRLPGLKTRQQVLEASGNRLPGCVIDYTEEHAT

SEQ ID NO: 228754 - protein, 77 aa, Glycine max
  Coding DNA Sequence Number=SeqID_111976
MPLLLCKQFIVAALRVLSCTKPQEALSANLLRFLNSWKYAKRAYCAKPELLSKALSAACCAKPQMFTVPYNFKLGLA

SEQ ID NO: 228755 - protein, 54 aa, Glycine max
  Coding DNA Sequence Number=SeqID_111977
  Gene Ontology: Mol. function=oxidoreductase activity, acting on NADH or NADPH, quinone or similar compound as acceptor; Cellular component=integral to membrane; Biological process=electron transport
  Homolog annotation: Hit_ID=Q2PMN7; Match level="QueryCoverage=96%, HitCoverage=20%, E-value=3e-19, Identity=69%"; Hit description =NAD(P)H-quinone oxidoreductase subunit 1, chloroplast (EC 1.6.5.-) (NAD(P)H dehydrogenase subunit 1)
MGFIVFLISSLAECERLPFDLPEAEEELVAGYQTEYSVLYFGGSNISIPYIFVF

SEQ ID NO: 228756 - protein, 83 aa, Glycine max
  Coding DNA Sequence Number=SeqID_111978
  Gene Ontology: Cellular component=chloroplast
MGKEDRNMPLKDSTETKTGCQERRGEDQAGPCEQLDALSPFNPLSEMWQKEKESMDRPHRLHPVGTTRSPQGRLRHPGVADRP

SEQ ID NO: 228757 - protein, 234 aa, Glycine max
  Coding DNA Sequence Number=SeqID_111979
MSSTSQGPKKGRMSSSKVSWGAKCYGLHQSLPSEKFDDFGGEQTSIPRDYVQGGVLGSRGCQVEGYCSHGLEIGAPQGRVLAKLLCIRLDGDELFARHKGLQEEKTDLAGKVEHIATERDELAKVVADLEALVKESESRLEEFELWVAKKREVYKELEEELTMYKKEVMEQHEKGFQKAVRQAGFFAKDLDLGLFDLFKEVNDGVLLDEEEISTKEETTDEEKGAEEQGNDAQV

SEQ ID NO: 228758 - protein, 94 aa, Glycine max
  Coding DNA Sequence Number=SeqID_111980
MAVGNDVCMIHDFEGELYEYDFEGETAAEDECCKLLEDAAGEQKQKADVTRDVLTSWRRLVDLQLEEFPLCLITLIMEVADPTCITARTCSGSV

SEQ ID NO: 228759 - protein, 153 aa, Glycine max
  Coding DNA Sequence Number=SeqID_111981
  Gene Ontology: Mol. function=DNA binding; Cellular component=nucleus; Biological process=regulation of transcription
  Homolog annotation: Hit_ID=Q49QW7; Match level="QueryCoverage=96%, HitCoverage=34%, E-value=5e-52, Identity=71%"; Hit description=Myb family transcription factor-related protein
  Pfam annotation: Domain name=Myb_DNA-binding; Domain location=37-88; Score=47.3; E_value=5.3e-11; Accession=PF00249.21; Description=Myb -like DNA-binding domain
MERMFPPKKPSTMNSHDRSMCVQGDSGLVLTTDPKPRLRWTVELHERFVDAVAQLGGPDKATPKTIMRVMGVKGLTLYHLKSHLQKFRLGKQPHKDFNDHSIKDGMRGFIFTVHEVLLHIFIASFILAASALELQRNIGSSSAMIGRNMNEYA

SEQ ID NO: 228760 - protein, 88 aa, Glycine max
  Coding DNA Sequence Number=SeqID_111982
MFTPLALIITAIFSALVERNTLLGKVQILLYQSQNKHKIVGGTVLLVVGLYNVLWEKSKESVKEGVKGDNLEVEETKEETRLECIVQH

SEQ ID NO: 228761 - protein, 121 aa, Glycine max
  Coding DNA Sequence Number=SeqID_111983
MATSRWKGWWIALTWIIWKHRNNIVFSNSSFNANRMMEEPLFLVWTWMKHLEKDFNTHYNQWSSNLTQGSVMSPILGWTKQLAEFRYSRFVISIPNLLVPLGYRPWEENKDFAPLNKGAKI

SEQ ID NO: 228762 - protein, 46 aa, Glycine max
  Coding DNA Sequence Number=SeqID_111984
MGGQTKHMFLREGFHQVKVKYGSNQLAKVEAEDESSYIASLSTANT

SEQ ID NO: 228763 - protein, 192 aa, Glycine max
  Coding DNA Sequence Number=SeqID_111985
  Gene Ontology: Mol. function=protein-tyrosine kinase activity; Cellular component=integral to membrane; Biological process=protein amino acid phosphorylation
  Homolog annotation: Hit_ID=Q1SGW7; Match level="QueryCoverage=56%, HitCoverage=17%, E-value=5e-26, Identity=56%"; Hit description =Protein kinase
MTNANSLQESLHSVSNGNLRVCVCVCVCDEGVCVDVIRVHRCVSVMRVCVCVSMSLGLVCVSACLIRGGCVCVSMMRKAPEVTQQGQVSRSCAVYYLGVVIIEILTARFPSQYVSNGKGGADVVQSVETAISEGRESKVLDPKIAGSRNWLVSMEQLLHIGAACTKSNPQQRLDMVEAIRRIMEIKFECGHE

SEQ ID NO: 228764 - protein, 221 aa, Glycine max
  Coding DNA Sequence Number=SeqID_111986
  Gene Ontology: Mol. function=nucleic acid binding
  Homolog annotation: Hit_ID=Q8H642; Match level="QueryCoverage=92%, HitCoverage=78%, E-value=8e-28, Identity=35%"; Hit description =Putative RNA-binding protein
MCFPKPGFGVHDLTLFDVSGVHDLPGYFPHDDDRGGLRVIRDTESLDASYERYLRSAQVSSYGSGQSTRTISGRIPNRAIDDSHVANIGGIDRGTNAKDKMLGLSSGRTDHSLPPDATSTLFVEGLPPNCTRREVARILSSVICFVLLNLEVQIFFDLLLATKKSDLLARNRDNWFGSDENDTQAWKGYKFDELDRNSVNLRFQFARYPGARSGGVHRGKR

SEQ ID NO: 228765 - protein, 68 aa, Glycine max
  Coding DNA Sequence Number=SeqID_111987
  Subcellular localization annotation: CTP_CleavageSite=60; ConfidenceScore=5.45e-01
MKAQKQKARNTYVDGEAPTKKKNESTTTTPSIMVNNSTTTSPEATTPSGRRSSKAQEKTRGSQKKKTN

SEQ ID NO: 228766 - protein, 72 aa, Glycine max
  Coding DNA Sequence Number=SeqID_111988
  Subcellular localization annotation: CTP_CleavageSite=43; ConfidenceScore=5.20e-01
MALMQATLILLAVKQCTRFKPSSLRSGFRPLESINIRNLLPPRGFSLGSVYPGVGDLMGSWGAMEVEQQGFV

SEQ ID NO: 228767 - protein, 242 aa, Glycine max
  Coding DNA Sequence Number=SeqID_111989
  Gene Ontology: Mol. function=RNA binding; Cellular component =intracellular; Biological process=regulation of progression through cell cycle
  Homolog annotation: Hit_ID=Q4QXS6; Match level="QueryCoverage=62%, HitCoverage=83%, E-value=7e-65, Identity=80%"; Hit description=MLL
  Pfam annotation: Domain name=PUA; Domain location=98-170; Score=34.4; E_value=3.9e-07; Accession=PF01472.10; Description=PUA domain
MVIYMSVSSRFSGEDVSAQNQVKASVQRKIRQSIAEEYPGLEPVLDDILPKKSPLIVAKCQNHLNLVLVNNVPLFFSVRDGPYMPTLRLLHLYPNIMKKLQVDRGAIRFVLAGANIMCPGLTSPGGVLDEEVGAECPVAIMAEGKQHALAIGFTKMSAKDILQHTTKSPLSTIPSSAVDEHQQASPLLFPMHCHQLCHTTKTTLLLDAPDHKPETAAFQAPHTQYHPACNLTKQLSNAALCF

SEQ ID NO: 228768 - protein, 58 aa, Glycine max
  Coding DNA Sequence Number=SeqID_111990
LQYEAKDDTEAKLDLHVPCNSDYQCPGCPCIDYQCICDLEKEEEQKPVSIAPVKEEFP

SEQ ID NO: 228769 - protein, 2132 aa, Glycine max
  Coding DNA Sequence Number=SeqID_111991
  Gene Ontology: Mol. function=structural constituent of ribosome; Cellular component=intracellular; Biological process=translation
  Homolog annotation: Hit_ID=Q9FIN7; Match level="QueryCoverage=96%, HitCoverage=85%, E-value=0.0, Identity=51%"; Hit description =Arabidopsis thaliana genomic DNA, chromosome 5, TAC clone:K16H17
  Pfam annotation: Domain name=MED14; Domain location=420-591; Score= -88.8; E_value=0.061; Accession=PF08638.1; Description=Mediator complex subunit MED14
  Pfam annotation: Domain name=Sec39; Domain location=584-1193; Score= -265.7; E_value=0.012; Accession=PF08314.2; Description=Secretory pathway protein Sec39
  Pfam module annotation: Pfam domain module=MED14::Sec39; Domain location=420-591::584-1193
MEELLLYETRHHASNHPPQHHQNQQQQQQQENESAKGSLLSLLSSRGVSQLKEKWSEYNQPKRLRRLVSLFVSATAKHVAVAAGNRITFLSKEDDYQNPRAIFTTIGSLGSSFGTFSVGAWSENEDVLGVADDSDTLYFIKFSGEVVAEISKKHLKVSTPIVALFSDIDLDTHESYLFSIVTSDGSLQRIEISHGQSGSTFPNHTSRISNNIFCFDRHSELNLFVAVHKNSVGYVEGSPIIRARGRIRKTTGKTIKDLELEPKGYSGHLTYPKVLISPEATFVATLDLTGCLHIFKLDKEGFTLSRFVLGERNDSPMSDNLSKGGNKSFVGFMDFTWWCDHILAIIDRGGVVMLIDILNGSKVPEDGPAYFLPILERAPKYKGYIFLLASQSSIERYNPSDIGSTEELHQPEWIIEDRLNQFHLSRLLWNLVSFTEKSVPEMYGILISKKKYQAALDFADSHGLDKDKVLKSQWLNSSHGVNEINIFLSNIKDRDFVLSECVDRIGPTEDAVKALLAYGLHITDHHRFSEVDDDNSSHVWDCRLARLQILQFRDRLETYLGINMGRFSVQEYSKFRIMPINEAAVALAESGKIGALNLLFKRHPYSLSPYMLEILTAIPETVPVQMYGQLLPGRSPPSGVAVRQDDWVECEKMVYFINASVEKHDMLIQVKTEPLVKHFLGFPWPSIDELSNWYTNRAKAMDDFSGQLDNCLSLLEFALRKGISELQPFHRDVLYLHQIIYSNDDDSEMSFNMSLAMWGEFSNYEKFKFMLKGVKEENVTERLHNRAIPFMREKFHKETSLENKLDICLVVIEEGCRNFQSNDYFKTEVEAVDCALQCIYLSTVTDRWSIMASILSKLPQLHDGAIQVEDLERRLRIAEGHIEAGRLLAFYQVPKPLNFFLGAQLDEKAVKQIIRLILSKFIRRQPSRSDSEWASMWRDMQYLREKAFPFLDPEYILTEFCRGLLKAGKFSLARNYLKGTSSVALASEKAENLVIQAAREYFFSASSLSCSEARECLNLYPSSGNVKAEADIIDALTVKLPNLGVNILPLQFRQIKDPMEIIKIAITNQTGAYFHVDELIEVARLLGLRSADDISAVEEAIAREAAVSGDLQLAFDLCLGLARKGHGNIWDLCAAIARGPALDNMDVDSRKQLLGFALSHCDEESIGELLHAWKDLDMQGQCETLMISTGTNPSKFSVQGSSVNSLPKQSFQNILDESGCFQEFDSISADNEDVHLEKTRDMLSIVAKTLAIGDRTDWASILTENGKVLSFAALQLPWLLELSRKGEHHKKFSTGKLYLNIRTQAVVTILSWLARNGFAPRDNLIASLAKSIMEPPVTEEEDIMGCSYLLNLVDAFNGVEIIEEQLKMRKDYQEICSIMSVGMAYSLLHNSRIGTDPSQRKELLKRRFKEKHASPSSDDIDKLGKVQSSFWREWKLKLEEQKRLTEHSRALEKIIPGVETERFLSRDSIYIENVVISLIESVKLEKKHILKDILKLADTYDLNCTELIGDVVKAIFLAVLWFHLKVLLRYLSAVLVSDVWTNDDITAEVAGYKGEIIGNSVKTIETISTIVYPAIDGCNKIRLAYVYGLLSECYLQLETTKDLSSIVQADHVNANLSLAQYYKVIEQECKNVSFINNLNFKNIAGLHGLNFECISDEVYACIEESSLSALSKMVQTLVNMYGDSLPIDFLSWQDIYKYYILSLLRALETKVTTDSGIRTPEYLQGFINKLEQSYDLCRVYIRLLSQSDALGIMKQYIAVTMPLYSSYGLLPDNSTWQECLIVLLNFWMRLADDMKEIALEENSAETSSFNPQCLMSCLKVFMKLVMEDIISPNQGWGSIYGYVNCGLNGDSSAETINFCKAMIFSGCGFGAVAEVFSVASSETGSASDHGTCCQDLPHFYLDILEAVLTELINGSHESQNLYHILSSLSKLEGDLKVMQCVRHVIWERMVQFSDNLQLPSSVRVFVLELMQFISGKNIKGFSTEILANVQPWEEWNELIYASRKSETDVDKQLPDHKDSSSRVTNTLVALKSSQLVASISPSIEITLDDLLNADTAVSCFMRLCGEATEDLHLDALLAILEEWDGLFTAGKDEETTVETSDGGNDWNNDDWDEGWESLEEVDNPEKEKIEDP

SEQ ID NO: 228770 - protein, 78 aa, Glycine max
  Coding DNA Sequence Number=SeqID_111992
MERENEAHSWSLEIKIENFLDKNNSFKRNNEHAMKKIDKKTHREGKRSITFEFFVRHLRHFRPAFGEQQHQDIVFERW

SEQ ID NO: 228771 - protein, 102 aa, Glycine max
  Coding DNA Sequence Number=SeqID_111993
MASLSTLRVFVADFEDEEAEHPIYILAAVEPLSAASKLLVVAGSTTPSSSTPPLIFANRKRNPFIGEVAGFQHQNTGRRHPEHGANEVDMNMHVSHKKPKSM

SEQ ID NO: 228772 - protein, 434 aa, Glycine max
  Coding DNA Sequence Number=SeqID_111994
  Gene Ontology: Mol. function=protein-tyrosine kinase activity; Cellular component=integral to membrane; Biological process=protein amino acid phosphorylation
  Homolog annotation: Hit_ID=Q0WN89; Match level="QueryCoverage=82%, HitCoverage=59%, E-value=1e-137, Identity=66%"; Hit description =Protein kinase like protein
  Pfam annotation: Domain name=Pkinase; Domain location=219-433; Score=- 33.0; E_value=1.4e-06; Accession=PF00069.15; Description=Protein kinase domain
  Pfam annotation: Domain name=Pkinase_Tyr; Domain location=219-413; Score=-82.3; E_value=2e-07; Accession=PF07714.7; Description=Protein tyrosine kinase
  Pfam module annotation: Pfam domain module=Pkinase::Pkinase_Tyr; Domain location=219-433::219-413
MWLMKPQARNCGDKHPKSVKAEITAEFDMKNVFLHIKLMEQASESDQPAILIQEECDGEIQGSALRLTFACNSPISWPAMSGALDSSSICCKRMQIFEKKGFTLGVVLLVVLPGHDKLVRTRVENALKFAMKKPKTGAVKLPFGLCGCQEENSKGRELVEIEEETGDGYRGKEFENSSQRIQLQVPLPSSSFVVSVDEWQTIKSGGNEIEKWLLNSDSVEFVEQIGPNSYRGVYMGKRVGIEKLKGCDKGNSYEFELHKDLLELMTCGHRNILQFCGICVDDNHGLCVVTKFMEGGSVHDLMMKNKKLQTKDVVRIAVDVAEGIKFMNDHGVAYRDLNTRGILLDKHGNACLGDMGIVTACKSVGEAMEYETDGYRWLAPELLFQKNLLTLILELYQFTSTVAPGIQTLAQAIFSTPSYPEKAVYVLQSTNEIS

SEQ ID NO: 228773 - protein, 50 aa, Glycine max
  Coding DNA Sequence Number=SeqID_111995
  Homolog annotation: Hit_ID=Q1SJV5; Match level="QueryCoverage=70%, HitCoverage=8%, E-value=6e-10, Identity=88%"; Hit description =Peptidase S41
MVGDEILAANNMEVKGKSAFEVSSLLQGPNGTSVTIQVLDSISKLVWHLL

SEQ ID NO: 228774 - protein, 335 aa, Glycine max
  Coding DNA Sequence Number=SeqID_111996
  Gene Ontology: Mol. function=catalytic activity; Cellular component =cellular_component; Biological process=biological_process
  Homolog annotation: Hit_ID=Q01BX7; Match level="QueryCoverage=93%, HitCoverage=74%, E-value=3e-10, Identity=21%"; Hit description=[R] KOG2823 Cellular protein
  Pfam annotation: Domain name=Nop53; Domain location=4-289; Score= -86.9; E_value=0.0002; Accession=PF07767.2; Description=Nop53 (60S ribosomal biogenesis)
MGPRSQGFKRIEPYLAVKKKIEKHRERVLRCDSLLQKNQFVKPVPSSILKKCSKNRNVASKSNLKVANQDGDKDDSAMFDLWDDKGKDDKKVKKVAKPTLIPAVEIDPPGCSFNPSYESHQDTLASAVAEVMQKIYKNELGPEPVPLTVPGEAIAEEDMYFLDVDNRSDNDESTPENEDDDALEKKPIKTKRVTRVELNKRARRKEQQRKEAEAKKIKELSKEIDSIPEIVQEIEHEDEEKKKRHLRRQVAKQEMLKTRPPRLGKHKFEPAPVQVLLSEEITGSIRKLKVGLCFSCYDFGWCLFYETRNGCCTLIKDRYKSIEKRGLIVPAKRRN

SEQ ID NO: 228775 - protein, 83 aa, Glycine max
  Coding DNA Sequence Number=SeqID_111997
MGDQEEVQEQMKADMSALKEQMASIMNAMLGMRQLMESNMATAAAVSSAAEADPTLPATMHHPIPNMVGRERSTLGHIRQPHP

SEQ ID NO: 228776 - protein, 231 aa, Glycine max
  Coding DNA Sequence Number=SeqID_111998
  Gene Ontology: Mol. function=calcium ion binding; Biological process =cell adhesion
  Homolog annotation: Hit_ID=Q1XJ58; Match level="QueryCoverage=95%, HitCoverage=29%, E-value=6e-40, Identity=40%"; Hit description=YD repeat
MRLVKNIKNDNWTSNYTYYDSKGRVVGTYTVNHLGGYTKTETLLDFAGTPQKAITTHMRKPGEASVTINERFVYDNGNRLKQHYHQVDSNPEELLTDNTYNELSQLSNKKVGNNLQSIDYNYNIRGWLTDINKNQMSVANLGGKLFAYRIKYNQKEGITNPDPVLFSGKNVEAKYNGNIAEVDWRAVETIGANPSLTPKRYGYVYDKLNRLTAGYYQNPNNSNSKENTESL

SEQ ID NO: 228777 - protein, 115 aa, Glycine max
  Coding DNA Sequence Number=SeqID_111999
  Homolog annotation: Hit_ID=Q1STU5; Match level="QueryCoverage=56%, HitCoverage=55%, E-value=2e-08, Identity=52%"; Hit description =Leucine-rich repeat
MAYPPTIIDIPTSKGNQFREACDPSWFLQGDFPLSRAESITFGVPWKAGFQWFREFLEVFICFSSINLVPCSVSFSNLTYFEVDSCKNMLYLFTSSTAISLTQLKTMKGKMLQFN

SEQ ID NO: 228778 - protein, 63 aa, Glycine max
  Coding DNA Sequence Number=SeqID_112000
MYVSFLVIHVKDLEIVGWVVIQKVMQSYTPRALDRRLQEDWARDIREGPRILISLKVDFGPMG

SEQ ID NO: 228779 - protein, 112 aa, Glycine max
  Coding DNA Sequence Number=SeqID_112001
MSNFGYNISRRSKLNIESSREIQMVITFNSDVRFGDKMSDLGIKYIEMLEIEQRKPSTNSKRHNFSLGCPIQAHNISRRSKLNIGSSREIQMVITFHSDVRFRRITYRDAEN

SEQ ID NO: 228780 - protein, 70 aa, Glycine max
  Coding DNA Sequence Number=SeqID_112002
MAMGRDRDGYYLPNPRSRLPNMSPYPYPITGGLKFIIPFSYLSVFLLQCVHLVKVPTMPALISGPHRHKC

SEQ ID NO: 228781 - protein, 370 aa, Glycine max
  Coding DNA Sequence Number=SeqID_112003
  Gene Ontology: Mol. function=DNA binding; Cellular component=beta -galactosidase complex; Biological process=DNA integration
  Homolog annotation: Hit_ID=Q1S1E0; Match level="QueryCoverage=92%, HitCoverage=32%, E-value=5e-91, Identity=48%"; Hit description =Integrase, catalytic region
MVPPPGVNGSHPSQCCKLLKSLYGLKQANRACNFVDELTHIKQVLHFHFRIKDLDTLKYFLGLEVAYSVAGILCQRKYCPDLVTNFGVLGSKPISTLMDNTLRLHQDSGPLLLDPLPYKRLIGRLIYLTNTRPHIAFTTQQLSQFMSLPPTQTHLCAATRVLKYLKGCPRKGLSFSRESPIQILGFSDADWATCIDSSKSITWYCFFLGSSLISWKAKKQNTVSRSSSSSEAKYRALTSTTCELQWLTYLLKDLHLPIKVIYHGQLEIDCHIVREKTQQGLMHCLLPVSSSNQLADIFTKALSPKLFSSNLSKLGLSDIFLPPACVCVWLRGRGGIRKTATHTQTPCPPDPTSELNLLEVSRILHLHSCW

SEQ ID NO: 228782 - protein, 55 aa, Glycine max
  Coding DNA Sequence Number=SeqID_112004
  Gene Ontology: Mol. function=NADPH:quinone reductase activity
  Homolog annotation: Hit_ID=Q8L5Q7; Match level="QueryCoverage=98%, HitCoverage=34%, E-value=2e-17, Identity=61%"; Hit description =Putative quinone oxidoreductase
MSQLVHHGMIFVPVGYTFGDGMYEMKKVKGGSPYGAGTVVGDGSRQPSIAKKLKG

SEQ ID NO: 228783 - protein, 97 aa, Glycine max
  Coding DNA Sequence Number=SeqID_112005
  Gene Ontology: Mol. function=oxidoreductase activity
  Homolog annotation: Hit_ID=Q1W388; Match level="QueryCoverage=55%, HitCoverage=26%, E-value=3e-14, Identity=64%"; Hit description =Quinone-oxidoreductase QR2
MVAQEAIEDLKSIVTALRKPLSTEKKSDDVPIIKPRELADADGFLFGFPTTFGSMVSQFKAFLEGTISLWLTQALAGKPVGFFSSTSSQGGGQEETP

SEQ ID NO: 228784 - protein, 431 aa, Glycine max
  Coding DNA Sequence Number=SeqID_112006
  Gene Ontology: Mol. function=nickel ion binding; Cellular component =extracellular space; Biological process=protein complex assembly
  Homolog annotation: Hit_ID=Q6ZHC0; Match level="QueryCoverage=74%, HitCoverage=91%, E-value=1e-126, Identity=65%"; Hit description =Putative GAMM1 protein
  Pfam annotation: Domain name=UPF0160; Domain location=105-430; Score =439.1; E_value=5.9e-129; Accession=PF03690.4; Description =Uncharacterised protein family (UPF0160)
MGIEIPCIESLPVGESMHRGQVVGPTSVTARLTLEEKIVGVQVYGEVSHHEILRQHCLQYRVCCIRQTKQEAFPKMIRLVRLWHCHKPFTFPKPQPRMVVEASSSCFSTRVGTHNGTFHCDEALACFMLRLSKRFSAAHIVRTRDPNLLQSLHALVDVGGAYDPTRHRFDHHQKDFHQVFGHGFHTKLSSAGLVYKHFGLEIIANVLKLHEDHPHVHQLYPVIYRNFVEAIDAVDNGVNLYDLDVPPKYEINTTLASRIKRLNLNWMDSDQSSDRENEAFHRAMALAGAEFLENVNYYAKSWLPARSIVMDSLAARESVDSSGEIVKLNRSCPWKLHIHELEEEMKISPSIKYVLYPDDRSENWRLQAVAISPAKFESRKPLPYLWRGLENDNLSEVAGIPGCTFVHMSGFIGGNRSYGGALAMARASLKA

SEQ ID NO: 228785 - protein, 207 aa, Glycine max
  Coding DNA Sequence Number=SeqID_112007
  Gene Ontology: Mol. function=nucleoside-triphosphatase activity; Cellular component=membrane
  Homolog annotation: Hit_ID=Q1SHI2; Match level="QueryCoverage=96%, HitCoverage=58%, E-value=4e-35, Identity=45%"; Hit description=AAA ATPase
  Subcellular localization annotation: CTP_CleavageSite=73; ConfidenceScore=5.50e-01
MKFNTLDKLVVFDFDFSVSKRSRSSITIRDFAVVCISITFQSAPSARRRGGSSASKRGLAGGSTASTSGTAPLAGVGVHVQLDVLFSSLLDLVRDGENVLEDERVAGGVGPGEPGAEEGVMNGVVRVEVEEDVGGIGAGEEVGVIGIFNGGKRIEVSEDFPVEAIVQRVKIIARDFEGLVKVETVFEGKEPLVEDVKCRGFAEEEND

SEQ ID NO: 228786 - protein, 66 aa, Glycine max
  Coding DNA Sequence Number=SeqID_112008
MVFKGSNRYSDSHLLKLLADSSSEERSTSVLQQALSGWEDFSRLQVATMQLPEQSDCLWLCQEEIL

SEQ ID NO: 228787 - protein, 98 aa, Glycine max
  Coding DNA Sequence Number=SeqID_112009
  Homolog annotation: Hit_ID=Q1SL70; Match level="QueryCoverage=80%, HitCoverage=8%, E-value=2e-09, Identity=45%"; Hit description =Leucine-rich repeat; Leucine-rich repeat, cysteine-containing type
  Pfam annotation: Domain name=LRR_1; Domain location=18-40; Score =11.9; E_value=1.7; Accession=PF00560.23; Description=Leucine Rich Repeat
  Pfam annotation: Domain name=LRR_1; Domain location=42-64; Score=9.2; E_value=5.4; Accession=PF00560.23; Description=Leucine Rich Repeat
  Pfam module annotation: Pfam domain module=LRR_1::LRR_1; Domain location=18-40::42-64
  Subcellular localization annotation: CTP_CleavageSite=25; ConfidenceScore=5.18e-01
MKSRATGKLPHSIGKFNSLNDLDLSSNSLSDLIPTSTGNLSNLRSLNLEGNMLNGKILESIVILFQLEHLHLLQNNWEDTMTRTTSKNSKKFKNKKYS

SEQ ID NO: 228788 - protein, 71 aa, Glycine max
  Coding DNA Sequence Number=SeqID_112010
MTCIGPIPFVFKNKDIVFKTRRTKKLKLNRNNQTQKGEGSCGKKVKRQEEAYPSNSHSHSKTHGFVSYSEQ

SEQ ID NO: 228789 - protein, 365 aa, Glycine max
  Coding DNA Sequence Number=SeqID_112011
  Gene Ontology: Mol. function=zinc ion binding
  Homolog annotation: Hit_ID=Q337A7; Match level="QueryCoverage=92%, HitCoverage=83%, E-value=2e-98, Identity=52%"; Hit description=HIT zinc finger family protein, expressed
  Pfam annotation: Domain name=SHQ1; Domain location=140-320; Score= -72.8; E_value=0.032; Accession=PF04925.6; Description=SHQ1 protein
MADNVVTSTNSSTPSLNPTRIICHSHSLRCTESFMKENVVQELQQMQPDEQTKNKMLDILKRFHSEEEMDEDYSTLSEETMEKILSGQEISFDDLSLEEKKRFHRAIAYGELSKMIKPWDPWWSKPSARNICLSKEGTQLVQPLPDQELLDDDIGSDELSEVPLGPEIPLPPLSRLSSKEPSPLLTVHLVDILYSYCFTLRLYNGDWKSDALGSVMVVLSVSLVLGQGAQPETVLEALSHCLEQVCCPVYRHMGGLQFGLGVIDDVISLLGLGTPALVCALCDMHRLIQEGEKEAKSERPRKLRTDGTRSAIKLAERRIYFITCWVHEQPEEAWFSLAAIVRAEKTSAMEFQQSNKSENLNNKAE

SEQ ID NO: 228790 - protein, 452 aa, Glycine max
  Coding DNA Sequence Number=SeqID_112012
  Gene Ontology: Mol. function=3-dehydroquinate dehydratase activity; Cellular component=integral to membrane; Biological process=aromatic amino acid family biosynthetic process
  Homolog annotation: Hit_ID=Q1RZX6; Match level="QueryCoverage=97%, HitCoverage=65%, E-value=0.0, Identity=70%"; Hit description =Oligopeptide transporter OPT superfamily
  Pfam annotation: Domain name=OPT; Domain location=55-445; Score=78.4; E_value=2.3e-20; Accession=PF03169.6; Description=OPT oligopeptide transporter protein
MIDHSLRGEDLMNPMGASTVSNEELKEIESLGREDIEEAPIVPEDVSRIAPWIRQITLRGLVASFLIGIIYSVIVMKLNLTTGLVPNLNVSAALLGFVFIRAWTKVLAKAKIVSTPFTRQENTIIQTCAVACYSISVGGGFGSYLLGLNRRTYEQAGVGTEGNNPGSTKEPGIGWMTAFLFVTSFVGLLALVPIRKIMIIDYKLTYPSGTATAVLINGFHTPKGDVMAKKQVHGFLKFFSASFLWAFFQWFYSGGDNCGFVKFPTFGLKAWKNSFYFDFSMTYVGAGMICSHLVNLSLLLGAVISWGIMWPLIRGLKGEWFPASIAESSMKSLNGYKVFISIALILGDGLYNFVKVLYFTATNIHATVKRKNPETFSDNQKPLPLDDLRRNEVFARESIPIWLACTGYILFSIVSIIVIPLMFPQLKWYYVVFAYLFAPSLSFCKCLRRRLN

SEQ ID NO: 228791 - protein, 187 aa, Glycine max
  Coding DNA Sequence Number=SeqID_112013
MVICPLCRRLECLSTETITVSLCLLETSESVGTRRQIMVIRHLCYLETSESDNMQRQIMLILHPCQPETSESVGTWRQIMVIRHPCQPETSESVGTWRQIMVIRHPCQLETSKFIGTRRLLWSSTLLCYPGTSESDSMRRQIWSSALFVEDSNVFRPRLLQSPFAFQRQASPIARGDKLWSSATFAI

SEQ ID NO: 228792 - protein, 309 aa, Glycine max
  Coding DNA Sequence Number=SeqID_112014
GLWAELSEELWREKIIVIQMKLSRGEGPQHSHPQEAVVDAQGFLGGSHDTSVLTSYADHVVVIVWNGEEHPKLKLSSHGRKVQKFGRPAAEIKGLVVVTGLSSLIVCSLDTSNQGLISAFAESEVTITLNDVVSLLNLSITGAFHSCGLFMLTKSKCDFTYWTVVARAYLLHLLGYTLFANKSATHVSVTIPPHSPGSRLCLEDIDDRWMHFSEYLAPLEDPVKHLPVVQDDTYVEPDILQYLVAATAMEEAPAHAHSHVEQPQHSVEACQEITESLEQLLNLRIMTKDTKIYYVMKDCIRIARGVAAD

SEQ ID NO: 228793 - protein, 427 aa, Glycine max
  Coding DNA Sequence Number=SeqID_112015
  Gene Ontology: Mol. function=translation initiation factor activity; Cellular component=mitochondrion; Biological process=translational initiation
  Homolog annotation: Hit_ID=Q9FH50; Match level="QueryCoverage=89%, HitCoverage=89%, E-value=1e-130, Identity=60%"; Hit description=APO protein 3, mitochondrial precursor
  Pfam annotation: Domain name=DUF794; Domain location=15-427; Score =675.6; E_value=3.8e-200; Accession=PF05634.2; Description =Arabidopsis thaliana protein of unknown function (DUF794)
MRATITSSKRYLLKRLPHHLIPTLSFASETWPAPAASVDDGFPYSDVPKPKRRNSERKPYVTPMKALIERAKAEREARKAQPCRVLEEPPENGLLVPELVEVARRVYQARGSLLFGLSQLVRVIPVLRCRLCNEVHIGYIGHEIRTCTGPESFSRNAMHVWTRGGVQDVVFFPKCFHLYDRVGKPRVGHDERFSVPRIPAIVELCIQAGLDLEKYPTKRRTKPVYCIEGRIVDFESVVKEDETERQHFFENDKPFVNSSSMLTQPIEKVQILLENNISHLDQLSDEERNKLRDLSKHTLDSWIEMTSGAKKIMEKYTVNTCGYCPEVQVGPKGHKLRMCKASKHQSRNGLHAWQEATLDDLVIPNYVWHVEDLNGPALNNNLKRYYGKAPAVVELCVHSGTPVPDQYSSMMRLDVVSPDRDEVDLVA

SEQ ID NO: 228794 - protein, 64 aa, Glycine max
  Coding DNA Sequence Number=SeqID_112016
MGEELPKSMVRKIQNLSDEVRRRWKETQGWVGANCATERECHRNNYAELASMPNVNERNQKRTN

SEQ ID NO: 228795 - protein, 122 aa, Glycine max
  Coding DNA Sequence Number=SeqID_112017
  Gene Ontology: Mol. function=transition metal ion binding; Cellular component=chloroplast; Biological process=iron ion homeostasis
  Homolog annotation: Hit_ID=Q6A196; Match level="QueryCoverage=69%, HitCoverage=38%, E-value=1e-23, Identity=59%"; Hit description =Ferritin
MWVVGLWLRPPRKLRTNPFWASTSSDTTKIEYNKRGGRVQLQSMLMPFSKFDHAEKGDALYGFYFCFTMQLANENNDVQFVDFLESEFLVGQVEDIKKISEYVAQLRRMGRGHGNTLITCAL

SEQ ID NO: 228796 - protein, 57 aa, Glycine max
  Coding DNA Sequence Number=SeqID_112018
  Homolog annotation: Hit_ID=Q8LBW3; Match level="QueryCoverage=94%, HitCoverage=30%, E-value=6e-12, Identity=75%"; Hit description=LOB domain-containing protein 12
  Pfam annotation: Domain name=DUF260; Domain location=9-52; Score= -23.8; E_value=0.0023; Accession=PF03195.5; Description=Protein of unknown function DUF260
MVGSSSSPKRRCSEQFSARVTNPVYGCVGIISYLESQVSELQKQLAVAQAEILSMQM

SEQ ID NO: 228797 - protein, 43 aa, Glycine max
  Coding DNA Sequence Number=SeqID_112019
MPRAQNSTAHHRAYFGKRALEAARGAAFAEMPRFLLKFCMFLV

SEQ ID NO: 228798 - protein, 91 aa, Glycine max
  Coding DNA Sequence Number=SeqID_112020
MWTTTGTYNELKKIGLRKLGEKLATQLAQASKVASSRSNSLLEESSGGPKWAWLLSAPPFLLNTPPAFFGDSFFVKLRKLTNFVTILVFFP

SEQ ID NO: 228799 - protein, 376 aa, Glycine max
  Coding DNA Sequence Number=SeqID_112021
  Gene Ontology: Mol. function=nucleic acid binding; Cellular component= intracellular
  Homolog annotation: Hit_ID=Q00ZH4; Match level="QueryCoverage=26%, HitCoverage=35%, E-value=4e-20, Identity=49%"; Hit description=[R] KOG1995 Conserved Zn-finger protein
  Pfam annotation: Domain name=RRM_1; Domain location=266-350; Score =34.4; E_value=3.8e-07; Accession=PF00076.12; Description=RNA recognition motif. (a.k.a. RRM, R
  Pfam annotation: Domain name=zf-RanBP; Domain location=49-80; Score =38.0; E_value=3.3e-08; Accession=PF00641.9; Description=Zn-finger in Ran binding protein and others
  Pfam module annotation: Pfam domain module=RRM_1::zf-RanBP; Domain location=266-350::49-80
MSGTYDQDGGYGGAASAGYGHGGRGGGGFGGRGGDRGGRSGGRGGGSGRDGDWRCPNPSCGNLNFARRAECNKCGAPSPSGSNDRGGGGGYNRGGHGNSRGGRSGNFDGGRGNGYNGGSRGNNNSSRSGGGNRGGSFSGSQGFDDGGYGQVPPPAAQSYGGAGGNYPPAYGSYGGNSNYETDVVPPPASYTGGPASGPPSYGSNAVTSGNNVADARYGGRSGPPVGNDSGYGAGSQGGFGGAPAEPPAKVKQCDENCGDSCDNSRIYISNLPPDVTIEELRELFGGIGQVGRIKQKRGYKDQWPWNIKLYTDEKGNNKGDGCLVYEDPSAAHSAGSFYNNYDLRGYKIGVAMAEKSAPKAPPAYNHGYSIIYHFSH

SEQ ID NO: 228800 - protein, 243 aa, Glycine max
  Coding DNA Sequence Number=SeqID_112022
  Homolog annotation: Hit_ID=Q94KJ2; Match level="QueryCoverage=37%, HitCoverage=23%, E-value=4e-16, Identity=53%"; Hit description=CIL
  Pfam annotation: Domain name=CCT; Domain location=180-210; Score =38.3; E_value=2.7e-08; Accession=PF06203.4; Description=CCT motif
MGCTSLLRSPKKEEQEVPDANSNQPYTYEDFNILDELEGVLSTKEEQDSSLPQQKSSSSEFHWDFMEWEEFQPPNIEEEGEDENEGKENRRSKCLFDEEEQEMKIENNNNIVGFWEMDDEKMVALNLNLNYQEVLDAWSDRGSLWADDCSLSFATNNAYYMGEVPVLEEERARREACVLRYKEKRQNRLFSKKIRYQVRKLNADKRPRIKLFPIFLFVGSLCEETLKLLEKDPPNQKISPTNI

SEQ ID NO: 228801 - protein, 217 aa, Glycine max
  Coding DNA Sequence Number=SeqID_112023
  Homolog annotation: Hit_ID=Q6KF70; Match level="QueryCoverage=47%, HitCoverage=17%, E-value=7e-07, Identity=34%"; Hit description =Transglutaminase
MEKGRWKLNFDSDFGDYANTIVVALAAFVSQFFRYVKNVSDLYLILFSLISNIEPCDQFSYLSAYIQFPASSQMIGKKIIQSEISTDAYRNAIEFEKKTHASNLEHRRTMDNNMIIMDHEVEKLRAELANEEKRARAAMAADTKPSPGYPANYDNPEMGYGGTTCPPDSYSTHQMQAVVDTHSPHEAGAPLHHPNDLQHTQVPRNLFNNRAYSFADI

SEQ ID NO: 228802 - protein, 106 aa, Glycine max
  Coding DNA Sequence Number=SeqID_112024
  Homolog annotation: Hit_ID=Q9FGH9; Match level="QueryCoverage=73%, HitCoverage=12%, E-value=5e-07, Identity=40%"; Hit description =Leucine zipper protein
MSESLHELNLQLDSEIFVLDGMSFATDVKEATVDDGGTHQITRQVMNYIHHICTSFGNTVQEYTMVPGREGNSSFSVQIAKMIKLLKSILEAKSRDYADPVLGYVL

SEQ ID NO: 228803 - protein, 472 aa, Glycine max
  Coding DNA Sequence Number=SeqID_112025
  Gene Ontology: Mol. function=transferase activity, transferring hexosyl groups; Cellular component=cytoplasm; Biological process =metabolic process
  Homolog annotation: Hit_ID=Q1SIP8; Match level="QueryCoverage=97%, HitCoverage=99%, E-value=1e-154, Identity=58%"; Hit description =Probable indole-3-acetate beta-glucosyltransferase T27E13.11- Arabidopsis thaliana
  Pfam annotation: Domain name=UDPGT; Domain location=13-468; Score= -98.0; E_value=1.1e-05; Accession=PF00201.9; Description=UDP -glucoronosyl and UDP-glucosyl transferase
MDDCIQVLPITASHVVAVPYPGRGHVNPMMNLCKLLLSKNSDILVSFVVTEEWLGFIGSEPKPDNIGFATIPNVIPSEHGRASDFVGFFESVMTKMEAPFEELLHRLQPLPTLIIYDTYLFWVVRVANSRNIPVASFWPMSASVFAVFKHYHLLQQNGHYPVNAYVVQMFATEDGEKRVDYIPGNSSIRLADFPLNDENWRSRKLLELALNVIPWVQKAQYLLFPSIYELEPQAIDALKSELSIPIYTVGPVIPYFGNGHIDFSNFADHELGYFQWLENQPSGSVLYISQGSFLSVSNEQIDEIAAGVRESGVRFLWVQRGENDRLKDICGDKGLVLQWCDQLRVLQHHAIGGFWSHCGWNSTREGVFSGVPFLTFPIFMDQPLNGKLIVEEWKVGWRVRTKVKEDTLITKDEIASLIRKFMHLGSDEVRDMRKRSRELKQLCHGAIASGGSSETNINDFLSHVLQGAKPEL

SEQ ID NO: 228804 - protein, 393 aa, Glycine max
  Coding DNA Sequence Number=SeqID_112026
  Gene Ontology: Mol. function=hydrolase activity; Cellular component =endoplasmic reticulum
  Homolog annotation: Hit_ID=Q01A81; Match level="QueryCoverage=73%, HitCoverage=48%, E-value=1e-55, Identity=43%"; Hit description=[TR] KOG0374 Serine/threonine specific protein phosphatase PP1
  Pfam annotation: Domain name=Metallophos; Domain location=61-337; Score=41.5; E_value=3e-09; Accession=PF00149.18; Description =Calcineurin-like phosphoesterase
  Subcellular localization annotation: CTP_CleavageSite=24; ConfidenceScore=5.34e-01
MASLCLNSLPVPPSSLPRKPTETSLSSYPSLLLHNNNNNLSDLKPIVVSGDPPTFVSAPGRRILAVGDLHGDLKQARSALEMAGVLSSDGQDLWTGGETVLVQLGDILDRGEDEIAILSLLRSLDKQAKAKGGAVFQVNGNHETMNVEGDFRYVDSGGFDECNDFLEYINGSEDNWEETFTAWVDVSERWKEDRTMSKSYWGPWNLLERQKGVIARSILFRPGGLLARELARHAVVLKVNDWVFCHGGLLPHHVAYGLERMNKEVSEWMRGQHEDDNIHKKPFIATRGYDSVVWNRLYSRDTLDLVDYQDKQVCSILDETLQAVGAKAMVVGHTPQTIGVNCKYNCSIWRVDVGMSSGVLNSRPEVLEIIDDKARVIRCKRDRHSELQAAAYT

SEQ ID NO: 228805 - protein, 56 aa, Glycine max
  Coding DNA Sequence Number=SeqID_112027
MGSSSAMGCSFRFDTCVCGCCEGGVKGYEGWFSLSKEAIVVVVDMRVVVMMVVIEE

SEQ ID NO: 228806 - protein, 400 aa, Glycine max
  Coding DNA Sequence Number=SeqID_112028
  Gene Ontology: Mol. function=transferase activity, transferring hexosyl groups; Cellular component=cytoplasm; Biological process =metabolic process
  Homolog annotation: Hit_ID=Q1SIP8; Match level="QueryCoverage=73%, HitCoverage=64%, E-value=1e-111, Identity=69%"; Hit description =Probable indole-3-acetate beta-glucosyltransferase T27E13.11- Arabidopsis thaliana
  Pfam annotation: Domain name=UDPGT; Domain location=1-393; Score= -170.2; E_value=0.048; Accession=PF00201.9; Description=UDP -glucoronosyl and UDP-glucosyl transferase
MGRDGFIKVLSGKLGMRLLARCESGMKMGGDGNWCGEENALSGRENPREEEEIFSLLWRIKAPRKALFFIWRSGVGTTSLLNMLCGGDYLEDVVLENGGERVDYIPGISSMRLVDFPLNDDSCRSKQLLQISLKGFEWVSKAQHLLITSIYELEPQAIDVLKAELSLPIYTIGPAIPYFSLEKNPTLSTTNGTSHSYMEWLDAQPDRSVLYISQGSYFSVSRAQVDEIAFALRESDIRFLWVARSEASRLKEICGSKGLVVTWCDQLRVLSHSSIGGFWSHCGWNSTKEGVLAGVPFLTFPIIMDQPIDSKMIVEDWKVGWRVNEDVNVNNTLVKKDEIVMLVQKFLDLNSEHAREIRERSKTLRQICRRAITNGGSAVTDLNAFVGDLMQTNIDSMNTL

SEQ ID NO: 228807 - protein, 124 aa, Glycine max
  Coding DNA Sequence Number=SeqID_112029
MVPSRKDKERHLARFLDIFKKLEITLPFGEALQQMALYAKILKDMLTKKNRYIHSDCRNLPFCGRARRGSRVDKGVSLAPMYSSIVIRKSDLRSSFKRGESSDSFLLGRRSFKALDLKMIHFTW

SEQ ID NO: 228808 - protein, 321 aa, Glycine max
  Coding DNA Sequence Number=SeqID_112030
  Gene Ontology: Mol. function=ATPase activity, coupled to transmembrane movement of substances; Cellular component=integral to membrane; Biological process=transport
  Homolog annotation: Hit_ID=Q3PIT5; Match level="QueryCoverage=94%, HitCoverage=51%, E-value=4e-53, Identity=38%"; Hit description=ABC transporter, transmembrane region:ABC transporter
RQDRGEVHEGRQRFGKARHQHQYRAESRGSQAPLGDPQHAAAQDCQHPGFDDGGHHQRRLGAAPVMLALQSFHLLEAGAQAFIGGAGSARRQAHGQPLHVLEQFRVQGFIGAARGRMPAIQRRPAPAVERHDHGKHQHQRHAQSPVPGQQRQRGRGRRNRGAQDQVDHRQRVVHLLVDAAQQLGGDAAGAVGLQRLQRHAPQLLAQQHAQLVRGARHVAAIVEALRAPAQDDGGGCQQGEARQPGQRGAPGIAAGHVDEQGHDAGQRQALAHGGGQQQAQAGAQAAGLAACAAEKAAIGVAPGSGRCRHEGCSPKVQRRAR

SEQ ID NO: 228809 - protein, 108 aa, Glycine max
  Coding DNA Sequence Number=SeqID_112031
MGLNQAHVFKKRFIESRKECTLRCPYRTCAKARVMSEIEEVQEQMKADIEAMKDQMAAMMEAMLSMKKIMESKAAAVATTSAATEVDPSHPSGACGGCPKTIVIVGYI

SEQ ID NO: 228810 - protein, 403 aa, Glycine max
  Coding DNA Sequence Number=SeqID_112032
  Gene Ontology: Mol. function=RNA-directed DNA polymerase activity; Biological process=RNA-dependent DNA replication
MEVDIPLGWKPLNLERYDETTDPDEHLDAFLTQANLYTNDDAILCLVFPMSFKGATLMCYGRLPPWQMTSHFANLWIDSGGPSPNQKSQSRGSTTFHVGCPTTCQGYTLLTTNQATILEEAFNAKGHNEDHQRRKETDRRGDRTKDRGRQRHHPQRHEHKHQQKQEDKPAQQIIGIINTLAGRFSYGGLSSQSWKHHLHAIKDVDFNYCQRHNLQPSRSLPPITFTDRDFKGINLINQDDPMVVSIVITNFMVSKVLIDQGSERVESRGYADLMTTFGQGKLLQSFTIRYLIVDENTYFALIGRKTLNELEVIVSTLHLKMKFATLMGEIVTVNVDQKQAQQCYGESLKMTPYPTIRESGKPYSSSSGSNNQVMSIVGEFPLRTLTIYKITKGNLRDTFNIDP

SEQ ID NO: 228811 - protein, 108 aa, Glycine max
  Coding DNA Sequence Number=SeqID_112033
MSRNFTYCATKGAKYLEAVKQRLHAMKQWSPDEYRIFIYQIEVVWRQATTACGGHHWSWVVKEKVLGFLGGSLERGGKMRIFTLLNCANLAKQIFLSGWELCLACLSH

SEQ ID NO: 228812 - protein, 96 aa, Glycine max
  Coding DNA Sequence Number=SeqID_112034
  Subcellular localization annotation: CTP_CleavageSite=27; ConfidenceScore=5.04e-01
MVFGVGGGHRCPPWRSSEGGWNFLGVSLSKVSLTSRLIAVRMNFNDLPGGGVVGILFLRNEVYLQKGLRRSNQYLNSLTTWLLGARADFVREASMF

SEQ ID NO: 228813 - protein, 199 aa, Glycine max
  Coding DNA Sequence Number=SeqID_112035
  Homolog annotation: Hit_ID=Q1S717; Match level="QueryCoverage=63%, HitCoverage=19%, E-value=4e-20, Identity=35%"; Hit description =Ovarian tumour, otubain
MPEDPANQPNYPDFFNHFATNEVFENQDDLLRRVRDLRKSLGFVLAIHRSENGRKIYVVVDWENGGTYKQYKDKRVDTQDVDKDIIWSHPDSIKLLNSFPTVLICETIYKTNKYRLPLLEIVAKCKILVTKAEDWEEYVYYTWLLHHKRRFVQAWTDHDMYLGNTTTNRVENAYARLKRWLRDSMGDLCTCWDASTTIY

SEQ ID NO: 228814 - protein, 69 aa, Glycine max
  Coding DNA Sequence Number=SeqID_112036
  Gene Ontology: Mol. function=structural constituent of ribosome; Cellular component=ribonucleoprotein complex; Biological process =translation
  Homolog annotation: Hit_ID=Q06FM3; Match level="QueryCoverage=75%, HitCoverage=19%, E-value=2e-22, Identity=94%"; Hit description =Ribosomal protein L2
MAIHLYKTSTPSTRNGAVDSQVKSNPRNHLIYGQHRCGKGRNARGIITAGHRGAEVPIKMGNALPLSAV

SEQ ID NO: 228815 - protein, 102 aa, Glycine max
  Coding DNA Sequence Number=SeqID_112037
MAWRRDKDSASGVRHNHASNIPAPKELSLANIEALTLQVILPWLGGCHEVARLGEVVTAGCEALEFLHYSKCTKGWLQRYLVVVDLNGLQLKKIRSFVQSAC

SEQ ID NO: 228816 - protein, 135 aa, Glycine max
  Coding DNA Sequence Number=SeqID_112038
  Homolog annotation: Hit_ID=Q1RTJ9; Match level="QueryCoverage=88%, HitCoverage=35%, E-value=5e-15, Identity=40%"; Hit description =Cyclin-like F-box; F-box protein interaction domain
MPGYHLVGSCNGLHCGVSEIPEGYRVCFWNKATRVISRESPTLSFSPGIGRRTMFGFGYDPSSDKYKVVAIALTMLSLDVSQKTEMKVYSAGDSSWRNLKGFPVLWTLPKVGGVYLSGTLNWVVIKGKETIHSEI

SEQ ID NO: 228817 - protein, 46 aa, Glycine max
  Coding DNA Sequence Number=SeqID_112039
MASDRKLHTFEEVAKHDQTKDCWLIISGKTNAIVAATIAVVELHKL

SEQ ID NO: 228818 - protein, 75 aa, Glycine max
  Coding DNA Sequence Number=SeqID_112040
MSVLLRILMGTVGMSRRLPFEGERSNMTCVIMCGRCQENWVCFGGCAGGDSCCRITLHYSFHSQHGFHHRSHLVF

SEQ ID NO: 228819 - protein, 106 aa, Glycine max
  Coding DNA Sequence Number=SeqID_112041
MQPILLSVGGLPSIAEGKEKLDLIEERLRAVEGFSDYPFMDMTDLCLVPDVIIPSKFKVLDFDRDEKLLMHFFQDSLAGAAVIWYTNLEASRIHTWKDLITAFIRQ

SEQ ID NO: 228820 - protein, 63 aa, Glycine max
  Coding DNA Sequence Number=SeqID_112042
MRWVVTSLIFVGGRTIPQVLMIYPTRIISVAVYNRCHTTFVDWLPSHSAVDQWLAVSQGMSIL

SEQ ID NO: 228821 - protein, 137 aa, Glycine max
  Coding DNA Sequence Number=SeqID_112043
MVLESTQGEEKPSTSYLPLPLPLPLPLHPITKKTTIHIISRSDSDDDDDRSHEEGKHGFEFVWEMEVQILGVSGHVSSGVLVHVHRHRLAPLEMEEKEKVVRHMWDVYTNSHCRQNGEEVSQEEAHPHRKPWIRTWR

SEQ ID NO: 228822 - protein, 89 aa, Glycine max
  Coding DNA Sequence Number=SeqID_112044
  Gene Ontology: Mol. function=Rab GTPase activator activity; Cellular component=intracellular; Biological process=regulation of Rab GTPase activity
  Homolog annotation: Hit_ID=Q69NG6; Match level="QueryCoverage=74%, HitCoverage=11%, E-value=2e-21, Identity=67%"; Hit description =Putative GTPase activating protein
MGEGYCTQPYPCICKKAVSGFEPMTNRGRLKSPWSRRKRKHVLTPQQWKSVFTQDGRIRDGGIKFLKRVRSGGVDPSIRAEVWPFLLGV

SEQ ID NO: 228823 - protein, 193 aa, Glycine max
  Coding DNA Sequence Number=SeqID_112045
  Subcellular localization annotation: CTP_CleavageSite=57; ConfidenceScore=5.24e-01
MEFLSNVKFSTDFNNITFSNKSTIQPIRPKCCRTKRPKTETQHTQADQPKRTLTPTLGMRRKNEKGRTHRSEDEQEAGEEEVTTNRTDRKWIHEEEEDDDDDDCDDDDEGEEFEDDDCELEVLGFLPTGTAEDDGDENKAGEGREEQRRSNHRRSHGEQPGTAGDEVRVVGGVRKCPFNDPWLAPQFVVSETS

SEQ ID NO: 228824 - protein, 267 aa, Glycine max
  Coding DNA Sequence Number=SeqID_112046
MGCIKRERQVLKLVHPGRHVEVLKEPITAAEVMRRNPRHCIARPDVFEFPSVVVKPESVLLPGNVFFIVPNHTLYNLLKTKGQTNNLPFIQKQYSPNDRLVSSYAWVSSKLQTYKQHIKCLFTRKGKVGQSRKVKEKLHVFNKAFLPLFFHSPFSQRGSNCPSYSNSAYVESLCIYEGDGKSESQLQVEDTSYDAIENRKNNEMKLLKKDVFGPNQKVTMLKSCLRKPDSIRKSLNLKVSFDLPNKKQEQQMELNIFRSKFFGYLSW

SEQ ID NO: 228825 - protein, 86 aa, Glycine max
  Coding DNA Sequence Number=SeqID_112047
  Gene Ontology: Mol. function=nucleic acid binding
  Homolog annotation: Hit_ID=Q1S6N9; Match level="QueryCoverage=82%, HitCoverage=5%, E-value=2e-12, Identity=45%"; Hit description =Integrase, catalytic region; Zinc finger, CCHC-type; Peptidase aspartic, catalytic
MEGETSYTVGPPPIFDGEEFKFWAARMTTHLEVMDLWEAVEENYDVPKLPSNMTRFGTISNHNIKAMKEPKACKCSSWPKNLRFRA

SEQ ID NO: 228826 - protein, 106 aa, Glycine max
  Coding DNA Sequence Number=SeqID_112048
MGAVGDGERDWNVGNGFGRKKGEEMAFFLSYLDYKAQNAQMSNALGNGNVAHTLDIFSKIPILKTKFRDDPTVNEGWAAFLPRQLHVASLRNFIKKLPREASSCLL

SEQ ID NO: 228827 - protein, 82 aa, Glycine max
  Coding DNA Sequence Number=SeqID_112049
  Gene Ontology: Mol. function=structural constituent of ribosome; Cellular component=intracellular; Biological process=protein modification process
  Homolog annotation: Hit_ID=Q7XHS4; Match level="QueryCoverage=75%, HitCoverage=44%, E-value=3e-28, Identity=100%"; Hit description =Putative ubiquitin / ribosomal protein CEP52
  Pfam annotation: Domain name=ubiquitin; Domain location=6-73; Score =110.6; E_value=4.5e-30; Accession=PF00240.13; Description=Ubiquitin family
MQIFVKTLTGKTITLEVESSDTIDNVKAKIQDKEGIPPDQQRLIFAGKQLEDGRTLADYNIQKGLEYLNFENCVNILNVVID

SEQ ID NO: 228828 - protein, 155 aa, Glycine max
  Coding DNA Sequence Number=SeqID_112050
  Gene Ontology: Mol. function=structural constituent of ribosome; Cellular component=intracellular; Biological process=protein modification process
  Homolog annotation: Hit_ID=P19232; Match level="QueryCoverage=19%, HitCoverage=57%, E-value=5e-11, Identity=96%"; Hit description=60S ribosomal protein L40
  Pfam annotation: Domain name=Ribosomal_L40e; Domain location=13-59; Score=22.7; E_value=0.0013; Accession=PF01020.8; Description =Ribosomal L40e family
STLHLVLRLRGGIIEPSLMALARKYNQDKMICRNKIPNFGTACKLWKACMNLLMSSIEKVQPQQIVDFSELHISEKPYTKVLCPFTSPCCELQEKEVWSQQPVEAKEEDQCYMYTWFGKCFGSSCEVIHLLHPPTEATRLRRGANEEHPNFPQLV

SEQ ID NO: 228829 - protein, 102 aa, Glycine max
  Coding DNA Sequence Number=SeqID_112051
  Gene Ontology: Mol. function=oxidoreductase activity; Cellular component=chloroplast thylakoid membrane
  Homolog annotation: Hit_ID=Q94HY4; Match level="QueryCoverage=96%, HitCoverage=37%, E-value=1e-33, Identity=70%"; Hit description =Putative aldo/keto reductase
MAPYTRAVCECLQGLVKAVGVSNYGPKQLLKMHDYLKDLGVPLCSAQLQFSLLSTGKYQLKIKSICDSLGIRMIAYSPLGLGMLTGKYSSSKLPSGPRFVDI

SEQ ID NO: 228830 - protein, 58 aa, Glycine max
  Coding DNA Sequence Number=SeqID_112052
MANTNNEHTRIDEDKPRIDEDQQIEEKNMREFERRNEKRVKEMMLDAGRKSQEDVRIG

SEQ ID NO: 228831 - protein, 103 aa, Glycine max
  Coding DNA Sequence Number=SeqID_112053
EGCENGVGVGGRVDVRRGVGGARFWGEEGIGVGGSGEDRWRERVVVRFGERGHGAARGWSSIIVIVSEDWEILESEVLLMELAACKLEDDDDDGGVREGLGRG

SEQ ID NO: 228832 - protein, 429 aa, Glycine max
  Coding DNA Sequence Number=SeqID_112054
  Gene Ontology: Mol. function=phosphoinositide binding; Biological process=cell communication
  Homolog annotation: Hit_ID=Q00V04; Match level="QueryCoverage=96%, HitCoverage=60%, E-value=8e-33, Identity=27%"; Hit description=[U] KOG2273 Membrane coat complex Retromer
  Pfam annotation: Domain name=PX; Domain location=8-125; Score=95.2; E_ value=1.9e-25; Accession=PF00787.14; Description=PX domain
  Pfam annotation: Domain name=Vps5; Domain location=172-429; Score= -81.5; E_value=0.0022; Accession=PF09325.1; Description=Vps5 C terminal like
  Pfam module annotation: Pfam domain module=PX::Vps5; Domain location =8-125::172-429
YLKITVSNPVKEQETSNSIVPGSNSYVTYLVTTKTNIPEFGASGADFAVRRRFRDVVTLSDRLAEAYRGFFIPPRPDKSVVESQVMQKQEFVEQRRMALEKYLRRLATHPVIRKSDEFRVFLQVQGRLPLPATTDVASRVLDGASKLPKQLMGESVIAPHEVVQPARGGMDLMRLFKELRQSVANDWGGSRPSVVEEDKEFMEKKEKINELEQQINGASQQVLNHGCGCSFVAILDIAGKCGQCGCSELKNPDIAADAESLVKAQQDMGETMGELGLAFIKLTKFENEEAIMNSQRVRAADMKGVATAAVKASRLFRELNAQTVKHLDTLHEYLGLMLAVHSAFSDRSSALLTVQTLLSELSSLESRAEKLEVASSKIFGADKSRVRKLEELQETIRATEDAKNVAIREYERIKVQIVAFIDLSAFVNL

SEQ ID NO: 228833 - protein, 621 aa, Glycine max
  Coding DNA Sequence Number=SeqID_112055
  Gene Ontology: Mol. function=sequence-specific DNA binding; Cellular component=exocyst; Biological process=exocytosis
  Homolog annotation: Hit_ID=Q1SVZ9; Match level="QueryCoverage=99%, HitCoverage=84%, E-value=9e-93, Identity=37%"; Hit description=Exo70 exocyst complex subunit
  Pfam annotation: Domain name=Exo70; Domain location=101-615; Score =67.8; E_value=3.5e-17; Accession=PF03081.6; Description=Exo70 exocyst complex subunit
MLANTWEPSLTSSRLKAHSAFLVLLMTSVYSFFVDKELQGKPDVYSLVSSAAFAIASLGLSTLTTLGFEVDLLYFFSGVLIVQLMKINLWLVIVGGGFSYFLIILRSTLENEYNQIQDIEIGLHRPSQGTNVSQVSSSPQAIGNAHPQADASQVTQVALSSQQGNRHRGLIRARYMSHIEELKKENGKLIDTISKHVGEYLMANVVNEDGISVPEMQADDNLVADVLPQGIINNLRETGRLMLQNECCNVYSRVRREFLKECLSKFGLQVEELNVEDIDKMEKIESWIKALNITVRILFPNERRLCDLVFSPSYAADISFGEVCKELNISLLRFANTLATENHSPFHLCHLIPKVFKTLSDLIPNFNSLFYGQLFSESLRNDAVLVGKRLGIFVELESLIHREMPKETVPDGGIHPTTHKVMDYLRDVFIDNQSFSIRTGVSSFSDQVARIIQVLDSSLEAKSKNYTDPALGHVFMINNLMLLQYEKYIYRVVIFGEDWYKSKINQNIELYQRSSLDKILDFLNLDSNELLLAESMKKKLKLFNQHFNEICKAQSEWLIFDEQLKEQMIKSIENKLLPAYGTFLGRIHDVLGKDAYDFIRYGIQNIQDLLSGLFLVIQHEG

SEQ ID NO: 228834 - protein, 87 aa, Glycine max
  Coding DNA Sequence Number=SeqID_112056
MVFTLRKMFVRSVKGKGLDLNHEGETLTDCLEFRPWGQRHLKCNNSLPMCCLCLDPVMILNFVFVRTDDYVDDFKDPRARRHCDTIL

SEQ ID NO: 228835 - protein, 101 aa, Glycine max
  Coding DNA Sequence Number=SeqID_112057
MGEKEEKKKKKIKSHMLPKQPSSLGQAGRQPPPPFLIQRQKVDVPRIPDPPGYAFQLFLVKKNYFREENPSRGASITLPRRFCEQIREGFLSFFIRSSFFN

SEQ ID NO: 228836 - protein, 140 aa, Glycine max
  Coding DNA Sequence Number=SeqID_112058
  Subcellular localization annotation: CTP_CleavageSite=42; ConfidenceScore=5.22e-01
VDSRGSHLRVTASSRGDEDVSSRTARLARIASFARSHDSRIRAFALFTLFTSFAVFAVFAVFAVGVTAWIDFRHTTPRRPHLVVSPARALVRTTRTVSVDVFAASPSRDVVSIARDDRIDVPRERFGTRRRDRPIRANLA

SEQ ID NO: 228837 - protein, 220 aa, Glycine max
  Coding DNA Sequence Number=SeqID_112059
  Gene Ontology: Mol. function=ATP binding; Cellular component=nucleus; Biological process=septin ring assembly
  Homolog annotation: Hit_ID=Q01FY4; Match level="QueryCoverage=88%, HitCoverage=89%, E-value=2e-86, Identity=80%"; Hit description=[D] KOG3022 Predicted ATPase
  Pfam annotation: Domain name=CbiA; Domain location=84-211; Score= -30.1; E_value=0.024; Accession=PF01656.13; Description=Cobyrinic acid a,c-diamide synthase
MSEWDARQTRARAKRAGASMSDVPANAPEACPGTRAKTAGTSEACAGCPNRAACASGAVKAASEETDADAVRVAERLRGVRRKILVLSGKGGVGKSTFAAQLAFGLASRGRDVGLLDVDICGPSVPLMCGEVGAEVHKSNSGWSPVYVEENLGVMSIGFLLPNPDDAVIWRGPRKNGLIKQFLGDTEWGELDYLIVDAPPGTSDEHLSIVQYMKEAGGIL

SEQ ID NO: 228838 - protein, 254 aa, Glycine max
  Coding DNA Sequence Number=SeqID_112060
  Homolog annotation: Hit_ID=Q01B15; Match level="QueryCoverage=79%, HitCoverage=8%, E-value=7e-24, Identity=33%"; Hit description =Chromosome 04 contig 1, DNA sequence
  Subcellular localization annotation: CTP_CleavageSite=36; ConfidenceScore=5.58e-01
VDSRGSHVIDSADTSSPTSQPAKVLLVVRQSDSSASAATNSSSGQSVQSFEFWDGDNSTSLSFGEFAKFVEDTAGFPLKGHAIISRAVWSSLDADGDDTLSPSEYADAKGKMRSGDLVAAPVLVYASINAKYLNSFETTRGNANSCENFVLARTNSTAMPANTTAWNAFYEELIPSGSSSLSSAITPCEVGVHIPAVYAGVDANMTKLIPLRVFESTAPKTISLASESAKSTSEDLTQFDDPVVLSATEQYHDI

SEQ ID NO: 228839 - protein, 64 aa, Glycine max
  Coding DNA Sequence Number=SeqID_112061
MAIVKYLTMDELKRLSIPSKMLKFFNHSSFPHYEQVPDVIRTFSYLTMLMCSMVSPEMLNPDPS

SEQ ID NO: 228840 - protein, 111 aa, Glycine max
  Coding DNA Sequence Number=SeqID_112062
  Gene Ontology: Mol. function=transferase activity; Cellular component= cytosol; Biological process=aromatic compound metabolic process
  Homolog annotation: Hit_ID=Q01DG2; Match level="QueryCoverage=98%, HitCoverage=19%, E-value=1e-36, Identity=65%"; Hit description =Chromosome 02 contig 1, DNA sequence
LRREDAEDGRPRYVWRTDVRATAPFWRAWYEGLSRKFLAVRAAKLLILAGNDRLDTELTVAQMQGKFQLALLPKTGHAVHEDSPEETATAIENFFARYVVNARPTPPPFVV

SEQ ID NO: 228841 - protein, 296 aa, Glycine max
  Coding DNA Sequence Number=SeqID_112063
  Gene Ontology: Mol. function=4 iron, 4 sulfur cluster binding; Cellular component=integral to membrane; Biological process=electron transport
  Homolog annotation: Hit_ID=Q01GW4; Match level="QueryCoverage=47%, HitCoverage=29%, E-value=6e-66, Identity=82%"; Hit description=[O] KOG0716 Molecular chaperone
  Pfam annotation: Domain name=DnaJ; Domain location=123-185; Score =87.7; E_value=3.6e-23; Accession=PF00226.21; Description=DnaJ domain
MIDIPCTICAISHTGELTKKCLLTVISGGSCRAHTVSLNHVIFEYLSHHSRIRLKNHDGEHGHHASSSRFSSSRGVVMRACADARSVSAAPRYPRVLRRGNTRRARARRAGLAVDAEHTPLVDFYELLGVDTDADVKTIKKAYYGLAKECHPDVSEVEEEGHDMCVLLNEAYEILRDPIARALYDAELEQQKLDEDLFTGNAYSKWTTKKAKPGETRAVFVDEFTCIGCKQCVWQAPATFRMNNDYGRARVFAQWLNDEEDIQCAIDSCPVDCIHWVKREELPYLEHVCVNFGKVS

SEQ ID NO: 228842 - protein, 102 aa, Glycine max
  Coding DNA Sequence Number=SeqID_112064
MGRAPQRLGRANGGRGECLTVCPYDNLNPSKNRVSEKRAPLDVERATVTSSWRRRLASSTLPYVAAQIADLESANDAKQRRIDGLEERVNALVARMEAVENV

SEQ ID NO: 228843 - protein, 764 aa, Glycine max
  Coding DNA Sequence Number=SeqID_112065
  Homolog annotation: Hit_ID=Q94I65; Match level="QueryCoverage=33%, HitCoverage=32%, E-value=3e-54, Identity=38%"; Hit description =Putative retroelement
  Subcellular localization annotation: CTP_CleavageSite=56; ConfidenceScore=5.76e-01
MASALHNTTGGSPPPPPPLQPLVVSSSLASFSHSISEKLTTSNYLLWCSQVQPVVKVSQLEEARSASSFLICSPSSCRMHYVASMGETSLTFPFDCSREEQQVDIILEGLPMEYESMVSYIYNKSKPMSVDDVELLCLARESRLGKLSKKSLGAISAGVNSDPQSHPTQVSNDAADNYNNSGNNSGKGGGQNLFCGCCGGGCGHGGVTENLQMFSVNLQTGILILVTNVSQNIQQATPFEGPDQITISNGQGLNINASGLTDCLLLLLLLFTLVGKSSSPTSARDKITSISESLEVLVFLYSDPITNTSFSPDLRNAKFPYTQLFAEPVTSSTQASNSTLSVLPSVLNHVVPAMSQPPGTNSTHAVSSSSGTNSTNEVSSSSISPEPAATSPEPVATLPADHLPSPQPEVTSNPVISAPALPTSVHSTAESPPLLVRPDNIHSMCTRTKAAMKAEYDVLLHKNTWKLVDLPSSRSPIGCKWVFRVKENPEGTVSKYKDRLVAKGFHQRLGYDYNETFSPVIKPVTVRILLKLAVTNKWKLQQLDVNNAFLNGILEEEFSIKDLGDLDYFLGIEVSSQPNGSLLLIQSKYIQDLLVKTTMNEANSISSPMYATITRPEISFSVDKICQFMSKPTEQHWMAVKRILRYLKGTINFGLAMQPNFSVSHYSVHAYCDADWASDLDDRSTEAEYQSLALTTAEVTWIQSLLAELKVPHAPPVIEKQVQVVRVRAADQRADILTKALIPSNFTAYRFKLRVAVKISTNPS

SEQ ID NO: 228844 - protein, 500 aa, Glycine max
  Coding DNA Sequence Number=SeqID_112066
  Gene Ontology: Mol. function=catalytic activity; Cellular component =integral to membrane; Biological process=metabolic process
  Homolog annotation: Hit_ID=Q5P603; Match level="QueryCoverage=80%, HitCoverage=77%, E-value=1e-44, Identity=32%"; Hit description =Putative ADP-producing CoA ligase,similar to feruloyl-CoA synthetase
  Pfam annotation: Domain name=AMP-binding; Domain location=34-448; Score=240.6; E_value=3.3e-69; Accession=PF00501.18; Description=AMP -binding enzyme
MANYSHPHICQCLSHLLTLRQHFPVIIAGNRRKTGQELVEEVLSLAQGLLHLGLTSGQVVAISAFNSDRYLEWLLAIAFVGGIAAPLNYRWSFEEARLAMAAVKPVLLVIDESSYTWYSKLQQNDVPSLKWHILLDSPSSDFSKWNVLTPEMLKRHPIKLLPFDYSWAPDGAVIICFTSGTTGKPKGVTLSHGALTIQSLAKIAIVGYNVDDVYLHTAPLCHIGGLSSAMTMLMVGGCHVLMPKFDAESAVDAIEQHAVTSFITVPAIMATSSGSSMQTVLLCKCFAIKNLRHKETWKGGETVKKILNGGGSLSHELIKDTSIFFHKAKLISAYGSKLIHQQQGVCIGKAAPHIELKISADASGHTGRILTRGPHIMLRYWDQTLTNPLNPNKRAWLDTGDIGSIDHYGNLWLLGRTNGRIKSGGENIYPEEVEAILQQHPGIASVVVVGIPDAHLTEMVAACRKLLLVMAGLVEVHYRNGSLAARSCRRGWCYSITAEE

SEQ ID NO: 228845 - protein, 158 aa, Glycine max
  Coding DNA Sequence Number=SeqID_112067
  Subcellular localization annotation: CTP_CleavageSite=51; ConfidenceScore=5.45e-01
MSSLSGLATAIALLLVGISSAGRDLRPSEHGLVFQTSPPANSSPEMKSFFSTSKGSSSSSSSNADAPLRNATESLPPPWWGVTGGGGGGGRSHVGRALMTASLVCGITGGVLLVASALLYLFKHRRNPHQNEPFRARNDGTVNNSANKLQLVPVVPNR

SEQ ID NO: 228846 - protein, 40 aa, Glycine max
  Coding DNA Sequence Number=SeqID_112068
MAHLALSQMAVTVPVGNDLSLRRSAVKIQLSEESIVMLDV

SEQ ID NO: 228847 - protein, 452 aa, Glycine max
  Coding DNA Sequence Number=SeqID_112069
  Homolog annotation: Hit_ID=Q01CM3; Match level="QueryCoverage=81%, HitCoverage=91%, E-value=3e-86, Identity=46%"; Hit description =Chromosome 03 contig 1, DNA sequence
  Pfam annotation: Domain name=WRC; Domain location=373-418; Score=7.1; E_value=0.033; Accession=PF08879.1; Description=WRC
MHAFLPIAHSFVGMSARAALERAVEAVRVECPNAIGTPLDLRAIASSAATEGEMTSDADAVTRVTRAWTRATRDPGNGLTEGELARVMRAFHKVWIEHGRSGTPLDDGTWAFRCARVNRPAVKQCLTRLATWTRRGRWAGWAEACREMRREVAMKSGGPYETYAQVVRGLDGLRARATTAVRTEAKEDAMAFDESARKWIEACWSDASIGSPLPSLDEMPRENVTFYARGMERDGVVSVSKRVPPRDRSQPVSPAAPTPKRAKKAVKPKIEAPSSVNRESGALLPSSSKKDAAEVSVVVEEGDERRAPVRMMEMHAVRQSVGITVKVRCHGLDAEMVIIPPFGLPNGVKTNGEMAAMVFQETQAAKHANAPPAEPSARCVHNDGKAWRCPGRRVDDTPFCAKHKPAKFATSVRWSPTAFETPHGLRVTYDGPPSAGVIRSVAGTPVDASDLL

SEQ ID NO: 228848 - protein, 136 aa, Glycine max
  Coding DNA Sequence Number=SeqID_112070
  Gene Ontology: Mol. function=transcription factor activity; Cellular component=nucleus; Biological process=regulation of transcription, DNA-dependent
  Homolog annotation: Hit_ID=Q84JP1; Match level="QueryCoverage=45%, HitCoverage=27%, E-value=5e-18, Identity=77%"; Hit description =Nuclear transcription factor Y subunit A-7
MYRNNEADEQQQSEPQMQHLSANGISHAGIGTQNVQYATPPQLGTGHAVWFASLVLSLELVPPTYPYPDPYYRSIFAPYDAQTYPPQPYGGNPMVHLQLMGIQQAGVPLPTDTVEEPVFVNAKQYHGILRRRQSLC

SEQ ID NO: 228849 - protein, 324 aa, Glycine max
  Coding DNA Sequence Number=SeqID_112071
  Gene Ontology: Mol. function=protein serine/threonine kinase activity; Cellular component=calcium- and calmodulin-dependent protein kinase complex; Biological process=protein amino acid phosphorylation
  Homolog annotation: Hit_ID=Q8RY07; Match level="QueryCoverage=99%, HitCoverage=52%, E-value=1e-141, Identity=76%"; Hit description =Serine/threonine protein kinase pk23
  Pfam annotation: Domain name=Pkinase; Domain location=2-232; Score =223.4; E_value=5e-64; Accession=PF00069.15; Description=Protein kinase domain
  Pfam annotation: Domain name=Pkinase_Tyr; Domain location=1-270; Score=-59.5; E_value=8.1e-09; Accession=PF07714.7; Description =Protein tyrosine kinase
  Pfam module annotation: Pfam domain module=Pkinase::Pkinase_Tyr; Domain location=2-232::1-270
MTSAIAIEDVRREVKMLKALSGHKNLVKFYDAFEDVNNVYIVMELCEGGELLDRILDRGGRYPEDDAKAILVQILDVVAFCHLQGVVHRDLKPENFLFVSKEEDAVMKVIDFGLSDFVRPALTSTKHADQRLNDIVGSAYYVAPEVLHRSYSVEGDLWSIGVISYILLCGSRPFWARTESGIFRSVLRANPNFDDSPWPSISPEAKDFVKRLLNKDHRKRMTAAQALAHPWLRNEKNAIPLDILIYKLVKSYVRASPLRRAALKALAKALTEDELIYLRAQFNLLEPKDGCILLENFRVALMKNATDAMKESRVPEILNLVSNL

SEQ ID NO: 228850 - protein, 204 aa, Glycine max
  Coding DNA Sequence Number=SeqID_112072
  Gene Ontology: Mol. function=protein serine/threonine kinase activity; Biological process=protein amino acid phosphorylation
  Homolog annotation: Hit_ID=Q9FIM9; Match level="QueryCoverage=56%, HitCoverage=20%, E-value=8e-37, Identity=63%"; Hit description =Calcium dependent protein kinase-like protein
  Subcellular localization annotation: CTP_CleavageSite=67; ConfidenceScore=5.13e-01
MGHCCSKNIAVNNETLPADHAPKPPHYAAAVAASPLPPSGSSVSAATPGRNTPAQSFSMSPFPSPLPAGMAPSPARTPGRKFRWPLPPPSPAKPIMAALLRRQGKAKPKEGPIPEEQGEGGGGEGERSLDKSFGYGKNFGAKFELGKEVGRGHFGHTCWAKGKKGDLKGQSVAVKIISKAKLEMVYVDSWSLQDQFLTGISSSV

SEQ ID NO: 228851 - protein, 68 aa, Glycine max
  Coding DNA Sequence Number=SeqID_112073
  Gene Ontology: Mol. function=transcription factor activity; Cellular component=nucleus; Biological process=regulation of transcription, DNA-dependent
  Homolog annotation: Hit_ID=Q8VY64; Match level="QueryCoverage=88%, HitCoverage=32%, E-value=2e-12, Identity=53%"; Hit description =Nuclear transcription factor Y subunit A-4
  Pfam annotation: Domain name=CBFB_NFYA; Domain location=1-29; Score =17.3; E_value=0.018; Accession=PF02045.6; Description=CCAAT-binding transcription factor (CBF-BNF-YA) subunit B
MENEGKKPYLHESRHLHALRRARGCGGRFLNSKKDENQQDEVASTDESQSNINLNSDKNELAPSDRTS

SEQ ID NO: 228852 - protein, 64 aa, Glycine max
  Coding DNA Sequence Number=SeqID_112074
  Homolog annotation: Hit_ID=Q9FJB9; Match level="QueryCoverage=76%, HitCoverage=69%, E-value=4e-11, Identity=66%"; Hit description =Arabidopsis thaliana genomic DNA, chromosome 5, P1 clone:MNC6
MGYVMRVRLASFFTGAAVASFLGLYTLHKDYKVAHQSFTQQMRIFRLLIDGVRTVQREADCCIS

SEQ ID NO: 228853 - protein, 148 aa, Glycine max
  Coding DNA Sequence Number=SeqID_112075
  Gene Ontology: Mol. function=protein serine/threonine kinase activity; Cellular component=membrane; Biological process=protein amino acid phosphorylation
  Homolog annotation: Hit_ID=Q6UD78; Match level="QueryCoverage=56%, HitCoverage=14%, E-value=5e-24, Identity=57%"; Hit description=LysM domain-containing receptor-like kinase 1
MHNSINSTRLNCRSENFVTLQETSIHEGLVKAINLEPLEQVNVSNHSNGSLEVGVSPPSLVVGVFDSRIGVQGGLWSGTRLLLLMAGLQPHLHLLHHGLQPSDNSGRHSQLQQGHRAQQGHHHRRPKGQRPLPLRLHRRPVSWPHLPL

SEQ ID NO: 228854 - protein, 205 aa, Glycine max
  Coding DNA Sequence Number=SeqID_112076
MRRAIFTAWTRFHALKDRLYFPYQNPWVSWQMSFYENKTKLFNNLHVHLGTQVNVVEPPLIEVTSQLPPIVEDALAIVSTSITPREITPLTTFAPSIRFIVERIETNMLIKNTLESSLKSFNDFVPYNMNLLMQQRLPPFVQHQSTPIPQPPPPTPTTVVQPHPEVLAQMIPASEVAIPIDHVLVPLPSPPKSPPPITQPPSTEG

SEQ ID NO: 228855 - protein, 240 aa, Glycine max
  Coding DNA Sequence Number=SeqID_112077
  Homolog annotation: Hit_ID=Q6UD74; Match level="QueryCoverage=22%, HitCoverage=8%, E-value=2e-13, Identity=60%"; Hit description=LysM domain-containing receptor-like kinase 7
EGVAKKLAVDAVAGEGDVDPLVGDDDVLAGHGVLVVVDYVVRSCQKAGGHDGGDVVNLVQANGKREELNDLSVQRVNNPLLKMMLLTTPLQLIFNKFLSRLQLFKSLKEAFDKLRLYASGRRNQTEFTLIWTMMFKLMFNMDNDRFQHQGLPTIDPNLSAEDIARLCFPIVFLFENAYNIQRRMEEKFQPQIDWMQFPLDIKEEEVTCPLSKHQESHVASTTFKQAPPTGIKVLPSPKWK

SEQ ID NO: 228856 - protein, 133 aa, Glycine max
  Coding DNA Sequence Number=SeqID_112078
MDFTIIATLMKKLYNNVYDIFRRFADDGIFVTPIKLHTLSSTIQFDDYREIFCTAKVSSLDSFLERVRNLDVAMMPFEELVVDPRKKGLPSSGNIGVGMKKWRRQAWETNGDDHKVSMESGKKEDNGRSNGHR

SEQ ID NO: 228857 - protein, 257 aa, Glycine max
  Coding DNA Sequence Number=SeqID_112079
  Gene Ontology: Cellular component=integral to membrane
  Homolog annotation: Hit_ID=Q3BR16; Match level="QueryCoverage=92%, HitCoverage=99%, E-value=1e-103, Identity=78%"; Hit description =Putative membrane protein
ARSHAHVAAGAVVEHQHQAEHHRADGRIQHLGRRQHEERGHHQAGVVGHLHLARAPATGALQVHRQDADTAEAGTVTDEEQDAQAGQCATDDRRIQRVDVREVDPARQQVGQHAAGGDRGEGLQGEFPAHAPHRHPVERQIDQHEHHAEVPVQRVMQQERHAGHAADHQPTLGEDGQAQRGHHRGQHHALHILGDRVAQRFFVGGGAGAIGRRGQRAGGDQVAVSVVARRGAMGGKGHTGGEQQAARPACPLRRRPF

SEQ ID NO: 228858 - protein, 156 aa, Glycine max
  Coding DNA Sequence Number=SeqID_112080
  Gene Ontology: Mol. function=protein serine/threonine kinase activity; Cellular component=membrane; Biological process=protein amino acid phosphorylation
  Homolog annotation: Hit_ID=Q6UD74; Match level="QueryCoverage=60%, HitCoverage=15%, E-value=8e-24, Identity=60%"; Hit description=LysM domain-containing receptor-like kinase 7
MVALCVCRLGLTGRAIAGIAVGIVAALLLLGVCIYVGYFRKKIQKDEFLPRDSTALFAQDGKDETSRSSANETSGPGGPAIITDITVNKSVEFSYEELATATDNFSLANKIGQGGFGSVYYAELRGETKFYYIYILTILEQEAKSTSLRPAAAGYK

SEQ ID NO: 228859 - protein, 203 aa, Glycine max
  Coding DNA Sequence Number=SeqID_112081
  Gene Ontology: Mol. function=protein serine/threonine kinase activity; Cellular component=membrane; Biological process=protein amino acid phosphorylation
  Homolog annotation: Hit_ID=Q6ZD33; Match level="QueryCoverage=92%, HitCoverage=36%, E-value=1e-68, Identity=64%"; Hit description =Receptor protein kinase PERK1-like protein
  Pfam annotation: Domain name=Pkinase; Domain location=1-168; Score= -93.8; E_value=0.0057; Accession=PF00069.15; Description=Protein kinase domain
  Pfam annotation: Domain name=Pkinase_Tyr; Domain location=1-168; Score=-126.7; E_value=0.00011; Accession=PF07714.7; Description =Protein tyrosine kinase
  Pfam module annotation: Pfam domain module=Pkinase::Pkinase_Tyr; Domain location=1-168::1-168
MVPGSREPLPWATRVQIALDSARGLEYIHEHTVPVADFGLTKLTEVGSSSLPTGRLVGTFGYMPPEYAQYGDVSPKVDVYAFGVVLYELISAKEAIVKTNDSVADSKGLFDGVLSQPDPTEELCKLVDPRLGDNYPIDSVRKMAQLAKACTQDNPQLRPSMRSIVVALMTLSSTTDDWDVSFGEGEGIDVHCCSGWFVDGGIR

SEQ ID NO: 228860 - protein, 160 aa, Glycine max
  Coding DNA Sequence Number=SeqID_112082
MPISPCGSINWSVSFRRRDRAQKTPSRPGEVQQGPGVSSYGYGPLSVLQGARPPQQGIAPTRHPVDPEKSNRALGGSAHKTPSGPEGAQQGPGVSSMGLCQSYRAPIPPPSSCHRDIGIVPVRHPVDPEKSNRALGFPALVAGLYQSYRVPVLPSKVTPS

SEQ ID NO: 228861 - protein, 75 aa, Glycine max
  Coding DNA Sequence Number=SeqID_112083
MTEGEGDDASLCALTGLSAPGRRKVRQKNVYTDNHSGISACPLTSRLACLWLTKGADNHKVPPHVIGLTVSGMTK

SEQ ID NO: 228862 - protein, 236 aa, Glycine max
  Coding DNA Sequence Number=SeqID_112084
  Homolog annotation: Hit_ID=Q01FE5; Match level="QueryCoverage=99%, HitCoverage=34%, E-value=1e-103, Identity=79%"; Hit description =Chromosome 01 contig 1, DNA sequence
DLEVPTKKNEGIYPSQIRRRRLTALVQALEEQIIDESLICLMEKGSDDRSVFTGHARLNKYFTGMRARPEELLHRGTCTSSSPTVGALQASRDMLLRLWDLEEKADTVLCEEVRKRVEALFCGDNGRMVIHPSGTDAEMVPLLEAILASRALKREAGLSDVKGDVINVVSCAGEVGSGTRQACEGVFFSSTVPLGGYGVVNGERLPAIHKLADMRAIELVARCSENGKLLDGYDQM

SEQ ID NO: 228863 - protein, 38 aa, Glycine max
  Coding DNA Sequence Number=SeqID_112085
MEMGERIQCMVMSNNWLKTLGHADGASVEKLLQNGDID

SEQ ID NO: 228864 - protein, 75 aa, Glycine max
  Coding DNA Sequence Number=SeqID_112086
  Homolog annotation: Hit_ID=Q01CD5; Match level="QueryCoverage=97%, HitCoverage=73%, E-value=5e-18, Identity=53%"; Hit description =Chromosome 03 contig 1, DNA sequence
MPNDYVETRFQSNRRAPDADAKQQIYDDEDRVLNIATSQKVTAASLVVVAALLFLFIVVIGPPPSDGRCTLPWCG

SEQ ID NO: 228865 - protein, 132 aa, Glycine max
  Coding DNA Sequence Number=SeqID_112087
MASRKCKSIGSRPTTQYDTRRFHSLDAWNRYTDNVLGRNILPERKVELYHTKLDDFKNEVERRNFYKRLTNLVDGSIDLALVKEFYANLYSFEGPSPKQARVKGHLLKIDVDSLNTFLETPVDAILPRKGIG

SEQ ID NO: 228866 - protein, 139 aa, Glycine max
  Coding DNA Sequence Number=SeqID_112088
  Gene Ontology: Mol. function=4 iron, 4 sulfur cluster binding; Cellular component=chloroplast; Biological process=electron transport
  Homolog annotation: Hit_ID=O49856; Match level="QueryCoverage=76%, HitCoverage=56%, E-value=3e-31, Identity=82%"; Hit description =Ferredoxin-thioredoxin reductase catalytic chain, chloroplast precursor
MASGERASERMAECDKAALKSSEKNSVRIRILHVFGEFDEFIHGDGLLVAGEIVIVPANGVKRNASSSSSVSSQSELVSRKRTSRRACSDTPFSLSSARTDSSRTPAPLPLPYRRSACTDTTAIRARPCVPPTPESQRR

SEQ ID NO: 228867 - protein, 238 aa, Glycine max
  Coding DNA Sequence Number=SeqID_112089
  Homolog annotation: Hit_ID=Q01DC8; Match level="QueryCoverage=92%, HitCoverage=5%, E-value=2e-19, Identity=30%"; Hit description=[TU] KOG1026 Nerve growth factor receptor TRKA and related tyrosine kinases
MTSSNASHLKRSFALTDGDHSGKHGRTPLVAGGYVRVDLGDWSSIDSVQICMPLQSISLRQYTTNTLTASFKVSANSPAEFEYISPPSLQNDVVQILKASAVMSVPSTTFVNVKPGDMVIFECWIKAAFMDKAKFKPIFVTSAASAVGASDTFEALTDGWTFVRLEKTFTKAERVTVKVQNLDGSQSVYFTSASLRVNTITAHMQPKNGVALVDDDAMKAPPGLEDVVLTIGNARTVL

SEQ ID NO: 228868 - protein, 229 aa, Glycine max
  Coding DNA Sequence Number=SeqID_112090
  Gene Ontology: Mol. function=catalytic activity; Cellular component =peroxisome; Biological process=metabolic process
  Homolog annotation: Hit_ID=Q010A6; Match level="QueryCoverage=93%, HitCoverage=34%, E-value=2e-79, Identity=65%"; Hit description=[I] KOG1176 Acyl-CoA synthetase
MARANALALALRDDVSKGTRVGLAATAGPEYCAAAYATWARGGVLVPIASSHSDEDAAYVVRHSGMSVVLVPPASDGREDTETYEKYARLIERSNVSVEIRHVARVDEDNDSTVSGGEDARADDVFPDDGALIIYTSGTTGRPKGALHTHRSLYAQCSGLIEAWRWDSSDRIVHTLPLHHIHGIVNAWLCAHVAGAAVEFQRSFTPRGVWTRLRDDAQPPVTIFMGVPT

SEQ ID NO: 228869 - protein, 212 aa, Glycine max
  Coding DNA Sequence Number=SeqID_112091
  Homolog annotation: Hit_ID=Q5XM22; Match level="QueryCoverage=44%, HitCoverage=71%, E-value=3e-31, Identity=60%"; Hit description =Resistance-like protein HAAS-2
LSPLIDCSVTTGDPGLISAFVERWHSKTSTFHLPFPCSFYGGGQIYADRVAGGVCRGGQSVDSTHTWGISRAYLLHLVGCTLFANKSATYVHVVHLDAFRDLAHSGGYAWGVAALVHMYDQLDEACRAPTRQLAGYLTLLQHFPSVHQCVTDDTYQETSPRASQWLTSKAHMKGITGAPYRAHCDGLTVTDVSWLPYTEHRGVRAFQEISSF

SEQ ID NO: 228870 - protein, 364 aa, Glycine max
  Coding DNA Sequence Number=SeqID_112092
  Gene Ontology: Mol. function=DNA ligase (ATP) activity; Biological process=DNA replication, synthesis of RNA primer
  Homolog annotation: Hit_ID=Q3SGP7; Match level="QueryCoverage=99%, HitCoverage=42%, E-value=7e-72, Identity=63%"; Hit description=DNA ligase, ATP-dependent, putative
  Pfam annotation: Domain name=DNA_ligase_A_M; Domain location=237-364; Score=-17.2; E_value=0.00019; Accession=PF01068.12; Description=ATP dependent DNA ligase domain
MADTLAKYRAKRNFNVTSEPAEGGQANEAARAFVIQKHWASRLHYDFRLELDGAMKSWAVPKGPSYDPSVKRMAVQVEDHPIAYNRFEGEIPKGQYGAGKVIIWDRGTWAPVGDPADGYRRGHLKFDLHGVKMRGRWALIRMKGRESEKQPPWLLVKDRDEHARAESEFSVVDEQPDSVATPPRTGARAVPAAAPGARPDAAASPSASPSSSASSSSDAGAAGLPGEAAPLPELLKPQLATLVEGVPRQAGDDWIYEMKFDGYRLLARLRDGQVRLYTRNGHDWGPKLPHLARALQRLPLPDAWIDGEIVMLADNGAPSFQALQNAFDGERTDGILFYAFDLPYVTGRDLRQEPLRVRRAVLAR

SEQ ID NO: 228871 - protein, 176 aa, Glycine max
  Coding DNA Sequence Number=SeqID_112093
MRIDEFCALYHSGTTSWVTNFAPFIIQEQQAEWINAHRRILRPLSFRNNKLGGKRAEIDSALFIIQEQRVEWNNKLGGKRAETDSAPFVIRGQFRWQGGSPAEWCFARTKLVSYLYFPFISNKRQVKRGNCHTLILSGNHPLLGCDPRLTTLRYLAPIVRQFVKFRDMPEAKRKAS

SEQ ID NO: 228872 - protein, 35 aa, Glycine max
  Coding DNA Sequence Number=SeqID_112094
AFSKELTKRAYRAKRVHLLRMNTHSLAELHVAKKA

SEQ ID NO: 228873 - protein, 117 aa, Glycine max
  Coding DNA Sequence Number=SeqID_112095
IPEHKGWVVPVWFRLCKWFFYKDSGNPKRVAWGLDISTEFAEPATRSNIGNSNCEGSFLLLPSSVMQSYPARALDRRLQVDWARDPREGPRVLISLRGVCSEALASHFKEVSLAIRE

SEQ ID NO: 228874 - protein, 66 aa, Glycine max
  Coding DNA Sequence Number=SeqID_112096
  Homolog annotation: Hit_ID=Q1RYI3; Match level="QueryCoverage=64%, HitCoverage=5%, E-value=7e-07, Identity=53%"; Hit description=AAA ATPase, central region
MAKGYTGSDLKNLCTIVSYRPVRELIQQERLKSLDLKEAKNQVTPTLTIFTWYDLKNSNIYGARVQ

SEQ ID NO: 228875 - protein, 41 aa, Glycine max
  Coding DNA Sequence Number=SeqID_112097
MGRRLVQKECVEGPDIAEDDVVALDEVLVGLRVVEAPHDGN

SEQ ID NO: 228876 - protein, 258 aa, Glycine max
  Coding DNA Sequence Number=SeqID_112098
  Gene Ontology: Mol. function=heat shock protein binding; Cellular component=integral to membrane; Biological process=protein folding
  Homolog annotation: Hit_ID=Q7F1J8; Match level="QueryCoverage=75%, HitCoverage=48%, E-value=1e-30, Identity=39%"; Hit description=DnaJ protein family-like
  Pfam annotation: Domain name=DnaJ; Domain location=59-121; Score =105.5; E_value=1.5e-28; Accession=PF00226.21; Description=DnaJ domain
RIPQRDGAWLGTTTDEAIFARAEARAEARGTKAGIGGLFDEASRVGADESGRGRPAETEYYDCLEVAPSAKSGEIRRQYYVLARKCHPDKNLDDPDAKAKFQKIGEAYQILSDEKLRAQYDARGKEGMEDVPVVNPAAFFGVLFGSEQMENFIGRLKLATLAMAGTDLTREEQDLLQRRRETRLAIKLASMLDVYVDWQPPRGSAIGKKERANAFVEMMKPIAETLVNASFGTVMLKKIGWVYKLEAEKYLHDPLAGT

SEQ ID NO: 228877 - protein, 235 aa, Glycine max
  Coding DNA Sequence Number=SeqID_112099
  Gene Ontology: Mol. function=DNA topoisomerase (ATP-hydrolyzing) activity; Cellular component=chromosome; Biological process=DNA topological change
  Homolog annotation: Hit_ID=Q00XE2; Match level="QueryCoverage=100%, HitCoverage=54%, E-value=1e-55, Identity=53%"; Hit description=[L] KOG2795 Catalytic subunit of the meiotic double strand break transesterase
VLDALASGLRRSTTYSSTTLRELYYVVNSRGGGGGGGASEAGIVRTLRQISDALDEPRAALGVCASAKGQVAGRAHIETAAGARIDCTAAGVGGWTVAGDVFELDAMTIHSDAAYVIVVEKDAVFNRLIAERAYETLPCVLVTAKGFPDAATRKFLHLLKRALDATRPEGARFFGLMDWNPSGAWILSTYSVARDDGGGVRDALECVVPLTWIGLREEDLCLVPERALLDLTERD

SEQ ID NO: 228878 - protein, 68 aa, Glycine max
  Coding DNA Sequence Number=SeqID_112100
  Subcellular localization annotation: CTP_CleavageSite=50; ConfidenceScore=5.71e-01
MQSSPPSTVHDSPMTPSGDDARHVERRNPPARTRRASRVSRANTSASRVRAIANAGRVNSSNRRGGIL

SEQ ID NO: 228879 - protein, 115 aa, Glycine max
  Coding DNA Sequence Number=SeqID_112101
MYTNDDTILCRVFPRSLKGATLTWFGCVAVQIRNLNPEVALHSMLLALCSGMFGDSATSRWKICLDLGTKSNKPDISVTSEKEASRLTHTSRTRGTSQTSANLSQKGPSTSVTHP

SEQ ID NO: 228880 - protein, 128 aa, Glycine max
  Coding DNA Sequence Number=SeqID_112102
  Subcellular localization annotation: CTP_CleavageSite=22; ConfidenceScore=5.09e-01
MVPSYRSRLSGFQPKGLDPSKRVSRLRPNRVLTIGKRDNERLRGIFYRIPTVGAKCTYQNLELAHIKVDVAKVVSWTSHVGLRVTFVRRKGGGTCKTKDFDAQLLRVRCSCSCTRADMEGGHMSQNTK

SEQ ID NO: 228881 - protein, 197 aa, Glycine max
  Coding DNA Sequence Number=SeqID_112103
  Gene Ontology: Mol. function=ubiquitin thiolesterase activity; Cellular component=nucleus; Biological process=ubiquitin-dependent protein catabolic process
  Homolog annotation: Hit_ID=Q00XI2; Match level="QueryCoverage=82%, HitCoverage=41%, E-value=1e-39, Identity=51%"; Hit description=[O] KOG1868 Ubiquitin C-terminal hydrolase
  Pfam annotation: Domain name=UCH; Domain location=8-168; Score=47.8; E_value=3.6e-11; Accession=PF00443.19; Description=Ubiquitin carboxyl-terminal hydrolase
GASRTLLEPTVGVSLDIPASTSKTASLEACLQDFTATEEIQSHETRVCAECSVASATYEKRMRFARAPRVLNVHLKRFEGDFESMRKNDAHVRFPLVLDLSPYVSDASPSSSYYYRLYAVVVHSGVLEGGHYVAYVKRRGTWYLCDDASVEPVSQERVLAAQAFMLFYDEFTATMKPNGNAHYILCDMFPPVSQDRV

SEQ ID NO: 228882 - protein, 461 aa, Glycine max
  Coding DNA Sequence Number=SeqID_112104
  Gene Ontology: Mol. function=RNA-directed DNA polymerase activity; Biological process=RNA-dependent DNA replication
  Homolog annotation: Hit_ID=Q8H6Q8; Match level="QueryCoverage=97%, HitCoverage=57%, E-value=5e-73, Identity=36%"; Hit description=CTV.20
  Pfam annotation: Domain name=zf-CCHC; Domain location=12-29; Score =23.6; E_value=0.00013; Accession=PF00098.13; Description=Zinc knuckle
MPKQTTKPRTKVLCYNCEKLGHISKYCRLKKKLRNLNLDPSIEEQINNLLIETSKEEIGEVSSEENLNQILRDDQASSSKEKDIQEEKKVFLNKLKKSLEAKPKPKEFITNNTFDVSNILKRLENTSVKPTTIQYLQTEINSIKQEIRELRQQQEIHQIILSHFEEHSDLDNEDKREEDEGQDDEIFMGLINKIKIQKFYINIRIIINDFVLDTKALFDIGADSNCIPKGLIPTKFFEKTSEKLSTSSGSKLKISYKLSRAIIENQVLRIETNFLLVKNLKNEVILGTPFIKSLFPLQISKGGITTWHLGKKITFDFSTKLITRNINFIEKKINQINFLKDEVSFSNIQIQLEKPQLKGKIQALLKHIQSTICSDFPYTFWNRKKHIVDLPYEKDFREKHIPTKAKPIQMNEEFLQYCQKEIKDLLDKGLIRKSKSPWSCAAFYVNKQAKLERGTPRLVIN

SEQ ID NO: 228883 - protein, 262 aa, Glycine max
  Coding DNA Sequence Number=SeqID_112105
  Gene Ontology: Mol. function=2-oxoglutarate decarboxylase activity; Biological process=menaquinone biosynthetic process
  Homolog annotation: Hit_ID=Q00T45; Match level="QueryCoverage=97%, HitCoverage=17%, E-value=5e-73, Identity=55%"; Hit description=[E] KOG1223 Isochorismate synthase
  Pfam annotation: Domain name=MR_MLE; Domain location=1-100; Score =78.8; E_value=1.7e-20; Accession=PF01188.11; Description=Mandelate racemase  muconate lactonizing enzyme, C-terminal domain
AARREARSLVDAGYACLKVKVARGAGREGARADAERLAAIRREVGPDVVLRADANRGWDLSEALDFGARVQELGVGLQYVEEPTRAARESAAFHFTTGVPVALDETIDDILRESTDFAAASAAIARVADRSAGIVAVVLKPSVVGGIEETASVARIAASRGARPTLSSAFESGVGLSVIGHLAATLDDALREDVAAAKEFLVANDDTERPRAMDVKPLILELDDEPAAHGLGTATWFEDDALAPNVAPVRATKDGGACMDLR

SEQ ID NO: 228884 - protein, 310 aa, Glycine max
  Coding DNA Sequence Number=SeqID_112106
  Gene Ontology: Mol. function=sequence-specific DNA binding; Cellular component=intracellular; Biological process=regulation of transcription, DNA-dependent
  Homolog annotation: Hit_ID=Q98JE7; Match level="QueryCoverage=95%, HitCoverage=92%, E-value=1e-100, Identity=61%"; Hit description =Probable transcriptional regulator
  Pfam annotation: Domain name=HTH_AraC; Domain location=205-251; Score= 36.5; E_value=9e-08; Accession=PF00165.13; Description=Bacterial regulatory helix-turn-helix proteins, araC family
  Pfam annotation: Domain name=HTH_AraC; Domain location=257-301; Score= 44.4; E_value=4e-10; Accession=PF00165.13; Description=Bacterial regulatory helix-turn-helix proteins, araC family
  Pfam module annotation: Pfam domain module=HTH_AraC::HTH_AraC; Domain location=205-251::257-301
MSLDPFSNILRFVRAESLLTGGFTAGGRWALRFPAPDKIKFFAIIKGSCWVILEGEPEPFHFATGDVGLLSAKRAFVLTSHPDEPPVDAMSVFYGAGKGHAPIGSGDDFVHIGGHVLLDPASGRLLTHVLPPWIQVPAASPQAASFRWVLDQLVQEGQHVQPGSQLATAQLAQLLFIQILRAHLQTSSALPASWLRALNDARLAPALQRLHGDPARNWHLDELARACAMSRTRFAQYFRQVVGITPIAYLTAWRMRLAERALQEENEAVAVVAQTLGYASESAFSHAFKRETGQSPNAFRRAVRLQQAQR

SEQ ID NO: 228885 - protein, 300 aa, Glycine max
  Coding DNA Sequence Number=SeqID_112107
  Gene Ontology: Mol. function=helicase activity; Biological process =viral genome replication
  Homolog annotation: Hit_ID=Q9LW42; Match level="QueryCoverage=99%, HitCoverage=18%, E-value=7e-72, Identity=48%"; Hit description =Helicase-like protein
MMFAFTYAGIKLDKSINESRGPPTIRIQGQPCHRIDSLLPMPGKQPKFSQLYIFDTQNEVENRINTMSQHVGIQPEIVSTLSQMLDEYNVHAKSFRMARDRLTDTQVDNVKLRLIATREKDGRTYNLPNVSEVAALIVGDFDPDSRRDIIFETQNGELQRIHELHSSYLGLQYPLLFPYGEDGYRPDILHRCTPSSRKRKRNRLTMREWFAYRLQSRSNEAQTLLHFRKLFQQFIVEAYTIIESERLSYIRNIKKKLRVDKYCSLQTSLDAGSSKGSSKEKRVILPSTFVGSPRYMDQLI

SEQ ID NO: 228886 - protein, 208 aa, Glycine max
  Coding DNA Sequence Number=SeqID_112108
  Gene Ontology: Mol. function=phosphatidylinositol N-acetylglucosaminyl transferase activity; Cellular component=integral to membrane; Biological process=GPI anchor biosynthetic process
  Homolog annotation: Hit_ID=Q010D8; Match level="QueryCoverage=84%, HitCoverage=52%, E-value=6e-22, Identity=36%"; Hit description=[I] KOG3059 N-acetylglucosaminyltransferase complex
MWRFAVGIVIMTRAVADGRVARDDAPRTSGRAYRVLYEDDAGEREDNYTDPETFLARMRLNRSVKTRSYATSALAAWTISQQCAVVVIQSGSHAAVASGRVDVGTVTRAEIGALAAGLTAWALGGVGRGDDDGGRRWTMARVIRRVMRSVRLGALTIGGLAALTPLCQTMTAAVSSDTAAMCATLALALYAITYDYAFINLETKRGIL

SEQ ID NO: 228887 - protein, 253 aa, Glycine max
  Coding DNA Sequence Number=SeqID_112109
  Gene Ontology: Mol. function=binding
  Homolog annotation: Hit_ID=Q00SY8; Match level="QueryCoverage=96%, HitCoverage=38%, E-value=1e-41, Identity=42%"; Hit description=[R] KOG4549 Magnesium-dependent phosphatase
  Pfam annotation: Domain name=TPR_1; Domain location=40-76; Score =17.7; E_value=0.042; Accession=PF00515.18; Description =Tetratricopeptide repeat
MVKRIMLNASACLMNADLGKNASEIEWATTQALRADAASAVAHYRRGCARATMVDEHAMEKALDDFRRAVALDPDENRYARALSECARRVAAAKSASRAMFGKIFSSDKAIYDGIDESEDAHVLTKRKCNAEDEVARVLRDESLKSKAREMGFDVDSEAFQSEFAALIRKEIDSNIHRETRTFGLKSCVEWISRAFGFADIGEAGTRSESSDFRASSSRLVVYASAAILVARLTYVVYALLTKQSLESVRVRA

SEQ ID NO: 228888 - protein, 175 aa, Glycine max
  Coding DNA Sequence Number=SeqID_112110
  Homolog annotation: Hit_ID=Q016C7; Match level="QueryCoverage=86%, HitCoverage=61%, E-value=1e-14, Identity=33%"; Hit description =Chromosome 06 contig 1, DNA sequence
VSRFWREVERSFRGLGDDAGREGRPGRAYANLFGRSHATRFRVTQATAIAFVFALALEWIVLVFYFARRRERRGGFATASSTTYSGAGAAAAICACVAHASIVAYVRADTPTHVPGLRKANFTAYLGWGYWMFLTCGCAHLVSFVFSLVEWDRASKARARRRRREALGNDLSRDA

SEQ ID NO: 228889 - protein, 316 aa, Glycine max
  Coding DNA Sequence Number=SeqID_112111
  Gene Ontology: Mol. function=magnesium ion binding; Cellular component=nucleus; Biological process=regulation of transcription, DNA-dependent
  Homolog annotation: Hit_ID=Q00T27; Match level="QueryCoverage=99%, HitCoverage=50%, E-value=4e-76, Identity=49%"; Hit description =Chromosome 17 contig 1, DNA sequence
  Pfam annotation: Domain name=Exo_endo_phos; Domain location=81-316; Score=-5.5; E_value=0.027; Accession=PF03372.13; Description =EndonucleaseExonucleasephosphatase family
YDEMLTTLFTATDDTIIDHFVLQNIDKTWLLHPSLTVQGHLDISNVLQHRVQELFETNLQTQTPRPRPSSRVMTSPPSPALRVATYNVLAQVYAKSSWFPWTERRLMKSKTRRDAIRTYIEKLNVDVLALQEVDGYEDDEENAKSGGGWKTWLASRGYESTYVRRTNVSNAKKDGSCVAWRRDVLEEIERREIAYNDIANEMYPSTSETADGDDDAATVEARSRYLRDCVGNLTLLRRRATDEEIVFASTHLYWDPAFADVKLSQAKKLIEECRRFRADRERATNGVNKVRVVVGGDFNSVETSDVYREMNAAFPS

SEQ ID NO: 228890 - protein, 193 aa, Glycine max
  Coding DNA Sequence Number=SeqID_112112
  Homolog annotation: Hit_ID=Q019Z8; Match level="QueryCoverage=78%, HitCoverage=74%, E-value=1e-33, Identity=51%"; Hit description =Chromosome 05 contig 1, DNA sequence
GAIVVSSPSELPNENGTKRPMVTVTDEEVANLEAYLQSGFGLVHDDGRDGDGRRVLVVNATRVPGWAGSADRDAALRLITKALTRAGAEGGGAESHPRVASRHARGVGAGDAEKRDENRLRQRVVVHGRAHLVDHDVYELQDEGEVCVGELFAHDGEGERVLREPHDVRRSVFAIRPLRAANRGVFVIRFDYG

SEQ ID NO: 228891 - protein, 119 aa, Glycine max
  Coding DNA Sequence Number=SeqID_112113
MAEQAKHVFYVQDPCDERWSVVLHRKTIDVNVEDDDSIVDTCCRDLPFGGRAMRGSWVCLPREEGAWTRHQHLFGENVRKTRTCGLRTLIVKGSGVIFTHGEGVVDKSGAFAPAYPQLR

SEQ ID NO: 228892 - protein, 260 aa, Glycine max
  Coding DNA Sequence Number=SeqID_112114
  Homolog annotation: Hit_ID=Q015E1; Match level="QueryCoverage=99%, HitCoverage=58%, E-value=1e-80, Identity=61%"; Hit description =Chromosome 07 contig 1, DNA sequence
KPARLWQWTCTCPSTARRSRTNTCALVNPDVDREGAIEAGLDAAGLDGTEEREVARRALAKTREGGAKPWCTLIGSDFSAGNHFVHLPLMAEYLDGAILDPYSKAYAHALVWRWADACKRVGAGKHEVTLRCAPLGIFVPESNACTFTGNVDDARARPEGFKAFLNELRKEYETSPNAPGMSATFSLTLRDEHCTGDKVERQAQEWAVDWPTDEIAECYTTALELANTGAPGKMAAEMVPGAVCCHVVLPSTEGQSGIAE

SEQ ID NO: 228893 - protein, 150 aa, Glycine max
  Coding DNA Sequence Number=SeqID_112115
  Gene Ontology: Mol. function=zinc ion binding
  Homolog annotation: Hit_ID=Q9FHX1; Match level="QueryCoverage=54%, HitCoverage=13%, E-value=3e-12, Identity=78%"; Hit description=TMV resistance protein-like
MSELLSVCQERHLFIALMGKKKVFKVTGRVTSLSVCSLIFQVIRVILYIVVQVLIAMKNGAQLLKYGRKGKPKFCPFRLSRICKDKVEAEVWIAGLKALISSGQGGRSKIDGWSDGGLILNATFDMDARREWDNIWVLFYVLCILKSEWY

SEQ ID NO: 228894 - protein, 219 aa, Glycine max
  Coding DNA Sequence Number=SeqID_112116
  Gene Ontology: Mol. function=translation elongation factor activity; Cellular component=intracellular; Biological process=translational elongation
  Homolog annotation: Hit_ID=Q014G4; Match level="QueryCoverage=66%, HitCoverage=18%, E-value=6e-65, Identity=83%"; Hit description=[J] KOG0465 Mitochondrial elongation factor
VDSRGSHFNTGDRVKETDGAVEHAKRAFNLQGEVDVARGVDNVDAVILPRARRRGGRNRDTTLLFLFHPIHGGGAFVHLADFVRATRVVQDALRRRRLTGVDVRHDTDVTVLFQRDSTLFRLFTLGGANHARSRRASGGLLQKWENRASHRVSQSRRPSPSTHHMHSFARERRATPTSRRRSDEKGRTIFLSIPLPPRLSPSRPRASVLRAPTARARKG

SEQ ID NO: 228895 - protein, 337 aa, Glycine max
  Coding DNA Sequence Number=SeqID_112117
  Homolog annotation: Hit_ID=Q010R6; Match level="QueryCoverage=98%, HitCoverage=96%, E-value=2e-78, Identity=49%"; Hit description=[J] KOG2147 Nucleolar protein involved in 40S ribosome biogenesis
GAVKSAFESVSHGRKFDILGRKVKGARGNVLKARTEAVEKRRRTLLREHEASGKANAFVDRRFGEYDDGLSKEEKSIGRLAKARLRQLKKSKNFSLAEEGDDDDDEYTPPRDHRKIGPSACPRTSPNKSVALDGIFGQTLEEKKLSSTALNGAVACLRQLSRAAVKTPSASELLSPIRGSIVNLRKALKKTNKELAELCDAFVKELDDGLAGAVKSPLAYHKKVAEAIKTYNPMYEEDGYQKGRDYDPNRERAEARKLKKQLKQESRGAMRELRKDNRFMADARSKEQAEAADERDARQKDLLSFLEKQEADFKSGGQGGQIVKNKRRVSKGSRRAF

SEQ ID NO: 228896 - protein, 49 aa, Glycine max
  Coding DNA Sequence Number=SeqID_112118
MGVHVLVRTSGTSLPTSITLMERSSSCKVILVGMIYNSPNLMHMESGIK

SEQ ID NO: 228897 - protein, 315 aa, Glycine max
  Coding DNA Sequence Number=SeqID_112119
  Gene Ontology: Mol. function=ATP binding; Cellular component =endoplasmic reticulum; Biological process=chaperone cofactor -dependent protein folding
  Homolog annotation: Hit_ID=Q00TR0; Match level="QueryCoverage=72%, HitCoverage=62%, E-value=2e-86, Identity=70%"; Hit description=[R] KOG2170 ATPase of the AAA+ superfamily
  Pfam annotation: Domain name=Torsin; Domain location=80-315; Score= -167.4; E_value=0.0061; Accession=PF06309.2; Description=Torsin
MRRESSDVVARADGGGRRAMRLMVVTIAIACVSHLVDATHAATMGAALDAGARAVSSNAVGAFARAVELAKRVTTGRTRCGLNGFFCEEDLCERARAATTEELMGQPTGVELVLDALCDHVETPSERLRKPLVMSMHGSPGTGKSTFHRILARAAYNATTRGSGEDAGRYACPGRGCPGYKVIFGTDYVVREREAQARMLRDAVTRHVERFPESVLVVEEYDKLGCPARGMLKQMLEHGSAGGEGNPFDRNVTFARSIFVLEANMGFMDVHDASAANGRRVGGDALVALQRKLKDGLFEKWRKDGCEDREDTLKV

SEQ ID NO: 228898 - protein, 98 aa, Glycine max
  Coding DNA Sequence Number=SeqID_112120
MAHMLSTIPDTGIKDVARKSLLHELINVLQSSKNLEEKILASLALKTFINDRIAQQPLRAYAKSIYKIITKINKYSTVVVHIMKTLLNLNSVDVVSTE

SEQ ID NO: 228899 - protein, 71 aa, Glycine max
  Coding DNA Sequence Number=SeqID_112121
MLRQLLIPDVALGATLALSAKPTPSDDKPLEKTSKIALTSTYARKHDHVYKCAIIRQEAKAYIMPFVIADE

SEQ ID NO: 228900 - protein, 275 aa, Glycine max
  Coding DNA Sequence Number=SeqID_112122
  Gene Ontology: Mol. function=methyltransferase activity; Cellular component=cytosol
  Homolog annotation: Hit_ID=Q74T59; Match level="QueryCoverage=90%, HitCoverage=74%, E-value=3e-98, Identity=67%"; Hit description =Predicted SAM-dependent methyltransferases
  Pfam annotation: Domain name=Methyltransf_10; Domain location=48-275; Score=402.1; E_value=8e-118; Accession=PF05971.2; Description=Protein of unknown function (DUF890)
MGDPVVIDEVFIVPGFPPLRHCGRDVLSYAPEIPSREPVTVEKKKTFPQQKSGLHPRNRHRSRYDFPALIASCPALAPFVKPNAWGDVSVDFADPAAVKMLNRALLQHFYGIEHWDIPADYLCPPIPGRADYLHHLADLLATSNGGEIPRGKGVAILDVGVGANCIYPIVGLREYGWRFTGSEIDSVSLNAAKMIVEMNPTLRNSVRLRLQKQPELIFSGIIGAAEKFDATLCNPPFHASEQEARASTRRKLHKLGKGEVADKPVQNFGGKNNEL

SEQ ID NO: 228901 - protein, 80 aa, Glycine max
  Coding DNA Sequence Number=SeqID_112123
GNTGSNKDRRKSLKVYQSHTVRGEKVASAQDFVGNQRERTTLGRGKDRHSHPRSRFMVSWDSGSRLVERLVMIYVRVWPA

SEQ ID NO: 228902 - protein, 302 aa, Glycine max
  Coding DNA Sequence Number=SeqID_112124
  Homolog annotation: Hit_ID=P77694; Match level="QueryCoverage=78%, HitCoverage=47%, E-value=2e-81, Identity=57%"; Hit description =Hypothetical protein yagW
SQLARCEQQLAVRRPAAHLALSRPIDGANAHLIQARAAGADIDCSGGKGEGQTQQPYQHKFHALPSIDVAPGGFDMNFTGGADVAVPTVAVDGSQRDRIIHRNAKGHAGLVQHPHFTGNIIPRGAAPERIGHVVPLAIAAGGEALLAVGAGGDAEGGGKRHLGTVIRGRKEAIVHPVDRLSRPGRHHPHLIGGGFAAGSHQVAELQRRLRRADITFTMWAVVVIIGNNADAEIARLDNQLIAGAAVGNPQRNHLFEEITGEEHIDGVAALQLVKGIVAAGARRVFPGVAVQTELQVGGVHRG

SEQ ID NO: 228903 - protein, 156 aa, Glycine max
  Coding DNA Sequence Number=SeqID_112125
  Gene Ontology: Mol. function=RNA-directed DNA polymerase activity; Biological process=RNA-dependent DNA replication
MGKALPDLGASVILMPLSLIKKIGDVEIKPSRMALQLADRTIKNPYGIIEDVLVKVDKFLFPSNFVVMDMDEDNEVTLILGRPFVKTTRVVIDVDDEKLSVRVQDDEVQFNVFKAMKHHMDKKEFFKIDILDEVIFESKKMISRKDYLEKPLTEEV

SEQ ID NO: 228904 - protein, 67 aa, Glycine max
  Coding DNA Sequence Number=SeqID_112126
MAERAKREANRRPRRTLGDYANQQGPKHFSNIVIPPSSTIGTYVEDVEVISLRVFPFSLTAKAKTWL

SEQ ID NO: 228905 - protein, 120 aa, Glycine max
  Coding DNA Sequence Number=SeqID_112127
MILDVAARVTMMSKILEEAIVIIVSIAASDYQGHHDRAHVHRKGIMELDTPNSILVQNMLISQQIKALTKKRKYTICRIKDDHNNVSKGITKVIKVVMVLQIEVHHNNNNLIECQRWKRL

SEQ ID NO: 228906 - protein, 44 aa, Glycine max
  Coding DNA Sequence Number=SeqID_112128
MAAELGQLTVEISTLVTPVAHDNSLVLLAALMNRRTYHERCHCI

SEQ ID NO: 228907 - protein, 190 aa, Glycine max
  Coding DNA Sequence Number=SeqID_112129
MAEDSKGQVLLSSNSYCFGGSDNGMKGNVLKNETLKNVRPSSFSPKAYKMEGSCNSKINNTKNDNNLMSNCSNKDMFLDSYTTTFAKRNTHGLSTRKTLEDELYRLLGYGKLNPLLDLPCRAKLSYYHEELGCDNLVVYVYLNAVLVEFSPTREIYGRCLIRIRLNYHEELRERKGIANLSTEWEKKGVS

SEQ ID NO: 228908 - protein, 106 aa, Glycine max
  Coding DNA Sequence Number=SeqID_112130
  Gene Ontology: Mol. function=transition metal ion binding; Biological process=cytoskeleton organization and biogenesis
MEEKHVEKNVCDSVIGTFFNIQGKTKDGLNTRHDLAEMGIRAQLHSKSNVERCMNILKGYTKNLHRPKASIVERYIVEEAIEFCLEYIEKAKHVGLPESRHGKRVG

SEQ ID NO: 228909 - protein, 155 aa, Glycine max
  Coding DNA Sequence Number=SeqID_112131
  Gene Ontology: Mol. function=transition metal ion binding; Biological process=cytoskeleton organization and biogenesis
QNSGATLRVESQHFASVNDVNPCVASIPYFGFIDDIWELNYVKFTVCVFKCKWVDSNIGVRTDDIGFTLVDLKKLGYHNDPFIMAEQARQVFYVQDPCDERWCVVLQGKTIGVNVEDVIHTWTPMYSSLLLAGSGSIIFLLARHIDLVVQTAFAI

SEQ ID NO: 228910 - protein, 101 aa, Glycine max
  Coding DNA Sequence Number=SeqID_112132
MYVHVLEIPRCAHVQFLVPQNALSMHVCKFSQGDVCDEMAPRKLASKRSRKDKAAEGTSSAPEYDSHRFRSAVHQQRFEAIKGWSFLRERHVQLKTLKKRY

SEQ ID NO: 228911 - protein, 421 aa, Glycine max
  Coding DNA Sequence Number=SeqID_112133
  Gene Ontology: Mol. function=oxidoreductase activity; Biological process=electron transport
  Homolog annotation: Hit_ID=Q01GI3; Match level="QueryCoverage=52%, HitCoverage=73%, E-value=2e-58, Identity=49%"; Hit description =Chromosome 01 contig 1, DNA sequence
  Subcellular localization annotation: CTP_CleavageSite=35; ConfidenceScore=5.77e-01
SPSSPSYPIPRIASAYAPAHRNRSPTLSSSLGNVSASLPRHVSSTRTTHARTTRTNSPAFSSYARTSSSVSEIPAARSATTSTSSASAPRASAVMPRSTRARAPECRRRAPSHSHRDSAVVKTRRVVFVAVLVDGDGEAMTERERETVEEREEDVDDADDLAALVPKMLTRGEPVETGNNDDESGESLVWKEAAGLRTAQAREHTAVLAWIALDTLWSQESEWVFAPMVIVCVYFTHSAWASWREDAKDFPHALAVFLWLVGANTVWVWMDVLGSSHALLKAWCIVCFAWSILIETVQLSSLVVDIRDVSARDLSDAFESLVILSWAAHDLVNFVYYSFSGTSRFYILFMWWLFSVIIIVQSTYYLLVQIRIFCSRPRSHSVEYALALFAWSVGVMLWEFGDFYAPEDQDPENIFEEPTNS

SEQ ID NO: 228912 - protein, 78 aa, Glycine max
  Coding DNA Sequence Number=SeqID_112134
MPEVERKHCRTIRKGVQIETRPTWAFQEVLQKAVPSGGSKLARLGELSSLGRAGWQDVSVGDFAKIFNRSSSFFGLQP

SEQ ID NO: 228913 - protein, 280 aa, Glycine max
  Coding DNA Sequence Number=SeqID_112135
  Gene Ontology: Mol. function=DNA-directed DNA polymerase activity; Cellular component=epsilon DNA polymerase complex; Biological process=nucleobase, nucleoside, nucleotide and nucleic acid metabolic process
  Homolog annotation: Hit_ID=Q00YV3; Match level="QueryCoverage=99%, HitCoverage=11%, E-value=1e-130, Identity=84%"; Hit description=[L] KOG0969 DNA polymerase delta
MCVLYDSLQLAHKCILNSFYGYVMRKGARWYSMEMAGVVTNTGAKIIQMAKRLVDDIGKPLELDTDGIWCCLPGTFPETYSFKIKGEDKPYEISYPCVVLNHMTKVQNTNDQYQTLVRDEDGKPLRYETSSEMSIEFEVDGPYKAMILPASKEEGVLIKKRYAVFDEEDKLVELKGFELKRRGELKLIKVFQSEVFDFFLKGKSLDEVYQAVGAIGNRWFDMLKTEGANFEDDELLEYISESSVMSKAAIEYGDRKSTSITTANRLAQFLGADLIKDKGL

SEQ ID NO: 228914 - protein, 281 aa, Glycine max
  Coding DNA Sequence Number=SeqID_112136
  Gene Ontology: Mol. function=transferase activity, transferring nitrogenous groups; Cellular component=membrane; Biological process =biosynthetic process
  Homolog annotation: Hit_ID=Q00UI1; Match level="QueryCoverage=98%, HitCoverage=62%, E-value=1e-126, Identity=80%"; Hit description=[E] KOG0258 Alanine aminotransferase
  Pfam annotation: Domain name=Aminotran_1_2; Domain location=1-266; Score=79.3; E_value=1.2e-20; Accession=PF00155.11; Description =Aminotransferase class I and II
MVRLSGADSVVVRTTADEGFLMTPEKLRAAITERSRLLILCSPSNPSGAVYPKETLEELAKIVVEHPRLMVLSDEIYEHIIYAPAEHHSIAAMEGMWERTMVVNGFSKSFAMTGWRLGYVAAPKHFARAMNMLQSQITSGPNSISQEAALAALELGFKGGEDVAEMVKAFRQRRDFVSERLNAIPGVKLPSVDGAFYVFPDVSAFFGGDASAEGFGPVTDVDELCRYILEKGQVALVPGSAFGVPECLRISYAASEATLEDALTRIEACLDPKVFTQNSSA

SEQ ID NO: 228915 - protein, 302 aa, Glycine max
  Coding DNA Sequence Number=SeqID_112137
  Gene Ontology: Mol. function=endonuclease activity; Cellular component=nucleus; Biological process=tRNA processing
  Homolog annotation: Hit_ID=Q012M6; Match level="QueryCoverage=77%, HitCoverage=24%, E-value=1e-89, Identity=66%"; Hit description=[A] KOG1801 tRNA-splicing endonuclease positive effector
MSMFKRFERCGYPVHVLKTQYRMHPAIREFPSKFFYDDVLKDGPGMTTLNARPWHAYSAFRPFVFYDVKGKERSTSGHSWANDEEAEFCVCLIQSLLKRFPKLGSDRSIGVISPYKAQVNTIRAKLGEKLGVAKARAIDVNTIDGFQGREKDVCVFSVVRAPQDSARARARGLGFVADERRVNVGLTRARSSLFVVGSAESIRGDANWGGVVAHATEKNCAVTPTKPYTAFFTKHTKEPDADAGADADRETSDASLVGEPATLASAAASPKKKHIHDPHWSGAAEFIRTNALNDNATGFAKD

SEQ ID NO: 228916 - protein, 351 aa, Glycine max
  Coding DNA Sequence Number=SeqID_112138
  Gene Ontology: Mol. function=structural constituent of ribosome; Cellular component=intracellular; Biological process=translation
  Homolog annotation: Hit_ID=Q00WI4; Match level="QueryCoverage=71%, HitCoverage=92%, E-value=3e-68, Identity=36%"; Hit description =Chromosome 14 contig 1, DNA sequence
  Subcellular localization annotation: CTP_CleavageSite=39; ConfidenceScore=5.31e-01
VITRSQNRLASMAFYQWSGLVMSKARHAALVSRFVTRMRVREVSAAINKWYDVMENEKRKRTVFTKVLRTITQKHLAATFNRWREFAAESYDVKVRLRKVVSHMLRLRLSQAFTLWNERTVEMRRQRAVVGRFVARMRNRRLASSFTHWLDVVEERKQTDQRVAYRERLAGNIMARMNRSTLRAAFDKWYSVVEEREMHREMLRRMLRTKRVAMNFFMTWYWDAFDGDIQDTMADMFGATRTFMNEAFEGSSLDLAPRPTALDFIAHRENDVNVFASERSFDDGDFDDASKSERFTSSPPAPEWRSSSSGDYPGYDDGSRSAFHVPRNDARARDDVGDDARLIRVTSGFSP

SEQ ID NO: 228917 - protein, 338 aa, Glycine max
  Coding DNA Sequence Number=SeqID_112139
  Gene Ontology: Mol. function=amidase activity; Cellular component =flagellin-based flagellum; Biological process=peptidoglycan catabolic process
  Homolog annotation: Hit_ID=Q8A7I6; Match level="QueryCoverage=92%, HitCoverage=87%, E-value=5e-54, Identity=40%"; Hit description =Hemagglutinin
  Pfam annotation: Domain name=Glucosaminidase; Domain location=31-161; Score=122.9; E_value=8.9e-34; Accession=PF01832.10; Description =Mannosyl-glycoprotein endo-beta-N-ace
  Pfam annotation: Domain name=LysM; Domain location=247-290; Score =12.0; E_value=0.031; Accession=PF01476.10; Description=LysM domain
  Pfam module annotation: Pfam domain module=Glucosaminidase::LysM; Domain location=31-161::247-290
MKRLFLLVSLLVLSKFSAQTWATEDQYIQKFAQYAVEEMEKYKIPASITLAQGLLETGGGQSRLALEGKNHFGIKCKEDWTGKTMKHTDDAPNECFRVYEDPRQSYEDHSIFLSTRKYYTNLFKLDMKDYRAWAYGLKKAGYATNPRYASILIGKIERYKLYEFDNTNSKEVLYAVLSLYPNLKDDRTFMAQLVPSKVAKKDPVTVNVPYKQTSYAQQQKRVERIKTKAEILNSILIKSHPNDGLKYIVIPEDTDVKYIANKFKVSEGRLIKWNELEGTALKKNDIVFLESKNSTGNTAVYKAESGEDMHDIAQKFGIKLHKLYAKNRMDEGQQPSPG

SEQ ID NO: 228918 - protein, 329 aa, Glycine max
  Coding DNA Sequence Number=SeqID_112140
  Homolog annotation: Hit_ID=Q00TV2; Match level="QueryCoverage=36%, HitCoverage=17%, E-value=4e-32, Identity=59%"; Hit description=[P] KOG2662 Magnesium transporters: CorA family
  Subcellular localization annotation: CTP_CleavageSite=39; ConfidenceScore=5.35e-01
MCVHVHASSAHGIVVKHTNTVPSPSHPEESLFRSLARVVVDTRVRVPRRRGDMPIDFATVRARARERARETVDRDAIGAGDGAGDVDARATGDYDYDDLDLNENVIDDDVFATHATTVIPGISLCDEFIDEDTARALEARVMREPASSWTMKTRGRRVMNSGGASPSAPYRDEDARKVPMYAKTMMRYVFRRGAAMKEPNHVLVNEYEANAGVTPHSDGDAYEEDAAILTLRGRAMIEFWPSEGASGGDEGEGEPVVSFVLEPRSLLMYRGDAYRLRHGIRERGEDVVTRTTANARALGLEVGDVIKRNPLGRLSVVFVRKKRADSVED

SEQ ID NO: 228919 - protein, 166 aa, Glycine max
  Coding DNA Sequence Number=SeqID_112141
  Gene Ontology: Mol. function=GTPase inhibitor activity; Cellular component=signalosome complex; Biological process=red or far red light signaling pathway
  Homolog annotation: Hit_ID=Q01BN5; Match level="QueryCoverage=86%, HitCoverage=32%, E-value=1e-42, Identity=59%"; Hit description=Was fused to ot04g00130
  Pfam annotation: Domain name=PCI; Domain location=3-107; Score=53.6; E_value=6.4e-13; Accession=PF01399.17; Description=PCI domain
AAADLREVLHNFYNSKYTACFSTLDNVRSTLALDIHLGAHIDALYECIRDRALIQYVKPYVTVDLTRAADSFSATTEEIQDEVTRLIRDGKIRARIDGNAKALRIIDEPSASTLLKHIAADGEKFEDETHAALLRLSLLRNDVIVRDARQHQQDDPRRRAQALTDC

SEQ ID NO: 228920 - protein, 235 aa, Glycine max
  Coding DNA Sequence Number=SeqID_112142
MLSPFFFSIALQLRLPAIRQPLILQFKAAFHCDKDAIEIPGFYQRQWLPNYPEIVEFKYDGETYEIQVRQHKGKLYFADGLTRLRTELQIYESVTINFVACDHPLKFDLHFTPPLDQQKCKRRRATRKHIWTYEITQSMLGAPYPLQLPASVTQYLIHCGNHMTILRRFEPPLQWNVVVLDKGIGDKYVTLPWYKFLQEDDFSHGDELSFYYRRVEKIWEVVIRRAIDWDDSDID

SEQ ID NO: 228921 - protein, 72 aa, Glycine max
  Coding DNA Sequence Number=SeqID_112143
MRGAPSEKSIAPFIARGFSDPNARMLQRVQKAWNAVQRKDKELGGSDNGIVGGYHKWLKARTQEITWHPMLK

SEQ ID NO: 228922 - protein, 105 aa, Glycine max
  Coding DNA Sequence Number=SeqID_112144
MHRRPQTHRHHLIRLIRLDHLAWSGIYSTWFASRRPTTGGRYRYMSVSTSSASVSRAKVSLLLCALLQISSGLRLHGPEIGLRPRQGRRPQRLPAMQRRPAWMRS

SEQ ID NO: 228923 - protein, 55 aa, Glycine max
  Coding DNA Sequence Number=SeqID_112145
MENSPWPQQQGPSLYDRMMKLEETLSQFMQVSISNQKSTESAIKCDILEISTRNF

SEQ ID NO: 228924 - protein, 133 aa, Glycine max
  Coding DNA Sequence Number=SeqID_112146
STPRGSHYLRVNVCRMTKLGLCLPTDTTVPEWQRGADNRKVSPRIIMTKLGLCLPTDTTVSEWQRGADNRKVSPRIIMTKLGLCLPTDTTVSEWQRGADNRKVSPRIIMTKLGLCLPTDTTVSEWQRGADNRK

SEQ ID NO: 228925 - protein, 136 aa, Glycine max
  Coding DNA Sequence Number=SeqID_112147
  Gene Ontology: Mol. function=potassium ion transporter activity; Cellular component=membrane; Biological process=potassium ion transport
  Homolog annotation: Hit_ID=Q5MWW0; Match level="QueryCoverage=97%, HitCoverage=15%, E-value=3e-40, Identity=63%"; Hit description=High -affinity K+ transporter
MSGEADRTSIEEEMDTGKETAEKNLKLKDRKVSWAKLRRVDSLNLEAGRVSTVAHNPYQMGWRTTLILAFQSIGVVYGDIGTSPLYVYASTFTKKINNNDDILGVLSLIIYTIVLIPLLKYVFIVLWANDNGNGTF

SEQ ID NO: 228926 - protein, 76 aa, Glycine max
  Coding DNA Sequence Number=SeqID_112148
MVVVHAARFIVFRCLSDRARDLAFSLLSMGRPSSTLLSFMEHPLIDRQTWCHCSRVASSMTGSASSMSLAEKAPPS

SEQ ID NO: 228927 - protein, 296 aa, Glycine max
  Coding DNA Sequence Number=SeqID_112149
MCGGKEILLYSKRGKSGEIQRQRLEREREPFLSWMQNKIGGKQDNRKPNTYTTTHDAKQEPREEFSDWPDGLLAIGTFGNSNEVKEKTEKHILREDPSSSEEIADFTPEEIGKLQKELTKLLRQKPNVEKEIAELPLDRFLNCPSSLEVDRRISNVLCSDSEDKDKDEEEREKEEEEDIEKTLSVILGKFKEICANNSKKAIGKKSISFLLKKMFVCRSGFAPAPSLKDTLQLQESRMEKLLRIILHKKINSQHSSRALSLKKRLEDRKMPKEDEAENDDGCKWVKTDSEYIVLEI

SEQ ID NO: 228928 - protein, 51 aa, Glycine max
  Coding DNA Sequence Number=SeqID_112150
VEGDVQESDVVQGKEIRGETAAQVVDIGKFFGTQKARLYGSKGLRNWRGEA

SEQ ID NO: 228929 - protein, 80 aa, Glycine max
  Coding DNA Sequence Number=SeqID_112151
MKYNIGKNLTLLTWYSHPKLKLSLIKEKDMQAYLGEHLQAATTKRHEAELTVLRKSATCHAELGGATSFAEVTVLREKEF

SEQ ID NO: 228930 - protein, 190 aa, Glycine max
  Coding DNA Sequence Number=SeqID_112152
  Gene Ontology: Mol. function=RNA-directed DNA polymerase activity; Cellular component=chromatin; Biological process=chromatin assembly or disassembly
  Homolog annotation: Hit_ID=Q1SPQ1; Match level="QueryCoverage=28%, HitCoverage=10%, E-value=4e-15, Identity=68%"; Hit description =Polynucleotidyl transferase, Ribonuclease H fold
MAGTTKVNKDYIVFGLQWHVRSVFGPNDQRKGQWAINTCPISNDFVLKVMGRQRLLPEEEDRWGALEEKEEGHERNAWAEKRGTQDESGHSWGGPETSKIEQEPQRSGNRVGAQSLTLKGMADQGLIGGTNKIVSFHLAVSLRMMSCGIFQLSALETEQFVPKLTKEDPILICDNRTGQPMKSINLNREV

SEQ ID NO: 228931 - protein, 450 aa, Glycine max
  Coding DNA Sequence Number=SeqID_112153
  Gene Ontology: Mol. function=RNA-directed DNA polymerase activity; Cellular component=nucleus; Biological process=RNA-dependent DNA replication
MPVKCIADEIGTQRETQNQDTFKHDSKMMLKMPQQWTKPVKKIVRMKNKVEDGSMEGITDRSRGWYCSNTVWIDGCLKSASIYILVNGSPTAEFTPQRELKQGDPLAPLLFNIVAEGLTGLMRKAQENNLFEGFTVGRNNVEISILQYANDIVFFGTATMANVRASKVMLRNFELVSGLKINFAKSSFGAIGMPEQWMNSVVSYLNCRLFFVPFPYMDIPIGANPSRSGTWDPIVNKCERKLSKVPKKVVDKLVRLQRDQKKIAWVNWGLVCLPKEKGGLGIKDSVKFNYVFLGKWRWNLFHHQGDLWAQVLDSKYGGWRNLDETRRNNTESLRCETKWNVGCGSKVMFWEDGWKDDGVSLMKYPRLYHTSQQKYQYIQQLGMTSNGGWEWKLQRRRFLLEAEIDMATKLMEDIEGLIVQTQRQDNWVWQGDSSGTYTVGNAYMLLDRDS

SEQ ID NO: 228932 - protein, 105 aa, Glycine max
  Coding DNA Sequence Number=SeqID_112154
  Homolog annotation: Hit_ID=Q7XAC4; Match level="QueryCoverage=71%, HitCoverage=7%, E-value=5e-26, Identity=73%"; Hit description=PAUSED
MGNLEHTRYYEQLSWGTWSILGALREHFVLFGEIVLAQKVMYEKFGDDFLVHFVSKGFSSAHCPPDLAEQYRQKLQGGDFKALKSFYQSLVENLRLQQNGSLIFR

SEQ ID NO: 228933 - protein, 730 aa, Glycine max
  Coding DNA Sequence Number=SeqID_112155
  Gene Ontology: Mol. function=receptor activity; Cellular component =nucleus; Biological process=transport
  Homolog annotation: Hit_ID=Q9CAH2; Match level="QueryCoverage=96%, HitCoverage=74%, E-value=0.0, Identity=62%"; Hit description =Putative exportin, tRNA (Nuclear export receptor for tRNAs); 81050- 85729
  Pfam annotation: Domain name=Xpo1; Domain location=104-257; Score =157.6; E_value=3.3e-44; Accession=PF08389.2; Description=Exportin 1 -like protein
MDDLERAILVIFDESGTLDDDLKKQAELYCNDVKEKPLICRLCIEKLCFSNLVQVQFWCLQTLHEVIRTRYLTMTPDERHMIRGSVFSIVCLEDKNLTRVLEGPAFIKNKLAQVLITLIYFEYPLVWSSVFVDFFPHLSKGNVVIDMFCRVLNALDDELINLDYPRTPEELTVAGRVKDAMRQQCVCQIVRVWYDIVSMYRNSDQELCTSVLDSMRRYISWIDIGLIVNDAFIPLLFDLILVGPLSVQLRGAAVRCLLAVVSKRMEPQSKLSLLRSLQISRVLRLVTEDGDAELVSDIAALLSGYAVEALDCFKHLNSEDAKGISMELLSEVFPSIFYVMKNFEVDVNIIQFLSGYVAILKSFAPLPEKQLLHLGQILEVILVLIRYDPAYRTNLDFMDKIGKEEEDRMVEFRKDLFVLLRTVGRVAPDVTQLFIRNSLASAVSRSSDSNVEEVEGALSLLYALGESISEETIRTGSGLLSELLLMLLSTKFPCHSNRLVALVYLETVTRYVKFIQDNTQYIPMVLAAFLDERGIHHSNINSLQDTVAQFTITNYTTEELSGSEDGSHIFEAIGLLIGTEDVLPEKQSDYLSSLLSPLCQQVEALLKNAKLLNAEETNAKIAVTQQIIMAINSLSKGFSERLVTASRPAIGLMFKQTLDVLLQVLVIFPKVEPLRNKVTSFIHRMVDTLGASVFPYLPKALEQLLEEIEMFMFWGCKGHLNVMALRILFL

SEQ ID NO: 228934 - protein, 363 aa, Glycine max
  Coding DNA Sequence Number=SeqID_112156
  Gene Ontology: Mol. function=RNA-directed DNA polymerase activity; Cellular component=chromatin; Biological process=chromatin assembly or disassembly
MVAFYMKRDALEWYQWMHTNHQLSDWGQPFKWCQHTSDSDYQLQFEKLCNQVYGLTPDAILNCFISGLNPDIRQELAILRPTSFSNAIGLAKLIEDKVKGTCSRTNLCSTPTSVPTTTPKAKQYLLLLMDKDTSESTPDILASSSSHEDLVQETHDTSVHLQLSLQALDGTSSLQSLRFHGTIWRNLMMVLMDTGSFHNIMQPRLAKHLQLPISPIKTFPVMIVTTFHLLTIADDPPNLSSPTSEVVLTDFPPFHQYLPDLQALLQNYSRVFANPYNLPPIRAHDHHIPLIPNTPLLRLNLIGTRMPIKKPFLLVKKKDGTWRVCVDYWALNVVTIKDHVPIPTIDELLDELGNATIFSKIDL

SEQ ID NO: 228935 - protein, 216 aa, Glycine max
  Coding DNA Sequence Number=SeqID_112157
  Gene Ontology: Mol. function=endonuclease activity
  Homolog annotation: Hit_ID=Q2HUP4; Match level="QueryCoverage=88%, HitCoverage=70%, E-value=9e-58, Identity=59%"; Hit description =Endonuclease/exonuclease/phosphatase
MDYSQQVSANARSLYEMSNEQGSLHWRPDVVLNEQGSLHFSRRMWVRKLVQKCSIRFATLTPKSIEEVDTMIQRRINIMCLQETKWVGVKAKEMDIAGFKLWYTGKVRGKNGVGIMVEKVWKESVVDVKRIRDRILALKLLMAQETINIISAYAPQVGSKALEKEKLWQDLEGLVQGILQQKIFLGGDLNGHVHSQKRHFTGAHGGFGFGDLNEEG

SEQ ID NO: 228936 - protein, 202 aa, Glycine max
  Coding DNA Sequence Number=SeqID_112158
  Gene Ontology: Mol. function=ion channel activity; Cellular component= integral to membrane; Biological process=ion transport
  Homolog annotation: Hit_ID=Q10AR7; Match level="QueryCoverage=85%, HitCoverage=23%, E-value=5e-89, Identity=94%"; Hit description=Ion channel DMI1-like, chloroplast, putative, expressed
  Pfam annotation: Domain name=DUF1012; Domain location=32-202; Score= -16.9; E_value=0.0037; Accession=PF06241.3; Description=Protein of unknown function (DUF1012)
MVYNPPSNNPCGVNSHGVLWHKCSLLVSVSKARAIIVLAEDGNADQSDARALRTVLSLTGVKEGLRGHIVVELSDLDNEVLVKLVGGDLVETVVAHDVIGRLMIQCARQPGLAQIWEDILGFENCEFYIKRWPQLEGMQFEDVLISFPAAIPCGIKVASYGGKIILNPDDSYVLQEGDEILVIAEDDDTYAPASLPTVLCLT

SEQ ID NO: 228937 - protein, 301 aa, Glycine max
  Coding DNA Sequence Number=SeqID_112159
  Gene Ontology: Mol. function=ion channel activity; Cellular component= integral to membrane; Biological process=ion transport
  Homolog annotation: Hit_ID=Q1A3R7; Match level="QueryCoverage=94%, HitCoverage=100%, E-value=1e-157, Identity=100%"; Hit description =CASTOR protein
MANSDNFYTLRLVWRGSLPKDFVYPKSPERILFCGWRRDMEDMIMVLDASLAHGSELWMFNDVPEKEREKKLTDGGLDINRLENISLVNREGNAVIRRHLESLPLESFDSILILADESVEDSAIQADSRSLATLLLIRDIQARRLPYVSMASQAHGGSFSKGSWIGEMKQASDKTVIISEILDPRTKNLISMSKISDYVLSNELVSMALAMVAEDRQINDVLEELFAEEGNEMHIRKADLYLCEGEELNFYEIMLRARQRREIVIGYRLANAERAVINPPVKTDRRKWSLKDVFVVITEKE

SEQ ID NO: 228938 - protein, 367 aa, Glycine max
  Coding DNA Sequence Number=SeqID_112160
  Gene Ontology: Mol. function=ion channel activity; Cellular component= integral to membrane; Biological process=ion transport
  Homolog annotation: Hit_ID=Q10AR7; Match level="QueryCoverage=70%, HitCoverage=34%, E-value=1e-81, Identity=59%"; Hit description=Ion channel DMI1-like, chloroplast, putative, expressed
  Subcellular localization annotation: CTP_CleavageSite=75; ConfidenceScore=5.75e-01
MSLDSETSGSARDWFFPSPSFLRSSSSQYGRRFYSNSKPHSPPSSSTRIRHRRRVKFPRTPTNDKSQLSDTENVKSSATARNNLICLSQFRFQFALVGEILGLNHRLHACHKLDTLYVTSSISQDVDPWSRENFKRNLALFFSFTLLFIPLLIFKYIGFVSKSRFSDNISEQVSLNKQIAYRVDVFLSVYPYAKPLVLLVATLLLIFLGGLALFGVTTEDLAHCLWLSWTYVADSGNHASSQGIGPRLVAVSISFGGMLIFAMMLGLVSDAISEKFDSLRKGKSEVVEQNHTLILGWSDKLGSLLNQLAIANESLGGGTVAVMAERDKEEMELDIAKMEFDFKGTSVICRSGSPLILADLKKVYSLL

SEQ ID NO: 228939 - protein, 150 aa, Glycine max
  Coding DNA Sequence Number=SeqID_112161
  Homolog annotation: Hit_ID=O48626; Match level="QueryCoverage=31%, HitCoverage=7%, E-value=1e-09, Identity=58%"; Hit description =Centromere/kinetochore protein zw10 homolog
MASICFQKSSWMRCFGRLTWPRISELIISSFLSKLPDFQKIIVCSSEFEKCNGPFGWLQCFSLTYSRESDFEEGNHFYRFFDHEPLISKCFNFRGTTNDSEPKAAAAVCHIQYTKLLVNAKHSEDLLYMHVARLHDLCIPVYHIPGVCSF

SEQ ID NO: 228940 - protein, 177 aa, Glycine max
  Coding DNA Sequence Number=SeqID_112162
  Gene Ontology: Mol. function=RNA binding; Cellular component =ribonucleoprotein complex; Biological process=RNA processing
  Homolog annotation: Hit_ID=O80567; Match level="QueryCoverage=80%, HitCoverage=26%, E-value=3e-53, Identity=73%"; Hit description =Expressed protein
  Pfam annotation: Domain name=La; Domain location=15-70; Score=86.2; E_ value=1e-22; Accession=PF05383.7; Description=La domain
MKYMYKEQNPGDGKVEYYFSDLNLATTDHLMRFVNKDPEGFVPISVVASFKKIKALIASHSQLATVLRNSSKLVVSEDGKKIKRQYPLTESDIEEIQSRIVVAENLPEDHCHQNLMKVFSAVGSVKTIRTCPPQTSNSGASSASRLGKVDGMPLSNKFWSHELGCTSIIKFRPVLLF

SEQ ID NO: 228941 - protein, 67 aa, Glycine max
  Coding DNA Sequence Number=SeqID_112163
MPCQLGGVEDKKGLEEDDTNSDHNESSQEVKQRWTQRGSTRAASEDAESRNGVLEPDEVTMGIAVLL

SEQ ID NO: 228942 - protein, 439 aa, Glycine max
  Coding DNA Sequence Number=SeqID_112164
  Homolog annotation: Hit_ID=Q1SKD7; Match level="QueryCoverage=29%, HitCoverage=34%, E-value=9e-14, Identity=34%"; Hit description =Ankyrin
  Subcellular localization annotation: CTP_CleavageSite=36; ConfidenceScore=5.20e-01
MDCSRFASGKSRRPLLPDFACKVAIPGKLTFQMFFSQEMAPKKLSTKRSRKDPTGESSSAASGFDRHRFQSAEHQQRFEAIKGWSFHRERRVQLREDEYPDFQEEVTRRRWAPLVTPMAKFNPEIVMEFYANAWPTEEGVQDMRLWVRGQWIPFDADTLNQFLDHPLILEEGQQCEYGQASGFDDEAIGVDHAHQYDHPDSDMDDVAAKQHPAQRSQLRPPPTEVSAGVCHTGTDENGAYEAPFGPGEVQQGPGVPSSDHGPPLVIGRLSPEPSSRSTAPQGRHRVRHHINLERISSRQQTHRHHLRSPPQLTCRGWSTIYDMWPANKRPTTGDRCGCMSIFTSTPSASRARVPPLTYVLLRSSLGLRSHGLETGPILRQGQDLQGPPEMRMEPRKMRIWLTCSTSWEGAEPHDRDRQTCDFSSSNITAFSYFVISIVT

SEQ ID NO: 228943 - protein, 361 aa, Glycine max
  Coding DNA Sequence Number=SeqID_112165
  Gene Ontology: Mol. function=calcium channel activity; Cellular component=integral to membrane; Biological process=detection of mechanical stimulus during sensory perception of sound
  Homolog annotation: Hit_ID=Q9SKB8; Match level="QueryCoverage=76%, HitCoverage=54%, E-value=1e-115, Identity=51%"; Hit description =Ankyrin-like protein
  Pfam annotation: Domain name=Ank; Domain location=127-159; Score =25.7; E_value=0.00017; Accession=PF00023.20; Description=Ankyrin repeat
  Pfam annotation: Domain name=Ank; Domain location=161-193; Score =20.2; E_value=0.0074; Accession=PF00023.20; Description=Ankyrin repeat
  Pfam annotation: Domain name=Ank; Domain location=195-227; Score =31.8; E_value=2.3e-06; Accession=PF00023.20; Description=Ankyrin repeat
  Pfam annotation: Domain name=Ank; Domain location=229-262; Score =20.8; E_value=0.0048; Accession=PF00023.20; Description=Ankyrin repeat
  Pfam annotation: Domain name=Ank; Domain location=263-344; Score=1.8; E_value=17; Accession=PF00023.20; Description=Ankyrin repeat
  Pfam annotation: Domain name=Ank; Domain location=53-85; Score=14.1; E_value=0.29; Accession=PF00023.20; Description=Ankyrin repeat
  Pfam annotation: Domain name=Ank; Domain location=92-121; Score=20.9; E_value=0.0045; Accession=PF00023.20; Description=Ankyrin repeat
  Pfam module annotation: Pfam domain module=Ank::Ank::Ank::Ank::Ank::An k::Ank; Domain location=127-159::161-193::195-227::229-262::263 -344::53-85::92-121
MEKQSSFRASTMEKQKSFRGFMEKQKSFRIVMEKQLSFIGSERKKNKESPGKRGDLPIHLAARAGNLSRVKEIIQNYSNYETKDLLAKQNLEGETPLYVASENGHALVVSEILKYLDLQTASIAAKNGYDPFHIAAKQGHLEVLRELLHSFPNLAMTTDLSNSTALHTAATQGHIDVVNLLLESDSNLAKIARNNGKTVLHSAARMGHLEVVKALLNKDRSTGFRTDKKGQTALHMAVKGQNEEILLELVKPDPAVLSLEDNKGNTALHIATKKGRTQPFSGFNPLFLGNSFMCEHECHQDEFNSEDAPSTTNKNLGRATPQKLAFVVGVLESPRPINLTLDSHTSNVGLKSQTLEVGIGS

SEQ ID NO: 228944 - protein, 390 aa, Glycine max
  Coding DNA Sequence Number=SeqID_112166
  Homolog annotation: Hit_ID=Q8VXZ8; Match level="QueryCoverage=43%, HitCoverage=87%, E-value=2e-32, Identity=52%"; Hit description =Putative aminotransferase
MADGGHWRKAQEEIMIPHGEKLRFWEDPWTNTSMPLMEKYPRLYHISCQQKTTIMRMGSNNNTGWEWKLTWRRDLFDSEVEMTDTFIGKISQHHVQPYREDNWIWKHDQSGNYSTKSGYDLIWRELMGANQNSDFADLWKLKIPAKAAMFAWRLIRDRLPKKMNLRRRQIAKRLEKFQTTIFTQMRLLAIKHGAINLGQGFPNFDGPKFVKEAAIQAIRDGKNQYAQGYGVADLNIAIANRFKKDTGLVAHAFLTFTIAHPFQCAAAAALRAPDSYYVELKRNYMAKRAILVEGRWLQGHPFYFNPEEGKNLIRFTFCKDDETIRSAIERMKTKLRSTITINVGAVFKIGRGGTTVDVGAAAIARVFGSGGSIRKVEAYGQAEKQRRAYG

SEQ ID NO: 228945 - protein, 587 aa, Glycine max
  Coding DNA Sequence Number=SeqID_112167
  Gene Ontology: Mol. function=DNA binding; Cellular component=nucleus; Biological process=regulation of transcription, DNA-dependent
  Homolog annotation: Hit_ID=Q1T199; Match level="QueryCoverage=95%, HitCoverage=34%, E-value=1e-165, Identity=68%"; Hit description =Homeobox
MVNVYGQVNESLAISNVVELFKLVFLSTSTDPQAPKLLDDILRRYSQHDLFAAFNYLKEKKVMVVHPCVFGKIPNTYLSYEIHFKVIGSHTLLEREFEPNSIPKTSSWGEDCLPLIYSILALSLADVGGTGNERFELSQQFLQSVSKSPFPFNTGKQAVKFSAWLEERGKDLTEVGTNLAEDLQCGDIFHLFALVSSGELSISPFLPDNGVGEAEDLRSAKRKSDTTESSYSDKAKKSKSFFGVEGEIISRREKGFPGIIISAHRTTISRADILNLFKDNDNYGQPFEGDFQLNIGQSSNYSLPDHILEITKSSDPVPLEENHSESPWEAMAGYARHLLSEYSNKKHAYAICAEVFRVVYAAIQKAGDQGLSMGEISQVINLPGAEVDVLIVDALQAFGQALKVNAYDTVRVVDVLYRHKYFLTPMSDFHLRVVQPSSTKNIEKSDHTCELYESEERDTTSVDTSRERNTAIDSVHKLTILNLPHGDVDPENQACDRNEGCKQNRLGLSRVNHKKETLEFSSGESCVPILPWVNGDGTINSIVYRGLRRRVLGIVMQNPGILEISNRIIKEDKKDILRERGNLGSKK

SEQ ID NO: 228946 - protein, 65 aa, Glycine max
  Coding DNA Sequence Number=SeqID_112168
  Subcellular localization annotation: CTP_CleavageSite=29; ConfidenceScore=5.20e-01
MTPVDPSKFIRPLLIGLSSRSTAPPGRRRARHHSSIRMAGLSIAYDTWPTNRQPSPKPKDAPSCS

SEQ ID NO: 228947 - protein, 64 aa, Glycine max
  Coding DNA Sequence Number=SeqID_112169
MRSDFSSKAMRSESSPRFKGCISLKGISLFLQWRLQSSHLEKGMYVFNTPIPTNREDEIIAKAR

SEQ ID NO: 228948 - protein, 107 aa, Glycine max
  Coding DNA Sequence Number=SeqID_112170
  Pfam annotation: Domain name=Transposase_23; Domain location=12-77; Score=-17.1; E_value=0.084; Accession=PF03017.5; Description =TNP1ENSPM transposase
SCVDPSGNNPDTGDSDKCGLYIEENSPHLVSLGRVYERSTTVHSIPLLHDQVKVGVEEVKDVDAPIPIPTNEGAVGPAKPGDRPIIRHLTETSMRAGNSDVYGFLKP

SEQ ID NO: 228949 - protein, 65 aa, Glycine max
  Coding DNA Sequence Number=SeqID_112171
  Subcellular localization annotation: CTP_CleavageSite=50; ConfidenceScore=5.04e-01
MAEYKACTLGIQATIDFKVKLLKKKSKMVNLGTLISNDTSRTMNTHGRPLTMTRERCEGWQSTFS

SEQ ID NO: 228950 - protein, 158 aa, Glycine max
  Coding DNA Sequence Number=SeqID_112172
MTDLVSAEDDGAEDDVSLCVLSGFLSYRQQKLYTDNHSGISASQRDSKVSMTDLVSAEDDQKVYTDNHSGISARQRDSKVSMTDLVSAEDDGAEDDVSLCVLSGFSSYRQQKVYTDNHSGIFARHRDSKVSMTDLVSAEDDPKVYTDNHSGISGRQRD

SEQ ID NO: 228951 - protein, 71 aa, Glycine max
  Coding DNA Sequence Number=SeqID_112173
MVASHITWRGFKYSCGMVNVVSYCRSSGGMEEELQDVRGANLKYCFMVTLAPAARTRLGCSGRPMAAVRTS

SEQ ID NO: 228952 - protein, 104 aa, Glycine max
  Coding DNA Sequence Number=SeqID_112174
MSPHVLYLYAFSRFLPGTVGTLYLVGQDHFGLPSGVKTKHEWQKPSQGRVLKDERKRDGVTTDRSLLFSVRNKQGMSLQGSPVSFVSSPGRAGLAWASHPCTKI

SEQ ID NO: 228953 - protein, 224 aa, Glycine max
  Coding DNA Sequence Number=SeqID_112175
  Gene Ontology: Mol. function=two-component sensor activity; Cellular component=membrane; Biological process=two-component signal transduction system (phosphorelay)
  Homolog annotation: Hit_ID=Q2RNX7; Match level="QueryCoverage=79%, HitCoverage=34%, E-value=1e-32, Identity=41%"; Hit description =Putative diguanylate cyclase (GGDEF domain) with PAS/PAC sensor domain
  Pfam annotation: Domain name=GGDEF; Domain location=28-197; Score =193.8; E_value=4.1e-55; Accession=PF00990.12; Description=GGDEF domain
MTTAIMLVMLAVTSLLLLVMHARAQAGLQAIATLDGLTGVLNRRGLQEAAARMQAVSQRLRLPMGMLMVDLDYFKKVNDVYGHLVGDAVLKSCAGTIRAALRGGDVIGRYGGEEFCVLMPNTGEQEAMILAERIRRIIEVTPVSIAGVESMRSETQAIKCTVSVGAVSSETVGYPLESLFSAADQNLYKAKQNGRNRIVSNVGQSQPNPTEEGKPAKRHASLLA

SEQ ID NO: 228954 - protein, 116 aa, Glycine max
  Coding DNA Sequence Number=SeqID_112176
MTETVCTDNRLGISARHLTSLVRMTETVCTDNRLGIFVRHLTSWVRMTETVCTDNRLGISVRHLTSRVRMTESAEDDVMIAEGGVVDKSETFAPTYPPFLMKNSELCSSFFCVVLG

SEQ ID NO: 228955 - protein, 287 aa, Glycine max
  Coding DNA Sequence Number=SeqID_112177
  Gene Ontology: Mol. function=sequence-specific DNA binding; Biological process=regulation of transcription, DNA-dependent
  Homolog annotation: Hit_ID=Q4KIJ0; Match level="QueryCoverage=69%, HitCoverage=97%, E-value=4e-51, Identity=51%"; Hit description=DNA -binding protein
  Subcellular localization annotation: CTP_CleavageSite=33; ConfidenceScore=5.47e-01
MSDPGRGKKVSTGFPVAVNGDARASGRGGPPARAQGARRALPAAGRRRAASGLARRGLEARGHFVQVAAHGQHLGRFLAQRQVDMADAAVEIGGFQPVQHHAVAVLELDAHLARQHQRELLPGMADVVLELDDLARVDQGQHGHHLLARVFAHQQPVVIVLGGVVARVAELVLDVGGSHLGLGRVAQHEHARHVDAQRPRQRGELLVAQGDLAQLGLGQGRDRDAAGLRQVLQGHFPGLALGAQARAHHFLAHDVGWGRIASGGRGHVAVCVQGWEGAARRPVHAGL

SEQ ID NO: 228956 - protein, 146 aa, Glycine max
  Coding DNA Sequence Number=SeqID_112178
  Subcellular localization annotation: CTP_CleavageSite=36; ConfidenceScore=5.09e-01
AKFDIAEATKVKTKVMSTVATRWRQFKSTLTSKFVFAKSEGQQTQDVVTKYGLDPEAWKQFEENRLTPNWEKLLDQKRKRIQEEALLSENAASLDEPPSPIKRHVKWKVARTRAVGNMTSESAQEIADKIVGSPICCNVHMFKYFE

SEQ ID NO: 228957 - protein, 35 aa, Glycine max
  Coding DNA Sequence Number=SeqID_112179
MPYTDYMKPDTETYNWVIQAYTRVESYARFHEASS

SEQ ID NO: 228958 - protein, 97 aa, Glycine max
  Coding DNA Sequence Number=SeqID_112180
  Subcellular localization annotation: CTP_CleavageSite=37; ConfidenceScore=5.10e-01
GPVGLFRVHWVSCGGRLALRSLGRMLLSSNVIYICVRVVMLVRMIRTRLFATARVKSCPGMHSSCVIASLSGCARTVGPPPISGGGPGTVKRKLLAP

SEQ ID NO: 228959 - protein, 68 aa, Glycine max
  Coding DNA Sequence Number=SeqID_112181
MKGRAERTLDKEEDEEHVMEEARELRRGARPKIPNSKLKDFYWHKEQHTHEGAYRGCQKDPEDDGKPQ

SEQ ID NO: 228960 - protein, 306 aa, Glycine max
  Coding DNA Sequence Number=SeqID_112182
  Gene Ontology: Mol. function=protein binding; Cellular component =integral to membrane; Biological process=xylan catabolic process
  Homolog annotation: Hit_ID=Q1S5Q1; Match level="QueryCoverage=97%, HitCoverage=77%, E-value=4e-59, Identity=37%"; Hit description =Leucine-rich repeat; Leucine-rich repeat, cysteine-containing type
  Pfam annotation: Domain name=LRR_1; Domain location=118-140; Score =10.7; E_value=2.9; Accession=PF00560.23; Description=Leucine Rich Repeat
  Pfam annotation: Domain name=LRR_1; Domain location=142-164; Score =14.4; E_value=0.43; Accession=PF00560.23; Description=Leucine Rich Repeat
  Pfam annotation: Domain name=LRR_1; Domain location=166-188; Score =14.3; E_value=0.45; Accession=PF00560.23; Description=Leucine Rich Repeat
  Pfam annotation: Domain name=LRR_1; Domain location=190-211; Score =11.6; E_value=1.9; Accession=PF00560.23; Description=Leucine Rich Repeat
  Pfam annotation: Domain name=LRR_1; Domain location=24-46; Score=5.0; E_value=33; Accession=PF00560.23; Description=Leucine Rich Repeat
  Pfam annotation: Domain name=LRR_1; Domain location=48-70; Score =15.6; E_value=0.18; Accession=PF00560.23; Description=Leucine Rich Repeat
  Pfam module annotation: Pfam domain module=LRR_1::LRR_1::LRR_1::LRR _1::LRR_1::LRR_1; Domain location=118-140::142-164::166-188::190 -211::24-46::48-70
MKFIDMGNNQLSDAIPDWMWEMQYLMVLRLRSNNFNGSITQKICQLSSLIVLDLGNNSLSGSIPNCLKDMKTMAGEDDFFANPLSYSYSSDFSYNHYKETLVLVPKGDELEYRDNLILVRMIDLSSNKLSGAIPSEISKLSALRFLNLSRNHLSGGIPNDMGKMKLLESLDLSLNNISGQIPQSLSDLSFLSVLNLSYNNLSGRIPTSTQLQSFEELSYTGNPELCGPPVTKNCTDKEELTESASVGHGDGNFFGTSEFYIGMGVGFAAGFWGFCSVVFFNRTWRRAYFHYLDHLRDLIYVIIVLK

SEQ ID NO: 228961 - protein, 119 aa, Glycine max
  Coding DNA Sequence Number=SeqID_112183
  Subcellular localization annotation: CTP_CleavageSite=38; ConfidenceScore=5.64e-01
MAESSKKRKGSSTSASASRAHRSEATSASTAPIPPSLSSSTLFSSEEQQKRYSNLFSSRSIIDPKFIDMEFFSAETFDCIQAFQNLGLIPLMSLQLPVYPELVKAFYCNLEIQDSTLNF

SEQ ID NO: 228962 - protein, 124 aa, Glycine max
  Coding DNA Sequence Number=SeqID_112184
MVGYTPSSFANLVFADERIEVGLKRGKFNHRAWTNEKTGANEEGENEGETHAVTVIPIRPSFPPTQQCHYSANNNPSPYPPPSYPQRPSLNQPQNPPTTQPMLNTTFSTNTNTNQGRNFAAKSL

SEQ ID NO: 228963 - protein, 80 aa, Glycine max
  Coding DNA Sequence Number=SeqID_112185
ADNHEVYPRATGPLSLTDSKMRLFRNLDQKTLTSPEKSRPEDADISGKSRPEVADISGEGADDDSRPEDADISGEGADDD

SEQ ID NO: 228964 - protein, 99 aa, Glycine max
  Coding DNA Sequence Number=SeqID_112186
MELFATICDNNNSQNNQHDSTSNVEDLLYEYENCWVKDHGSDSDSSFGPKGCNMSPSHEPICKRSWQQGKITVKIDNTLQFTQVSEKAIHVSPTKLTLN

SEQ ID NO: 228965 - protein, 71 aa, Glycine max
  Coding DNA Sequence Number=SeqID_112187
MKNGNHEEEIQTGENSEVTMEMEIGKMQRHEHCRAKANSKRQNNKCSVGGNKKMREASARTHKMTETTNAV

SEQ ID NO: 228966 - protein, 52 aa, Glycine max
  Coding DNA Sequence Number=SeqID_112188
MHMTQMQFTNTGARETVSFLDTTSRGSKVPQQGINPAPMCDAYAKGATRECT

SEQ ID NO: 228967 - protein, 102 aa, Glycine max
  Coding DNA Sequence Number=SeqID_112189
  Gene Ontology: Mol. function=RNA-directed DNA polymerase activity; Cellular component=chromatin; Biological process=RNA-dependent DNA replication
  Homolog annotation: Hit_ID=Q1T2D5; Match level="QueryCoverage=99%, HitCoverage=6%, E-value=2e-32, Identity=67%"; Hit description=Chromo
MDQEKVQAVLNWPYPINLKQLRGFLGLAGYYRKFIKGYVSIATPLSNLLKKENFHWNDHTSMAFDNLKAAITKAPVLALPDFSKAFTLETDASVIGIRAVLS

SEQ ID NO: 228968 - protein, 74 aa, Glycine max
  Coding DNA Sequence Number=SeqID_112190
  Homolog annotation: Hit_ID=Q2HSF6; Match level="QueryCoverage=57%, HitCoverage=3%, E-value=5e-09, Identity=72%"; Hit description =Glycoside hydrolase, family 1; Zinc finger, CCHC-type; Polynucleotidyl transferase, Ribonuclease H fold
MEKKLSQFSKNKEMNPCSKTRLEAIRIFLAYVAHKDIKLYQMDAKSVFLKGFTNEEMTSSLMPPQKGCATSFLS

SEQ ID NO: 228969 - protein, 608 aa, Glycine max
  Coding DNA Sequence Number=SeqID_112191
  Homolog annotation: Hit_ID=Q6ZIK5; Match level="QueryCoverage=16%, HitCoverage=26%, E-value=2e-29, Identity=59%"; Hit description =Putative growth-regulating factor 1
  Pfam annotation: Domain name=QLQ; Domain location=146-182; Score =55.6; E_value=1.7e-13; Accession=PF08880.1; Description=QLQ
  Pfam annotation: Domain name=WRC; Domain location=204-249; Score =98.8; E_value=1.6e-26; Accession=PF08879.1; Description=WRC
  Pfam module annotation: Pfam domain module=QLQ::WRC; Domain location =146-182::204-249
MGELFGVGKRRDIISNNNSASSSVLGLDVKVQSPEVLFHNRMTMMGHHNHHLHPLSSPFDNNNDISCAAGDGDGDGPTTYMSLTNHINLVSGASVLGPAIDGGCGAAPAAPVRTLQPFQISSYTSPTTTTTAFEPFSGVMAASLGFPFTSAQWRELERQAMIYKYMMASVPVPPDLLIPTSLTSSSRSSCMDGGFNLRLANSTDPEPGRCRRTDGKKWRCSRDVAPNHKYCERHMHRGRPRSRKPVEVNTNTTPTSINNNNNNHQIKRARHECNNPFATPDVAVAISNPTSRKGESSSHFLGSTTTQPYLKSPLCLANFGLKAASFDSVASVSANKEPRGLEWMLNGDPISLDASNSQWQSLMHNKVGMSSVSSCNTTESQYLNSFALYSSGLEQQNRRHPLFLNPLLVPMKNLQPEKPRGFIDAWSNAETAQSNANTNNKNSAASIGKLSLSSLDLSMGGGAVSEDVDNVNMGLGLMETYGKTHTDTKISLSNWHNPAPWVASSSTLGGPLAEVLRSSTVTATTNEATSNATSSPATTTHAESNSPLGTMVSSPSGVLQKTLISLSDSSNNSSPTVASSRANSEMAFLRPLWPIVEDALNSSFMETS

SEQ ID NO: 228970 - protein, 269 aa, Glycine max
  Coding DNA Sequence Number=SeqID_112192
  Gene Ontology: Mol. function=protein serine/threonine kinase activity; Cellular component=integral to membrane; Biological process=protein amino acid phosphorylation
  Homolog annotation: Hit_ID=Q6UJY9; Match level="QueryCoverage=99%, HitCoverage=33%, E-value=2e-57, Identity=44%"; Hit description =Receptor protein kinase
  Pfam annotation: Domain name=Pkinase; Domain location=5-259; Score =6.3; E_value=6.1e-09; Accession=PF00069.15; Description=Protein kinase domain
  Pfam annotation: Domain name=Pkinase_Tyr; Domain location=4-259; Score=-46.1; E_value=1.2e-09; Accession=PF07714.7; Description =Protein tyrosine kinase
  Pfam module annotation: Pfam domain module=Pkinase::Pkinase_Tyr; Domain location=5-259::4-259
MSSFKKCSTPKPSEGYHFCSSLDYKGEEFKALVMEFMPNGNLDVSLYPEDVESGSSLTLLQRLNIAIDVASAMDYLHHDCNPPVVHCDMKPANVLLDENMVAHVADFGLARFLSQSTSEMQSSTLGLKGSIGYIAPEYGLGAKASTRGDVYSFGILLLEMFTAKRPTDEIFKEGLSLSKFVSAMDENEVLKVADRSLIVDYEYSTQSSITGDQSSGIGSNTHWIRKAEECIAGVIRVGLCCTAQEPKDRWSMREAITKLQAIKHSMLAL

SEQ ID NO: 228971 - protein, 167 aa, Glycine max
  Coding DNA Sequence Number=SeqID_112193
  Gene Ontology: Mol. function=heat shock protein binding; Cellular component=integral to membrane; Biological process=protein folding
  Homolog annotation: Hit_ID=Q6K2F0; Match level="QueryCoverage=52%, HitCoverage=12%, E-value=2e-23, Identity=59%"; Hit description=Heat shock protein-like
MVEVLEDFNEEEGLLVSPLVKVDAFRTVFHRHSHDQGRKIPKVEIFRFSHQVPNYLLTGQEAHNAPKGCRELDPAATPLDLQTTTEEVLNNVGKSKEDTFPGSPENHDAGKGKNASKHNIEAILDEDDNEGEIPATTTMMTLNEANEDMRQRRNHCNGGDNGSTSLC

SEQ ID NO: 228972 - protein, 650 aa, Glycine max
  Coding DNA Sequence Number=SeqID_112194
  Gene Ontology: Mol. function=protein serine/threonine kinase activity; Cellular component=integral to membrane; Biological process=protein amino acid phosphorylation
  Homolog annotation: Hit_ID=Q9SN81; Match level="QueryCoverage=95%, HitCoverage=66%, E-value=1e-117, Identity=38%"; Hit description =Receptor-kinase like protein
  Pfam annotation: Domain name=LRRNT_2; Domain location=25-64; Score =56.9; E_value=6.5e-14; Accession=PF08263.3; Description=Leucine rich repeat N-terminal domain
  Pfam annotation: Domain name=LRR_1; Domain location=117-139; Score =10.1; E_value=3.6; Accession=PF00560.23; Description=Leucine Rich Repeat
  Pfam annotation: Domain name=LRR_1; Domain location=141-163; Score =17.2; E_value=0.058; Accession=PF00560.23; Description=Leucine Rich Repeat
  Pfam annotation: Domain name=LRR_1; Domain location=165-187; Score =10.1; E_value=3.7; Accession=PF00560.23; Description=Leucine Rich Repeat
  Pfam annotation: Domain name=LRR_1; Domain location=189-211; Score =12.5; E_value=1.3; Accession=PF00560.23; Description=Leucine Rich Repeat
  Pfam annotation: Domain name=LRR_1; Domain location=213-232; Score =5.9; E_value=23; Accession=PF00560.23; Description=Leucine Rich Repeat
  Pfam annotation: Domain name=LRR_1; Domain location=238-260; Score =11.1; E_value=2.4; Accession=PF00560.23; Description=Leucine Rich Repeat
  Pfam annotation: Domain name=LRR_1; Domain location=262-283; Score =15.2; E_value=0.23; Accession=PF00560.23; Description=Leucine Rich Repeat
  Pfam annotation: Domain name=LRR_1; Domain location=285-310; Score =10.1; E_value=3.6; Accession=PF00560.23; Description=Leucine Rich Repeat
  Pfam annotation: Domain name=LRR_1; Domain location=315-337; Score =11.8; E_value=1.8; Accession=PF00560.23; Description=Leucine Rich Repeat
  Pfam annotation: Domain name=LRR_1; Domain location=340-362; Score =4.1; E_value=48; Accession=PF00560.23; Description=Leucine Rich Repeat
  Pfam annotation: Domain name=LRR_1; Domain location=364-386; Score =13.9; E_value=0.59; Accession=PF00560.23; Description=Leucine Rich Repeat
  Pfam annotation: Domain name=LRR_1; Domain location=388-410; Score =13.2; E_value=0.94; Accession=PF00560.23; Description=Leucine Rich Repeat
  Pfam annotation: Domain name=LRR_1; Domain location=412-434; Score =0.7; E_value=2.1e+02; Accession=PF00560.23; Description=Leucine Rich Repeat
  Pfam annotation: Domain name=LRR_1; Domain location=436-459; Score =7.5; E_value=11; Accession=PF00560.23; Description=Leucine Rich Repeat
  Pfam annotation: Domain name=LRR_1; Domain location=460-482; Score =8.1; E_value=8.7; Accession=PF00560.23; Description=Leucine Rich Repeat
  Pfam annotation: Domain name=LRR_1; Domain location=484-506; Score =13.0; E_value=1; Accession=PF00560.23; Description=Leucine Rich Repeat
  Pfam annotation: Domain name=LRR_1; Domain location=508-530; Score =12.5; E_value=1.3; Accession=PF00560.23; Description=Leucine Rich Repeat
  Pfam annotation: Domain name=LRR_1; Domain location=532-554; Score =21.6; E_value=0.0029; Accession=PF00560.23; Description=Leucine Rich Repeat
  Pfam annotation: Domain name=LRR_1; Domain location=556-578; Score =7.4; E_value=12; Accession=PF00560.23; Description=Leucine Rich Repeat
  Pfam annotation: Domain name=LRR_1; Domain location=579-602; Score =11.0; E_value=2.5; Accession=PF00560.23; Description=Leucine Rich Repeat
  Pfam annotation: Domain name=LRR_1; Domain location=69-91; Score=5.8; E_value=23; Accession=PF00560.23; Description=Leucine Rich Repeat
  Pfam annotation: Domain name=LRR_1; Domain location=93-115; Score =14.8; E_value=0.31; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1; Domain ...
  Pfam module annotation: Pfam domain module=location=25-64::117 -139::141-163::165-187::189-211::213-232::238-260::262-283::285 -310::315-337::340-362::364-386::388-410::412-434::436-459::460 -482::484-506::508-530::532-554:...
  Pfam module annotation: =:556-578::579-602::69-91::93-115
MIYNIRHILLLFFLLHNFHDILCNNDTDKDVLLSFKSQVSDPKNVLSGWSSDSNHCTWYGVTCSKVGKRVQSLTLPGLALSGKLPARLSNLTYLHSLDLSNNYFHGQIPLEFGHLLLLNVIELPYNNLSGTLPPQLGNLHRLQILDFSVNNLTGKIPPSFGNLSSLKKFSLARNGLGGEIPTELGNLHNLSTLQLSENNFSGEFPSSIFNISSLVFLSVTSNNLSGKLTQNFGTDLPNIENLFLASNRFEGVIPNSISNASHLQYIDLAHNKFHGSIPLFHNLKNLTKLILGNNFFTSTTSLNSKFFESLRNSTMLQILMINDNHLTGGLPSSVANLSGNLQQFCVANNLLAGTLPQGMEKFKNLISLSFENNSFTGELPSEIGALHNLERLAIYSNRLSGEIPDIFGNFTNMFFLAMGNNQFSGRIYPSIGQCKRLTFLDLGMNRLGGSIPEEIFQLSGLTALYLEGNSLHGSLPHEVKIMTQLETMVLSGNQLSGNISKEIEGLSSLKWLLMAGNKFNGSIPTNLGNLASLETLDLSSNNLTGPIPQSLEKLQYIQTLNLSFNHLEGEVPMKGVFMNLTKFDLRGNNQLCSLNKEIVQNLGVLLCVVGKKKRNSLLHIILPVVGATALFISMLVVFCTIKKKRKETKI

SEQ ID NO: 228973 - protein, 303 aa, Glycine max
  Coding DNA Sequence Number=SeqID_112195
  Gene Ontology: Mol. function=nucleoside-triphosphatase activity; Cellular component=membrane
  Homolog annotation: Hit_ID=Q5W2W2; Match level="QueryCoverage=99%, HitCoverage=52%, E-value=1e-142, Identity=78%"; Hit description =Putative TrbE protein
MLVRRAQLKKDLDEEAADPLKFRFVFIIHNVPYCAQKELYSFEGSVGYRISSNISLSKFYPIIGFSLIEPGGIFLGTDDKGAPIAINPYLSVNGRQNPHWAITGTTGAGKTTTGAVLIDRLRKAHDDVYVIVIDPMSNYNRFFENEADLNIVFGDNDYLGLDPVSLANEGVVSSGDIADFLIESYGIPAELRGILVSQFEQNKSLNEIMDNLEDLASKKFATEYRKLENFLLNMTTGCDKYVFQGSPPSLKNKKFVILGLKTEDTRKKRLAATMLMIYAYSLINKLPKDVEKLILIDEAHLLE

SEQ ID NO: 228974 - protein, 126 aa, Glycine max
  Coding DNA Sequence Number=SeqID_112196
  Subcellular localization annotation: CTP_CleavageSite=62; ConfidenceScore=5.30e-01
MPSPPTNTQNANVTHILPGTGCASVWWPFTRTRPKAMRQERSGITHALHTDSNIRLSNNTPRCRAIRDEDHSMRQRPRRTIEVTTIRKVPRPNPSTYGLKAYLCWVQPLQRHHDHHADIWKGSSPH

SEQ ID NO: 228975 - protein, 188 aa, Glycine max
  Coding DNA Sequence Number=SeqID_112197
MVFITYCPASRCVVGKPYVAISVEGVLYQHIYIAQKLLIALFARSRMMFLDDGGRPPNRSTTGARKDVRHIRILGVGWWGWHCVLVAWKTSVFLQVATEGSATSIKNGVRCGNKERGMGYGLWCMVEGIWKEEFIEVKDEACKFFKDRFYEEHWERPNLGKVSFKKISSDDNDILIGSFGEEEIKSAI

SEQ ID NO: 228976 - protein, 620 aa, Glycine max
  Coding DNA Sequence Number=SeqID_112198
  Gene Ontology: Mol. function=protein serine/threonine kinase activity; Cellular component=integral to membrane; Biological process=protein amino acid phosphorylation
  Homolog annotation: Hit_ID=Q60D16; Match level="QueryCoverage=99%, HitCoverage=87%, E-value=2e-93, Identity=34%"; Hit description =Putative receptor kinase-like protein, identical
  Pfam annotation: Domain name=LRR_1; Domain location=101-122; Score =13.2; E_value=0.96; Accession=PF00560.23; Description=Leucine Rich Repeat
  Pfam annotation: Domain name=LRR_1; Domain location=124-149; Score =8.7; E_value=6.7; Accession=PF00560.23; Description=Leucine Rich Repeat
  Pfam annotation: Domain name=LRR_1; Domain location=154-176; Score =12.3; E_value=1.4; Accession=PF00560.23; Description=Leucine Rich Repeat
  Pfam annotation: Domain name=LRR_1; Domain location=209-231; Score =15.2; E_value=0.24; Accession=PF00560.23; Description=Leucine Rich Repeat
  Pfam annotation: Domain name=LRR_1; Domain location=233-255; Score =9.0; E_value=5.8; Accession=PF00560.23; Description=Leucine Rich Repeat
  Pfam annotation: Domain name=LRR_1; Domain location=257-279; Score =21.6; E_value=0.0029; Accession=PF00560.23; Description=Leucine Rich Repeat
  Pfam annotation: Domain name=LRR_1; Domain location=281-303; Score =7.1; E_value=13; Accession=PF00560.23; Description=Leucine Rich Repeat
  Pfam annotation: Domain name=LRR_1; Domain location=304-327; Score =9.1; E_value=5.6; Accession=PF00560.23; Description=Leucine Rich Repeat
  Pfam annotation: Domain name=LRR_1; Domain location=31-53; Score =11.1; E_value=2.4; Accession=PF00560.23; Description=Leucine Rich Repeat
  Pfam annotation: Domain name=LRR_1; Domain location=8-29; Score=1.3; E_value=1.6e+02; Accession=PF00560.23; Description=Leucine Rich Repeat
  Pfam annotation: Domain name=Pkinase; Domain location=369-620; Score =31.8; E_value=1.9e-10; Accession=PF00069.15; Description=Protein kinase domain
  Pfam annotation: Domain name=Pkinase_Tyr; Domain location=366-620; Score=-28.7; E_value=1e-10; Accession=PF07714.7; Description=Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase::Pkinase_Tyr; Domain location=101-122::124-149::154-176::209-231::233-255::257 -279::281-303::...
  Pfam module annotation: Domain location=304-327::31-53::8-29::369 -620::366-620
QPLDVGSSFDVLIIYNDLRGKLPPSFSNLLSLKNLALARNGFVGEIPAQLGNLHYLSYLQLSELFQLNLVISTISSNFNLQHLFLGLLIRLIPNFISNASHLQYIDLAHNNFHGPIPMINNLKNLTHLILGNNFFSSTTSFNFQFFDSLRNSTKLQILMVNDNHLAGELPSSVANLSGNIQQFCVANNLLTEGNSLHGSLPHEVKIMTQLETMVLSGNQLSGNIPKEIEGLSSFKWLLMAGNKFNGSIPTNLGNLASLETLDLSSNNLTGPIPQSLEKLQYIQTLNLSFNHLEGKVPMKGVFMNLTKFHLRGNNQLCSLNKEIVQNLGVLLCLVGKKKRNSLLHIILPVVGATALFISMLVVFCTIKKKRKETKISVSLTPLRGTGETATLAVKVLDLQQSKASQSFSSECQALKNVRHRNLVKVITSCSSLDYKGEEFKALVMQLMPNVRILSTLLQRLNIFIDVASAMDYLHHDCNPPVVHCDMKPVNVLLDENMVAHVAYFGLARFLSQSTSEMQSSTLGLKGSIGYIAPEYGLGGKASTHGDVYSFGILLLEMFTAKRPTVEIFKEGLSLSKFVSAVWMRMNGIGSNTHSIRKAEECIAGVIRVGLCCTAHQPKDR

SEQ ID NO: 228977 - protein, 70 aa, Glycine max
  Coding DNA Sequence Number=SeqID_112199
  Pfam annotation: Domain name=GRP; Domain location=7-70; Score=-12.9; E_value=0.0015; Accession=PF07172.2; Description=Glycine rich protein family
MAILLRASKLMSFAVLLAILLLLMSSTLGSAAQPLGRKLFQYPSGRGYGYAEGGSIYKKYPGGGGYRKRP

SEQ ID NO: 228978 - protein, 261 aa, Glycine max
  Coding DNA Sequence Number=SeqID_112200
MNLESIAQVSSYVREGSTYHDSWEVTYEKHVPRAFYKEKSVEYVGTKKIVYHTMCERVKIWANITNKSFLHKQLLFDLPHIVFINILKNLRTLGGMDDIYYATLVNKLFWEQGVYHVLKKIDKDSKHQVTVKGSFIAKQQQFSKRPPPSQINLAKFKKLARLSSWRPWVLLTKDMQEPVQCQFIIMSPTPWTRCDYVHKPSAIDKALPSYAIVSSKTPSWRQSGRQELRKKPIGNDDPFSKAPKECHLLVRMDPSQENLTP

SEQ ID NO: 228979 - protein, 64 aa, Glycine max
  Coding DNA Sequence Number=SeqID_112201
  Pfam annotation: Domain name=GRP; Domain location=6-64; Score=-29.6; E_value=0.081; Accession=PF07172.2; Description=Glycine rich protein family
MAILRASKLMSFAALLAILLLLMSFELGSAAQPSFKLGRKLFQTGELPPTYGSYPGGGGYTPNP

SEQ ID NO: 228980 - protein, 55 aa, Glycine max
  Coding DNA Sequence Number=SeqID_112202
MSMYHRSQGKPNELFIHRVDTSYKASAIKILEDQQTSFLGKIPRCWTPLKQKLTR

SEQ ID NO: 228981 - protein, 58 aa, Glycine max
  Coding DNA Sequence Number=SeqID_112203
  Homolog annotation: Hit_ID=Q5DQ85; Match level="QueryCoverage=55%, HitCoverage=17%, E-value=2e-07, Identity=75%"; Hit description=CAPIP1
MNGIGNDGGGGLSNVEMEYIRRHHRHEPGENQCGSALVKHIRAPVPQVLCWEHKWEVI

SEQ ID NO: 228982 - protein, 250 aa, Glycine max
  Coding DNA Sequence Number=SeqID_112204
  Gene Ontology: Mol. function=hydrolase activity, acting on carbon -nitrogen (but not peptide) bonds; Cellular component=cytosol; Biological process=nitrogen compound metabolic process
  Homolog annotation: Hit_ID=Q97WN8; Match level="QueryCoverage=99%, HitCoverage=92%, E-value=1e-136, Identity=94%"; Hit description =Amidohydrolase, putative
  Pfam annotation: Domain name=CN_hydrolase; Domain location=4-168; Score=39.2; E_value=1.4e-08; Accession=PF00795.12; Description =Carbon-nitrogen hydrolase
MGIRVELAQIRSYPGDVYRNYKKHLEIIETSTADCVIFPELSLTGYIIKDLTYEIYKDAEEATRKIAEKVNKCAVFGTIKEVRKGILRNAAAVIINGKMDYIYKFYLPTYGLFEERRYFQRGDPLKDLKIFEYRDLKFGVVICEDAWHPEPIEALSLMGADAIFIPSASPMRKLRENLAIEESWDSLLKAHSLMNTVWTVFTNVVGSQEEEYFWGGSRVVSPLGDVKLKLNLFYEDRGVVEITENELLRA

SEQ ID NO: 228983 - protein, 83 aa, Glycine max
  Coding DNA Sequence Number=SeqID_112205
MTRGDGMIENAMGFSEASAFKAIVSSYQIAQNNQLFPQMKVFWKSDVPSKVLFFSWRLFHDRLATREQLQNRGVLNLQQSGNK

SEQ ID NO: 228984 - protein, 472 aa, Glycine max
  Coding DNA Sequence Number=SeqID_112206
  Gene Ontology: Mol. function=protein serine/threonine kinase activity; Cellular component=integral to membrane; Biological process=protein amino acid phosphorylation
  Homolog annotation: Hit_ID=Q6UJY9; Match level="QueryCoverage=92%, HitCoverage=68%, E-value=3e-51, Identity=30%"; Hit description =Receptor protein kinase
  Pfam annotation: Domain name=LRR_1; Domain location=109-132; Score =6.3; E_value=19; Accession=PF00560.23; Description=Leucine Rich Repeat
  Pfam annotation: Domain name=LRR_1; Domain location=134-158; Score =9.7; E_value=4.4; Accession=PF00560.23; Description=Leucine Rich Repeat
  Pfam annotation: Domain name=LRR_1; Domain location=161-183; Score =6.9; E_value=14; Accession=PF00560.23; Description=Leucine Rich Repeat
  Pfam annotation: Domain name=LRR_1; Domain location=185-207; Score =6.4; E_value=18; Accession=PF00560.23; Description=Leucine Rich Repeat
  Pfam annotation: Domain name=LRR_1; Domain location=252-274; Score =6.8; E_value=15; Accession=PF00560.23; Description=Leucine Rich Repeat
  Pfam annotation: Domain name=LRR_1; Domain location=276-295; Score =8.9; E_value=6.2; Accession=PF00560.23; Description=Leucine Rich Repeat
  Pfam annotation: Domain name=LRR_1; Domain location=308-332; Score =6.8; E_value=15; Accession=PF00560.23; Description=Leucine Rich Repeat
  Pfam annotation: Domain name=LRR_1; Domain location=38-60; Score =14.5; E_value=0.38; Accession=PF00560.23; Description=Leucine Rich Repeat
  Pfam annotation: Domain name=LRR_1; Domain location=62-83; Score=6.3; E_value=19; Accession=PF00560.23; Description=Leucine Rich Repeat
  Pfam annotation: Domain name=LRR_1; Domain location=85-107; Score =6.8; E_value=15; Accession=PF00560.23; Description=Leucine Rich Repeat
  Pfam annotation: Domain name=Pkinase_Tyr; Domain location=327-471; Score=-165.5; E_value=0.026; Accession=PF07714.7; Description =Protein tyrosine kinase
  Pfam module annotation: Pfam domain module=LRR_1::LRR_1::LRR_1::LRR _1::LRR_1::LRR_1::LRR_1::LRR_1::LRR_1::LRR_1::Pkinase_Tyr; Domain location=109-132::134-158::161-183::185-207::252-274::276-295::308 -332::38-60::62-83::85-107::327-471
  Subcellular localization annotation: CTP_CleavageSite=22; ConfidenceScore=5.11e-01
MFCPGGLQIPITASGMVSHAPKLATGSNLAPQPSNLTCLHSLDLSNNYFHGQIPLEFGHLSLLNVIELPSNNLRVIPTELGNLHNLSSLQLSENNFSGEFLTSIFNISSLVFLSVTSNNLSGKLTQNSGHDLPNIKNLFLASNRFEGAGDLPSSVANLSGNLQQFCVANNLLTGTIPQGMKKFQNLISLSYENNSFTGELPSEIGAQHNQQQLVIYSNMLSGEISYIFGNFTNLYILAVGDNQFSEIFQLSCLTTLYLAENSLHGSLPHEVNIMTQLETMVLSGNQLSGNIPKEIEEGDVPTKGVFMNLTKFDLQGNNNQLCSLNKEIVQNLGVPLCDDVFSFSTGETITLAVKVLDLQQSKAFQSFNAECQALKNGEEFKALVMQFMPKGNFDVSLYPEDVESGSSLTLLQRLNIPIDVASAMNYLHHDCDPSVVHCDLKPANVLLDEIMIADVADFGLASDAILLRKGIG

SEQ ID NO: 228985 - protein, 248 aa, Glycine max
  Coding DNA Sequence Number=SeqID_112207
  Gene Ontology: Mol. function=nucleic acid binding; Cellular component= nucleus; Biological process=type I hypersensitivity
  Homolog annotation: Hit_ID=Q5N8W4; Match level="QueryCoverage=73%, HitCoverage=58%, E-value=1e-37, Identity=47%"; Hit description =Putative RRM-containing protein SEB-4
  Pfam annotation: Domain name=RRM_1; Domain location=18-89; Score =39.9; E_value=8.8e-09; Accession=PF00076.12; Description=RNA recognition motif. (a.k.a. RRM, R
MMSPNLAKQVGDATYTKIFVGGLAWGTKRDTLKRYFDQFGEILEAVVITDKITGRSKGYGFVTPTSLFFRHLVFHFLVTFRDPNSAIRACHNPYPVIDGRRANCNLAALGAQKFDPSITGRQKLSSPSWNMAPIPLQGTSTYYNQHIPHYPFPYPAYRYPGYPHPQDLYEMNYNNAYGGQQLPLRWLPAYCQPFYGLGRQFIPTAYVKKAQTPNMSPQEFTVVGFSEPISASPSISSTGSASKLQTML

SEQ ID NO: 228986 - protein, 105 aa, Glycine max
  Coding DNA Sequence Number=SeqID_112208
PAFVNHPTFCYRDPRVRWHAETPDGNPHTPFAIQQPESPIACGDTLRLSAPCHLETPSLIDKQRPMWSSAPFPKMSASSGRDYFSLTPLSQELRWSEFLIAIEDT

SEQ ID NO: 228987 - protein, 73 aa, Glycine max
  Coding DNA Sequence Number=SeqID_112209
MPILGKELWRQQEEQLLQRYLGFNLNAAELKLSLIRGICRLSFGFRYVVTILLFGLSLLQQEGSENKAQAKLV

SEQ ID NO: 228988 - protein, 38 aa, Glycine max
  Coding DNA Sequence Number=SeqID_112210
MEEQQFVGGKSTPLIWPALDIASALSGDNLGPRKGSGP

SEQ ID NO: 228989 - protein, 132 aa, Glycine max
  Coding DNA Sequence Number=SeqID_112211
  Gene Ontology: Mol. function=transporter activity; Cellular component= mitochondrial inner membrane; Biological process=transport
  Homolog annotation: Hit_ID=Q2PF08; Match level="QueryCoverage=99%, HitCoverage=41%, E-value=4e-37, Identity=58%"; Hit description =Putative ADP ATP carrier protein
  Pfam annotation: Domain name=Mito_carr; Domain location=53-129; Score= 23.2; E_value=2.6e-05; Accession=PF00153.17; Description =Mitochondrial carrier protein
MVSRLDPNFHSTNYSATGSYLNGTVHSSEVAILSPASSYSITVHTPSEKEVGNFRVDFLMGGIVPIERVKNQDKMMKSGWLSEPYKRIGDCFALTMKDEGVISLWRGNTANVIRYFLTQALNLAFKKDKDAY

SEQ ID NO: 228990 - protein, 204 aa, Glycine max
  Coding DNA Sequence Number=SeqID_112212
  Gene Ontology: Mol. function=asparaginase activity; Biological process=glycoprotein catabolic process
  Homolog annotation: Hit_ID=O65268; Match level="QueryCoverage=96%, HitCoverage=46%, E-value=8e-69, Identity=65%"; Hit description =Putative L-asparaginase 4 precursor (EC 3.5.1.1) (L-asparagine amidohydrolase 4) ...
  Homolog annotation: Hit description=[Contains: L-asparaginase 4 subunit alpha; L- asparaginase 4 subunit beta]
CALEDRVMDTVGVICIDNEGHVASGASSGGIALKVSGRIGLAAMYGSGCWASSKGPFGAPFMAGCCVSGAGEHLMKGFAARECCVSLSLKSREYIIDEYQSSQSGAASACTKILRSVVEDGRQCGTDSSAGILVVQSDASLTDQGKSSRLKAVEIAAAYTSLSFGVGYFGSSMERPKVSILRSTKQQSKTAIDQFGARIDLSNG

SEQ ID NO: 228991 - protein, 239 aa, Glycine max
  Coding DNA Sequence Number=SeqID_112213
  Gene Ontology: Mol. function=asparaginase activity; Cellular component=cytosol; Biological process=glycoprotein catabolic process
  Homolog annotation: Hit_ID=O65268; Match level="QueryCoverage=86%, HitCoverage=46%, E-value=7e-55, Identity=54%"; Hit description =Putative L-asparaginase 4 precursor (EC 3.5.1.1) (L-asparagine amidohydrolase 4) ...
  Homolog annotation: Hit description=[Contains: L-asparaginase 4 subunit alpha; L- asparaginase 4 subunit beta]
  Pfam annotation: Domain name=Asparaginase_2; Domain location=4-238; Score=-136.5; E_value=0.003; Accession=PF01112.9; Description =Asparaginase
  Subcellular localization annotation: CTP_CleavageSite=26; ConfidenceScore=5.02e-01
MEGKRYFVAVHVGAGYHSPSNDKALRSAMNRACLAAASVLSNGSGTRLDAVVAAIQVLEDDPCTNAGRGSNLTEDGGVECDASVIDGKSGAFGAVGAVAVYYARGTLAKANALFLPLLLLSGVRNAIQIAALLAKEQMMGSPLLGRIPPIFLVGEGACKWAKSKDIALPPSIEEANEWLVTERAKAQWIKYKSMVESARSKTENTPEGDSSVYQNATVPGIFNGTLPQDLTLLFCFPKL

SEQ ID NO: 228992 - protein, 160 aa, Glycine max
  Coding DNA Sequence Number=SeqID_112214
  Gene Ontology: Mol. function=protein binding; Cellular component =intracellular; Biological process=positive regulation of protein modification
  Homolog annotation: Hit_ID=Q2QQ52; Match level="QueryCoverage=91%, HitCoverage=50%, E-value=1e-33, Identity=50%"; Hit description =Autophagocytosis associated protein, C-terminal domain containing protein, expressed
  Pfam annotation: Domain name=Autophagy_C; Domain location=8-153; Score=40.8; E_value=4.8e-09; Accession=PF03987.6; Description =Autophagocytosis associated protein, C-terminal domain
MYFFLLLGPEHEVNHYDFHIVYSASYRVPVLYFRSYRSDVDTRNASYINNPAQFIAYDGQLLPFNEIEKDLPGHSAKLRSESKWTFITHEEHPYLNRPWYKLHPCGTSDWMKLLFHSDSSLNKNGFVIEQYLISWFSVIGQVVGLKIPLEMLDTVVSNDS

SEQ ID NO: 228993 - protein, 344 aa, Glycine max
  Coding DNA Sequence Number=SeqID_112215
  Gene Ontology: Mol. function=RNA binding; Cellular component =ribonucleoprotein complex; Biological process=hemolysis by symbiont of host red blood cells
  Homolog annotation: Hit_ID=Q53M53; Match level="QueryCoverage=72%, HitCoverage=73%, E-value=4e-75, Identity=61%"; Hit description =Hemolysin A, putative
  Pfam annotation: Domain name=FtsJ; Domain location=161-315; Score= -55.7; E_value=0.013; Accession=PF01728.9; Description=FtsJ-like methyltransferase
  Pfam annotation: Domain name=S4; Domain location=105-152; Score=47.0; E_value=6.2e-11; Accession=PF01479.15; Description=S4 domain
  Pfam module annotation: Pfam domain module=FtsJ::S4; Domain location =161-315::105-152
MALQFLKHPLTISRGLQNETTLTFLSRLRNPKLPLSGFLLNNNNNNNDDDDDDDEKCGGGALIFLLLFFHELTLVRCEDNVQIPTSFRSYATAKSEKVLQVKKKKRLDEICVEKYQQYSRSIIQSWILQGKVYVDGKVINKAGTPVPDKAVVEIIADIPKYVCRAGHKLEAAIEQLGVDVTGKVALDSGLSTGGFTDCLLQYGASHVYGVDVGYGQKYIFVILWVRGRIVAVCLLLNQYGLMGKTHKVADKIRRDERVSVIERTNLRYLAELPQNVDLVTLDLSFISILLVMPAVVNVMKENAALVTLVKPQFEARRSQTTPHAIYNMKKEINIDYNQLLINRK

SEQ ID NO: 228994 - protein, 70 aa, Glycine max
  Coding DNA Sequence Number=SeqID_112216
MIGTSSKQGMVEMKRWKKKSEEGGNGNNMQSHEKLEGWLEQSKPHALSDMIIFMRAPHMKGTMLQRDIKG

SEQ ID NO: 228995 - protein, 71 aa, Glycine max
  Coding DNA Sequence Number=SeqID_112217
MTNVVKIKILTRIGKVGPLAIKQLRGKDSPYMEKDSFSKEELLLEKHLLTQVYPQESQECTFCYQTPKTEG

SEQ ID NO: 228996 - protein, 253 aa, Glycine max
  Coding DNA Sequence Number=SeqID_112218
PRLFRFFRRFPQINVGGDSARIPFLEDAPASLASPSRRRKGLTKGKPWVFQALEWGRVCPRYFPDCGVVRITKCGAWDSPRVDLGFCEPFGVSTRKFLTWVLGVVLMNACQSPWVALIGDIARALACMSLVVGGMYWRRSNVLMRTCHSLWVDLPRVDLGFFDPFGVSTRKLSDLGFRHRVLVCMPLIVGGTSIEVELQAGCGPEWTFPVKVKLSHSGFFYGLTLDSPYEGSQDDSISCLYPTVSLRMFNKGD

SEQ ID NO: 228997 - protein, 121 aa, Glycine max
  Coding DNA Sequence Number=SeqID_112219
MPPHTPRLPFLEHLTNDQHFLVPSIASSKQPVLLLVTATTMQKQVEQEIEAVMKLSLAHQWAKRASTAKRSFSALSTIEESVRASISRSHAKREISALSATGVFSQAQRMTGAKLKPTYLR

SEQ ID NO: 228998 - protein, 98 aa, Glycine max
  Coding DNA Sequence Number=SeqID_112220
MYIILKFNSSNLVKNTHAQTKSERTEILVSKKLKASHTKEAMPLGQQIHNSKKHLNRGISHGKVKVMDEVKLIKYMHGSPKSMTDVSMASTRLQQLTI

SEQ ID NO: 228999 - protein, 280 aa, Glycine max
  Coding DNA Sequence Number=SeqID_112221
  Gene Ontology: Mol. function=nucleic acid binding; Cellular component= nucleus; Biological process=mRNA processing
  Homolog annotation: Hit_ID=Q3HRY5; Match level="QueryCoverage=65%, HitCoverage=61%, E-value=8e-62, Identity=64%"; Hit description=Pre -mRNA splicing factor-like protein
  Pfam annotation: Domain name=RRM_1; Domain location=113-202; Score =26.9; E_value=7e-05; Accession=PF00076.12; Description=RNA recognition motif. (a.k.a. RRM, R
  Pfam annotation: Domain name=RRM_1; Domain location=18-72; Score =20.7; E_value=0.0017; Accession=PF00076.12; Description=RNA recognition motif. (a.k.a. RRM, R
  Pfam module annotation: Pfam domain module=RRM_1::RRM_1; Domain location=113-202::18-72
MELVEHGSPQGLLSCCVAIISSLQYGRIMDIELKVPPRPPCYCFVEFDNARDAEDAIRGRDGYNFDGCRLRVELAHGGRGPSSSDRRGYGGGGGNGGAGGGRFGISRHSEFRVIVRGLPSSASWQDLKDHMRKAGDVCFAEVSRDSEEKLYSGNNDVSVPLASSDGTFGIVDYTNYDDMKYAIRKLDDTEFRNPWARAYIRVRKYESSRSRSRSRSPSRSPSRSRSPKRVRSRSLERSVSRSRSRSQSASPIKSSRPRSRSRSRSRSGSGSPHQVLSGSG

SEQ ID NO: 229000 - protein, 231 aa, Glycine max
  Coding DNA Sequence Number=SeqID_112222
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=82%, HitCoverage=14%, E-value=5e-37, Identity=38%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVKANFDPVLLMVTTSTKIDTFSSWYLDTGCSTHMTVRRDWFISLDESTKNKVRFVDDNTLKVEEVGKVLIKRNDGKQSFISNVLFMLGMKSNLLSLCQLLEKGFVMKMKDNVLKVYDSKKGLVLMAYLSKNKTLKVGIDVIKHKCLATIVSKSEWLWHYRFRHLTFRDLNLLNRDNMMHRLSHIQVPSEVCEECFECKNPALISYHLLIKFSSGNGKLDEAISIIEVFKL

SEQ ID NO: 229001 - protein, 247 aa, Glycine max
  Coding DNA Sequence Number=SeqID_112223
  Homolog annotation: Hit_ID=Q307Z7; Match level="QueryCoverage=24%, HitCoverage=54%, E-value=5e-14, Identity=59%"; Hit description =Acidic ribosomal protein P1a-like
  Pfam annotation: Domain name=Ribosomal_60s; Domain location=21-111; Score=61.3; E_value=3.1e-15; Accession=PF00428.9; Description=60s Acidic ribosomal protein
MDSGVQGCILATLILHDEEIPVTAEKINALLKASNVSAESYWPSLFAKLAQNKNIEDLILNAGGGGAAVAVAAPAGGGGGAAAAAAPAAEEKKVEAGVAGVEEEHGGDHGAMMAKSFPQSLQKCMCLCKDFHIVKLHDFAVVIEVLYVIIIFERRSCLFLLMTAGSGFSFFEWDSGSVTLSLASIIIHLSLTKLWTVNIVQYKALPSLPEEFGSVLGRQVIKNKKLWGSIESLETLQPNANTRSNYS

SEQ ID NO: 229002 - protein, 97 aa, Glycine max
  Coding DNA Sequence Number=SeqID_112224
MDSKQCNPSNSGANLGLKRGGFCLDPAVDDGFGSFLAAEEEVASILGFELTPFTGPVPKENLQFWACAISKWLKIDIMASLWIFVGILVIDHLTDFD

SEQ ID NO: 229003 - protein, 146 aa, Glycine max
  Coding DNA Sequence Number=SeqID_112225
MEFRQGEEEQLFIGDTGNLEGEEAEEGEAKSKDLARVVANFFSPNLAHFGFHNHPTMTPKKNVTHRGLKSIPITVHRPNIAGRRRRRRRRKEPPESVQLPEKLRGGEGAAEYYLRRTKIRERAEKEDKFGEKSEGEKDKNDKGGVD

SEQ ID NO: 229004 - protein, 218 aa, Glycine max
  Coding DNA Sequence Number=SeqID_112226
  Gene Ontology: Mol. function=nucleoside-triphosphatase activity; Cellular component=chloroplast
  Homolog annotation: Hit_ID=Q2PMM5; Match level="QueryCoverage=97%, HitCoverage=9%, E-value=1e-112, Identity=92%"; Hit description =Protein ycf2
MEREKQMNNHLLPQEIEEFLGNPARATRSFFSDRWSELHLSSNPTERSTRDQKLLKKEQKKHLVLSRRSENKEIVNLFKIIMYLQNTVSIHPISSYPGCDMVPKGELDSSNKISFLNKNPFWGLFHLFHDRNSGRYTLHHDFESEEIFQEMADLFTLSITEPDLVYHKGFAFSIDSSGLGQKHFLNELFNSRDESKNHSLLVLPPLFYEENDLFIEGS

SEQ ID NO: 229005 - protein, 490 aa, Glycine max
  Coding DNA Sequence Number=SeqID_112227
  Gene Ontology: Cellular component=plastid chromosome
  Homolog annotation: Hit_ID=Q9FK23; Match level="QueryCoverage=82%, HitCoverage=80%, E-value=1e-119, Identity=54%"; Hit description =Arabidopsis thaliana genomic DNA, chromosome 5, TAC clone:K18G13
  Pfam annotation: Domain name=mTERF; Domain location=120-483; Score =62.0; E_value=2e-15; Accession=PF02536.5; Description=mTERF
  Subcellular localization annotation: CTP_CleavageSite=71; ConfidenceScore=5.26e-01
MVLALALSANRSCLCSSTTFHPHPLLNPSPSLHFSPSTFHPQPLCSLIKQHIIPQPSHKASIHRRRCSNSLATADAQFDIGIGFEETQVLLCNNHDLASVPIDSLHVRFLSLRSLGFDPLTLCKLVTKRPTILTANEIDPLLTFLRDNLQGKLEKQQLNRLLSSTEQEFLESFPQKVQFLVDRGIPVDQVVHVLNKVNLSKVLCRRSLEEIDRTISFLEPFGGIALILKRPQILNHDLDTQIVPRVKFLMELSDGDEDSVGKVLLRFPIFLNYSVAHVEEHVGFLSSFAEFDYKQIFRIIQVYPAIVTTSRERKLRPRIQFLKECGLDSDEIFKFLIKGPTFLSISFNENIAYKLVLLVKIGYRYRSKDLAMAIRSATRTNCGNMQKVISLFLNYGFSCEDIVAMSKKQPQILQYNHTSLEKKMEYLIEEMGRDIEELLLFPAFLGYKLDDRIKHRFEVKKLVRGRGMSINKLLTVSEETFAGKRKKVMP

SEQ ID NO: 229006 - protein, 151 aa, Glycine max
  Coding DNA Sequence Number=SeqID_112228
  Homolog annotation: Hit_ID=Q9FLV2; Match level="QueryCoverage=31%, HitCoverage=15%, E-value=1e-09, Identity=62%"; Hit description =Arabidopsis thaliana genomic DNA, chromosome 5, TAC clone:K18P6
  Subcellular localization annotation: CTP_CleavageSite=51; ConfidenceScore=5.56e-01
MPMSTILAELFCMGATLSKTNKKCPRKQTNPKIFLASSATTTTTNSKPSVPAALPAAPSGDPAVPEVEEEAAADRGEDEEEGNELKGFTKSEVTVIDTSSPGWKVDKFVFRKNNVWKVREKKTKNKFLAKRKSNSTLAPRDVHVNAIENSK

SEQ ID NO: 229007 - protein, 288 aa, Glycine max
  Coding DNA Sequence Number=SeqID_112229
  Subcellular localization annotation: CTP_CleavageSite=32; ConfidenceScore=5.24e-01
GSSSTAAATAHRRHGPSEAPTAPIHSSLSSPRSSTLFSSDDQRLWYLSQFSSRIILDPKYLDIDFFNDETFDCYQVFQNSGLVDFMSLKLPYNPELVKVFYCNLKIQDDILSSEVHGIPMIIDQSLFFSLTKLPNQGAPFEGTIVDDWKFDYSCHDARRMALRANAPLPYPQLVTLFLRHFQIPLDDEPFVQVKRSFAIGAGAVTSFGYRKDRNGQWLKKDALPPQRDDSALMTEVLFELRGLRTYVGEHFDSLDTRFAGMDIRLTQLEEDVGYIHQSLDLPPPPPPS

SEQ ID NO: 229008 - protein, 87 aa, Glycine max
  Coding DNA Sequence Number=SeqID_112230
MTLHCTRQPSLLALAQEHERLSLSSQTPKLAGSPSCPHNKGYLLFDMRDLGAYLGHAHLDVGQLQILKRIITCKSRNSTSNGSKECA

SEQ ID NO: 229009 - protein, 147 aa, Glycine max
  Coding DNA Sequence Number=SeqID_112231
MAIVESWTWGSLELKVFLVDDSMHGGLVVCHVTMKWWRPSCEMKKKASSWIKKRLPLEGEAIMWKRLIIEGEIVGVQLVVYLWTWGFVVSKVFLADPWTWGSLESKVFLAYEFMHGVQIVARDHEVVKSEAMQDTRACWQQWLAKQE

SEQ ID NO: 229010 - protein, 66 aa, Glycine max
  Coding DNA Sequence Number=SeqID_112232
MDDQYEILMSLPVCKPQLKIENPSKALIESIRLNFFWKRKTRKENRASSEEHAASSRRQMLMLNRC

SEQ ID NO: 229011 - protein, 39 aa, Glycine max
  Coding DNA Sequence Number=SeqID_112233
MAVLSFAKNKFPKFLSLSKTATRSAPAKHKAETVAKNNR

SEQ ID NO: 229012 - protein, 55 aa, Glycine max
  Coding DNA Sequence Number=SeqID_112234
MPPTVPVNHYSDPEGQHNRIRILHDPASEGGRSASPAKGRADRCTPEGGPIDPTQ

SEQ ID NO: 229013 - protein, 328 aa, Glycine max
  Coding DNA Sequence Number=SeqID_112235
  Homolog annotation: Hit_ID=Q1SKD7; Match level="QueryCoverage=72%, HitCoverage=61%, E-value=4e-12, Identity=24%"; Hit description =Ankyrin
MAPKKLFAKRARKATTGEGYGAAPQAEIEFNGHHFRSEEHQRHFEMIKDWSFLKERRVQLAEGKYAKFQAEVARRHWTQPTEPMAKYNPEIVMEFYANAWPTKEGVMDKRSWVQGQWIPYDEDAINQFLGHPLILEEGQHCEYAKRRSQVSGFDEEAIGQLLCSPGHDFARSVARRRVRLMRTSMTALTEIWMTLLLSNILPDDHNSDLPLPKCQLVYAILIQISVHVAQLISNVIYQFVGIALEKSNRALGFPALIIGLCYFYRVPVMPTKLIQPPLTGTTTGARPVAVASSRCTTIASTSATIPRVHFSSHAKDGAPDACIHAAFG

SEQ ID NO: 229014 - protein, 83 aa, Glycine max
  Coding DNA Sequence Number=SeqID_112236
MESKLILKLECGVWKMVPECDMSEYVPRPPYVGEDSPQYMLGPHYVEIEEDPEMLEKEQSEVTEEPLNHAMEDGMAIVDEELP

SEQ ID NO: 229015 - protein, 222 aa, Glycine max
  Coding DNA Sequence Number=SeqID_112237
  Gene Ontology: Mol. function=nucleic acid binding; Cellular component= nucleus; Biological process=DNA integration
MVKLVRVQFHKMWKLKNSKLIAPSIIVPNNNEEEQHNNEPMIHNEPIVEEPQEVTLRRSQRERRSAISNDYMVYLHEPETDLSINDNDQILFSQVVSYDNLDAMKEELNSMEHNSVRDLVHFPKGCKKVGCKWVFKTKHDSHGNLERYKARLVAKRFTHKDEIVYKETFSPISRKNSFKIIMTLKYFVVKVEVQKQKVSIEHISKNLMIVNPLTKGDIYRAC

SEQ ID NO: 229016 - protein, 600 aa, Glycine max
  Coding DNA Sequence Number=SeqID_112238
  Gene Ontology: Mol. function=protein dimerization activity; Cellular component=nucleus; Biological process=regulation of transcription, DNA-dependent
  Homolog annotation: Hit_ID=Q9XED8; Match level="QueryCoverage=95%, HitCoverage=81%, E-value=1e-157, Identity=54%"; Hit description =Auxin response factor 9
  Pfam annotation: Domain name=Auxin_resp; Domain location=258-339; Score=169.5; E_value=8.5e-48; Accession=PF06507.4; Description=Auxin response factor
  Pfam annotation: Domain name=B3; Domain location=125-236; Score=93.9; E_value=4.9e-25; Accession=PF02362.12; Description=B3 DNA binding domain
  Pfam module annotation: Pfam domain module=Auxin_resp::B3; Domain location=258-339::125-236
MLSRGAHGEVVGSGESGEDELYEQQWKACAGPLVDVPRVGQRVFYFPQGHMEQLEASTNQELNQRIPLLKLPTKILCRVVNVHLLAEQETDEVYAQITLVPESSQDEPTNADPCTAEPPRAPVHSFSKVLTASDTSTHGGFSVLRKHATECLPVLVMRSVPDMSQPTPTQELVAKDLHGYEWRFKHIFRGQPRRHLLTTGWSTFVTSKRLVAGDTFVFLRGDNGELRVGVRRLARQASSMPSSVISSQSMHLGVLATASHAVATQTLFVVYYKPRTSQFIIGVNKYLEAMDKKFSVGMRFKMRFEGDDSAETDKRFSGTIVGVEDISPHWVNSKWRSLKVQWDEPAAVPRPDRVSPWEIEPFVASASTPSVQPTMVKTKRPRPPSETPDVDTTSVASVFWDAGLQQADMAQKNVLAESKWNDNTGTWHHMQTDMNSKSNSGNTMLRNQTEGSWLSSPHSSCPSHLFQDVTDDSKIVSAWPVSKPHSSKLNNDHVLDQVDKESKVETATSYRLFGIDLIDPSRNSPSVEKASAQAVNVPKVTTEGCTSTLSRTDAGHKSDVSMASSMERKQEQLQVSPKDTQSKQICRSRTKVLNIDCLFR

SEQ ID NO: 229017 - protein, 335 aa, Glycine max
  Coding DNA Sequence Number=SeqID_112239
  Gene Ontology: Mol. function=RNA-directed DNA polymerase activity; Cellular component=chromatin; Biological process=chromatin assembly or disassembly
MPMTEPDMSDSNVKGCPKSGEAKIGASVIACFSLSKNHVKPRNPWSSVVDAGEGQFLMALIFFGSYAMLATNTMCSRYWRVVLANKHFNFHKRNCSMDKVVKIASKWGHVGVQEHTINENFIDFWHREPVLHKECIQGAIVNTTSPTFVLLLDQQHRRGKRVVIDLDEARIQHSRNLFLKLNFLEVKVTLWSNVHGLGIGKKVNVKGNGALGWVTKRKRCGQGWVREKCGKELRRFVYDDGGTVQGQGVQIGSKGVTLNHEWHLGANTGAIEYPIIANHDAKGGYQSGRKVKEFGNPILHKIVGTIAIDQNRNAMVVDTVIKAKGHESGHSQHGI

SEQ ID NO: 229018 - protein, 450 aa, Glycine max
  Coding DNA Sequence Number=SeqID_112240
  Gene Ontology: Mol. function=two-component response regulator activity; Cellular component=nucleus; Biological process=two -component signal transduction system (phosphorelay)
  Homolog annotation: Hit_ID=Q6LA42; Match level="QueryCoverage=98%, HitCoverage=58%, E-value=3e-64, Identity=38%"; Hit description=Two -component response regulator-like APRR5
  Pfam annotation: Domain name=Response_reg; Domain location=49-221; Score=59.4; E_value=1.2e-14; Accession=PF00072.14; Description =Response regulator receiver domain
MGEVVIMSGEKKSVRVEGVEKEDSGGSGSKAGEFKGLMRWEKFLPKMVLRVLLVEADDSTRQIIAALLRKCSYKALTSFLGSVSLRVFTRLNEKGGVKAGTEEAISKSKISESQFEKGLTYMIFDIIKGAMVAVPDGLKAWELLKGRPHNVDLILTEVDLPSISGYALLTLIMEHEICKNIPVIMMSSQDSISTVYKCMLRGAADYLVKPIRKNELRNLWQHVWRRQSSTTGINGLQDESVAQQKVEATAENNAASNRSSGDAACIQRNIELIEKGSDAQSSCTKPDCEAESDPVGNMQEFSLLKCGEAYPSGTETQQVETSFRLGQTLMMHDCHAGGLNVSIRKNGEASTTNDKDTDTEHFGNASISGEAHDNPYVQINSSKEAMDLIGAFHTHPNCSLKNSTVNCTGNFDHSPQLDLSLRRSCPGSFENKLTEERHTLMHSNASAFKR

SEQ ID NO: 229019 - protein, 91 aa, Glycine max
  Coding DNA Sequence Number=SeqID_112241
MEFLIVTSFAVWVRYGYGRGTGTSLWYATLRIIDLQTFHFLAKTNCEMSFFLLCRLCIWVWYLAALVLSYKKVSLAHKKKKFFGECLDGKI

SEQ ID NO: 229020 - protein, 312 aa, Glycine max
  Coding DNA Sequence Number=SeqID_112242
  Homolog annotation: Hit_ID=Q9FGE4; Match level="QueryCoverage=39%, HitCoverage=41%, E-value=3e-39, Identity=64%"; Hit description =Arabidopsis thaliana genomic DNA, chromosome 5, BAC clone:T31K7
  Subcellular localization annotation: CTP_CleavageSite=82; ConfidenceScore=5.33e-01
MSSISKFAALNPPPIADPSSSIIPLTAADSGSSLGFIFSDRGLPRFLTLPSDNSWCDSTRILPCFPVTRTRTTWTVRTGGVESAREVSPWESSSQRLCTFLVPGFTPHEANDSEGSRGFSHSESDCGDAKLWRRGGRRVLLRLLFFEDFDVVVFVRDMAGILRKRRGKGQRVEPPMWGFEDETRKQTERAVRSRSGREGRVVCGGGGNISTGGAMMMQRVRGACVDGKVHAWKNKYEVGDGFVNCVLGLDIHILLSSAALLYSFSFYPSSPLWPFFITNTWLHSLCLISVVLNSCGPTFCFTWTGLHLSEAQ

SEQ ID NO: 229021 - protein, 74 aa, Glycine max
  Coding DNA Sequence Number=SeqID_112243
  Subcellular localization annotation: CTP_CleavageSite=23; ConfidenceScore=5.19e-01
MWLRMPPVSWDTVTKSGVVDKSKAFAPTYPQFVMRNSDLRSSCQLISFLNDHLEETLGPTKIGENHSKCINLTP

SEQ ID NO: 229022 - protein, 53 aa, Glycine max
  Coding DNA Sequence Number=SeqID_112244
MMRILLIGQGVGLKPNSHITPQGTRDNDDLKTTCKISHGYSQGGHSSIPFMAL

SEQ ID NO: 229023 - protein, 80 aa, Glycine max
  Coding DNA Sequence Number=SeqID_112245
  Gene Ontology: Mol. function=RNA-directed DNA polymerase activity; Cellular component=chromatin; Biological process=RNA-dependent DNA replication
MKYRHPIPRLDDMLDKFHGANIFSKIDLRSGYHQIRMRKGDEWKTTFKTKFWLYEWLVMPFRLTNDLHEANESCAKGVHR

SEQ ID NO: 229024 - protein, 75 aa, Glycine max
  Coding DNA Sequence Number=SeqID_112246
MTVKKRLSHEVLKVIVEFSSSVGLSAHPSLSTASGRDRDTRREDNFCREFQSTPQCLFREKSSRGSKRSSFCRET

SEQ ID NO: 229025 - protein, 120 aa, Glycine max
  Coding DNA Sequence Number=SeqID_112247
  Gene Ontology: Mol. function=endonuclease activity; Biological process=DNA catabolic process
  Homolog annotation: Hit_ID=Q9ZR88; Match level="QueryCoverage=72%, HitCoverage=31%, E-value=2e-14, Identity=42%"; Hit description =Bifunctional nuclease
  Pfam annotation: Domain name=S1-P1_nuclease; Domain location=24-120; Score=-122.4; E_value=0.00059; Accession=PF02265.7; Description=S1P1 Nuclease
MGCYRVQLVAIISFMLLLSNTHGWGDDGHAIVCKIAQARLSTAAAKAVKKLLPKSANNDLASKCSWADSLRVVFPWSSALHFANTPDSVCNYKDTSNFLSHSSSLNSPFACTCFKLSPDS

SEQ ID NO: 229026 - protein, 133 aa, Glycine max
  Coding DNA Sequence Number=SeqID_112248
MLIIQWSMSDVLGKFIPLVSKDWTQSEVARLFYAIKPYGNQLHKLSEACRVVSHIGLIDYSLLVIDYTVVSETTIDLFKSLYFNRLPCDIIDYFFFLSSLEVNKNTLIDYFEYIINYIVLELFSGFGKNTLID

SEQ ID NO: 229027 - protein, 109 aa, Glycine max
  Coding DNA Sequence Number=SeqID_112249
MYPITYNQDLVSLALLARWKELKEFYELTGNHHVTLTHYGQRCVEYHVLIYENLTKSLVHDGCKGKKRVTNRMYTMNVIGRIEVKNLDPEGQALLLCESFLRHEKGSKG

SEQ ID NO: 229028 - protein, 76 aa, Glycine max
  Coding DNA Sequence Number=SeqID_112250
MDPIRFQSVLEGLSPDDTSREDWDQLKASYHLEDKVVFEAMGDNMKQEPRMQSTLRERSTRKVTTPGYLRDYVERF

SEQ ID NO: 229029 - protein, 133 aa, Glycine max
  Coding DNA Sequence Number=SeqID_112251
  Subcellular localization annotation: CTP_CleavageSite=13; ConfidenceScore=5.09e-01
MPNPDSPNHSPLSSSANPSSTSLFHAHCMKLEVQWFDSVDPLGWIFKITQFFSNDQVTSWSVFLLALQTRFATSQYEDPSRALYKLTQRSTVNAYLSEFKNLANRTIGLPPPFRLSCFISILAPKMRHEVQAL

SEQ ID NO: 229030 - protein, 159 aa, Glycine max
  Coding DNA Sequence Number=SeqID_112252
  Gene Ontology: Mol. function=RNA-directed DNA polymerase activity; Cellular component=chromatin; Biological process=chromatin assembly or disassembly
MAIHGSQRRKQHPEYAPSCPHKEDDSGADGHCPPSHEVVLWPELEGPNCGPSAPGQSYGHKGSGARWPERVCRLICVGYKIRFRGDMLKAIIVILNQEENLGGIFVAMMKFIIAIEIEAALALRGQLLQEKSFDRQRRKRFERCGQQQRRGRRSGSGNR

SEQ ID NO: 229031 - protein, 268 aa, Glycine max
  Coding DNA Sequence Number=SeqID_112253
  Gene Ontology: Mol. function=RNA-directed DNA polymerase activity; Cellular component=chromatin; Biological process=chromatin assembly or disassembly
  Pfam annotation: Domain name=zf-H2C2; Domain location=214-248; Score =17.9; E_value=0.0015; Accession=PF09337.1; Description=His(2)-Cys(2) zinc finger
MKYPFEWSSKAQQVFTGLKDVLSIAPTLLLPDFIIPFSLETNVFGVDMGAVLSQKGHPIAFFSKPFTPKLLHASTYAWELFAITTAIKKWRQYLLGHHFIILTNHRSLKELMTQVVQKLEQQMYLAKLMGFDYEIHYRSNKANVVTDALSRIPKATLSSLLLFLVPCFPFLGELKQHLMNDPVFLKLRQAISNDPATYSDYSIAQDLILKGGGHMGVAKTLAHLSENFTWRGIQKDVECFIAACVDCQHMKYETQKAVRLLCPLPVPF

SEQ ID NO: 229032 - protein, 90 aa, Glycine max
  Coding DNA Sequence Number=SeqID_112254
MDTSKPYTGAMRGIMHEPQVNIGADQKFSPVDVLLNRKKKRKKRMNPGISMGLIKRQTAPLPSLQNGQVTKSNRTYTLREFPERLAKDRI

SEQ ID NO: 229033 - protein, 298 aa, Glycine max
  Coding DNA Sequence Number=SeqID_112255
  Gene Ontology: Mol. function=catalytic activity; Cellular component =integral to membrane; Biological process=cellular metabolic process
  Homolog annotation: Hit_ID=Q1MMK8; Match level="QueryCoverage=100%, HitCoverage=86%, E-value=1e-106, Identity=64%"; Hit description =Putative CoA reductase
  Pfam annotation: Domain name=3Beta_HSD; Domain location=7-280; Score=- 51.5; E_value=3.2e-09; Accession=PF01073.9; Description=3-beta hydroxysteroid dehydrogenaseisomerase family
  Pfam annotation: Domain name=Epimerase; Domain location=6-250; Score =48.2; E_value=2.7e-11; Accession=PF01370.11; Description=NAD dependent epimerasedehydratase family
  Pfam annotation: Domain name=NAD_binding_4; Domain location=8-233; Score=-49.9; E_value=2.1e-05; Accession=PF07993.2; Description=Male sterility protein
  Pfam module annotation: Pfam domain module=3Beta_HSD::Epimerase::NAD _binding_4; Domain location=7-280::6-250::8-233
MSNDKVLVTGGSGFIAQYCIIALLQQGYQVRTTLRDANREAEVRAHLLQAGVAAGEALQFVVADLTADAGWEDAVAGCRFVLHGASPTPTGSQVSEADWVNPAIEGNLRVLRAARDAGVKRVVLTSAFGAVGIGHPADYPRPFTERDWSDVSGDVWPYQKSKTLAERAAWQFIAEQGNGLELATVNPVSVLGPVLGADYSHSIRIVKELLEGQPGCPDINSCFVDVRDVASLHVLAMTHAAAQGQRFLASSGHSLPLIEVARTLKTHLAAEAEKVSLQPMSDAMVRAAAAQNPLMTGM

SEQ ID NO: 229034 - protein, 140 aa, Glycine max
  Coding DNA Sequence Number=SeqID_112256
MCSELQNSISSNSIYCGTQSDIRVKSYCRLNLLRASIINFERLDILRDSIRHRSKKLLSFEFAQTFGIPFRATRYITGLNRTSEASEFHFEQLDILRDSIRHPSKKLLSFEFSQSFDNQFRASRYITGLSQTTESKVVVV

SEQ ID NO: 229035 - protein, 73 aa, Glycine max
  Coding DNA Sequence Number=SeqID_112257
MEDCLEGLHLGNHETQLQPRRWRTHERKRNSWSSEKGLAGGVGYRQLRTTLNGNLKGSDTKNGFSFAGSPLPC

SEQ ID NO: 229036 - protein, 188 aa, Glycine max
  Coding DNA Sequence Number=SeqID_112258
  Gene Ontology: Mol. function=chitin binding; Cellular component =extracellular region; Biological process=chitin metabolic process
  Homolog annotation: Hit_ID=UPI000044A8F0; Match level="QueryCoverage =63%, HitCoverage=99%, E-value=3e-11, Identity=24%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
KIRDELATQLAQACSARPGENFTDCVTTLPFDFRHVSGLTYCATKGVKYLEAGMTHVLTFRGLHALAFKGRLVLNFRGLHAFAFRGLDVITFRGLHALTFRGLYILPLRGIHALTFRGLHVLTFRGLHVLVFRGLLALAFKGLHILAIKRRHVLNFRGLHALAFRGLCVLTFSGLHIHTLREFKVLCP

SEQ ID NO: 229037 - protein, 587 aa, Glycine max
  Coding DNA Sequence Number=SeqID_112259
  Gene Ontology: Mol. function=ATP binding; Cellular component=nucleus; Biological process=apoptosis
  Homolog annotation: Hit_ID=Q9AUH6; Match level="QueryCoverage=97%, HitCoverage=90%, E-value=0.0, Identity=72%"; Hit description=F-box containing protein TIR1
  Pfam annotation: Domain name=LRR_2; Domain location=119-142; Score =4.0; E_value=4.5; Accession=PF07723.3; Description=Leucine Rich Repeat
  Pfam annotation: Domain name=LRR_2; Domain location=170-195; Score =3.9; E_value=4.7; Accession=PF07723.3; Description=Leucine Rich Repeat
  Pfam annotation: Domain name=LRR_2; Domain location=202-228; Score =14.9; E_value=0.15; Accession=PF07723.3; Description=Leucine Rich Repeat
  Pfam annotation: Domain name=LRR_2; Domain location=472-496; Score =1.0; E_value=12; Accession=PF07723.3; Description=Leucine Rich Repeat
  Pfam module annotation: Pfam domain module=LRR_2::LRR_2::LRR_2::LRR _2; Domain location=119-142::170-195::202-228::472-496
MKQIDDGDDEQRSLSPLPEQVLENVLESVLHFLTSRRDRNAASLVCKSWYRAEALTRPDLFIGNCYAVSPRRATARFPRVRSLTIKGKPRFADFDLMPLNWGAHFTPWATALSQSYPSSLNKLHLKRMSLTDHDLILLSHSFPSFQDLVLTCCEGFGTTGLAALTSNCRLLRVLELVECVVEVGDEEMDWISCFPESDAQTHLESLVFDCVECPVNFDALERLVARSPLLRKLRLNRYVSMSQLHRLMHRAPQLTHLGTGSFSASELDQELDFASAFASCKSLVCLSGFREFWADYLPAIYPACANLISLNFSFADISADQLKSVIRHCHKLQTFWVLDTICDEGLQAVAETCKDLRELRVFPVNTREEIEGPVSEVGFEAISRGCRKLQSILFFCQRMTNAAVVAMSNNCPDLVVFRLCIIGQYRPDPVTLEPMDEGFGAIVMNCKKLTRLAVSGLLTDRAFSYIGTYGKLIRTLSVAFAGDTDLGLQYVLQGCPNLQKLEIRDSPFGDGALHSGLHHFYNMRFLWMSSCKLTRQACQEVAQTLPHLVLEVINSEEDKADGIEILYMYRSLDGPRDDAPKVVTILC

SEQ ID NO: 229038 - protein, 507 aa, Glycine max
  Coding DNA Sequence Number=SeqID_112260
  Gene Ontology: Mol. function=pyridoxamine-phosphate oxidase activity; Biological process=pyridoxine biosynthetic process
  Homolog annotation: Hit_ID=Q9LTX3; Match level="QueryCoverage=90%, HitCoverage=93%, E-value=1e-148, Identity=56%"; Hit description =Similarity to pyridoxamine 5-phosphate oxidase
  Pfam annotation: Domain name=Pyridox_oxidase; Domain location=383 -444; Score=6.7; E_value=0.032; Accession=PF01243.10; Description =Pyridoxamine 5'-phosphate oxidase
  Pfam annotation: Domain name=YjeF_N; Domain location=139-311; Score =192.0; E_value=1.4e-54; Accession=PF03853.5; Description=YjeF -related protein N-terminus
  Pfam module annotation: Pfam domain module=Pyridox_oxidase::YjeF_N; Domain location=383-444::139-311
MVVGEVNSGEGDAEAQLPLVPKGSSSISMTCLCLTHSITQTHNHNHNLPHATTTFSSSLHNRNPLFQLFSVSNQFPLLSRALFQSIILRPRIRPFSTNLTASYSSSAFAQIMANFDADSVTYLTQRDAAEIDETLMGPLGFSVDQLMELDVLSVATSISEVYKPCEHSRVLTICGPGNNGGDGLVAARHLHHFGYKPFVCYPKRTPKPLYAGLVTQLEALSIPFLSVEELPSDLSNDFDVVIDAMFGFSFHGSPRPPFDDLIQRLVSLHNNNNQIGQKRSVIVSVDIPSGWHVEEGDVDGTGIKPDMLKFCGPHHFLGGRFVPPAIAEKYKLILPPYPGTSMCVQIGKPPQIDISALRENYISPEFLEEQVEVDPINQFHKWFDDALAAGLKEPNAMALSTVGKDGKPTAEAMLFGKCLFVFACYYCFALVRVEGPVQKVSDEESEQYFHSRPRGKSDWSNSQQAEYCSACSLSGVQRAGRKIPDGSLIPKPKNWGGYRLTPQLFEF

SEQ ID NO: 229039 - protein, 121 aa, Glycine max
  Coding DNA Sequence Number=SeqID_112261
MKHIIDIIAELRNQIAIFNRELKEGRLRIPVFQDDACRWLIQIQQHFDMKKEGKLQLVVKVLEGHAYDWYKQWGVSNPKVSWEELQMSVLKKFQARYDLNLPVRVQGKGNLGSKTKGKMKG

SEQ ID NO: 229040 - protein, 75 aa, Glycine max
  Coding DNA Sequence Number=SeqID_112262
  Subcellular localization annotation: CTP_CleavageSite=53; ConfidenceScore=5.21e-01
LVFVKLRSIFEVVTAKKPVKDKPTVDSGSKSKGSGKKLSTSATPLNPLPAIARATPIAMNMGLPSGPSAVPAIGP

SEQ ID NO: 229041 - protein, 105 aa, Glycine max
  Coding DNA Sequence Number=SeqID_112263
MVPKKLLCKRARKDTAGEGSSSAPQVDMEFDRHWFRSKEHQRHFEAIKGWSFLKERRVQLREGEYAEFQEEISRRQCTQLTGPMAKYDPEIVIELYANAWHTKEG

SEQ ID NO: 229042 - protein, 140 aa, Glycine max
  Coding DNA Sequence Number=SeqID_112264
  Gene Ontology: Mol. function=cysteine-type peptidase activity; Cellular component=intracellular; Biological process=proteolysis
  Homolog annotation: Hit_ID=UPI000054845F; Match level="QueryCoverage =51%, HitCoverage=23%, E-value=4e-10, Identity=43%"; Hit description =PREDICTED: similar to SUMO1/sentrin specific protease 7 isoform 1
  Pfam annotation: Domain name=Peptidase_C48; Domain location=2-137; Score=-13.5; E_value=0.0057; Accession=PF02902.9; Description=Ulp1 protease family, C-terminal catalytic domain
MVRCFGNLNFGRYLKNQIPDKEKPRFHFFNSFFFRKLADMDKNPSSASDGKAAFLRVRKWTRKVNLFAKDYIFIPVNFNLHWSLIVICHPGELVNFNGEVSAYDRSCENKELDNSLKVPCILHMDSIKGSHSGLKNLVQR

SEQ ID NO: 229043 - protein, 405 aa, Glycine max
  Coding DNA Sequence Number=SeqID_112265
  Gene Ontology: Mol. function=cysteine-type peptidase activity; Biological process=proteolysis
MPILVLHLPILPNITSNFQLNVDWFLPAEAFLKRTLIQKLIFELLENHGSHEISSSDCSDDDECLQNNDNRTGIDHPEVNKESTTSHAGQGIEITLLSGSSSLDPQSFNNSGLVLKELFDPGATAGAMLGQCQSFDQRSSDYRFSGSIFSIEEDTDLGNQFMYLPTDPNFQQVTGITPPTCSLPYLPRDCGDETCHRPQISPLVDRDVVQPSLDTSNGVLDDSEDVTVTKSCLVLNVPGSSNEPEQGEKTCSAMENAEHVIDISNSVVGNSLDSITKCDDNKNGDLHYTGQETLTIPVQQVSDAVDDEETPIPLQQVSDAVHDEETPIPVQVSDAVNNEETPTVSLQQVSDAVDDEEAPTTPSQVSDEAGCDDGQMIDDMEPDNCEEQAAKRRRLMPLQCRSEAL

SEQ ID NO: 229044 - protein, 143 aa, Glycine max
  Coding DNA Sequence Number=SeqID_112266
MEVVLHPDYVIYQDNYYLGPKLTFSPCFVKINVSTACIKQEAFDLEWAVDDLIDINCQLFQSSGTVIIKLRVISHNASQSNHVSDASGIEELEIAVADYNWSLRHRQITSLNLKYLASWNMALRVDVEGNGTDSRGSRCYFPK

SEQ ID NO: 229045 - protein, 52 aa, Glycine max
  Coding DNA Sequence Number=SeqID_112267
MMRWMTAARCSGAATRKDGTEEAELKQELGFFFSFFLSVSFGVGFRERNGQR

SEQ ID NO: 229046 - protein, 184 aa, Glycine max
  Coding DNA Sequence Number=SeqID_112268
  Gene Ontology: Mol. function=sequence-specific DNA binding; Cellular component=nucleus; Biological process=regulation of transcription, DNA-dependent
  Homolog annotation: Hit_ID=Q6RF31; Match level="QueryCoverage=97%, HitCoverage=72%, E-value=3e-23, Identity=36%"; Hit description=MADS box transcription factor
  Pfam annotation: Domain name=K-box; Domain location=29-122; Score =49.7; E_value=9.9e-12; Accession=PF01486.8; Description=K-box region
MNDIVTKYSTHSHGINKLDKPSLELQSLYRLNFLVTKLEASNSAKLSKEIADRTQELSWLKGDDLQGLGLNELQQLEKTLEIGLDRVTDIKENQIMSQISELQKKGILLEEENKHLTKKLAEKEKEAMLCKAKIPFMVDSDKGIMQEEGVSLDSTNNISSCISDPPLEDGSSDISLTLGLPFSN

SEQ ID NO: 229047 - protein, 146 aa, Glycine max
  Coding DNA Sequence Number=SeqID_112269
  Homolog annotation: Hit_ID=Q9LUW1; Match level="QueryCoverage=61%, HitCoverage=6%, E-value=2e-24, Identity=58%"; Hit description =Arabidopsis thaliana genomic DNA, chromosome 3, P1 clone: MCB17
  Subcellular localization annotation: CTP_CleavageSite=95; ConfidenceScore=5.27e-01
MMGLSLLLLSVQSNSLPLPLSVPSGLPLMGYMTPLQGVVSMDGTPVKSTTISPPHLLFNQPWPKRCATHCYIARNILCHQQIARMNSFWPTTAGSASLYGGKPNNLNVVPSTELHENVPGRAANSSQDKGHGIVKFSEHIGKDKAY

SEQ ID NO: 229048 - protein, 70 aa, Glycine max
  Coding DNA Sequence Number=SeqID_112270
MEVETKSSPRVSILEKTNEKGKGIGHVDVSYWAKLLDSAVSFSAFDGRCYGNLDKEISPTPISQVDEEKI

SEQ ID NO: 229049 - protein, 150 aa, Glycine max
  Coding DNA Sequence Number=SeqID_112271
PAVDALDFLEGDEDPLLEVDSPEEVMSASEADSTEDSGPREMAISGGSSSYAPVEFDSHRERRVQLREDEYPDFQEEIARRRWARMVTPMAKFDPEIVIELYANAWPIEEGVQDMRSWVRGHWIPFDANALSQFLSDPLILEENQQCEFS

SEQ ID NO: 229050 - protein, 141 aa, Glycine max
  Coding DNA Sequence Number=SeqID_112272
MQHLGSDPRSSPNEQWSTKWHDPHLPPPRSGPGKILPRYAQQLGDGLLIEAVCLVPPLAELTLLVLLQNQRVAQELAEGIRIEGDPVTPHPRAHLDTPLPVERLSLDGLIALLVFGTPEPVTVKLHGGAGAFPMGIVASLN

SEQ ID NO: 229051 - protein, 419 aa, Glycine max
  Coding DNA Sequence Number=SeqID_112273
  Gene Ontology: Mol. function=zinc ion binding; Cellular component =membrane
  Pfam annotation: Domain name=MS_channel; Domain location=7-383; Score= 0.1; E_value=5.6e-06; Accession=PF00924.9; Description=Mechanosensitiv e ion channel
MRIDFTGKAVYTAIWVAAVSLFMELLGFSTQKWLTAGGLGTVLISLAGRESFYGLSCIFDFSNFVRVTLQGIAIAIINQIFTNFLSSIMIHATRPFVVNERIQTKIKGYEVTGKVEHVGWWSPTIVRGSDCEAVHIPNHNLSVNVVRNLSKKSHWRIKTHLAISHLDVNKINSIIADMRKVLAKNPQVEQKKLHRREAILLDLLRVISHHRARLATPIRTVQKMCSDTDLDVDPFDDTIPTRSRSKNNRPFPLINPPYKVKPSTTTNEDKDTKIDETLPSDFKVERDKFAATSSSVQKTSKSQKLKKERVGSSEKGTTSKNLSKSNEFGSGETTSPSKLDEEKSVMSSSSASHSLEENIVLDAALLGSKRTLAIDEELIQSIPAEPQEVAVHQDGSEPPISKDKKDGEMSSFPTPKQKD

SEQ ID NO: 229052 - protein, 233 aa, Glycine max
  Coding DNA Sequence Number=SeqID_112274
  Gene Ontology: Mol. function=nucleotide binding
  Homolog annotation: Hit_ID=Q9FKP3; Match level="QueryCoverage=98%, HitCoverage=40%, E-value=1e-91, Identity=73%"; Hit description =Similarity to auxin-independent growth promoter
  Pfam annotation: Domain name=DUF246; Domain location=1-197; Score =53.5; E_value=9.2e-18; Accession=PF03138.5; Description=Plant protein family
MQDMAAHSACDFGGGKAEKLALAKYRQVLWQGRVLNSQFTDEELRNQGRCPLTPEEIGLLLAALSFNNRTRLYLASHKGHRALCALTWDLSGLLSCFQVYGGEARLATLSKLFPLMEDKKSLVSTEEMAKVKGKASLLAAVDYYVSMQSDIFISASPGNMHNALEAHRAYMNLKTIRPNMRLLGQLFQNKSIGWSEFQLAVLDGHKNRQGQIRLRKENQSIYTYPAPDCMCRA

SEQ ID NO: 229053 - protein, 70 aa, Glycine max
  Coding DNA Sequence Number=SeqID_112275
MQSSKCDVYLGAYLNGALKGLDDAPQSKSKAPARWIVVKYFNDPRPLEPERLKVLRIQWAQYYLRVRAQS

SEQ ID NO: 229054 - protein, 330 aa, Glycine max
  Coding DNA Sequence Number=SeqID_112276
  Gene Ontology: Mol. function=microtubule motor activity; Cellular component=microtubule associated complex; Biological process =microtubule-based movement
  Homolog annotation: Hit_ID=Q9FME7; Match level="QueryCoverage=95%, HitCoverage=25%, E-value=3e-64, Identity=43%"; Hit description =Kinesin-like protein
  Subcellular localization annotation: CTP_CleavageSite=24; ConfidenceScore=5.06e-01
MSPGARNSRIFALQNMLSTSSATLVSMLSQLSEAEEQKRVFSGKERWNQVRSLADAKNVMNYLFNIVSSSREKDMEIRDLKEKFVGLSYSLRQLDMIKAELSHKLKLQSDALKRYSEYVGDSEYSDLNVGGHKYYLCKPEYRWSTHLLEDMDISETESDDLTDDGWEESGKLKVWKRKSKTRRSDIENNQSNINNLEDFKENSGDILVDTPGETASDICCSCSRTSLCKTAKCKCKAMGNSCGSSCGCLATKCVNRASISSESQEPTQSASIEETGLLVTQGAGLLQGALVDRLDETNSGRGHRKPLSDIGNTQVRVNHHPLKRQRRFLD

SEQ ID NO: 229055 - protein, 144 aa, Glycine max
  Coding DNA Sequence Number=SeqID_112277
VEAQKKSPVKEHESREKDEEKDEEQAQQQWEKYSIVENQQENILQSNNLPHQLIDKKGRQGEHEETLSVILSLITNTFLEIIWNVLPDYMKFMKFLAKSPFTKRKPRAKRISVHALSCKSHALSVQPLHLRLIWSAKLAKVELS

SEQ ID NO: 229056 - protein, 120 aa, Glycine max
  Coding DNA Sequence Number=SeqID_112278
CAKEGTDERKKKQLEEAAQSRSTNTTIDPSSPIRRHVKWKMTRTKKTEQMTSEAAKEIANKIASSFVAHGHQDVLTVAIGRQEHPGRVHAVGVGVTIKQYFGPAPRTSRTSSSMAPEDLE

SEQ ID NO: 229057 - protein, 242 aa, Glycine max
  Coding DNA Sequence Number=SeqID_112279
VNVFPLKKNTQEVYYMGNQQRQGYTQGGFSCFQKGPYNQQGQWRSHPGNQFNKDQGGPSNRPIQQGSTIFQRTTKLEETLTQFMQVTMSNHRSTESTLKNLEVQDEYSVVSKKKAAEKKCTDEKKDDVRAREKKREKAVNEGSEVPYPVVPSKKEKKRHLARFLDIFNKLEITMPFEEALQQMPLYSNHYGKALIDLGASITIMPLSMCRRLGELEIMPTRMTLQLVDRSITRPYGVTEDVL

SEQ ID NO: 229058 - protein, 68 aa, Glycine max
  Coding DNA Sequence Number=SeqID_112280
MAPEDLEQLIQKIKDHLEESIIEKMHSQGLAMPLKPEVGLSATPVNTKESCVDPSRNNPDTGDLEKCK

SEQ ID NO: 229059 - protein, 412 aa, Glycine max
  Coding DNA Sequence Number=SeqID_112281
  Gene Ontology: Mol. function=transferase activity, transferring phosphorus-containing groups; Cellular component=integral to membrane; Biological process=peptidyl-histidine phosphorylation
  Homolog annotation: Hit_ID=UPI0000689916; Match level="QueryCoverage =99%, HitCoverage=55%, E-value=7e-84, Identity=39%"; Hit description =Histidine Kinase
CGELTFDIRVYDREADAIESLISRGLKDEYGNYVGKLQARQLLNESNGIGVYRNGFRIRPLGDADFDWLKLNEQRVQNPSLRIGSNQAIGYVLIQSEEQSSLIEKSARDGLRENSAYEQLKEITREVIAKLEERRFSYRRKAGLSKPALKVERELERLFSFDSLKKEIRKKLIGGGMAESAAGEVIALITHEEEEKAKTAEDIRQAVATYQGQATLGKIINVVLHEGRRPLNYFRNEVPRISRFGKKFSETGDKKNIEEILSITKGVESNSTILSDLFKRLDPLATGKRAARKKLNIKSEILNSFAIFRHEMEENNIKFEVNGDGDIIFSAWSQDIYAIFANLIDNSIFWMKEKSSVRKITVDIAEENGQLAYINFRDTGPGIEPSLISDSVIFEPQFSTKPSGSGIGLAIA

SEQ ID NO: 229060 - protein, 221 aa, Glycine max
  Coding DNA Sequence Number=SeqID_112282
  Pfam annotation: Domain name=Transposase_23; Domain location=138-210; Score=-13.5; E_value=0.034; Accession=PF03017.5; Description =TNP1ENSPM transposase
MAIGRPEHPGRVRGAGIGVTIMQYFGPASRRSTTSSNITVEQLADIIGNLKEEWQRQVEQENIKREEVWMRRVEEEKQRTMDTFKGQIQEAIKLELSQIASQHSAPLQPNDIQVLAARVSTKGSCAATETNALAKKPSKLNGDNVGLHVTAENSNKLVAVGKQCDSFGTIHNVPYADDVVPVSMVEVIFGDAEVPIPTSEIKFVKEALGSREGCELTIEDC

SEQ ID NO: 229061 - protein, 77 aa, Glycine max
  Coding DNA Sequence Number=SeqID_112283
MRTLRSSLASLTQSSRSLLSNALGRAFTDAIRNAVGWPRPDFFWHCMRILPHDQNTGAFFIVVVQKVSPLSDSFSYD

SEQ ID NO: 229062 - protein, 114 aa, Glycine max
  Coding DNA Sequence Number=SeqID_112284
  Homolog annotation: Hit_ID=Q9FVI7; Match level="QueryCoverage=31%, HitCoverage=11%, E-value=6e-10, Identity=77%"; Hit description =Putative serine/threonine kinase GDBrPK
MAFISTRSDYGYTPPKLKGMIGSNKKAQQRDQKGRLFPLSISVITYNRSNYKRAELSSYLPRREYDGKTQKTQETSEKHFSEFLVSTILFQTMYVPVKSVGTQGWDMAFTAYKF

SEQ ID NO: 229063 - protein, 910 aa, Glycine max
  Coding DNA Sequence Number=SeqID_112285
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q9ZP04; Match level="QueryCoverage=97%, HitCoverage=96%, E-value=0.0, Identity=76%"; Hit description=Alpha-D- xylosidase precursor
  Pfam annotation: Domain name=Glyco_hydro_31; Domain location=276-750; Score=807.9; E_value=5.7e-240; Accession=PF01055.16; Description =Glycosyl hydrolases family 31
MVSPHCFAALSLSCLLLAMLLCAVGATSSSKNATKIGQGYRLVSIEETPDGGLIGILQVKQKTKTYGPDIPLLRFYVKHEAENRLRVHITDAQKQRWEVPYNLLPREQPPPLSQSIGKSRKNPITVSQYSGSEFLFSYTSDPFSFAVKRKSNGETLFDTTSGDSDPFSSLVFKDQYLEISTKLPKDASLYGLGENTQPHGIKLYPSDPYTLYTTDISAINLNADLYGSHPVYMDLRNAGGKASAHAVLLLNSNGMDVFYTGTSLTYKIIGGVFDFYFFSGPSPLNVVDQYTSLIGRPAPMPYWAFDVVENYKKAQIPLDVIWNDDDHMEGKKDFTLNPVNYPRPKLLKFLDKIHNFGMKYIVIIDPGIAVNTSYGVYQRGIANDVFIKYDGEPFLAQVWPGAVNFPDFLNPKTVSWWVDEIRRFHELVPVDGLWIDMNEVSNFCSGKCKIPEGQCPTGTGPGWICCLDCKNITKTRWDDPPYKINASGIKAPIGFKTIATSAYHYNGVLEYDAHSLYGFSQSVATHKGLQGLQGKRPFILSRSTYVGSGKYAAHWTGDNQGTWENLRYSISTMLNFGIFGVPMVGSDICGFYPQPTEELCNRWIEVGAFYPFSRDHANYYSPRQELYQWQSVAESARNALGIRYKLLPFLYTLNYEAHVSGAPIARPLFFSFPTYTECYGLSTQFLLGGSLMVSPVLEQGKTQVKSLFPPGSWYSLLDWTHTITSKDGVYVTLDAPLHVVNVHLYQNAILPMQQGGMVSKEARMTPFTLIVTFPSGATQGEAKGNIFVDDDELPDMNLGNGYSTYVDLHATVDQGAVKVWSEVQEGKFALDKGWIIDSISVLGLEGSGAVSSLEIDGKPLMGGGSNVNVTTSAHEHLNNEGEGEKKTVMVALRGLNIVVGKNFAMTWKMG

SEQ ID NO: 229064 - protein, 104 aa, Glycine max
  Coding DNA Sequence Number=SeqID_112286
MVIHTPVQHPETIESEGTQRQIMVIRQLLSSRGGEPDDMWRQIMVIRTPFRHPEAIESGGTQRQIMVILHLLSSRGGEPDDMRKQIMEIRTPFLNPETIESNGT

SEQ ID NO: 229065 - protein, 108 aa, Glycine max
  Coding DNA Sequence Number=SeqID_112287
MAKGCADDHNLSLPVIGLAASASQKVHKDHNLSLRDIGLDCLWMAKRCADDNNLSPHVIGLAASGLQKVQSDHNWSLRGTGLERLRMAKRFADDNNLSPHVIGLTALG

SEQ ID NO: 229066 - protein, 197 aa, Glycine max
  Coding DNA Sequence Number=SeqID_112288
  Gene Ontology: Mol. function=phospholipid binding; Cellular component= coated pit; Biological process=endocytosis
  Homolog annotation: Hit_ID=Q10NB4; Match level="QueryCoverage=90%, HitCoverage=33%, E-value=1e-34, Identity=39%"; Hit description =Clathrin assembly protein, putative, expressed
  Pfam annotation: Domain name=ANTH; Domain location=4-197; Score= -26.2; E_value=1.5e-06; Accession=PF07651.6; Description=ANTH domain
PSITRFHNLCFVFLFTLDSINASLVTISKRLNKTRDWIVAIKAFLLIHRLLLDAHPAFQDKIMHSTRLDTSRILNMSNFKDDAHSNSSDQVGFVRVYSLYHDAKVDFVAYRRKLSNGVVESVEFRDEFGFVERERERNEVTPVREMGDERVLKRLNRLLWMLDRVLGCRPSRAAKNNSLVLVALYQVVRDSFKLYAE

SEQ ID NO: 229067 - protein, 150 aa, Glycine max
  Coding DNA Sequence Number=SeqID_112289
  Gene Ontology: Mol. function=transcriptional repressor activity; Biological process=regulation of nitrogen utilization
  Homolog annotation: Hit_ID=Q3KN71; Match level="QueryCoverage=95%, HitCoverage=45%, E-value=2e-48, Identity=66%"; Hit description =Isoflavone reductase-like protein 2
  Pfam annotation: Domain name=NmrA; Domain location=1-150; Score=13.9; E_value=6.6e-09; Accession=PF05368.3; Description=NmrA-like family
MSLFTTRFLPSNFRVEEDRVNPLPPFQAVLDKKRKIRRKIEAVGIPYTFVSANCFGAYFVNYLLRSYEKKNNITVYGNSDTKAVLNYEEDIAMYTIKVANDPRTCNRVVTYPPSKNIISQNELISLWEQKGGQNFRKEFVAEEEIVNLSE

SEQ ID NO: 229068 - protein, 156 aa, Glycine max
  Coding DNA Sequence Number=SeqID_112290
MVKSNAKNDNPKKKTATVIIVPNPPPSSQAENSEVPIPIHNLKFSFRKEKFNFRKENNNNTNETSVAVNKPRHKRSKSRPENAASAPRAEGNFVDPDAPLKMPRAVRREASSNSSGVPFWDRNAAAGNKSDEPEVFETRNPLRHKRSLDEKENNRR

SEQ ID NO: 229069 - protein, 481 aa, Glycine max
  Coding DNA Sequence Number=SeqID_112291
  Gene Ontology: Cellular component=nucleus
  Homolog annotation: Hit_ID=Q10QQ8; Match level="QueryCoverage=88%, HitCoverage=51%, E-value=8e-64, Identity=55%"; Hit description =Expressed protein
  Pfam annotation: Domain name=WD40; Domain location=18-58; Score=24.6; E_value=0.00036; Accession=PF00400.22; Description=WD domain, G-beta repeat
  Pfam annotation: Domain name=WD40; Domain location=73-112; Score =13.9; E_value=0.59; Accession=PF00400.22; Description=WD domain, G -beta repeat
  Pfam module annotation: Pfam domain module=WD40::WD40; Domain location=18-58::73-112
MRWLGIPKINIWSYSGWKLLHSIDTGHTANIFCTKFIPETSDELVASGAGDAEVRLFNLSRLNGSGFSDNAIIAPSAYYQCHTRRVKKLAVENGNPNVVWSASEDGTLRQHDFREGTSCPPAGSSHQECRNILLDLRSGSKRSLADPPKQVLALKSCDISSTKPHLLLVGGRHLFNPLSVENVTSPFLGGINNIVDKLCVGGCLVGISNIGSLLSMILSWEIYSILEGSLEMVAIMAIVMSSERNDSCGCGGGSGFLGHPSLHLTHVTFSPDGHEVLLSYSGEHVYLMNVNHAGVKEMQYTSGDESKLMTYSPTINGSEMQPCVSNVFPNRFPIKKNIAAKLDKCRKQIKYAKKSLDNGIPYYGIDACNEVLNGYSHIIGPALKHECLCTRAALLVKRKWKNDAHMAIRDCYAARIIDNSSYKALYYMSEALSQMYCSSENGRVNRIEVEALVNDIDSYYCLVYASYFRVLGWERDIELGH

SEQ ID NO: 229070 - protein, 94 aa, Glycine max
  Coding DNA Sequence Number=SeqID_112292
  Gene Ontology: Mol. function=DNA binding; Biological process=DNA integration
  Homolog annotation: Hit_ID=Q0KIN0; Match level="QueryCoverage=53%, HitCoverage=2%, E-value=7e-12, Identity=62%"; Hit description =Integrase core domain containing protein
MESSGAKALLEGGRNGNNRLISQWCMTDNGLREEWSRLKESDISKNQIPLKLWTVAMISFLYTRVIEKNTLKRLSNEFIFTWEKIIDKTYTTKT

SEQ ID NO: 229071 - protein, 265 aa, Glycine max
  Coding DNA Sequence Number=SeqID_112293
  Gene Ontology: Mol. function=nucleic acid binding; Cellular component= beta-galactosidase complex; Biological process=DNA integration
  Homolog annotation: Hit_ID=Q0KIN0; Match level="QueryCoverage=98%, HitCoverage=23%, E-value=5e-57, Identity=37%"; Hit description =Integrase core domain containing protein
MAAIRHWPLHQFDIKNAFLHGELVGKRFTWINPPGFTASKGSHLFDMTCCEADHSVFLHSLSDMCIYLVVYVDNIVITGDDFDGSWSAKTFLGHRSCSIHFGIVISQRNYALDILTKIDMLDCHPCDLWILKLLPVIGMLSSILRYIKNAPGHALLYEERGNSKIVCYSDADWARSPLDRRSTSSYCVLVGAESEITWLRQLLQQLQFGDTQGTKLICDNQGALHIASNPVFHEWTKHIKIDCHLQSHIDYICNKLGAYDIYAPA

SEQ ID NO: 229072 - protein, 46 aa, Glycine max
  Coding DNA Sequence Number=SeqID_112294
MSLVGNMDGYQLDYGPQLLIGEEQQKKGRALENNAFNTHVSYFICS

SEQ ID NO: 229073 - protein, 154 aa, Glycine max
  Coding DNA Sequence Number=SeqID_112295
  Gene Ontology: Mol. function=phosphotransferase activity, alcohol group as acceptor; Cellular component=phosphoinositide 3-kinase complex; Biological process=protein amino acid phosphorylation
  Homolog annotation: Hit_ID=P42347; Match level="QueryCoverage=81%, HitCoverage=15%, E-value=2e-64, Identity=97%"; Hit description =Phosphatidylinositol 3-kinase, root isoform
  Pfam annotation: Domain name=PI3Ka; Domain location=9-154; Score =192.5; E_value=1e-54; Accession=PF00613.10; Description =Phosphoinositide 3-kinase family, accessory domain (PIK domain)
MSVSMAILLRLPHFNGRSIQRILKYPPTRTLSGDERQLLWKFRFSLMSEKRALTKFLRCVEWSDVQEAKQALELMGKWEMIDVCDALELLSPVFESEEVRAYAVSVLERADDEELQCYLLQLVQALRFERSAKSRLSHFLIQCGMCMRVEELFQ

SEQ ID NO: 229074 - protein, 219 aa, Glycine max
  Coding DNA Sequence Number=SeqID_112296
MVGQGGEVLGSTVGPHMVHNRNAFPYGLPPNYTPPNAMHMSNENANHVVPVSFEGQQPQLGNTPFAQPMGDACEEPRDYAQGDFEPYPMFTAEGSMCDGMPQPNAAGPPQQCPLQPLHFSIGRLPSTAEGREKLDLIKERLRAIEGIGDYLFTNMAELCLVPDIVILPKFKVPDFDRYKGTTCPKNHLKMYCRKMGAYSRDEKLLMHFFQESLAKAALT

SEQ ID NO: 229075 - protein, 152 aa, Glycine max
  Coding DNA Sequence Number=SeqID_112297
  Gene Ontology: Mol. function=hydrolase activity; Biological process =translation
  Homolog annotation: Hit_ID=P95896; Match level="QueryCoverage=96%, HitCoverage=29%, E-value=1e-73, Identity=89%"; Hit description =Amidase
LVKEGFNWPNSEKDVDELVLDSANKLEDYGIKAEEVSIPLHRMGLDIWTPIGIEGATATMILGSGLGWGRKGLFETQIADLFGNSLKSKARDLPNTVKGVLMLGYFMIRKYNNRYYAKARNLSIMLKEAYDEALRKYDALIMPTTPMKAHEV

SEQ ID NO: 229076 - protein, 54 aa, Glycine max
  Coding DNA Sequence Number=SeqID_112298
MTQMSDSGQYCIEMLEIEHKSSRQIQTAITFDSVHNISRSSELNRKTLDKVKQP

SEQ ID NO: 229077 - protein, 247 aa, Glycine max
  Coding DNA Sequence Number=SeqID_112299
MVRMRELHRTLGRILGRTLGRQLVNDEEEALQYRRPTTSARRQRATAVVTEDVEHMNYAADEIHKESYELVTDHVGADTEDFPGAFHTFDAIDVEEVIDFLVELLEVSRKGAKDETEQCRGAYVRLAWLRDNYHIKCDVRQWTVAACAYLLHLVESSIYEHSPTIVSIIVDEDYHERKSRVCRWKFGKTLPVMTYRKRLDKLMLDVVCWGSSSVRRQPERVVQQFVVLFVNELQTTWSDSIGYLTHS

SEQ ID NO: 229078 - protein, 394 aa, Glycine max
  Coding DNA Sequence Number=SeqID_112300
  Gene Ontology: Mol. function=phosphotransferase activity, alcohol group as acceptor; Cellular component=phosphoinositide 3-kinase complex; Biological process=protein amino acid phosphorylation
  Homolog annotation: Hit_ID=P42347; Match level="QueryCoverage=99%, HitCoverage=44%, E-value=1e-153, Identity=73%"; Hit description =Phosphatidylinositol 3-kinase, root isoform
  Pfam annotation: Domain name=PI3_PI4_kinase; Domain location=106-341; Score=167.6; E_value=3.1e-47; Accession=PF00454.17; Description =Phosphatidylinositol 3- and 4-kinase
MAAGVNGEEDGFKQWQSLVRQTELTAQLCSITREVSNVRGNTQKKIEKLRQLLSGLLSELTYFDEPIRSPLAPGVLITGIVPSESSIFKSALHPLRLTFRAANGGTCKIIFKKGDDIRQDQLVVQMVSLMDRLLKLENLDLHLTPYKVLATGQDEGMLEFIPSRSLAQILSENRSIISYLQKFHPDDHGPFGITATCLETFIKSCAGYSVITYILGIGDRDWVHQKLPHAGQKTQSWKTQIRRLDYTHLDNLLLRNDGGLFHVDFGFILGRDPKPFPPPMKLCKEMVEAMGGAERYSSHWMIHFRFKSGCAICSLNCEIVVDFFVPMQPILYKVKTVHLFLYQGIVAVQLQEKFRLDLDDEASIHFFQDLINESVSALFPQMVETIHRWAQYWR

SEQ ID NO: 229079 - protein, 205 aa, Glycine max
  Coding DNA Sequence Number=SeqID_112301
  Gene Ontology: Mol. function=transposase activity; Biological process= transposition, DNA-mediated
  Homolog annotation: Hit_ID=Q97WY1; Match level="QueryCoverage=100%, HitCoverage=49%, E-value=1e-111, Identity=100%"; Hit description =Transposase ISC1332
  Pfam annotation: Domain name=Transposase_mut; Domain location=4-205; Score=-168.8; E_value=4.6e-07; Accession=PF00872.9; Description =Transposase, Mutator family
MKVMEEIREKIRKAIKEGVSLREIEEIILQEAMMEEREAYLEVEDDHKNGTYFRYLGTGDGVLRLRVPRTRKGGFRPKILPEKYERTSPDYEDFLQQLVLSGMTPSQVKAVLAAKGIPYSEIVMNRVAERISNKLKEYKSRELPHDLLALYIDVKIVKVRISESIMERAIYIAIGVDLEGNKFVLDYEVRDREDLDGWKSFLSGL

SEQ ID NO: 229080 - protein, 43 aa, Glycine max
  Coding DNA Sequence Number=SeqID_112302
  Gene Ontology: Mol. function=DNA-directed RNA polymerase activity; Cellular component=nucleus; Biological process=regulation of transcription
  Homolog annotation: Hit_ID=Q9SYA6; Match level="QueryCoverage=88%, HitCoverage=54%, E-value=7e-14, Identity=92%"; Hit description=DNA -directed RNA polymerase II 8.2 kDa polypeptide
  Pfam annotation: Domain name=RNA_pol_N; Domain location=1-32; Score =12.0; E_value=0.0005; Accession=PF01194.8; Description=RNA polymerases N  8 kDa subunit
MDSRDALDALGLVRYCCRRMLMTHVDLIEKLLNYNTLDKSDLN

SEQ ID NO: 229081 - protein, 136 aa, Glycine max
  Coding DNA Sequence Number=SeqID_112303
MRYATQGPDGRKDASVIHTKVDLSFAKDPKGKAKAGVEESIKASPILDKEVPAERFAKEEDDFNKKRISAEEATKGIINNIMTNNYLKFANEEILVEGWGHNRALHVSVKCLDHIVAKVLIDNDSSHNVMPKATLN

SEQ ID NO: 229082 - protein, 364 aa, Glycine max
  Coding DNA Sequence Number=SeqID_112304
  Homolog annotation: Hit_ID=Q10QQ8; Match level="QueryCoverage=58%, HitCoverage=28%, E-value=2e-41, Identity=44%"; Hit description =Expressed protein
  Pfam annotation: Domain name=WD40; Domain location=296-338; Score =18.0; E_value=0.033; Accession=PF00400.22; Description=WD domain, G -beta repeat
MNIVGVDFGFAPNLITHVKCLVRRSEIRAIENQRTLHKEASIFRQLARCFSGMSVALVMVLPASRCRVPAKEDARELHALEKKHMGTRVAAQRWRFWSPGRGDSGWRSCAGEGATGCCQTVAEGAGTIHREAAHQAELGRHEDALEFAVASHSLAPSKSEVAERVANVKRDIALAEAEKNSQTNDGASRFDSRGGRILSLSDILYCPESNSDDPHDGSRSERDDSDYDDELELDFETSISGDEGHDLESNILHGNLNLRIHGRGDSRDNADASGSCESPSSSSQNSRTSYQPEPAVDMKQRFVGHCNIGTDIKQASFLGQRGEYVASGSDDGRWFIWEKCTGRLIKMLSGDESGNHWFPQGFRV

SEQ ID NO: 229083 - protein, 176 aa, Glycine max
  Coding DNA Sequence Number=SeqID_112305
  Subcellular localization annotation: CTP_CleavageSite=52; ConfidenceScore=5.18e-01
MALPPSSPPPPPPHSDASTSSTPGAKRPVVHVDHATGKDNGPHRKKLRTYLRVMMRDKVGVTYENWKEFHIAQKDLIWEDIQASDSRMKKKLLKTVSERWRQFKSDLTRKWALAADNGGVDDTVWEKYGISQFFQTRRDPSWEKLLAEKTKNKLEEAAQLGSVDGIIDPPSPLRRQ

SEQ ID NO: 229084 - protein, 105 aa, Glycine max
  Coding DNA Sequence Number=SeqID_112306
  Gene Ontology: Mol. function=protein serine/threonine kinase activity; Biological process=protein amino acid phosphorylation
RNRCIWRRGSSRWCRRVLLFDGGEELAAVEGSSVDPAVTSSTQEGVGGEAVGSGGDVGVVEVSDWCCGEGLVFLEVGIAGGDCGLGIARENCIGIYFARPSGYKR

SEQ ID NO: 229085 - protein, 220 aa, Glycine max
  Coding DNA Sequence Number=SeqID_112307
MLTLVPPSVVDWAVPLIKLGDFAGICDRRIGPQPDPAVLRQLAVLAARCVRSTAEKRPSMAEVVECLNLARKRNRASPIWNNLRRRVASVESALPVWEEECDSDRSEKFERMVKKGGKGKVSSVSRVGYGNGSEASNNNDKVMRSKSIGSGSGSLRGSWVKMQQQQHQTDNGFGRRKVRLKKSKSMGVLQGSLLLHYGIQNNNNDVREWPSWKRKCWKNR

SEQ ID NO: 229086 - protein, 50 aa, Glycine max
  Coding DNA Sequence Number=SeqID_112308
MSSLVLLDVKGGFQPADMRVTQINRRETLANSYALGKTPKGINYQLRPNS

SEQ ID NO: 229087 - protein, 96 aa, Glycine max
  Coding DNA Sequence Number=SeqID_112309
MLHRPQARHHHLIRLARLGHLTWTSIYDEPQHAEPGLRSFSCPTPDQFRAEVAWPGDWPEAQAGEAPPEAPGDGEEAHEDEEMTNLLDFLGGSGAT

SEQ ID NO: 229088 - protein, 124 aa, Glycine max
  Coding DNA Sequence Number=SeqID_112310
  Subcellular localization annotation: CTP_CleavageSite=48; ConfidenceScore=5.30e-01
MAFQKSFIILDWVCNPNNPLNPNTFKFFSNAPLHSSGKEGAGNSPLSSVSHEREKGCFENWGRHCVMREMPTSHEGEGGLNLRRGRGGGVLRLGFEVDYGVTTVVPPRKSGRRVLWVGATWRTN

SEQ ID NO: 229089 - protein, 42 aa, Glycine max
  Coding DNA Sequence Number=SeqID_112311
MACTKRVNFDGDDHGDKRIRPTMSNPYGKGCNSSRVGGVTWS

SEQ ID NO: 229090 - protein, 87 aa, Glycine max
  Coding DNA Sequence Number=SeqID_112312
  Gene Ontology: Mol. function=transporter activity; Cellular component= integral to membrane; Biological process=transport
  Homolog annotation: Hit_ID=Q5K409; Match level="QueryCoverage=64%, HitCoverage=11%, E-value=2e-15, Identity=70%"; Hit description =Nitrate transporter
MFSGPSSKKVTEEDYYLAEWNSKEKEKGSHHASLKFADNSRSERGRKLNASTELTEEITPPHLSLGSEMVPRLFKFSALISRYYSLL

SEQ ID NO: 229091 - protein, 128 aa, Glycine max
  Coding DNA Sequence Number=SeqID_112313
  Subcellular localization annotation: CTP_CleavageSite=75; ConfidenceScore=5.03e-01
MAYSRLAGLYSIGKFAHNGVDYTSDLLSGFLFLWRLSLTPLLLVSLSTLVFRFIYSSVYFVVPMLLILVPFESCSCFVGKEHGMQHYHTVRSVGCIMRTKAFDRGVEVVYGSRWESTILGQCLPLEGR

SEQ ID NO: 229092 - protein, 1030 aa, Glycine max
  Coding DNA Sequence Number=SeqID_112314
MTSHVSPLKTQPLRVGRLCSWTKADMEGNSLVKYKGDESVEPLSMDKCCPISRVVASTRVKVAAKGCIVVQKIRAPLQLPLVNEESDSSLNAVDDTCHGASNNESSSSERLRVSCRAGGGTSHLHGRVQPSTASLVREPVPVTVILTPSASMGASISVGDVKYKSSITSVASIAPLQCQVKLESPEDSYKIVFSLILPLTSFQCALLEYLNVAPSQLHPNSWAMMKLTSKIGWVLAIDVMADGLPPMFNKDGEPRFSFYWQNNPTWFKSFDEDLLTLEERVDKAILEQLPTSLDAQTILSLSSASDPLTALDDKCFTLSSSFVKPVGGTMPLFDVALVSREGGQPAVEVGAIASDAEVAHEASSFVLTKRKRDDGVGMLGHKKSRALFSLCALRQATGLTPSSGCPSSLQDVPLAPLTVEAPTSVVVVVIVTPIPRPPLVVFVQEASFAAEVSAPTTSASFVVAPLSTVVVPLLSVDVATTTALVMLSPPFSALPVPSSTVLALVSTSFHLHVSLDHIYTSSDVDSLWGMGYKPEQKTLIGFVSALDKNLIQSDGVKHATNSTKSATTQNVSRVKCPKVVNASVAFAKEKKKDMVGQVEGIIAEKDELVKESELWAAREKEVYKELEDELIMYKKKVMEQHEKVFNKAVGQVRFFSKDLDLGLFDPFKDMKDGVLLDEKDIATEEEAEEEQDADDADNGVFDLGDVGSKALGVLSKVKKYMKSSPASPLMVMRSWYDFRVIEGLADHFGDSPRENLGFDEPLENRSRTRMSWILARLTKGGPWEIVRLGFWRDSPREKNHGFDKLRDSPRTDLEFCEPFEETTYETHQGWTLGLTSLWRIDQGIIRPGFWRDSPRADLRFDELACYDLELAFPVENKLSPSGIFSGFASNSPHEVVGLKGSWLNLCIVSSYCSKLGSFFPDPGHFLDFICCLEFYSHCPEDDYVGCLCLTIGLRMFDRGNKKNILAYEVFPGEFLHLVGHNFSQCGPSMSIPYMAKGQGELKLWRFLGGIANLFMEFSHDIICLLVIQEL

SEQ ID NO: 229093 - protein, 317 aa, Glycine max
  Coding DNA Sequence Number=SeqID_112315
  Gene Ontology: Mol. function=RNA-directed DNA polymerase activity; Cellular component=mitochondrion; Biological process=RNA-dependent DNA replication
MVKKSNGKRWMRTDYIDLDRACPKDAYPLPSIDRLVDGVQGIKVNPEKCIAILERHSPTNIQEVQKLNGSLASLSKFLPKLIEKAKSFHKLLKKTKSFLWDKTYEQAFLGFKKIIAISGSQDELPHQIGFVKAKAGSEDGGMVHGTFRVRSLVRTLSPMKKQFMVDFLTKFVGNNQTNLDWWSLYVDNVSNVKVSGAGITLEGPDNVILEQALKLNFKALNDQVEYEAFIAGLKPTREVGAKKLRYYTNSQLVQGQVANRYQTKENVLLKESNTRAYLLSKLANTKKTEHFKIIIQEMLQTTTIGTEEVMTGEEEPD

SEQ ID NO: 229094 - protein, 537 aa, Glycine max
  Coding DNA Sequence Number=SeqID_112316
MTLVSQVEYLTSLMKLVMKSLPTSSLTALCHSCPIFLLFCDNDISYASVLKDGEVRVELYTLAKHFVHAHDLSGTIHYGVRFRRLPGGRISGELNLQMQYGYDGSELVECFPANQRKVKELALTEGGHKVDITSGLYSFSCEAKEWTGMRLDGDLGHHEVDIYDEGNHGLMSMSQIVESDAYETGWTTLRRRIHPQWSEITYLLGSPTAKGQAFALLWAPVLVEVVDRVSTRDVFSFLSLPLCLFFCPRHDSYVDPLGVLRLLLLPSGCPASKQTRLGPSNLLCYDRYSDGVCNARTWALLGEDGACSACASCLTCVIQSCTSVELTTSSATKKYRSRGTPGLGRLKIGGVAMVFLKAKKDFLQVSSYKEACSQVAMNLQYGTAFVGVHVIFTEFPEDLFQVCHVLGYALRLDDHVIHSKHPGSLTLGIFGERLVHISVVSTHLSFVVGFFYHDNAGEPRVDGKLVANNAAMDSRHVRWLLSKQICIFVLHVSDVLVLMVGEVPTELRIQPKFRFELQLDELFDEFWASIKGVVSWI

SEQ ID NO: 229095 - protein, 53 aa, Glycine max
  Coding DNA Sequence Number=SeqID_112317
MANFMVSKRLKVFPDTAHPQAGPLLGFAGKRVETRGYMDLTTFGQVNFPGVSP

SEQ ID NO: 229096 - protein, 384 aa, Glycine max
  Coding DNA Sequence Number=SeqID_112318
  Gene Ontology: Mol. function=transporter activity; Cellular component= integral to membrane; Biological process=transport
  Homolog annotation: Hit_ID=Q5K409; Match level="QueryCoverage=99%, HitCoverage=75%, E-value=1e-146, Identity=68%"; Hit description =Nitrate transporter
  Pfam annotation: Domain name=MFS_1; Domain location=46-384; Score =22.8; E_value=2.9e-05; Accession=PF07690.6; Description=Major Facilitator Superfamily
  Subcellular localization annotation: CTP_CleavageSite=94; ConfidenceScore=5.03e-01
MDIELPAATANESQQQKFALPVDSENKATVFRLFSLANPHMRAFHLSWVSFFACFVSSFAAPPLLPIIRDNLNLTATDIGNAGVASVSGAVLARIAMGTACDLVGPRLASASLILLTAPFVYFTSIINSSTSYLLVRFFTGFSLATFVSTQFWMSSMFSAPVVGSANGFSGGWGNLGGGATQLIMPLVFSLIRDIGASKFTAWRIAFFVPAMFQMLTAFSILLFGQDMPDGNFHRLKKSGEKAKDDFSRVLFHGVTNYRGWILGLTYGYCFGVELTIDNIIAEYFYDRFNLKLHTAGIIAASFGLANFFSRPGGGYISDVMAKRFGMRGRLWALWICQTLAGVFCIILGLVGSLSVSIVVMIIFSVFVQAACGMTFGIVPFVSR

SEQ ID NO: 229097 - protein, 78 aa, Glycine max
  Coding DNA Sequence Number=SeqID_112319
VTSTSGDAISPSQKIARLMVEMIKHGDQMRKSEEERTNHLILFMEKSRGMKRVREEEGMKVIGREEIIKDIEIGKERK

SEQ ID NO: 229098 - protein, 140 aa, Glycine max
  Coding DNA Sequence Number=SeqID_112320
  Homolog annotation: Hit_ID=Q9FFX3; Match level="QueryCoverage=39%, HitCoverage=12%, E-value=5e-08, Identity=49%"; Hit description =Arabidopsis thaliana genomic DNA, chromosome 5, P1 clone:MAC12
MCPLPRHLKHFIELVFSCILALGACFSIAFPLSSLGLEESRRTSVDVFLKAAGYLDCAVKHVLPQLPVELRRNLPVDLAEGVLRALCLQALGQVSQPTLRREGEARLRGASSKKGKCAKLPPTFIRGKRRKNGKDMVYEL

SEQ ID NO: 229099 - protein, 446 aa, Glycine max
  Coding DNA Sequence Number=SeqID_112321
  Gene Ontology: Mol. function=RNA-directed DNA polymerase activity; Cellular component=chromatin; Biological process=chromatin assembly or disassembly
  Pfam annotation: Domain name=rve; Domain location=133-257; Score=3.2; E_value=0.0032; Accession=PF00665.16; Description=Integrase core domain
  Pfam annotation: Domain name=zf-H2C2; Domain location=74-115; Score =21.7; E_value=0.00047; Accession=PF09337.1; Description=His(2) -Cys(2) zinc finger
  Pfam module annotation: Pfam domain module=rve::zf-H2C2; Domain location=133-257::74-115
MGFDYTIQYRSDNHNQVANALSRLPEQDQASLMILSVPCLTFMEELHRQLGTHPDRIWLPCGFSLIPTLITEYHATPTGGHTGVAKIVARVLENFYWQGLRENVAQFVAKCVDCQVTKYEAKQLAGLLCPLPVPSRPWEDLSLDFIAGLPSYHGNTMILVVVDRFSKGIHLGMLLANHTTSGVASLFIDIVTKIHGIPRSLVSDRDSLFISRFWQDLFRSSGTQLPGAWGKLLPWVEWSHNTAWNASTSTTPFEIMFGKKPFNLPDYITGTAKVDAVDDILAGREATFQAIRKKLLKAQACMKTYADKKRHEVNYECGDWVLVKLRPYRETSAKGTPASMGKLAKRYYGPFQIIERIGPMAYRLQLPKGARIHPIFHCSTLKPFHGLPMTSKPAELPPNCIDNQPLIFPLAILDYHRHSSDPNAPWEALVFWHGLSPDETSWEDWS

SEQ ID NO: 229100 - protein, 181 aa, Glycine max
  Coding DNA Sequence Number=SeqID_112322
  Gene Ontology: Mol. function=isomerase activity; Cellular component =membrane; Biological process=carbohydrate metabolic process
  Homolog annotation: Hit_ID=Q9M1T1; Match level="QueryCoverage=91%, HitCoverage=49%, E-value=6e-61, Identity=76%"; Hit description=Sugar- phosphate isomerase-like protein
  Pfam annotation: Domain name=SIS; Domain location=4-124; Score=7.3; E_ value=0.0061; Accession=PF01380.12; Description=SIS domain
  Subcellular localization annotation: CTP_CleavageSite=20; ConfidenceScore=5.23e-01
MPPASSSSPMSKNPALSHTRSRRRSSLSPVDAFHGDIGILTNRDVLILLSKSYATEELLRLVLCAGAKGALLIALTSVEGNALTTACDMSVHLPLRRELCPINLAPVTSTAIQMVFGDTIAIALMEARNLTKEEYAANHPAGKIGKSLFLKVKDVMKKQDELPICRESNFFDSVPIFNCED

SEQ ID NO: 229101 - protein, 277 aa, Glycine max
  Coding DNA Sequence Number=SeqID_112323
  Homolog annotation: Hit_ID=Q2HSY3; Match level="QueryCoverage=45%, HitCoverage=58%, E-value=4e-09, Identity=26%"; Hit description =Nucleic acid-binding, OB-fold
  Pfam annotation: Domain name=DUF223; Domain location=39-135; Score= -5.0; E_value=0.0084; Accession=PF02721.5; Description=Domain of unknown function DUF223
MFRKENMISELHTKKGTWKIAVQITDMWHVNKHNGKQAIEMVFMDQIGAKIGVTLWQELFPEFEVKLNCGSTHVIQNIKVVENHSEYKVSRIPFLVYLVKTTSVREVERPEIPTNVHVITPFANIIDGVVPRDTLVDVVGVVVEVIERKTVNPTYRVTIKLRDNNYSDRDMILTCWEEYALPLDDAIEKNHFDRKPLVVMLTLAKIKDPKGIPFYARRLSDQGSVSQSQYSQYSQRSSMDKFLHNAQMVMLGEISRLRQDCYCLTVGTVDEVMIDTP

SEQ ID NO: 229102 - protein, 91 aa, Glycine max
  Coding DNA Sequence Number=SeqID_112324
MGVKYLEAVKRGSHAIKQRSPDEIRCLLSTCSSMAKVKLMLMNLSQLYAYGDLALPGSDISTWVMGPYGYAAPEDMATGFTKFSSSPTNLL

SEQ ID NO: 229103 - protein, 589 aa, Glycine max
  Coding DNA Sequence Number=SeqID_112325
  Gene Ontology: Mol. function=protein dimerization activity; Cellular component=chromatin; Biological process=DNA integration
  Homolog annotation: Hit_ID=Q1S735; Match level="QueryCoverage=90%, HitCoverage=91%, E-value=1e-160, Identity=54%"; Hit description =Probable transposase [imported]-Arabidopsis thaliana-related
  Pfam annotation: Domain name=DUF659; Domain location=214-366; Score =218.0; E_value=2.1e-62; Accession=PF04937.6; Description=Protein of unknown function (DUF 659)
  Pfam annotation: Domain name=zf-C2HC_plant; Domain location=29-85; Score=89.1; E_value=1.3e-23; Accession=PF07567.3; Description =Protein of unknown function, DUF1544
  Pfam module annotation: Pfam domain module=DUF659::zf-C2HC_plant; Domain location=214-366::29-85
MSYVAAPLSQETFTQNSSQTQRHIRVKSDPAWGHCKVAEENEKTILLCLYCNKIFRGGGINRFKNHLAGEKGQCEQCKNVPADVRFQMKQNLDERKNKRRKVREEYVDSNEFGEDQMRIVVDEVQEPIRVCNLNPPQKGKNINRIGQYFMPKTTPRAQPTLKSGLQSKEVIEKCDLAIAKWMIDASVPFNAINSAYYQPMIDAISSMGPSYKGPNFHRVRGCLLNKWVDDVRKLVDGYRIVWKQTGCTLMADGWNDGCRRTFINFLVYCPKGTVFLRSVDVSHASKSAEMLHKLFREMVLFVGPENVVHIVTSNAENYVAAGRLLEAEFPKLYWSPCATQCINLMLDDIMKLEEVSEIVSLASKITKYIYNHCYSLYLMRKYTGGKDILGPAPTQSATNFIALQSILAHKDALRAMVTSRDWTSSAYAKESKAKKIVEQILDSRFWKKCADIVKLTEPLVHVLQIVDSKDKPAMGFLYQAMYKAKEEMIRRFQKNKKVEPYLNILDRHWDSLCKSIHAAGYWLNPACHFNEEFAKHKSTTSGLLDVIERYAHGDPDLQFNLASEMRIFKNAELDFGRLVATRERNTVMP

SEQ ID NO: 229104 - protein, 157 aa, Glycine max
  Coding DNA Sequence Number=SeqID_112326
MDRVRLVYGLVMKMDMDVGSIISRQISQMAQSNSSRLGFPALITALCIIRGFVPDSLTFESLSPTINLAYIRKNCWNLNDPTITFLGSRKARARGPSNASTYALAPTPALTPAPTPTPAPTPAPTAPLRPLHFEHKCDHADVAEPPQWLMPSDAKYP

SEQ ID NO: 229105 - protein, 107 aa, Glycine max
  Coding DNA Sequence Number=SeqID_112327
MHIAQLISDFIYCLQGSRLQDTQWTRRSPTGSWSCQALITGLCQFYGMPVTSSKVIKPPTKRAFIKKYCVPRQVQGETPQQLGDGRQRATDAPPSPLEFTSADPQKG

SEQ ID NO: 229106 - protein, 352 aa, Glycine max
  Coding DNA Sequence Number=SeqID_112328
  Gene Ontology: Mol. function=hydrolase activity, acting on ester bonds; Cellular component=nucleus; Biological process=lipid metabolic process
  Homolog annotation: Hit_ID=Q9FHQ1; Match level="QueryCoverage=88%, HitCoverage=88%, E-value=1e-145, Identity=75%"; Hit description=GDSL- motif lipase/hydrolase-like protein
  Pfam annotation: Domain name=Lipase_GDSL; Domain location=24-334; Score=192.1; E_value=1.3e-54; Accession=PF00657.12; Description=GDSL- like LipaseAcylhydrolase
MPRLVFAACIFSLASIALAALPVTYIFGDSLTDVGNNNFLQYSLAKSNYPWYGIDYSGGQATGRFTNGRTIGDFISAKLGITSPPAYLSATQNVDTLLKGVNYASGGAGILNDTGLYFIERLSFDDQINNFKKTKEVISANIGEAAANKHCNEATYFIGIGSNDYVNNFLQPFLADGQQYTHDEFIELLISTLDQQLQSLYQLGARKIVFHGLGPLGCIPSQRVKSKRGQCLKRVNEWILQFNSNVQKLINTLNHRLPNAKFIFADTYPLVLDLINNPSTYGFKVSNTSCCNVDTSIGGLCLPNSKVCRNRHEFVFWDAFHPSDAANAVLAEKFFSLFSSAPSPASAPTPSP

SEQ ID NO: 229107 - protein, 530 aa, Glycine max
  Coding DNA Sequence Number=SeqID_112329
  Gene Ontology: Mol. function=hydrolase activity, hydrolyzing O -glycosyl compounds; Cellular component=anchored to membrane; Biological process=carbohydrate metabolic process
  Homolog annotation: Hit_ID=Q94EN5; Match level="QueryCoverage=91%, HitCoverage=98%, E-value=0.0, Identity=78%"; Hit description=Beta-1 ,3-glucanase
  Pfam annotation: Domain name=Glyco_hydro_17; Domain location=56-377; Score=358.8; E_value=8.9e-105; Accession=PF00332.9; Description =Glycosyl hydrolases family 17
  Pfam annotation: Domain name=X8; Domain location=392-477; Score =176.1; E_value=8.7e-50; Accession=PF07983.3; Description=X8 domain
  Pfam module annotation: Pfam domain module=Glyco_hydro_17::X8; Domain location=56-377::392-477
MALHFLLLLLFAVSFVAADEVLSSPMTPCCFLEEFLEFALWGIELNHALSYQEPFIGVNIGTDLSDMPHPTQVVALLKAQQIRHVRLYDADQAMLLALAKTGIQVVVTVPNEEILAIGQSNSTAANWVSRNVVAHYPATNITAICVGSEVLTTLPNAAKVLVSAIKYIHSALVASNLDRQVKVSTPLSSSIILDSFPPSQAFFNRSLNPVLVPLLDFLQSTGSYLMLNIYPYYDYMQSNGVIPLDYALFKSLPPNKEAVDSNTLLHYTNVFDAMVDAAYFAIAFLNYTNIPVVVTESGWPSKGGSNEPDATVDNANTYNSNLIKHVFNKTGTPKHPGIAVSTYIYELYNEDMKPGPLSEKNWGLFDANGTPIYILHLTESGAVLANDTSNNTFCIAKDGADPKMLQAALDWACGPGKVECSPLLQGQPCYEPDNVIAHANYAFDTYYHKMGKTPDACDFNGVATISTSDPSHGSCLFPGSVGKNGTLGNFTAPSMNSTNSDSSAYKFSSDLRIRSLLMVAGFLLWGVVLL

SEQ ID NO: 229108 - protein, 225 aa, Glycine max
  Coding DNA Sequence Number=SeqID_112330
  Gene Ontology: Mol. function=nucleic acid binding; Biological process= DNA integration
  Homolog annotation: Hit_ID=Q1S7C5; Match level="QueryCoverage=90%, HitCoverage=17%, E-value=4e-32, Identity=35%"; Hit description =Integrase, catalytic region
MASANNNSSPPPHPSPPLPLVQPVIIGHGLLDYILAPQIPQKFLTVEDHNNNIVSAAYHFWEQQDQLILSWLQSTISEAVLLCIINRVTSWHLWDRLHEHFQSFACAKKKQLHSELCSSSLENRSITAYMLHIQSRIDSHASIGDSILTSAHIDVILNGLLDDYRTICTILNNSSDPLSLDDVTSMLLVEESSIEKSRKKNLGSLNLAEGLNSNSASEAQVHLTQ

SEQ ID NO: 229109 - protein, 131 aa, Glycine max
  Coding DNA Sequence Number=SeqID_112331
MEAMKEQMATMMEAIMSMKKIMEANAVTVATTSTVAKVNPMPPSDLNQMNHPTSNMEGKELGSRDDPHDVQIQNKHAFPPYVLPPNCKPPNVAYTPSENVNNSTPIPIESQQIMHMSFKSWGRHMKFPTTS

SEQ ID NO: 229110 - protein, 67 aa, Glycine max
  Coding DNA Sequence Number=SeqID_112332
  Subcellular localization annotation: CTP_CleavageSite=42; ConfidenceScore=5.07e-01
MVHKFGDRSVLAMGVPLPDKANTLNLPRDKSQDEGTPSSQTRFRMKTKMWRRPRLRITRSSLCGTMH

SEQ ID NO: 229111 - protein, 89 aa, Glycine max
  Coding DNA Sequence Number=SeqID_112333
MDRARLVYDLVTDMDMDIGALISALITALCRARGVTSNSLTYESLSLAINSAYIKKNCWNKDYLTVQILPKNLPRMALSVQDEPSAWYA

SEQ ID NO: 229112 - protein, 997 aa, Glycine max
  Coding DNA Sequence Number=SeqID_112334
  Homolog annotation: Hit_ID=Q8ZDZ8; Match level="QueryCoverage=37%, HitCoverage=82%, E-value=1e-163, Identity=77%"; Hit description =Multidrug resistance protein mdtK
  Pfam annotation: Domain name=CMAS; Domain location=1-254; Score =489.8; E_value=3.1e-144; Accession=PF02353.10; Description =Cyclopropane-fatty-acyl-phospholipid synthase
  Pfam annotation: Domain name=MatE; Domain location=634-794; Score =161.1; E_value=2.9e-45; Accession=PF01554.9; Description=MatE
  Pfam annotation: Domain name=MatE; Domain location=862-997; Score =55.8; E_value=1.4e-13; Accession=PF01554.9; Description=MatE
  Pfam annotation: Domain name=Methyltransf_11; Domain location=54-147; Score=56.4; E_value=9.2e-14; Accession=PF08241.2; Description =Methyltransferase domain
  Pfam annotation: Domain name=Methyltransf_12; Domain location=54-145; Score=38.8; E_value=1.8e-08; Accession=PF08242.2; Description =Methyltransferase domain
  Pfam module annotation: Pfam domain module=CMAS::MatE::MatE::Methyltra nsf_11::Methyltransf_12; Domain location=1-254::634-794::862-997::54 -147::54-145
HYDLGNDLFTLMLDPYMQYSCGYWKDATTLEEAQEAKLRMICEKLQLQPGMRLLDIGCGWGGLSAYAAKNYGVSVVGVTISAEQQKLAQARCAGLDVQILLQDYRDLHQQFDRIVSVGMFEHVGPKNYRTYFNVVERNLAPHGLFLLHTIGSNKTDMNVDPWINKYIFPNGCLPSVSHIAEASEGHFVMEDWHNIGADYDRTLMAWFERFKQAWPQLAPRYSERFERMFSYYLNACAGAFRARDLQLWQALKAASASPAKRLPDKKGPGSNIAGAFFCSFDAYGLAAVDADDFIVAVAKEVQAAQVEIHGDGRVVRNGAHLGVDPHAFQRGHRFADEVLILRSAAGIIRIGHLRARALLRRTAAGAQRQQRVFVRRRHRRRQRRFPIGQHALDGVHHRLRLRIDLDVHLVTQAFLTQRGAIQRFRDQVHAETVIHHFADGQANAVDADEAFVQHIFHQFGIRHAQPYLPVIFRGINLGHFRRADNMAGHQMAANFVIELRRALDIDDVAQRQIAEVGQAQRFLNQIEADAVAFHRGDGQAAAVMGHRRAQLQPRQQLGRHFDHVGAEIGFSSMATSGAVPCTIPFAPVGAENQIRDGKKRMAAHLITIYLRRLLNDAEQKYLIEARSLLALAIPVIIAQISQTAMGVVDTIMAGAYSATDMAAVAVGTSIWLPAILFGHGLLLALTPVIAQLNGAGRRDRIAHQVRQGFWLASGVSVLLIVVLYNCKFVIDMMHNIDPQLADKAVGYLHAIMWGAPGYLFFQVMRNQCEGLSKTKPGMVIGFLGLLVNIPINYIFIYGKFGMPELGGVGCGVATGSVYWIMFLMIRGYVKRAPSQRDIKRQTGDLGGPDWAALKRLIGIGMPVAQALFFEVTLFAVVALLVSPQGIVAVAGHQIALNFSALMFVLPLSLGVGATIRVGYRMGEGSVEGARVAAYSAIGVGITKAVCTALFTAAFREPIALLYNDSPAVVAKASQLMLLAALYQISDSVQVIGSGVLR

SEQ ID NO: 229113 - protein, 70 aa, Glycine max
  Coding DNA Sequence Number=SeqID_112335
MKIGEFFPELKRMVGQEDREMKPYQEEMKIVNLGFGEEKKESLDTQNGFPTLYQSPRKMGKCECAWTIGI

SEQ ID NO: 229114 - protein, 104 aa, Glycine max
  Coding DNA Sequence Number=SeqID_112336
MGACSRDEKLLMLFFQESLSGAAVIWYTILEASRIRSRKDLITTFISFIDLVFAGERIEVGLKRGKFNYVALASTSNRRFRATGEKKKEWDAHAVTSTPTRPKP

SEQ ID NO: 229115 - protein, 110 aa, Glycine max
  Coding DNA Sequence Number=SeqID_112337
MGSNQAPLLKKRNGVVGIPRKRLEEKAKVLEGQGEWVSFIDVLVLLVFEIVLFPNMDGLVDLATIDAFLAYHHSKESPVIAILVDAYDTFDQRCEKSDIRIACCTPTLLS

SEQ ID NO: 229116 - protein, 110 aa, Glycine max
  Coding DNA Sequence Number=SeqID_112338
  Homolog annotation: Hit_ID=Q1SRI1; Match level="QueryCoverage=41%, HitCoverage=7%, E-value=5e-08, Identity=45%"; Hit description=RNA -directed DNA polymerase
MDGIGTSVSSKASRGIGIKDISNFNKALLGKWRWRIIVEPNNMWARVIRAKYGEFGLRMRYFVMWKLEVDGVFSVKSAFNLLNNHSSVELLCTLNLELWFLEFEDQEEPP

SEQ ID NO: 229117 - protein, 70 aa, Glycine max
  Coding DNA Sequence Number=SeqID_112339
MLCKSMYVGGGYVVTLDCRERGFGCEGLSSAANSQWKRGIMIYGNKFSTCGKEQKEREQFTCGRMGLQFG

SEQ ID NO: 229118 - protein, 93 aa, Glycine max
  Coding DNA Sequence Number=SeqID_112340
  Subcellular localization annotation: CTP_CleavageSite=56; ConfidenceScore=5.76e-01
MRSIPLGISVSLTPINTSKLSPFSVNFKKPTTFPSRGSTLPREFSLSQSVLRILISLNAEPYSFLPDLFKEANYEWGTSNQGVDTWGDGIFSI

SEQ ID NO: 229119 - protein, 236 aa, Glycine max
  Coding DNA Sequence Number=SeqID_112341
  Gene Ontology: Mol. function=small conjugating protein ligase activity; Cellular component=cytosol; Biological process=protein modification process
  Homolog annotation: Hit_ID=P35132; Match level="QueryCoverage=60%, HitCoverage=97%, E-value=1e-69, Identity=87%"; Hit description=SUMO -conjugating enzyme UBC9
  Pfam annotation: Domain name=UQ_con; Domain location=29-162; Score =264.1; E_value=2.8e-76; Accession=PF00179.16; Description=Ubiquitin -conjugating enzyme
MGTDASFGALDWKGKGVHDDSLDQMASKRINKELKDLQKDPPTSCSAGPVADDMFHWQATIMGPADSPFAGGVFLVSIHFPPDYPFKPPKVSFCTKVFHPNINSNGSICLDILKEQWSPALTISKVLLSICSLLTDPNPDDPLVPEIAHMYKTDRAKTTAETIGKPYDCIYVGLQEQARKEKEDPERMLEENRRKVEEAQRTEALEKKEGRKKDMKRCKDRSKKPCEGRNRRRSKN

SEQ ID NO: 229120 - protein, 219 aa, Glycine max
  Coding DNA Sequence Number=SeqID_112342
ARLSQIEEKHPQFQDGILALADQLANQDKAQQLWHLGENLGMETVTDNLHFLHSFASMECRDRKEAKENLVGKHKIDLLCLQETKRDSIDKALCQALWGHSDFDWKWFPAVNTAGGLLCVRNNNNFQGTSTALNTQLKEWEALFVIADTNLIAEFSEWLAEMEVDDIPCLGKPFTWVRPNGSCKSKLNRVLVFDDWVSKWPDVPYTTLKGTTHIIALSF

SEQ ID NO: 229121 - protein, 522 aa, Glycine max
  Coding DNA Sequence Number=SeqID_112343
  Gene Ontology: Mol. function=alpha-glucan, water dikinase activity; Cellular component=chloroplast; Biological process=carbohydrate metabolic process
  Homolog annotation: Hit_ID=Q8LPT9; Match level="QueryCoverage=95%, HitCoverage=33%, E-value=1e-167, Identity=59%"; Hit description =Alpha-glucan water dikinase, chloroplast precursor
MDQLSGKFNLDGNIELQVAVSSSEPGAARQVDIKVSYNSDSLFLHWGVVRDQPGKWVLPSHHPDGTKNYKNRALRTPFVKSDSGSFLKIEIDDPAAQAIEFLILDEAKNKWFKNKGENFHIKLPVKSKLSQEVSVPEDLVQIQAYLRWERKGKQMYTPEQEKEEYEAARNELFEEVARGTSVQDLRAKLTKKTKAAEVKEPSVSETKTIPDELVQIQAFIRWEKAGKPNYSQEQQLMEFEEARKELLAELEKGASLDEIRKKITKGEIQTKVAKQLKTKKYFRAERIQRKKRDLVQLINRNVAENIVEQVIDAPKALTVIEHYANAREEYESGPVLNKTIYKLGDNDLLVLVTKDAGKIKVHLATDSKKPFTLHWALSRTSEEWLVPPATALPPGSVTMNEAAETPFKAGSSSHPSYEVQSLDIEVDDDTFKGIPFVILSDGEWIKNNGSNFYIEFGGKKQIQKDFGDGKGTAKFLLNKIAEMESEAQKSFMHRPGSATDSYSLKGKPSFLCHPLPMADLHY

SEQ ID NO: 229122 - protein, 360 aa, Glycine max
  Coding DNA Sequence Number=SeqID_112344
  Gene Ontology: Mol. function=alpha-glucan, water dikinase activity; Cellular component=chloroplast; Biological process=carbohydrate metabolic process
  Homolog annotation: Hit_ID=Q9SAC6; Match level="QueryCoverage=96%, HitCoverage=24%, E-value=1e-170, Identity=83%"; Hit description =Alpha-glucan water dikinase 1, chloroplast precursor
FNIASDLIDEAKNAGQQGLAGILVWMRFMATRQLIWNKNYNVKPREISKAQDRLTDLLQDVYASYPQYREIVRMILSTVGRGGEGDVGQRIRDEILVIQRNNDCKGGMMEEWHQKLHNNTSPDDVVICQALIDYINSDFDIGVYWKTLNANGITKERLLSYDRAIHSEPNFRRDQKEGLLRDLGNYMRTLKAVHSGADLESAISNCMGYKSEGQGFMVGVQINPVPGLPNGFPELLEFVAEHVEEKNVEPLLEGLLEARQELQPSLSKSQSRLKDLIFLDVALDSTVRTAVERSYEELNNAGPEKIMYFISLVLENLALSSDDNEDLIYCLKTQAYKAYICDMSSENVFSNNKDLGCSQL

SEQ ID NO: 229123 - protein, 404 aa, Glycine max
  Coding DNA Sequence Number=SeqID_112345
  Gene Ontology: Mol. function=protein binding; Cellular component =integral to membrane; Biological process=protein amino acid phosphorylation
  Homolog annotation: Hit_ID=Q949G9; Match level="QueryCoverage=99%, HitCoverage=85%, E-value=3e-47, Identity=29%"; Hit description =HcrVf1 protein
  Pfam annotation: Domain name=LRRNT_2; Domain location=3-43; Score =49.5; E_value=1.2e-11; Accession=PF08263.3; Description=Leucine rich repeat N-terminal domain
  Pfam annotation: Domain name=LRR_1; Domain location=121-143; Score =14.3; E_value=0.44; Accession=PF00560.23; Description=Leucine Rich Repeat
  Pfam annotation: Domain name=LRR_1; Domain location=145-167; Score =0.6; E_value=2.2e+02; Accession=PF00560.23; Description=Leucine Rich Repeat
  Pfam annotation: Domain name=LRR_1; Domain location=169-194; Score =8.6; E_value=7.1; Accession=PF00560.23; Description=Leucine Rich Repeat
  Pfam annotation: Domain name=LRR_1; Domain location=196-218; Score =14.2; E_value=0.49; Accession=PF00560.23; Description=Leucine Rich Repeat
  Pfam annotation: Domain name=LRR_1; Domain location=248-269; Score =10.0; E_value=3.8; Accession=PF00560.23; Description=Leucine Rich Repeat
  Pfam annotation: Domain name=LRR_1; Domain location=274-296; Score =6.1; E_value=21; Accession=PF00560.23; Description=Leucine Rich Repeat
  Pfam annotation: Domain name=LRR_1; Domain location=298-323; Score =4.7; E_value=38; Accession=PF00560.23; Description=Leucine Rich Repeat
  Pfam annotation: Domain name=LRR_1; Domain location=325-347; Score =14.2; E_value=0.49; Accession=PF00560.23; Description=Leucine Rich Repeat
  Pfam annotation: Domain name=LRR_1; Domain location=349-371; Score =10.0; E_value=3.8; Accession=PF00560.23; Description=Leucine Rich Repeat
  Pfam annotation: Domain name=LRR_1; Domain location=373-395; Score =12.9; E_value=1.1; Accession=PF00560.23; Description=Leucine Rich Repeat
  Pfam annotation: Domain name=LRR_1; Domain location=94-119; Score =10.8; E_value=2.7; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1; Domain location=3-43::121-143::145-167::169-194::196-218::248-269::274 -296::298-323::...
  Pfam module annotation: Domain location=325-347::349-371::373-395::94- 119
VCIPSERETLLKFKNNLIDPSNRLWSWNHNNTNCCHWYGVLCHNVTSHLLQLHLHTSPSAFYHDYDYQYLFDEEAYRRWSFGGEISPCLADLKHLNYLDLSGNRFLGEGMSIPSFLGTMSSLTHLDLSYTGFYGKIPPQIGNLSNLVYLDLSSDVANGTVPSQIGNLSKLRYLDLSANYLLGGGMSIPSFLGTMTSLTHLDLSGTGFMGKIPSQIWNLSNLVYLGLGGDSDVEPLFAENVEWLSSMWKLEYLHLSYANLSKAFHWLHTLQSLPSLTHLYLSFCTLPHYNEPSLLNFSSLQTLHLSDTSYSPAISFVPKWIFKLKKLVSLQLSYNEINDPIPGGIRNLTLLQNLDLSFNSFSSSIPDCLYGLHRLKSLDLSSCDLHGTISDALGNLTSLVELDLS

SEQ ID NO: 229124 - protein, 609 aa, Glycine max
  Coding DNA Sequence Number=SeqID_112346
  Gene Ontology: Mol. function=alpha-glucan, water dikinase activity; Cellular component=chloroplast; Biological process=carbohydrate metabolic process
  Homolog annotation: Hit_ID=Q8LPT9; Match level="QueryCoverage=99%, HitCoverage=37%, E-value=0.0, Identity=72%"; Hit description=Alpha -glucan water dikinase, chloroplast precursor
  Pfam annotation: Domain name=PPDK_N; Domain location=291-609; Score= -37.0; E_value=8.5e-11; Accession=PF01326.9; Description=Pyruvate phosphate dikinase, PEPpyruvate
MGWDVALSMCKSKDTHWALYAKSVLDRTRLALTNKAHLYQEILQPSAEYLGSLLGVDRWAVEIFTEEIIRAGSAASLSTLLNRLDPVLRKTAHLGSWQVISPVETVGYVEVIDELLAVQNKSYERPTILIAKSVRGEEEIPDGTVAVLTPDMPDVLSHVSVRARNSKLIKNLIIIKVSIQSVKFCEFVRVDNVCFATCFDPNILANLQENKGKLLRLKPTSADVVYSEVKEGELIDDKSTQLKDVGSVSPISLARKKFSGRYAVSSEEFTGEMVRFQNSLLTWAFIVVYPYVCVFPPTKMHQVGAKSRNISYLKGKVASWIGIPTSVAIPFGVFEHVLSDKPNQAVAERVNNLKKKLIEGDFSVLKEIRETVLQLNAPSHLVEELKTKMKSSGMPWPGDEGEQRWEQAWIAIKKVWGSKWNERAYFSTRKVKLDHEYLSMAVLVQEVINADYAFVIHTTNPASGDSSEIYAEVVKGLGETLVGAYPGRALSFICKKRDLNSPQVLGYPSKPVGLFIRRSIIFRSDSNGEDLEGYAGAGLYDSVPMDEAEKVVLDYSSDKLILDGSFRQSILSSIARAGNEIEELYGTPQDIEGVIKDGKVYVVQTRPQM

SEQ ID NO: 229125 - protein, 142 aa, Glycine max
  Coding DNA Sequence Number=SeqID_112347
MAFLGETSSQTIVNSRLAFIYPNGSIIHNDTGVYFQTSTLVPIRVPNWCDFASLKTRIHNTLQLSDKQFLDEIHYRKPFTDTARFEYSDTVIKYEINELITNEELLKVLVQSNYWKKYGPIEILAVFTKYVEDEVSGTSLNN

SEQ ID NO: 229126 - protein, 81 aa, Glycine max
  Coding DNA Sequence Number=SeqID_112348
MSCLAIITLISLCLSASWCMPPTRHPMDPDKSNRALGFPALVIRPPITRAFIEKYCTPRQAQGDAHQAADAPPPPHQANPA

SEQ ID NO: 229127 - protein, 243 aa, Glycine max
  Coding DNA Sequence Number=SeqID_112349
MDILISRPFRWSYYLMLSTDGFHVWPSDYLILKAVGLQLLLHMDPSTENLDVLIGEKGFLVMMGGGLDDCGVGVGVASLLDKLKSLEDGILMGSIGFRDLHPTLIFLFFGNNEGMIGLLLGLDLALLLSKDPLNLFSESKGNKGSFVVDGVLGVLIQSFEDMEYLVFPEEFVDEGDIVDVIQSSQGLHVPEYVDVDHVWKAKTFQHVDVKVVFNVNSRFSISVNGGGVSGDNGGGRRNVFTRV

SEQ ID NO: 229128 - protein, 82 aa, Glycine max
  Coding DNA Sequence Number=SeqID_112350
MPSTVHVSSVIKRGASEKKKEGVETRVVVTERAGRTKSMSYLCFPFISDERYLDPFVAQYVKSRDVPKIKRKQAYAIRENSV

SEQ ID NO: 229129 - protein, 90 aa, Glycine max
  Coding DNA Sequence Number=SeqID_112351
MNRKLGYGAQLRANLDPTKGVGRLRQQDGGHGSRNPLRRRGGRCKTQGASPGGAVVGADLGGTGEARLIALCARTPKGNRVKIPEPGRGG

SEQ ID NO: 229130 - protein, 273 aa, Glycine max
  Coding DNA Sequence Number=SeqID_112352
  Homolog annotation: Hit_ID=Q6CQE5; Match level="QueryCoverage=11%, HitCoverage=29%, E-value=2e-07, Identity=84%"; Hit description =Protein TAR1
ICTDDRSARARALGFAATAAPSYSSGLGPCPDGRNSPAGSSYPEGNFGGNQLLDGSISLSPLYPSQTNDLHVKYRCGPPPEFPLASPRSGIVHHLSGPDRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPR

SEQ ID NO: 229131 - protein, 73 aa, Glycine max
  Coding DNA Sequence Number=SeqID_112353
MEEDGRAEREKRQRPRWASTSLAYPLLGFPNLLSEMYGLAKWMPLAEWICLTERVINYLNILFFGLKLIWIQY

SEQ ID NO: 229132 - protein, 112 aa, Glycine max
  Coding DNA Sequence Number=SeqID_112354
MTGGNPGDLQPFDPEIDRTFHRLARHSVHPSHAVHFEHSVAGDSEYSDFEHSSTNFHTENMAQPPPRERTLREMATPDFTYESLCIQYPDEGVPYVLKTGLIHLLPKFHGLA

SEQ ID NO: 229133 - protein, 323 aa, Glycine max
  Coding DNA Sequence Number=SeqID_112355
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=100%, E-value=4e-34, Identity=26%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
ALHALILRGLHDLTFTGLHALALRGLHTLPFTGLHALAFRELHILTFRGPHVLTFRGLHVHALRGLHILAFRGLHALAFRGLHVLTFRGLDVFHFRGPHILPFRGLHVLTIRGLHVVAFIGLHVHPLRGLQVLTFRGIHVLAFIRLQVLPLRGLYALTFRGLHVLALRRLHVLRFRGLHVLAFRGLHVLPFRGLHVLTFRGLPVLALRGLLVLPFRGLHALAFEGLHAFTFRGVHVLPLGGLHALAFIGLHSHTFRGVHVVTITGQHVLAFKGLNVFPFRGLHSLAFRGLRGPHFQRTTRPHLQRTTRPHLHRTSCPCLQRPT

SEQ ID NO: 229134 - protein, 77 aa, Glycine max
  Coding DNA Sequence Number=SeqID_112356
MAGSLSKIIPDMSKIEPLDGSNYRRWSQKLLILFEALEVDYVLFEDPPADVNASESSTPETPATPVVTPLSCRNQES

SEQ ID NO: 229135 - protein, 173 aa, Glycine max
  Coding DNA Sequence Number=SeqID_112357
  Homolog annotation: Hit_ID=Q1SKD7; Match level="QueryCoverage=90%, HitCoverage=41%, E-value=1e-14, Identity=30%"; Hit description =Ankyrin
MAPRKLASKRSRKDKAAEGTSSALEYDSHRFRSAIHQQRFEAIKGWSFLRERRVQLRDDEYTDFQKEISRRRWASLVTPMAKFDPEIVLEFYANAWPTEEGVRDMRSWVRGQWIPFDADAIGQLLGYPLVLEEGQECEYGQRRNRSDGFDEEAIAQLLYMDDFATQQHPAHRP

SEQ ID NO: 229136 - protein, 284 aa, Glycine max
  Coding DNA Sequence Number=SeqID_112358
  Gene Ontology: Mol. function=nucleic acid binding; Biological process= DNA integration
  Pfam annotation: Domain name=zf-CCHC; Domain location=107-124; Score =24.3; E_value=9.9e-05; Accession=PF00098.13; Description=Zinc knuckle
MKMCEILQANVLLEKFPPSWSDYRNQLKHKKRDLSLQELINHMKTEEANRLKDKHVLHSVNSVNANVVEFADQHRSKGKEKRFQKKGQKKTHTNINKGDNKIQKRKGECYVCGKTGHKAYECKLRKGQQSNNSKPAAPHAPQAHLAENEEVIVVVVVEAIMVDNKVDWILDTGASKHLCANKEPFHQIEDADDGECVFMGNSATAGVLGKGKILLKLTSGKTLSLSDVLYVPSLRRNLISGSCLNRAGLKLVFEADKVVITRNDERYVIKFCAFTFAYFFLCNK

SEQ ID NO: 229137 - protein, 318 aa, Glycine max
  Coding DNA Sequence Number=SeqID_112359
  Gene Ontology: Mol. function=protein binding; Cellular component =ribonucleoprotein complex; Biological process=nuclear mRNA splicing, via spliceosome
  Homolog annotation: Hit_ID=Q6EUK2; Match level="QueryCoverage=86%, HitCoverage=99%, E-value=2e-92, Identity=62%"; Hit description =Putative U2 snRNP protein A'
  Pfam annotation: Domain name=LRR_1; Domain location=114-136; Score =3.1; E_value=75; Accession=PF00560.23; Description=Leucine Rich Repeat
  Pfam annotation: Domain name=LRR_1; Domain location=43-63; Score=6.2; E_value=20; Accession=PF00560.23; Description=Leucine Rich Repeat
  Pfam annotation: Domain name=LRR_1; Domain location=65-86; Score=1.9; E_value=1.3e+02; Accession=PF00560.23; Description=Leucine Rich Repeat
  Pfam annotation: Domain name=LRR_1; Domain location=89-112; Score =8.4; E_value=7.7; Accession=PF00560.23; Description=Leucine Rich Repeat
  Pfam module annotation: Pfam domain module=LRR_1::LRR_1::LRR_1::LRR _1; Domain location=114-136::43-63::65-86::89-112
MVRLTADLIWKSPHFFNAIKERELDLRGNKIAVIENLGATEDQFDTIDLSDNEIVKLENVPYLNRLGTMLINNNRITRINPNIGEFLPNLHTLVLTNNRIVNLVEIDPLASLPKLHFLSLLDNNITKKPNYRLYVINKLKSLRVLDFKKVKNKERLEAKNLFSSKEVIEEIQRTPTKSETPNVSEVIEEQQMPKVVAPTPEQIIAIKAAIVNSQTLEEVARLEKALKSGQLPADLLLDNVDEKHEDMIHDDRGQADGESNDTQEQRNTDSASMEQSLWTSSFQILVSHYFSLFGLAHLSSHMTTDIASLASAHHCQQP

SEQ ID NO: 229138 - protein, 150 aa, Glycine max
  Coding DNA Sequence Number=SeqID_112360
  Homolog annotation: Hit_ID=Q5XM22; Match level="QueryCoverage=42%, HitCoverage=35%, E-value=3e-11, Identity=57%"; Hit description =Resistance-like protein HAAS-2
MLKRRRLTASARRHRAVAPVVEDVEHVNHVANEECPELKLSSHGRKVKKFGRPAPEIEGLVAATGLSHLIACSLELETGDLYLLLWRGCTVFTNKSITRVHVVFLDAFRDLSQTGSYAWGATALVHMYENLNDALKRSARQLAGYITLLQ

SEQ ID NO: 229139 - protein, 357 aa, Glycine max
  Coding DNA Sequence Number=SeqID_112361
  Gene Ontology: Mol. function=ubiquitin thiolesterase activity; Cellular component=intracellular; Biological process=ubiquitin -dependent protein catabolic process
  Homolog annotation: Hit_ID=Q93X76; Match level="QueryCoverage=94%, HitCoverage=74%, E-value=1e-169, Identity=78%"; Hit description =Putative carboxyl-terminal proteinase
  Pfam annotation: Domain name=DUF239; Domain location=139-317; Score =359.0; E_value=7.5e-105; Accession=PF03080.5; Description =Arabidopsis proteins of unknown function
LFAYAKAEYNDPLSCLQVARILLPPSPDGDIIDCVVSHMQHAFDHPLLKGQKPLDPPERPRGHNQMDDGDLSENFQLWSFSGESCPEGTIPIRRTTEQDMLRATSVRRFGRKKIINRVRRDTSGNGHEHAIGYVTGDQYYGSKASINVWAPLVENPYEFSLSQMWVSPELYGDSYPRFFTYWTTDAYQATGCYNLLCSGFVQTNSKIAIGAAISPTSSYSGGQFDISLLIWKDPKHGNWWLEFGSGILVGYWPSFLFTHLGDHASMIQFGGEIVNSGSSGSHTSTQMGSGHFAEEGFAKASYFRNMQVVDWDNNLIPLSNLKVLADHPNCYDIQGGVNNAWGNYFYYGGPGRNVKCP

SEQ ID NO: 229140 - protein, 346 aa, Glycine max
  Coding DNA Sequence Number=SeqID_112362
  Gene Ontology: Mol. function=protein binding; Cellular component =clathrin vesicle coat; Biological process=intracellular protein transport
  Homolog annotation: Hit_ID=Q6DF04; Match level="QueryCoverage=68%, HitCoverage=51%, E-value=2e-83, Identity=64%"; Hit description =Adaptor-related protein complex 1, mu 1 subunit
  Pfam annotation: Domain name=Adap_comp_sub; Domain location=82-345; Score=328.0; E_value=1.6e-95; Accession=PF00928.11; Description =Adaptor complexes medium subunit family
MEIDLFFVREKVLSNKLAVVHIPAQDQWADLLTKPPSSTRFQFIRDKLKTIGAAIFPLAESLKKLDWPHAYAFREEILVVLLPISSTTWLILDSTFTVDSGLDLGTLGMPECKLGLNDRVLLEAQGRTTKGKSIDLEDIKFHQCVRLARFENDRTISFIPPDGSFDLMTYRLSTQVKPLVWVEAQVEKHSKSRIEIMVKARSQFKERRPLYMYLLLQTTQENLFYSTATNVEIELPVPADATNPNVRTSMGSASYAPEKDALIWKIRSFPGGKEYMLRAEFHLPSIVDEEATPERKAPIRVKFEIPYFTVSGIQVRYLKIIEKSGYQALPWVRYITMAGEYELRLI

SEQ ID NO: 229141 - protein, 376 aa, Glycine max
  Coding DNA Sequence Number=SeqID_112363
  Gene Ontology: Mol. function=binding; Cellular component=mitochondrion
  Homolog annotation: Hit_ID=Q5JL31; Match level="QueryCoverage=98%, HitCoverage=76%, E-value=9e-65, Identity=36%"; Hit description =Putative DNA-binding protein
  Pfam annotation: Domain name=PPR; Domain location=114-147; Score =17.6; E_value=0.044; Accession=PF01535.11; Description=PPR repeat
  Pfam annotation: Domain name=PPR; Domain location=221-255; Score =26.6; E_value=8.9e-05; Accession=PF01535.11; Description=PPR repeat
  Pfam annotation: Domain name=PPR; Domain location=297-331; Score=4.6; E_value=2.1; Accession=PF01535.11; Description=PPR repeat
  Pfam annotation: Domain name=PPR; Domain location=332-366; Score=2.8; E_value=3.5; Accession=PF01535.11; Description=PPR repeat
  Pfam annotation: Domain name=PPR; Domain location=44-78; Score=26.4; E_value=9.8e-05; Accession=PF01535.11; Description=PPR repeat
  Pfam annotation: Domain name=PPR; Domain location=79-113; Score=26.4; E_value=0.0001; Accession=PF01535.11; Description=PPR repeat
  Pfam module annotation: Pfam domain module=PPR::PPR::PPR::PPR::PPR::PP R; Domain location=114-147::221-255::297-331::332-366::44-78::79-113
MAKRNMIKTVSDHAIHLDLLAKARGITAAENYFVSLPEPSKNHLCYGALLNCYCKELMTEKSEGLMEKMKELSLPLSSMPYNSLMTLYTKVGQPEKIPSLIQEMKASNVMLDSYTYNVWMRALAAVNDISGVERVHDEMKRGGQAEVALKELEKRNAFKDLTAYQFLITLYGRTGNLYEVYRVWRSLRLAFPKTANISYLNMIQKKCFREWECGCPTYDIRVANVLIRAYVKLDMLEKAEELKERARRRGAKPNAKTLEIFMDYYLLKGDFKLAVDYLNEAISMGRGNGEKWVPSSRIISIMMRHFEQEKDVDGAEEFLEILKKSVESPGVEVFESLIRTYAAAGRISSAMQRRLKMENVEVSEGTQKLLEAISVE

SEQ ID NO: 229142 - protein, 90 aa, Glycine max
  Coding DNA Sequence Number=SeqID_112364
MVGYAPSSFTDLVFTGERIKVGLERAKKPVEFTPILVSYADLLPYLLDNSMVAITPTKVLNLHFSEDTTQMQHVLIMEEPRGIPLSIVGP

SEQ ID NO: 229143 - protein, 118 aa, Glycine max
  Coding DNA Sequence Number=SeqID_112365
MCWKKQLGLRLQVEAWKLAPESGNQVLLVVGHEVNELLLELASESDHESFPRLERSEQILEYTIESSWRELIVAMSGASGLVFPTQCTPDSQCQSSDQLHLHTEEESYTPSNGVVDAL

SEQ ID NO: 229144 - protein, 253 aa, Glycine max
  Coding DNA Sequence Number=SeqID_112366
  Gene Ontology: Mol. function=protein binding; Cellular component =clathrin vesicle coat; Biological process=intracellular protein transport
  Homolog annotation: Hit_ID=Q5KDW0; Match level="QueryCoverage=79%, HitCoverage=46%, E-value=4e-64, Identity=57%"; Hit description =Clathrin assembly protein AP47, putative
  Pfam annotation: Domain name=Clat_adaptor_s; Domain location=4-142; Score=-59.3; E_value=0.026; Accession=PF01217.10; Description =Clathrin adaptor complex small chain
MAGAASALFLLDIKGRVLIWRDYRGDVTAVEAERFFTKLIEKEGDPQSQDPVVYDNGVTYLFIQHSNVFLMMATRQNCNAASLLFFLHRIVDVFKHYFEELEEESLRDNFVVVYELLDEIMDFGYPQYTEAKILSEFIKTDAYRMEVTQRPPMAVTNAVSWRSEGINYKKNEVFLDVVESVNILVNSNGQIIRSDVVGALKMRTYLREDYWFKRRFNGAEVSSGKLSGSFYGNLFKQVVTTGKLSSDFYGNFF

SEQ ID NO: 229145 - protein, 60 aa, Glycine max
  Coding DNA Sequence Number=SeqID_112367
MEPSTNSKVILVGIISKSPSLQHMESGIKIILAPKLIRVLPIETSPIEQGSDPRSSPSEQ

SEQ ID NO: 229146 - protein, 149 aa, Glycine max
  Coding DNA Sequence Number=SeqID_112368
MEAMKEEMATMMEAMMSMKKIMEVNATAVAAISVVSGVDPTPPSCLNLINHPTADTGDPHFVQAQNKQVFPPYGLPPNYTSPNENVNNFTSIPIESQQPQSDHAHVSQPMGETHEMRHHNLADFQPCFRYATEGQAVGGIPLQNTLEGP

SEQ ID NO: 229147 - protein, 71 aa, Glycine max
  Coding DNA Sequence Number=SeqID_112369
MDAKHPTRTKEWSHVIEQRFPDEIRVELNELLIDCTLSLYSVISCYLDLGHRRASSTGSAVQSKFVPNLGE

SEQ ID NO: 229148 - protein, 107 aa, Glycine max
  Coding DNA Sequence Number=SeqID_112370
  Homolog annotation: Hit_ID=Q2HSW6; Match level="QueryCoverage=40%, HitCoverage=13%, E-value=2e-09, Identity=63%"; Hit description =Nucleic acid-binding, OB-fold
MFGGLGEKLAKKCHVKCEKAHLIAGSRAPNFESLKEGIGNGGSSTVRFRVSPSILQCLQREKEYKPEVGDIVIGRVVEVAQKCWRLEINYNQDAVLLLSSMNMRDGV

SEQ ID NO: 229149 - protein, 128 aa, Glycine max
  Coding DNA Sequence Number=SeqID_112371
MGIGVVVIYTCIWANMTIFFKCGYRHNAFCVFDNAITQYLTPPHYDSKSKMFYSQSTGKGRYKNKNIVETSVNNVIEETSKKPRLNLGEGLAMFEKKKTKGDGVSVATPAFGAFSSFSDTFYIEKGMK

SEQ ID NO: 229150 - protein, 476 aa, Glycine max
  Coding DNA Sequence Number=SeqID_112372
  Gene Ontology: Mol. function=protein binding; Cellular component =integral to membrane; Biological process=protein amino acid phosphorylation
  Homolog annotation: Hit_ID=Q1T435; Match level="QueryCoverage=89%, HitCoverage=77%, E-value=6e-70, Identity=33%"; Hit description =Leucine-rich repeat; Leucine-rich repeat, cysteine-containing type
  Pfam annotation: Domain name=LRR_1; Domain location=111-133; Score =7.5; E_value=11; Accession=PF00560.23; Description=Leucine Rich Repeat
  Pfam annotation: Domain name=LRR_1; Domain location=141-162; Score =19.0; E_value=0.017; Accession=PF00560.23; Description=Leucine Rich Repeat
  Pfam annotation: Domain name=LRR_1; Domain location=164-186; Score =8.5; E_value=7.3; Accession=PF00560.23; Description=Leucine Rich Repeat
  Pfam annotation: Domain name=LRR_1; Domain location=188-210; Score =15.3; E_value=0.22; Accession=PF00560.23; Description=Leucine Rich Repeat
  Pfam annotation: Domain name=LRR_1; Domain location=212-234; Score =11.4; E_value=2.1; Accession=PF00560.23; Description=Leucine Rich Repeat
  Pfam annotation: Domain name=LRR_1; Domain location=241-262; Score =11.5; E_value=2; Accession=PF00560.23; Description=Leucine Rich Repeat
  Pfam annotation: Domain name=LRR_1; Domain location=264-285; Score =12.8; E_value=1.2; Accession=PF00560.23; Description=Leucine Rich Repeat
  Pfam annotation: Domain name=LRR_1; Domain location=288-310; Score =11.3; E_value=2.2; Accession=PF00560.23; Description=Leucine Rich Repeat
  Pfam annotation: Domain name=LRR_1; Domain location=312-334; Score =11.1; E_value=2.4; Accession=PF00560.23; Description=Leucine Rich Repeat
  Pfam annotation: Domain name=LRR_1; Domain location=341-362; Score =8.5; E_value=7.5; Accession=PF00560.23; Description=Leucine Rich Repeat
  Pfam annotation: Domain name=LRR_1; Domain location=36-59; Score=7.4; E_value=12; Accession=PF00560.23; Description=Leucine Rich Repeat
  Pfam annotation: Domain name=LRR_1; Domain location=364-386; Score =12.5; E_value=1.3; Accession=PF00560.23; Description=Leucine Rich Repeat
  Pfam annotation: Domain name=LRR_1; Domain location=388-411; Score =9.4; E_value=5.1; Accession=PF00560.23; Description=Leucine Rich Repeat
  Pfam annotation: Domain name=LRR_1; Domain location=413-433; Score =8.5; E_value=7.2; Accession=PF00560.23; Description=Leucine Rich Repeat
  Pfam annotation: Domain name=LRR_1; Domain location=438-460; Score =3.2; E_value=73; Accession=PF00560.23; Description=Leucine Rich Repeat
  Pfam annotation: Domain name=LRR_1; Domain location=62-84; Score =12.6; E_value=1.2; Accession=PF00560.23; Description=Leucine Rich Repeat
  Pfam annotation: Domain name=LRR_1; Domain location=7-34; Score=4.1; E_value=49; Accession=PF00560.23; Description=Leucine Rich Repeat
  Pfam annotation: Domain name=LRR_1; Domain location=87-109; Score =9.4; E_value=4.9; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1::LRR_1::LRR_1; Domain location=111-133::141 -162::164-186::188-210:...
  Pfam module annotation: Domain location=:212-234::241-262::264 -285::288-310::312-334::341-362::36-59::364-386::388-411::413 -433::438-460::62-84::7-34::87-109
  Subcellular localization annotation: CTP_CleavageSite=69; ConfidenceScore=5.27e-01
MIAKLPKLRELSLIHCTLSDQFILPLRPSKFNFSSSLSVLDLSINSFTSSMILQWLSNVTSNLVELDLSDNLLEGSTSNHFGRVMNSLEHLDLSYNIFKADDFKSFANICTLHSLYMPANHLTEDLPSILHNLSSGCVKHSLQDLDLSDNQITGSLPDLSVFSSLKSLFLDQNQLRGKIPEGIRLPFHLESLSIQSNSLEGGIPKSFGNSCALRSLDMSGNNLNKELSVIIHQLSGCARFSLQELNIGGNQINGTLSDLSIFSALKTLDLSRNQLNGKIPESTKLPSLLESLSIGSNSLEGGIPKSFGNACALRSLDMSNNSLSEEFPMIIHHLSGCARYSLEKLDLGMNQINGTLPDLSIFSSLKKLYLDGNKLNGEIPKDYKFPPQLEQLDMQSNSLKGVLTDYHFANMSKLNYLELSDNSLVTLAFSQNWVPPFQLTYIGLRSCKLGPVFPKWLETQNQFEYIDISNAGIADM

SEQ ID NO: 229151 - protein, 175 aa, Glycine max
  Coding DNA Sequence Number=SeqID_112373
  Gene Ontology: Mol. function=protein binding; Cellular component =membrane; Biological process=defense response
  Homolog annotation: Hit_ID=Q1SW19; Match level="QueryCoverage=88%, HitCoverage=16%, E-value=7e-32, Identity=47%"; Hit description =Disease resistance protein
MSTLRKLVLCGTLTRLPNWISQFPNLVQLYLGGSRLTNDALKSLKNMPRLMYLCFAHNAYEGETLHFQCGGFQKLKLLFLAYLDKLKCILIDRGALCSVEKISLADLSQLKTVPSGIQHLEKLKDLIIHSMPTELEQRIAPDGGEDHWIIQDVPHVLIWSRDAEEPSHIFGRSHH

SEQ ID NO: 229152 - protein, 84 aa, Glycine max
  Coding DNA Sequence Number=SeqID_112374
MQSNTSSSTKAKSTNLGSIMEREEKRELYRVKANKIKKKIRHQTISLVDQAFASKHIVSNIQGSGNRLPGNVIDYQKTILKQWV

SEQ ID NO: 229153 - protein, 542 aa, Glycine max
  Coding DNA Sequence Number=SeqID_112375
  Gene Ontology: Mol. function=protein serine/threonine kinase activity; Cellular component=membrane; Biological process=protein amino acid phosphorylation
  Homolog annotation: Hit_ID=Q5JNK2; Match level="QueryCoverage=60%, HitCoverage=79%, E-value=2e-91, Identity=51%"; Hit description =Putative Nod-factor receptor 1b
  Pfam annotation: Domain name=APH; Domain location=235-409; Score= -8.4; E_value=0.022; Accession=PF01636.13; Description=Phosphotransfer ase enzyme family
  Pfam annotation: Domain name=LysM; Domain location=83-128; Score =28.0; E_value=3.3e-05; Accession=PF01476.10; Description=LysM domain
  Pfam annotation: Domain name=Pkinase; Domain location=233-514; Score =174.4; E_value=2.9e-49; Accession=PF00069.15; Description=Protein kinase domain
  Pfam annotation: Domain name=Pkinase_Tyr; Domain location=233-514; Score=159.6; E_value=8e-45; Accession=PF07714.7; Description=Protein tyrosine kinase
  Pfam module annotation: Pfam domain module=APH::LysM::Pkinase::Pkinase _Tyr; Domain location=235-409::83-128::233-514::233-514
MHGIKQDYLIRVPCSCKNTSGLSGYFYDTTYKVRPNDTFANISNLIFSGQAWPVNHTLQPNETLAIHIPCGCSESKSQVVVTYTVQPNDTPMMIANLLNSTLADMQNMNKVLAPNIEFIDVGWVLFVPKESKGLLLLPSATSTNIEEKKHNKWTTIIIGILGGMTLLSIVTTIILILRRNKVDKISIEDSRLISGRSIANKTISSKYSLHKEFVEERPLIYNLEDIEEATNNFDESRKIGSGGYGSVYFGILGNKEVAVKKMRSNKSKEFYAELKVLCKIHHINIVELLGYANGEDYLYLVYEYVPNGSLSDHLHNPLLKGNQPLSWSARVQIALDAAKGLEYIHDYTKARYVHRDIKTSNILLDNKFRAKVGDFGLAKLVDRTDDENFIATRLVGTPGYLPPESLKELQVTPKTDVFAFGVVLSELLTGKRALFRESHEDIKMKSLITVVSVEKVNEIFQDDDPETALEDAIDKNLEASYPMEDVYKMTEIAEWCLQEDPMERPEMRDIIGALSQIVMSSTEWEASLCGNSQVFSGLFSGR

SEQ ID NO: 229154 - protein, 146 aa, Glycine max
  Coding DNA Sequence Number=SeqID_112376
  Homolog annotation: Hit_ID=Q6W2J0; Match level="QueryCoverage=69%, HitCoverage=27%, E-value=3e-07, Identity=44%"; Hit description=Poor homologous synapsis 1 protein
MAGNMAVIEHSNNKNPARLHREQWEICFGSLHPLFFILRGALRHQAAFHVASGVLRLWIPSQGHQNCALLILAFLIVTSCGDGWVGRIQKFAMRFPSIYEAESFINALKEILKGDKDPEPLNTDFGSEILSQSEFMSTIGGMGGYN

SEQ ID NO: 229155 - protein, 169 aa, Glycine max
  Coding DNA Sequence Number=SeqID_112377
  Gene Ontology: Mol. function=helicase activity
  Homolog annotation: Hit_ID=Q1SRJ5; Match level="QueryCoverage=96%, HitCoverage=20%, E-value=5e-44, Identity=50%"; Hit description =Probable helicase [imported]-Arabidopsis thaliana-related
IHISCESTWRIFGFPIHGRKPVVERLHFHLPGQHSVLYEDHDDIDDVLSKPSISDSKFISWMNTNQNSVEGRNLTYAEFVSKFVYNQKKICWHLRKKDYTIGRLLWVPPITGELFYLRMMLTVCKGPTSFEDLRTVDNVQYSTYKEACFAMRFLQDDKEFVEAIKEAKD

SEQ ID NO: 229156 - protein, 97 aa, Glycine max
  Coding DNA Sequence Number=SeqID_112378
VTDRKPVKDKPTADSGSKSRGSAKQHATQHDQIPEVFWNLAAELIIAEVEFADIDGDLAGRDLPDNVFPFSDDKGGEGVDVEVEATIGTRPRVEEAK

SEQ ID NO: 229157 - protein, 117 aa, Glycine max
  Coding DNA Sequence Number=SeqID_112379
  Gene Ontology: Cellular component=membrane
  Homolog annotation: Hit_ID=Q9C9F2; Match level="QueryCoverage=62%, HitCoverage=22%, E-value=4e-10, Identity=40%"; Hit description=MtN21- like protein; 91922-89607
METKMSKEYPRPHSCTTLMTSMGAMQATIFALCIEKDWSQWKLGWNIRLLTSAFSGIVVSGLVVIVTAWCVRLRAKEMKMTPQLVSSNKENFEPSTVAVVIATLDYDNSDYDNNNHT

SEQ ID NO: 229158 - protein, 248 aa, Glycine max
  Coding DNA Sequence Number=SeqID_112380
  Gene Ontology: Mol. function=translation initiation factor activity
  Homolog annotation: Hit_ID=Q2HSQ9; Match level="QueryCoverage=63%, HitCoverage=13%, E-value=1e-30, Identity=52%"; Hit description =Initiation factor eIF-4 gamma, middle; Up-frameshift suppressor 2
  Pfam annotation: Domain name=Upf2; Domain location=108-231; Score= -47.3; E_value=0.068; Accession=PF04050.5; Description=Up-frameshift suppressor 2
MGKAAYNIPPPYLRIAKSLWAMGYEDLFVDLRPNMVRYTSIEEVNAALVELEEHDRIVSADKVSSEKHSGTEKPLIRTTSTTAVVGNGQSIDNGTEENEVQDDNDSETDSGSDTIDVEGHDEELDEENHDDGCETEDDDDDDDDGPGPASDEEDEVHVRQKVTEVDPLEEANFDQELKAVVQARKNISWESYCYADMVCLGTTIRLLGTTIRLLPCDKIEIFEITSFLVGESASIYPSQVPLGGGPVQ

SEQ ID NO: 229159 - protein, 72 aa, Glycine max
  Coding DNA Sequence Number=SeqID_112381
MDASVEFYTTWLTKSKGARMLFDVRVEPTASMMMNLPSKVVMEVGGGGDERVRWRRNGEDRGREGRETMTRL

SEQ ID NO: 229160 - protein, 140 aa, Glycine max
  Coding DNA Sequence Number=SeqID_112382
  Gene Ontology: Mol. function=transferase activity, transferring glycosyl groups; Biological process=metabolic process
  Homolog annotation: Hit_ID=Q6ZG91; Match level="QueryCoverage=67%, HitCoverage=17%, E-value=4e-23, Identity=56%"; Hit description =Putative Anthranilate phosphoribosyltransferase
MLNLEKNCIDDVYGSLVHHSERKETEPGADCGFGVTSARHFRVVLGLRTRFLALLKLTCSSHVANGKEAIVAGFYHEGYEEPLLMLMKRRGVHSGLVVKGEEGGLSLTTRLRSANTTRGLPVNYCSGFRALDISSTSEVG

SEQ ID NO: 229161 - protein, 392 aa, Glycine max
  Coding DNA Sequence Number=SeqID_112383
  Gene Ontology: Mol. function=zinc ion binding
  Homolog annotation: Hit_ID=Q2HRX8; Match level="QueryCoverage=86%, HitCoverage=53%, E-value=1e-36, Identity=32%"; Hit description=IMP dehydrogenase/GMP reductase
  Pfam annotation: Domain name=DUF1723; Domain location=135-184; Score =40.2; E_value=6.9e-09; Accession=PF08330.1; Description=Protein of unknown function (DUF1723)
RRRPTASARRQRVPVIVAHDESVLPAPDVEADVFPDDPMALTDVEDTGADIPTDSGTQATEDEPEGFSGGPSDPSVLTQYANHVACSVWTGEECPELKLSSHGRKVYSLGRSVPAIEGLVVGTGLSPLIACSVDTGDRGYLFSFVEQWHRETSSFHLPVGEVTITLDYVSSLLHLPMVGDLHAFQPLHVDDAVPMLMNLLMVSAEASRAETGQCRGPYVRLQWVCYIYERRCQVGHWTAVARAYLLHLLGCIPFANKSATNVHVVYLEALRDLSQTGRYAWGIAALCWIYEHFASVAEFIVDQDYDEDSPRAYREEHMYTGVQGAPGPTPDFGCLLDPIWGASTSLGLPYDFMLFRSPAMETRCCVLPTREGHAVVWIHPDHFFSAFRFMGV

SEQ ID NO: 229162 - protein, 59 aa, Glycine max
  Coding DNA Sequence Number=SeqID_112384
MEKKPPTRSQKRELEDFELDVLLSDDALIPTTVFGILPMEFASQDWLKATLEDDVLVDE

SEQ ID NO: 229163 - protein, 313 aa, Glycine max
  Coding DNA Sequence Number=SeqID_112385
VVAFSLGLILLGDPLLPAVLSLSNGLPSELKNTVVGVDVGKEGEVVDGVECEASETRLLKPPEVNDGDTILTEDSCMWQLCTLLTRKRNTNVVPFTKPSPESEDEMYLSSEPYLARDTSQGDSFYENEDTNELSDILCSKEDKRCALEEIDDDEEKRKQTVDIPWILDLSHDKLGVGKTVNVFGQLGRETGVKEYNTLIKMCVKKARATDDEFIGVREMSKAFHLYKSMRDLGYPLEEKTYGPLLRYLVDMGLVQEFQLFTDIIKTENPSSASRLGYYEMLLWLRVGNEEMIRDICEYITVEAREETSALRGW

SEQ ID NO: 229164 - protein, 614 aa, Glycine max
  Coding DNA Sequence Number=SeqID_112386
  Homolog annotation: Hit_ID=Q1RVN3; Match level="QueryCoverage=49%, HitCoverage=48%, E-value=6e-12, Identity=23%"; Hit description =Nucleotide-binding, alpha-beta plait
  Pfam annotation: Domain name=RRM_1; Domain location=51-118; Score =38.1; E_value=3e-08; Accession=PF00076.12; Description=RNA recognition motif. (a.k.a. RRM, R
MWKVEDIIPKFKNMHELLEVLPSTSSYEKLILHCCGLDKLIPLLLESGEAGLFSENTTKKELWQHFRKVGDVREVFIAKKRNKNGRRYGFVRFKGVEDMLQLEKKLDNIVFGGLKMFVNIPKFGRAAPGKPQPVDWRRPHNKTNAEENRHAYLTMTQRGLRGAKTGLYVDAVKGNNPRAEQGRLLHRGNFLGNRSQSEVQLDIPLIGHKWLNEAWVGRLKNLTVFDKVEDDILWDCGANVSPRYIGDDMVLLLGLTDDKARQMMDEENEGGRTMFHTMEKWNPRMRPGHRLTWIQCWGIPLIAWDMQQIKKIVAGIGEMVEVDDNVEGQWKMDMARILLKTPWKPLIQHTVRVNIQGEIFQVHITEEGGTSPQVCMCRREMEYNSSDEIQSEESQEGSLWWITAQTSQTKEGSRRWAAVPPSQGGSDEHRTADDKAGMNGDASSSSETRSIHHAPDKFQNGKVPTSSGQNTNFEPKDNNSAYRISETLGFGGRREKEHKKGNEEAEVNIDTLGKISNISKLSRDLEASDLNGLGCANHTPSTSLVYQAGSPSTSKVGPNNSWRVFYRKRWRKKQYGPLPEADTAQQLTTKHPNTQDSAQTQMNERDQSCNYQSP

SEQ ID NO: 229165 - protein, 410 aa, Glycine max
  Coding DNA Sequence Number=SeqID_112387
  Gene Ontology: Mol. function=RNA-directed DNA polymerase activity; Cellular component=nucleus; Biological process=RNA-dependent DNA replication
  Homolog annotation: Hit_ID=Q1T5K4; Match level="QueryCoverage=98%, HitCoverage=40%, E-value=2e-94, Identity=42%"; Hit description=RNA -directed DNA polymerase
MVVDSWNSNQQRGWGGYVLKEKIKTLKERIKVWNREHFGDTFRKYKKIEEDLNKLEEGTEDRQPTHHEVATRKQLQQDLWEAAQSHESLMRQKARSRWIKEGDCNSRYFHMMINASRRSNCLKGVMVKGSWIEEPVIVKEVVRSFFSQRFKESDFGRPTLDGVHFQTITRQHNDMLVERFQEDEVKRVVWGCGSDKSPGPDGLNFKFIKQFWHIFKPDFLRFLDEFHVNGIFPKGSNASFIALILKVVEPQMLNDYRPISLIGCTYKIVAKILANRLKKVMPLIIHERQTTFIEGRHMLHSVMIANEAVEEAKRCQKPRIVFKVDYEKAYDSVSWEFLIYMMRRMGFCNKWIQWIEGCLKSASISVLVNGSPSSEFLPQKGLRQGDPLSPLLFNIVVEALNGLISQLWRK

SEQ ID NO: 229166 - protein, 250 aa, Glycine max
  Coding DNA Sequence Number=SeqID_112388
  Gene Ontology: Mol. function=RNA-directed DNA polymerase activity; Biological process=RNA-dependent DNA replication
MENVKAIKAILRAFQLVLGLKINFAKSSFGAFGMSEQWTLNAANYLNCSLMPFPFTYLGVLIGANPRKCQTWDPIISKVPKRVVDKLVSLQRTFLWGELNFMEGGMWGQISFLGGQVERWRPLFDNEVDMTVSFLNEIEGHRIQPQIPDQWVWVADPQGQYSARGAYNLLTKAAANQSKPSEEANQVNQCVLSFLWIIGGECKSPLLSMQQNTSTVVGIVVLGATSGCFPAAAKTTLSPSHWWNAAGKEG

SEQ ID NO: 229167 - protein, 716 aa, Glycine max
  Coding DNA Sequence Number=SeqID_112389
  Gene Ontology: Mol. function=nucleic acid binding; Cellular component= intracellular; Biological process=DNA integration
  Homolog annotation: Hit_ID=Q1RXN8; Match level="QueryCoverage=99%, HitCoverage=73%, E-value=1e-93, Identity=46%"; Hit description =Peptidase S8 and S53, subtilisin, kexin, sedolisin; Integrase, catalytic region; Zinc finger, CCHC-type
  Pfam annotation: Domain name=RVP; Domain location=238-339; Score= -10.3; E_value=0.04; Accession=PF00077.10; Description=Retroviral aspartyl protease
  Pfam module annotation: Pfam domain module=RVP::RVT_2; Domain location=238-339::554-716
MGTRFDVEKFTGDNDFSLWRIKMQALLVHQGLDDTLQGASKLPSTLSDKEKKDLFSKAHSTIILSLGDEVLREVAEEKSATEIWLKLESLYMTKSLTNKLYLKKRLHQLKMEEGSSIKEHVSLSTKAVLDLKSVDVRIDEEDQAVMLLCSLPSSFENLVDTMLFGRDTLTLEEVKATLNSRELKKKITENKGEGGDPKALMARGRSEKRDSKSKNKRRSKSRNKKACYYCKKEVVADGYESTEVLSISTEKHSEEWILDSGCSFHMTPNLEWFSSYKEIDGGKVLMGNNMACNVIGIGTVKLKMQDGSVKLLPDVRHVPELKRNLLSLGMLDQFGCSFKGEGGTLKVFKGSLQVMKDTRQNGLYKLQGNTILNSAGLVSISEPNASKLWQYRLGHVSEKGLEELHKQGLIGNGNYQKSQINYQKGCLFREEDMIADYQQKSDSVQKGVQAEQNRHSDQGIRLEVEKLAQTSGPVEDRNEASHDEPMISSIPEPADTSYNLVRDRQRRQIKAPVRLGYVDLVAYALSIEIDYQGSEPISYKDAISRTDSDQWRSVMQDEFDSLMKNDTWKLVEKPTKQKVVGCKWILKRKPKETGMDSYRYKARLVARGFTQREGIDYNEIFSPVMKHTSIRIILALVAVHNLELEQMDVKTTFLHRNLEETIYMSQPKGYEVKGKEEMVCLLKKSLYGLKQSPRQWYKRFDSFVVSNGFSKSSYDS

SEQ ID NO: 229168 - protein, 1248 aa, Glycine max
  Coding DNA Sequence Number=SeqID_112390
  Gene Ontology: Mol. function=ATPase activity, coupled to transmembrane movement of substances; Cellular component=integral to membrane; Biological process=transport
  Homolog annotation: Hit_ID=Q9LHD1; Match level="QueryCoverage=99%, HitCoverage=97%, E-value=0.0, Identity=52%"; Hit description =Multidrug resistance protein 13
  Pfam annotation: Domain name=ABC_membrane; Domain location=14-297; Score=100.1; E_value=6.5e-27; Accession=PF00664.13; Description=ABC transporter transmembrane region
  Pfam annotation: Domain name=ABC_membrane; Domain location=679-955; Score=143.6; E_value=5.2e-40; Accession=PF00664.13; Description=ABC transporter transmembrane region
  Pfam annotation: Domain name=ABC_tran; Domain location=1031-1215; Score=208.5; E_value=1.6e-59; Accession=PF00005.17; Description=ABC transporter
  Pfam annotation: Domain name=ABC_tran; Domain location=371-555; Score= 212.5; E_value=9.4e-61; Accession=PF00005.17; Description=ABC transporter
  Pfam annotation: Domain name=SMC_N; Domain location=1019-1219; Score=- 131.2; E_value=0.053; Accession=PF02463.9; Description=RecFRecNSMC N terminal domain
  Pfam module annotation: Pfam domain module=ABC_membrane::ABC _membrane::ABC_tran::ABC_tran::SMC_N; Domain location=14-297::679 -955::1031-1215::371-555::1019-1219
MGNNSMFRYADGMDKLLMFFGTLGSLGDGLQTPLMMYILSDVINAYGDKNSHLTRHDVNKYALRLFCAALGVGLSAFIEGMCWTRTAERQASRMRMEYLKSVLRQEVGFFDTQTAGSSTTYQVVSLISSDANTIQVVLCEKIPDCVAYMSTFLFCHILAFVLSWRLTLAAIPLSVMFIVPALVFGKIMLDLVMKMIESYGIAGGIAEQAISSIRTVYSYVGENQTLTRFSSALQKTMEFGIKQGFAKGLMLGSMGVIYISWGFQAWVGTFLITNKGEKGGHVFVAGFNVLMGGLSILSALPNLTAITEATAAVTRLFEMIDRVPTIDSEDKKGKALSYVRGEIEFQDVYFCYPSRPDTPVLQGFNLTVPAGKSVGLVGGSGSGKSTVIQLFERFYDPVEGVILLDGHKTNRLQLKWLRSQIGLVNQEPVLFATSIKENILFGKEGASMESVISAAKAANAHDFIVKLPDGYETQVGQFGFQLSGGQKQRIAIARALLRDPKVLLLDEATSALDAQSERVVQAAIDQASKGRTTIIIAHRLSTIRTANLIAVLQAGRVVELGTHNELMELTDGEYAHMVELQQITTQNDESKPSNLLTEGKSSHRTSIPQSPTVSFRSSTVGTPMLYPFSQGFSMGTPYSYSIQYDPDDDSFEDNLKRPNHPAPSQWRLLKMNAPEWGRAMLGILGAIGSGAVQPVNAYCVGTLISVYFETDSSEMKSKAKTLALVFLGIGVFNFFTSILQHYNFAVMGERLTKRIREKILEKLMTFEIGWFDHEDNTSASICARLSSEANLVRSLVGDRMSLLAQAIFGSIFAYTLGLVLTWKLSLVMIAVQPLVIGSFYSRSVLMKSMAEKARKAQREGSQLASEAVINHRTITAFSSQKRMLALFKSTMVGPKKESIRQSWISGFGLFSSQFFNTSSTALAYWYGGRLLIDDQIEPKHLFQAFLILLFTAYIIADAGSMTSDLSKGSSAVGSVFTILDRKTEIDPETSWGGEKKRKIRGRVELKNVFFAYPSRPDQMIFKGLNLKVEPGRTVALVGHSGCGKSTVIGLIERFYDPAKGTVCIDEQDIKFYNLRMLRSQIALVSQEPTLFAGTIRENIAYGKENTTESEIRRAASLANAHEFISGMNDGYETYCGERGVQLSGGQKQRIALARAILKNPAILLLDEATSALDSVSEILVQEALEKIMVGRTCIVVAHRLSTIQKSNYIAVIKNGKVVEQGSHNELISLGHEGAYYSLVKLQGGSSPR

SEQ ID NO: 229169 - protein, 223 aa, Glycine max
  Coding DNA Sequence Number=SeqID_112391
  Homolog annotation: Hit_ID=O48915; Match level="QueryCoverage=82%, HitCoverage=83%, E-value=1e-20, Identity=32%"; Hit description=Non -race specific disease resistance protein
  Pfam annotation: Domain name=Hin1; Domain location=28-173; Score =48.2; E_value=2.8e-11; Accession=PF07320.4; Description=Harpin -induced protein 1 (Hin1)
MAQERNTNCCRCCFGTLLSLGLTAAFLWLTLRTSPPKCTLQSLYLPSFTSPHHKNDTLFFNLSLQNDNKDKSIKYGAVLFTFAIFLDNTTTRPLANATLEPFYQGRSKTTRKWGSARVPRDGRAIANRSADATVRNNGKVFVRVEFRTRVRYKIWTLFYVKRQRLVGGANVEVNASSGEKVEPKGIRLGEMPPRLGSQAAKARSCYVAFLGVLVTGLFLTAFT

SEQ ID NO: 229170 - protein, 116 aa, Glycine max
  Coding DNA Sequence Number=SeqID_112392
MTVAFYTTAKPGAIPRNKPWDPSITFGSKGLIPQHLEDKVFLMRARMIGIVLQEAKGLQEQSFLSLLLPLEVLTPRSQLIFFFFLIILEELTLEVSNQAAACNTILRARNSLKTKK

SEQ ID NO: 229171 - protein, 216 aa, Glycine max
  Coding DNA Sequence Number=SeqID_112393
  Homolog annotation: Hit_ID=Q6EUK9; Match level="QueryCoverage=88%, HitCoverage=39%, E-value=2e-27, Identity=35%"; Hit description =Putative NHL repeat-containing protein
MQQQPSQKQFKGLASNEKHMPILESSKEEPGWPSFGQLIVDLSKLSLEALASTFIQFIPSHFRPSNSKRGLTPLKDRLVMPEDDVPPPLVNRQNAQGHTPLTENRMASQVHTPLTENRMASQVHTPTIAEKYSEMKPPKIKSSSFKGPLYVKQAPSQKERPRHRQREKSGEVVMGAVGAEAKPVETRAVDHNNPKFDHYSMRTKYASEETFRFNSQ

SEQ ID NO: 229172 - protein, 50 aa, Glycine max
  Coding DNA Sequence Number=SeqID_112394
MVMELTTDQNGAAYQHSLPVPEDKVLVPVEVTLKPSSTTKIDDVGSAVEG

SEQ ID NO: 229173 - protein, 182 aa, Glycine max
  Coding DNA Sequence Number=SeqID_112395
  Gene Ontology: Mol. function=translation initiation factor activity; Cellular component=cytoplasm; Biological process=translational initiation
  Homolog annotation: Hit_ID=P41568; Match level="QueryCoverage=76%, HitCoverage=100%, E-value=2e-42, Identity=66%"; Hit description =Protein translation factor SUI1 homolog 1
  Pfam annotation: Domain name=SUI1; Domain location=94-175; Score =144.5; E_value=2.8e-40; Accession=PF01253.13; Description =Translation initiation factor SUI1
MGWSLLISSFVWCVEDCFDAMINDTGLSNLVGRTFGLSESSFMSELDDQIPTAFEYGTYCLTSLCQTALTFMFYSSNLYLIDPFADANADDSGAGSKEYVHIRVQQRNGRKSLTTVQGLKKEFSYNKILKDVKKEFCCNGTVVQDPELGQVIQLQGDQRKNVSTFLVQAGIVKKDHIKIHGF

SEQ ID NO: 229174 - protein, 417 aa, Glycine max
  Coding DNA Sequence Number=SeqID_112396
  Gene Ontology: Mol. function=NAD(P)+ transhydrogenase (AB-specific) activity; Cellular component=integral to membrane; Biological process=electron transport
  Homolog annotation: Hit_ID=Q66AA7; Match level="QueryCoverage=91%, HitCoverage=78%, E-value=1e-140, Identity=67%"; Hit description =NAD(P) transhydrogenase alpha subunit
  Pfam annotation: Domain name=AlaDh_PNT_C; Domain location=173-325; Score=218.4; E_value=1.6e-62; Accession=PF01262.12; Description =Alanine dehydrogenasePNT, C-terminal domain
  Pfam annotation: Domain name=AlaDh_PNT_N; Domain location=35-164; Score=228.7; E_value=1.3e-65; Accession=PF05222.5; Description =Alanine dehydrogenasePNT, N-terminal domain
  Pfam module annotation: Pfam domain module=AlaDh_PNT_C::AlaDh_PNT_N; Domain location=173-325::35-164
STLEDPTIHCWHLNICVNVISVRYDARSSWAFSVERLANESRVAATPKTVEQLIKLGFSVTVEQGAGLRASFDDDSFIAAGASISNPQDVWQSDIVLKVNAPDDSEIALMRAGSTLVSFIWPAQNPALLEKLAARNITAMAMDSVPRISRAQSLDALSSMANIAGYRAIVEAAHEFGRFFTGQITAAGKCHRQNLGAIVRAFDTRPEVKEQVQSMGAEFLELDFEEEAGSGDGYAKVMSEAFIKAEMALFAAQAQEVDIIVTTALIPGKPAPKLITADMVASMKPGSVIVDLAAATGGNCDLTVADRVTLSDNGVKIIGYTDLPSRLPTQSSQLYGTNLVNLLKLLCKEKNGEIVVDFDDVVVRGVTVIRDGEVTWPAPPIQVSAAPQAAKPAAQPQVKAAEKPAAPWRKYLLLALA

SEQ ID NO: 229175 - protein, 84 aa, Glycine max
  Coding DNA Sequence Number=SeqID_112397
MEARGARGRRVGVAWKEGDDDLLKRDEGGDVRKEEVMVEEAMLWVKIGKFESTIIQERVSRECMDDAWQFIMQNQRCRLLLYHW

SEQ ID NO: 229176 - protein, 47 aa, Glycine max
  Coding DNA Sequence Number=SeqID_112398
  Gene Ontology: Cellular component=nucleus; Biological process =intracellular transport
  Homolog annotation: Hit_ID=P92985; Match level="QueryCoverage=62%, HitCoverage=13%, E-value=2e-10, Identity=90%"; Hit description=Ran -binding protein 1 homolog c
EHSGNEKSCVWHASDFADGELKDELFCIRFPSVESESLGLVLLELPC

SEQ ID NO: 229177 - protein, 260 aa, Glycine max
  Coding DNA Sequence Number=SeqID_112399
  Gene Ontology: Mol. function=chitin binding; Cellular component =extracellular region; Biological process=chitin metabolic process
  Homolog annotation: Hit_ID=UPI00006A17C9; Match level="QueryCoverage =86%, HitCoverage=100%, E-value=7e-37, Identity=34%"; Hit description= UPI00006A17C9 related cluster
  Subcellular localization annotation: CTP_CleavageSite=43; ConfidenceScore=5.27e-01
MSSPLESYTSSLLESYTSSLQRTTHTRLQRTTRPYLQRTACPRLQRATGPRIRGVHILAFRGLHVLPFRGLHALAFLGLNALAFRGLHALAFRGLHVLTFRGLHILAFRGLHVLLFRKLHALAFLGLHALTFRGLHVLTFRGLHALAFRGLHVLSFRGLHVLAFRGLHILAFKGLHVLAFRGLHILAFRGLHVLPFRGLHVLPFRGLHTLAFRGLHVLTFKGLHALAFRGLHVLTFRGLHIIAFRGLHMCTFRERKVLCP

SEQ ID NO: 229178 - protein, 328 aa, Glycine max
  Coding DNA Sequence Number=SeqID_112400
  Gene Ontology: Mol. function=transferase activity, transferring glycosyl groups; Biological process=pyridine nucleotide biosynthetic process
  Homolog annotation: Hit_ID=Q6XQM5; Match level="QueryCoverage=94%, HitCoverage=52%, E-value=1e-133, Identity=77%"; Hit description =Nicotinate phosphoribosyltransferase-like protein
  Pfam annotation: Domain name=NAPRTase; Domain location=188-322; Score= -80.2; E_value=0.0016; Accession=PF04095.6; Description=Nicotinate phosphoribosyltransferase (NAPRTase) family
METKENGPSKKVSNGGIDGPTNPMVTPLLNDLYQFTMAYAYWKAGKHQERAVFDLYFRRNPFGGEYTVFAGLEECIRFIANFTLAEEEIDFVRECLSSSCELQLTTSSFCFMVVDGFFDYLRGLDCSDVEVYAIPEGTVVFPKVPLMRVEGPVAVVQLLETPFVNLINYASLVSTNAARHRNVAGKSKTLLEFGLRRAQGPDGGVGASKYCYIGGFDATSNVAAGKLFGIPLRGTHSHAFVSSYMSLDEITDKSLRGKDGSSRCDDFVSLVQTWLNKIQVIPETEMDILKAEAQCSKALHAYACVFNANFDVSSTQQFEAHEYWHTYD

SEQ ID NO: 229179 - protein, 227 aa, Glycine max
  Coding DNA Sequence Number=SeqID_112401
  Gene Ontology: Mol. function=copper ion binding; Cellular component =cytosol; Biological process=electron transport
  Homolog annotation: Hit_ID=Q9XHP4; Match level="QueryCoverage=89%, HitCoverage=29%, E-value=1e-119, Identity=99%"; Hit description =Peroxisomal copper-containing amine oxidase
  Pfam annotation: Domain name=Cu_amine_oxid; Domain location=4-205; Score=22.8; E_value=7.8e-17; Accession=PF01179.10; Description =Copper amine oxidase, enzyme domain
MSSSSIIKLELIKYKLISSLSAQVVEVNVKVEKPGDNNVHNNAFYAEEKLLKSEMEAMRDCDPLSARHWIVRNTRTVNRTGHLTGYKLVPGSNCLPLAGSEAKFLRRAAFLKHNLWVTPYARDEMHPGGEFPNQNPRVGEGLATWVKQNRSLEEADIVLWYVFGVTHIPRLEDWPVMPVERIGFMLMPHGFFNCSPAVDVPPNQSDLDDKENGLPAKPIQNGLIAKL

SEQ ID NO: 229180 - protein, 75 aa, Glycine max
  Coding DNA Sequence Number=SeqID_112402
MVKVLGEGGGREEEECFGRVVVSVIAWSYFVPMGIQYSLDHTCLDNILKSLDPSRMNIEVVRHALGQWAYHPLAI

SEQ ID NO: 229181 - protein, 123 aa, Glycine max
  Coding DNA Sequence Number=SeqID_112403
MFETFQWAKKFPNECSMDVVSDKLKVEVTKMGHQVFFPSRLLEQSSDPPMVLRQQFLDGECGWVLLLALDHRTEGFWTIAVLGVVVLVLVFMIVVKGIYVRYAEIAYLASCPCPIVQTSNPVQ

SEQ ID NO: 229182 - protein, 44 aa, Glycine max
  Coding DNA Sequence Number=SeqID_112404
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=93%, HitCoverage=21%, E-value=7e-11, Identity=78%"; Hit description =Anaphase-promoting complex subunit 10
MLIVLVLVVKLDESYMPSKVSIRAGDGFHNLKEIKTVELVKATR

SEQ ID NO: 229183 - protein, 353 aa, Glycine max
  Coding DNA Sequence Number=SeqID_112405
  Gene Ontology: Mol. function=protein binding; Cellular component =integral to membrane; Biological process=defense response to fungus
  Homolog annotation: Hit_ID=Q1T2W0; Match level="QueryCoverage=99%, HitCoverage=70%, E-value=1e-113, Identity=35%"; Hit description =Leucine-rich repeat; Leucine-rich repeat, cysteine-containing type
  Pfam annotation: Domain name=LRR_1; Domain location=101-120; Score =11.5; E_value=2; Accession=PF00560.23; Description=Leucine Rich Repeat
  Pfam annotation: Domain name=LRR_1; Domain location=125-146; Score =9.1; E_value=5.6; Accession=PF00560.23; Description=Leucine Rich Repeat
  Pfam annotation: Domain name=LRR_1; Domain location=151-174; Score =7.2; E_value=13; Accession=PF00560.23; Description=Leucine Rich Repeat
  Pfam annotation: Domain name=LRR_1; Domain location=247-269; Score =15.1; E_value=0.25; Accession=PF00560.23; Description=Leucine Rich Repeat
  Pfam annotation: Domain name=LRR_1; Domain location=27-46; Score =13.6; E_value=0.73; Accession=PF00560.23; Description=Leucine Rich Repeat
  Pfam annotation: Domain name=LRR_1; Domain location=271-293; Score =19.0; E_value=0.017; Accession=PF00560.23; Description=Leucine Rich Repeat
  Pfam annotation: Domain name=LRR_1; Domain location=295-316; Score =9.9; E_value=3.9; Accession=PF00560.23; Description=Leucine Rich Repeat
  Pfam annotation: Domain name=LRR_1; Domain location=3-25; Score=2.4; E_value=1e+02; Accession=PF00560.23; Description=Leucine Rich Repeat
  Pfam annotation: Domain name=LRR_1; Domain location=53-75; Score =11.7; E_value=1.9; Accession=PF00560.23; Description=Leucine Rich Repeat
  Pfam annotation: Domain name=LRR_1; Domain location=77-99; Score=8.8; E_value=6.5; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=101 -120::125-146::151-174::247-269::27-46::271-293::295-316::3-25::53 -75::77-99
MPFTYYVSLSNNTLHGNIPYSLCNASYLQVLDLSINNISGTIPSCLMMMMNGTLEALNLKNNNLSGPIPNTVPVSCGLWNLNLRGNQLDGSIPKSLAYCSKLEVLDLGSNQITGGFPCFLKEISTLRVLVLRNNKFQGSLKCLKANKTWEMLQIVDIAFNNFSGKLPRKYFTTWKRNITGNKEEAGSKFIEKQISSGDGLYYRDSITVTNKGQQMELVKILTIFTSIDFSSNHFDGPIPQELMDWKELYVLNLSNNAFSGKIPSSIGNMRQLESLDLSQNSLSGEIPVQLASLSFLSYLNLSFNHLVGKIPTSTQLQSFSASSFEGNDGLYGPPLTKNPDHKEQEVLPQQECG

SEQ ID NO: 229184 - protein, 138 aa, Glycine max
  Coding DNA Sequence Number=SeqID_112406
MTPTHDAVLYYNGRWNMPRQNNFVGYAFIGKNLQKFDIPKGCTINELKDLIKKVAPKGNPPHEIHESQLVRHLFFRQLAHLEYSDKVLKFEIIEVKSDDDVLKVLVESNYWKQFVPIEILALFSKSVMENEDEVVTSL

SEQ ID NO: 229185 - protein, 174 aa, Glycine max
  Coding DNA Sequence Number=SeqID_112407
MKERSSVRVCGRTFFRRIYCLLEEEGSSTDSTEEGSSACSCGRSVFHVRAEEAYGHAEELRLQPRAKNSSQMSSNLRLAYAIQREMRSKPSITVARDHSKEGFGCEEGVAGNSERVLVMVRFTMQGEEASQGGGGERACIGEVVGVKEGKGEKCELFVSVKGHFVIQHKMQTVS

SEQ ID NO: 229186 - protein, 217 aa, Glycine max
  Coding DNA Sequence Number=SeqID_112408
MAFLGETSSQMIVNSSSTPVPMRVPNIFDFSTLKSRIHNTLQLNDDQVVDEIHYRRPLEDTGNKIHFQCMQLKNDMDVNTMLICNDRFSCVGPIELLCTVGRTLDGILNLLERTMTPTHDAVLYYNGRWNMPRQNNFVGYAFIGKNLQKFDIPKGCTINELKDLIKKVAPKGNPPHEIHESQLVRHLFFRQLAHLEYSDKVLKFEIIEVKSDDDVLK

SEQ ID NO: 229187 - protein, 213 aa, Glycine max
  Coding DNA Sequence Number=SeqID_112409
VLGAHVSTKGSNAENVVNPSGKYMDEWSSRFGHGSVYGFLEPQSIHKAKDRHVECEHYIQTWVKESQREVYLGTYLNQNDVVAWFCSLRKKLNIHIKATINNAMKTIKTTVDGKNDQGTPKWIKVKSHVQSGGYECGYYVMHWMWNIVSRGLKNDWSMWFADDTTLDIETITTIRKKWATYFVKVKNIRCRKPRTNERRVIGRVNCRGGPALG

SEQ ID NO: 229188 - protein, 557 aa, Glycine max
  Coding DNA Sequence Number=SeqID_112410
  Gene Ontology: Mol. function=RNA-directed DNA polymerase activity; Cellular component=chromatin; Biological process=chromatin assembly or disassembly
  Homolog annotation: Hit_ID=Q94I07; Match level="QueryCoverage=99%, HitCoverage=56%, E-value=1e-155, Identity=40%"; Hit description =Putative retroelement
  Pfam annotation: Domain name=rve; Domain location=252-409; Score =108.4; E_value=2.2e-29; Accession=PF00665.16; Description=Integrase core domain
  Pfam annotation: Domain name=zf-H2C2; Domain location=198-235; Score =4.7; E_value=0.086; Accession=PF09337.1; Description=His(2)-Cys(2) zinc finger
  Pfam module annotation: Pfam domain module=rve::zf-H2C2; Domain location=252-409::198-235
LPDFDKVFQVECDASGIGIGAVLSQEKKPIAFFSEKLSEARRKWSTYDQEFYAVFRALRQWEHYLIHREFILFTDHQALKFLHSQKLINKMHARWVSFLQKFPFIIQHKSGALNKVADALSRRDSLLVTLAQEVVGFECLKELYENDAEFQELWAKCREHPCDDFHVREGFLFKGNRLCIPCSSLREKLIRDLHGGGLSGHMGRDKTIASLEERFYWPHLRKDAGTIVKKCYTCQVSKGQSQNTGLYMPLPIPDDIWQDLAMDFVLGLPRTQRGVDSVFVVVDRFSKMSHFIACKKTADASNIAKLFFREVVHLHGVPKSITSDRDTKFLSHFWITLWKLFDTSLNRSSTAHPQTDGQTEVTNRTLGNMIRCVCGDKPKQWDLALPQVEFAYNSTMHSATGKTPFSLVYTSVPRHVVDLIKLPKAPGFSVAAENMAEEIIAVKDSVKSKLEATGLKNKIAADKRQRVKVFNVGDEVMVFLRKERFPVGTYSKLQPRKYGPFQVTRKINDNAYVVALPASMNISNTFNVADIYEYHADEVLYRDENSGSSSFEVEETD

SEQ ID NO: 229189 - protein, 114 aa, Glycine max
  Coding DNA Sequence Number=SeqID_112411
MEREARERVKESLHGEAVKWMDRFTLTLNGSQELPRLLARAKAMADVYPVLDEEVQEQMKADMEAMKDQMTSMMEAMMSMRRMMEDNAAAVVAASATVEADPTHPSGINQASRP

SEQ ID NO: 229190 - protein, 60 aa, Glycine max
  Coding DNA Sequence Number=SeqID_112412
MENWRKALGNNFVGLQTPLCNNFAGLQTYWWRMHEQHKAMTFMGLRKKVENGELANSAML

SEQ ID NO: 229191 - protein, 105 aa, Glycine max
  Coding DNA Sequence Number=SeqID_112413
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=98%, HitCoverage=19%, E-value=3e-29, Identity=72%"; Hit description=NADH -plastoquinone oxidoreductase subunit 2
MASGGWEILAILSMILGNLIAITQTSMKRMLAYSSIGQIGYVIIGIIVGDSNGGYASMITYMLFFIPLNLGTFACIVVGGGYVPELITFEIMQDYTRKILIWLSL

SEQ ID NO: 229192 - protein, 193 aa, Glycine max
  Coding DNA Sequence Number=SeqID_112414
  Gene Ontology: Mol. function=structural constituent of ribosome; Cellular component=ribonucleoprotein complex; Biological process =translation
  Homolog annotation: Hit_ID=Q9M5M7; Match level="QueryCoverage=65%, HitCoverage=84%, E-value=2e-24, Identity=43%"; Hit description=60S ribosomal protein L10
  Pfam annotation: Domain name=Ribosomal_L10e; Domain location=48-167; Score=-36.4; E_value=1.7e-05; Accession=PF00826.8; Description =Ribosomal L10
MEGVMSQHIMSREVRVVAKRRRGRGIKRGQRMHFIGRLKVLEGEIRFVWDEVDKGGGTKESMRIYDVGMKKKGVDEFPFCVHLAARIACNKYMTKFAGKGCIPLESQAASLPSAGYLCYSGYWPGPPFCPPYGLQQPSCTRGPHRAKFKFPGCQKIISEYRIMPDGVNAKLLGCHGPLANCQPGRAFLSRATA

SEQ ID NO: 229193 - protein, 226 aa, Glycine max
  Coding DNA Sequence Number=SeqID_112415
MKNKKVEAVGVSLSEAYALSEQHPLSEALSSLSGLRESGRESVIHARAQHAISSLSKYPSAGASEVDIVAKDQPRRARLPNPYYSSLHGSRGSSRPLTFESLSPAINLAYIKKNCWNPDDPSITFPGTRKARARGPEGPFSSTSFTPASTSSVPAPIPAPSIHNLAQHWPIISMEDFMAQPEAEAQPEVTSEATPQTSPATTPFVEVSEEEEGAEETDYATNMAAA

SEQ ID NO: 229194 - protein, 854 aa, Glycine max
  Coding DNA Sequence Number=SeqID_112416
  Gene Ontology: Mol. function=protein serine/threonine kinase activity; Cellular component=cell surface; Biological process =protein amino acid phosphorylation
  Homolog annotation: Hit_ID=Q53KU9; Match level="QueryCoverage=99%, HitCoverage=99%, E-value=0.0, Identity=53%"; Hit description =Probable protein kinase [imported]-Arabidopsis thaliana
  Pfam annotation: Domain name=Pkinase; Domain location=127-424; Score =141.3; E_value=2.6e-39; Accession=PF00069.15; Description=Protein kinase domain
  Pfam annotation: Domain name=Pkinase; Domain location=535-816; Score =10.3; E_value=3.6e-09; Accession=PF00069.15; Description=Protein kinase domain
  Pfam annotation: Domain name=Pkinase_Tyr; Domain location=127-421; Score=75.6; E_value=1.5e-19; Accession=PF07714.7; Description =Protein tyrosine kinase
  Pfam module annotation: Pfam domain module=Pkinase::Pkinase::Pkinase _Tyr; Domain location=127-424::535-816::127-421
MQLTHLCLIMPSDYDKLEPLHATPQTNIKGSQKKVKSRKQHPQGACCGGHVVATLLHGSLTRLCETKWWNNLCQHGTRRKTKQIKSSCVVFHDMEGVQLSSMIGKDSNINHPRIFSYAELYIGSRGFSEEEVLGSGGFGKVYKAVMPSDGTVVAVKCCLAGKGGQFEKTFAAELAAVAHLRHKNLVPLRGWCVFEDQLYLVYDYMPNLSLDRVLFRKNMKEEPLGWVRRGKIVKGLACALHYLHEQLETQIIHRDVKTSNVMLDSHYNARLGDFGLARWLEHELEYEYETRKESTSRKFEHFRLSETTRIGGTIGYLPPESFQRRSIATSKSDVFSFGIVVLEVVSGRRAIDLTYSDEKIILLDWIRRLSDEGRLVAAVDTRVTDGSYKVFEMEHLIHISLLCTLHDPQLRPSMKWIVEALSDVSNKLPTLPSFHCHPMYISLSSSSETSPNSTKGTGTSSGTEIATSTSNHTNSNSKFVTATGETIYVTAEAEHRNSGTSSSKSSKRVMHHQPSFVEAPREIPYKEIVSATGNFSESQRVAELDFGTAYHGILDGHYHVMVKRLGLKTCPALRQRFSNELRNLAKLRHRNLVQLRGWCTEQGEMLVVYDYSASRFLSHQLHHHNNATKNGNSVLKWHHRYNIVKSLASALLYLHEEWDEQVIHRNITSSAVTLEPDMTPRLGSFALAEFLSRNEHGHHVITTRSKSVCGIFGYMSPEYVESGEATTAADVYSFGVVVLEIVSGLKAVDFRQPEVLLVKKVHEFEMRKRPLEELADIGLNGEYNYKELMRLVSLGVACTSSDPKLRPSTRKIVSILDGNDKLIMGENMESREDWRERNACSLSLVKRIQALGIQ

SEQ ID NO: 229195 - protein, 1761 aa, Glycine max
  Coding DNA Sequence Number=SeqID_112417
  Gene Ontology: Mol. function=translation initiation factor activity; Biological process=regulation of translation
  Homolog annotation: Hit_ID=Q76E23; Match level="QueryCoverage=99%, HitCoverage=99%, E-value=0.0, Identity=42%"; Hit description =Eukaryotic translation initiation factor 4G
  Pfam annotation: Domain name=MA3; Domain location=1574-1688; Score =67.5; E_value=4.4e-17; Accession=PF02847.7; Description=MA3 domain
  Pfam annotation: Domain name=MIF4G; Domain location=1119-1341; Score =202.0; E_value=1.4e-57; Accession=PF02854.9; Description=MIF4G domain
  Pfam module annotation: Pfam domain module=MA3::MIF4G; Domain location=1574-1688::1119-1341
  Subcellular localization annotation: CTP_CleavageSite=87; ConfidenceScore=5.56e-01
MSFNQSKSEKNDAVYRKTGRSASFNQQRGGSYGRGGGGGGAAPSSSSLSFSRSFNKKSNNAQGGQSRVNPPGHSTESNSASTAQTINGSHVQPQLHGASDGPATKSSESPAAHRSAGILPKAPTSLQAPLISDPLPPSSPAKGDASKAFPFQFGSITPGFVNGMAIPARTSSAPPNLDEQKRDQALHDSYKSVPSVPIPPVPKQQQPPRKDAGVTEQSNAGDSWENHLGFKAKKDPHVSALTPASQMPKSSVPVTGISMSTPYHQSQAPLQFGGANPQIQSQGMSAASHQMPIPMPLPIGNATQVQQPVFVPGLQPHPMHPQGIRHQGQNMSFAPQMGHQLPHQLGSMGIGIGPPYPQQQGGKFAAPRKTTVKITHPETHEELRLDKRTDAYSDGGSSGARSHPNIPSKSPGKSFPASHPANYYSSSSYNTNSLYYPPSSLPLTSNPMSPNSQPPIFNFTVNHGPQGVNFMNSSSRGSPSINKASTPTEDASLTIKPSGTSAIVDSSLSNSSISDVQNTESPSSTASCDASSSVLQKGSETCLEIFLQQHKLSSDSVPVVSNNEGRRESLSRSNSLKDKKPGKKDQLSQHQVSVQSPTADNMPSHAVDHGISDTGVSKPVGTKTNHSAEITTEDLPTSNTIPSSTSTAEVKTNGSAEVSTFVSGAQTVDRVHNSNPDKIDELAEGKQLKHYDESDEPSSPEGYKSNMYFNGTEIKLTEKDAAIVSTVLTGILDESASYNAKCVIGDNLGTCTTTTLHYSRDVSFRTNDSVVTNRFVSGKFGISDLQSADLPETTSMHVKDASENTGGESGTKDRPTIEPNKVKTTSKGKKKRREILQKADAAGSTSDLYNAYKGPEEMKEAVLSSESTESTTTLKQLPKDAAQSDALASEKCGHSKAELDDWEDAADMSTPKLEVHDKSQQAGDGSGSTAKKYSRDFLLKFAEQCMDLPEGFEVTTDIESLMSANIGSSHVFERDSHPSPGRIVDRPGGMSRMDRRGDVVMEDDRWSRVSGAFRSGRGLDGIGGNVGFRSGQGGNFGVLRNPRAQTPPQYVGGILSGPMQSVGNHGGRNNPDGERWQRSASFQQRGLIPSPTQTPLQMMHKAENKYEVGKATDVEEVKQRQLKAILNKLTPQNFDRLFEQVKAVNIDNAVTLTGVISQIFEKALMEPTFCEMYANFCFHLASELPDFSEDNEKITFKRLLLNKCQEEFERGEREEEEANKADEGEVKQSAEEREERRVKARRRMLGNIRLIGELYKKKMLTERIMHECIKKLLGQYQDPDEEDIEALCKLMSTIGEMIDHPKAKVHMDAYFERMKLLSNNMNLSSRVRFMLKDSIDLRKNKWQQRRKVEGPKKIEEVHRDAAQERQAQAGRPGRGLGNNQSARRNPMDFGPRGSMLSSPNSQMGGLRGLPTQVRGYGASQDARFEERQSYEARTLSVPLPQRPLGDDSINLVPQGGLGRGMSTRGSTAISNLPISDVLPVHGNSHRMNIGLNGHSNLSECTPYSSREDLVSRYGNVRSSGPSAYDQSSAPERNVNHDNRDWRSADRNLEPPAHLQGSMVSQNASSEKIWPEERLRDMSLSAIREYYSARDENELALCVKDLNSPSFHPSLVSLWVTDSFERKDAERDLLAKLLVNLVKSQHGTLNQVQLIKGFESALSTLEDAVNDAPRAAEFLGRIFAKAITENVVSLKEIGQLIHDGGEEPGSLLEVGLAADVLGSTLEVIQSEKGDAVLNEMRSDSNLRLETFRQPNAKTSRKLEKFI

SEQ ID NO: 229196 - protein, 103 aa, Glycine max
  Coding DNA Sequence Number=SeqID_112418
  Gene Ontology: Mol. function=catalytic activity; Biological process =alkaloid metabolic process
  Homolog annotation: Hit_ID=Q56SE1; Match level="QueryCoverage=78%, HitCoverage=38%, E-value=2e-15, Identity=39%"; Hit description =Methyl jasmonate esterase
MVGTYVPVDGSFRGAWCWYKVANKLKSEGHNVTTACLLLLSINPKHMQERKKVILVGHGLGGISVSVAMGKYPENISVAVCITATVVSETEPHQIFFKMYFSH

SEQ ID NO: 229197 - protein, 81 aa, Glycine max
  Coding DNA Sequence Number=SeqID_112419
MFALVQESHLKKSATLVAKERALTLGPRLRFRCDEHPPFVVHAPSPISAGREGGVLGKYPSPTSAASILGVQLIYLLGNFT

SEQ ID NO: 229198 - protein, 61 aa, Glycine max
  Coding DNA Sequence Number=SeqID_112420
MVRVTLFCENAPTTWDQHRLKGALKPSVFIPKAETLKNPLGPHLHDSGPIPKTIFARKHCS

SEQ ID NO: 229199 - protein, 74 aa, Glycine max
  Coding DNA Sequence Number=SeqID_112421
  Homolog annotation: Hit_ID=Q8S5P6; Match level="QueryCoverage=56%, HitCoverage=6%, E-value=2e-07, Identity=45%"; Hit description =Putative transposase
SIPYFGFIDEMWELNYVKFTGFTLVDLKKLGYHNDPFIMAEQARQGKTIGVNVEDDDSYMDTYVSPLTAQITPN

SEQ ID NO: 229200 - protein, 285 aa, Glycine max
  Coding DNA Sequence Number=SeqID_112422
  Gene Ontology: Mol. function=hydrolase activity, hydrolyzing O -glycosyl compounds; Cellular component=beta-galactosidase complex; Biological process=carbohydrate metabolic process
  Homolog annotation: Hit_ID=Q1SJP8; Match level="QueryCoverage=93%, HitCoverage=16%, E-value=5e-72, Identity=51%"; Hit description=D -galactoside/L-rhamnose binding SUEL lectin; Integrase, catalytic region; ...
  Homolog annotation: Hit description=Galactose-binding like; Peptidase aspartic, catalytic
MVKLTNFSRKIKYFLGIEVAYSKQGIFISQRNYVLDLLQETRKLGCKPVGVPIEQNHEMSIEEESVKVDKAQYQRLVGKLIYLAHTRPDIVYATRVGRQFMHDPKVRHLQAANRVLQCLKDTPGRGPLFKRGGSLTIEAYTNADYTGSMSDRRSISSNCTFLCGNLVTWRSKKQSVVARSSVRQNLDLWHKESIKYEGLMKLFCNNKSTFNIAHNLVQHDKAKHFEIDLHFIKEKLDSESITTYIPSWHQLANVLRNGLPTKHFSQLTWKLGMIDIHSLDWGVML

SEQ ID NO: 229201 - protein, 276 aa, Glycine max
  Coding DNA Sequence Number=SeqID_112423
  Gene Ontology: Mol. function=methyltransferase activity; Cellular component=endoplasmic reticulum membrane; Biological process=GPI anchor biosynthetic process
  Homolog annotation: Hit_ID=Q10SA7; Match level="QueryCoverage=72%, HitCoverage=91%, E-value=2e-52, Identity=47%"; Hit description =Phospho-ethanolamine N-methyltransferase family protein, expressed
  Pfam annotation: Domain name=PIG-F; Domain location=11-221; Score =207.8; E_value=2.5e-59; Accession=PF06699.2; Description=Phospho -ethanolamine N-methyltransfer
MDRRKSNETTKSSTTSTVELPPPISASEALIVNALCALGLAFAFWIANTVYSIELVTHPSLTLFFIWITELPIVTLLYSRYRQNRKQCTYLRAVGRGVLGVPVGALLNFLGAIAVGAPVTFQYLPKTVNWALMMSVFTTIPASCVLGSSWADWRRIFAQTKPKGSIEYLICLPAHGAVIGAWFGAWPMPLDWERPWQEWPISVSYGTVAGYLVALVASLGFVLACGPVCRQWIMNYDDKGKIGAIKLQALAMTWSSMGLNPLWIYCRQYYLAFVRG

SEQ ID NO: 229202 - protein, 147 aa, Glycine max
  Coding DNA Sequence Number=SeqID_112424
MVRASLFNLEHLDILRDSIEHPASVFNLELLDILLDSIGHPCIKLLSFEFATSIHFNLEHLYILWDSIGHPSKKLLSFEFGTSYRFQFGASRLNLLQPSILNLENLDILRDSIEHPSIKLLSFEIPQSLCSQFGASRYMTVLNRTSE

SEQ ID NO: 229203 - protein, 107 aa, Glycine max
  Coding DNA Sequence Number=SeqID_112425
MALCFMDMGSSIDRNCVKAIEGVQPAILENAPVKAPSEIRKSEYKEDGLPVDVDSSTTRGERRGMGSLLVKKEFNEDEAEEEVEAAPIEFCAPLQADDIITVVEGFI

SEQ ID NO: 229204 - protein, 63 aa, Glycine max
  Coding DNA Sequence Number=SeqID_112426
MEAIRPSEDQLVAQVYVESKEPLMHVVAPEPRIAFYKGVEDTLFLLDFVVFCAENIEIASHST

SEQ ID NO: 229205 - protein, 200 aa, Glycine max
  Coding DNA Sequence Number=SeqID_112427
  Gene Ontology: Mol. function=selenium binding; Biological process =cell redox homeostasis
  Homolog annotation: Hit_ID=Q9ZQ24; Match level="QueryCoverage=50%, HitCoverage=48%, E-value=6e-24, Identity=56%"; Hit description =Expressed protein
  Subcellular localization annotation: CTP_CleavageSite=27; ConfidenceScore=5.27e-01
MPPAKRKAEGTAAAAASSAAAPMRVTRAAAKRAAASSDPPPVPVVKKAAKKAKVAAAAKKQKRNEKENEDVPVESENKAEEKEEGGDASEKNVLDASNKTIVVEHCKQCNSFKTRANLVKVGLEKADIGITVILNPEKGPNNVHRALPIWPRKGCFEIRQEGGGKKFITLLDLKRPFKPMKDLDMDKVISDIIEEISKTS

SEQ ID NO: 229206 - protein, 359 aa, Glycine max
  Coding DNA Sequence Number=SeqID_112428
  Gene Ontology: Mol. function=amino acid binding; Biological process =metabolic process
  Homolog annotation: Hit_ID=Q75IY1; Match level="QueryCoverage=90%, HitCoverage=72%, E-value=1e-121, Identity=67%"; Hit description =Putative ACT domain containing protein, ACR4, with alternative splicing forms
  Pfam annotation: Domain name=ACT; Domain location=127-199; Score =37.0; E_value=6.5e-08; Accession=PF01842.15; Description=ACT domain
  Pfam annotation: Domain name=ACT; Domain location=260-331; Score =20.2; E_value=0.0077; Accession=PF01842.15; Description=ACT domain
  Pfam annotation: Domain name=ACT; Domain location=39-102; Score=29.2; E_value=1.4e-05; Accession=PF01842.15; Description=ACT domain
  Pfam module annotation: Pfam domain module=ACT::ACT::ACT; Domain location=127-199::260-331::39-102
MSEVNMSFSHYMDDEYEKLFRRMNPPRVVIDNEACKNATVIRVDSANKHGILLEVVQILTDLNLIITKAYISSDGGWFMDVFNVTGQDGNKVTDEAILDYIRKSLGPESCVTSPMRSVGVKQTTDHIAIELMGTDRPGLLSEVSAVLTNLKCNIVNAEVWTHNTRAAAVMHVTDEESGSAITDPQRLSIIKELLCNVLGGGNKKRGAKTVVTDEATHTERRLHQMMFADRDYERVNDDDDFDEKQRPNVNVVNWSDKDYSVVTIQCKDRPKLLFDTVCTLTDMQYVVFHANIDAEGPEAYQEYYIKHIDGSPVKSDAERQRVIQCLAAAIQRRVSETCIWYSIIHGVKLVHVKPFFLSR

SEQ ID NO: 229207 - protein, 111 aa, Glycine max
  Coding DNA Sequence Number=SeqID_112429
  Subcellular localization annotation: CTP_CleavageSite=60; ConfidenceScore=5.87e-01
MATGRDRAGMGIVSSSPTSTPQHVPVPVSNARCTGMSMGRVVTFSSPTLTPTKKVRHGTRAGRGWGVLPRSPSPNLIVLPVPVPAPRGGGIFCPVSVPWLPTGTCGDPILH

SEQ ID NO: 229208 - protein, 128 aa, Glycine max
  Coding DNA Sequence Number=SeqID_112430
  Gene Ontology: Mol. function=oxidoreductase activity, acting on single donors with incorporation of molecular oxygen, incorporation of two atoms of oxygen; Cellular component=chloroplast; Biological process=abscisic ...
  Gene Ontology: Biological process=acid biosynthetic process
  Homolog annotation: Hit_ID=Q8LP15; Match level="QueryCoverage=59%, HitCoverage=12%, E-value=1e-19, Identity=61%"; Hit description=Nine -cis-epoxycarotenoid dioxygenase3
MTPLDSIFKDTKESLKSVLTKIRLNLRSGKSTWHVVIEEMNLEAKMVNQNRMRSNTRFAYLGIVETWLKVLGFVKVDSVDLLPPDPPPITHLDLNFLDSSLSKLHDVESRLIQGVLMIIKMMTKSPRE

SEQ ID NO: 229209 - protein, 100 aa, Glycine max
  Coding DNA Sequence Number=SeqID_112431
MVVIAMTAMTIMMETVTTVVIVIITTTIIAVTTTTIVIVAMTIVVATNITINMLVATMMIMTVIIVVVMVMATTIIMLVVATMIDEHSGDCSGDHDNWWK

SEQ ID NO: 229210 - protein, 122 aa, Glycine max
  Coding DNA Sequence Number=SeqID_112432
  Subcellular localization annotation: CTP_CleavageSite=51; ConfidenceScore=5.07e-01
MYKPIKRTINWGKDMIFPKLFNTKFCLSSSKERTVHLSSSDKLTVVIQNCVCFQAFNHMTQVAYNASTNNFSQDMQIFKDRNMIIKQHKICRYQGRIIQPKPHGHCFTQAQVFRLFINQQPT

SEQ ID NO: 229211 - protein, 72 aa, Glycine max
  Coding DNA Sequence Number=SeqID_112433
METILKCFKQLDVCGKVHLKSKLQEITYPDMNSMCPPPEKDSIENIIDVKADDNYGYRAIAALLGMSEETGH

SEQ ID NO: 229212 - protein, 146 aa, Glycine max
  Coding DNA Sequence Number=SeqID_112434
  Gene Ontology: Mol. function=DNA binding; Biological process=DNA integration
MAFSESLGYSENRPPPQVSTQKARPTRTNVKLPSTEDYNEGWWALYVDTASNNKGSGIGIITLEGQDNISIEQSVKFDLKASNNQVEYKALIAGLKLESRSKEIVHVNRGQNYRVDAFAILTSTKRPVQHQTFIQEILTTPTINVT

SEQ ID NO: 229213 - protein, 169 aa, Glycine max
  Coding DNA Sequence Number=SeqID_112435
MAGDEGVIRKQGQQSHSDRQQQIEAKLDQVDTFAKGGGGRGKVMNTIVGGFAGDVDPEQDDPMGHVLIDDDTSYNVLISKSLLNALGIIVSMPHLAMKFPNHKGKIVTIKVDQVLHQARPILTQGKMRKTGGIHQPSNYLYSNWARHCTNAPGWGKNSTNTFKKGLKTC

SEQ ID NO: 229214 - protein, 182 aa, Glycine max
  Coding DNA Sequence Number=SeqID_112436
MTTPVVVRGVDVVGKGTLLYQFFYLVLQDHAFLCCMAEVLMICLGCTSFYPCCGLLFPALPILESLLLLHLDVSCCSCSKLVQVLGLLLAKVVGEWPHFECYDHRMQSNTRVKTKEEKELSQHALHERARARLTGALSKGGKMRGVATNEGISTSHVDKSGAFAPTYPHLERKSDLRSSFLS

SEQ ID NO: 229215 - protein, 423 aa, Glycine max
  Coding DNA Sequence Number=SeqID_112437
  Homolog annotation: Hit_ID=Q011T5; Match level="QueryCoverage=56%, HitCoverage=81%, E-value=3e-68, Identity=51%"; Hit description =Chromosome 09 contig 1, DNA sequence
MSTSRVDGANSWTHKLWHDSRAGFVSKIRINGPYGTGFNDIEDKTQIVAIGAGTGIVPMLSLAKAKVNEFSRMNAQARLNDLAARDAKNREFAQNYSRESYTLKDLLYKSLGLEMKASSEKWENLSVQAILLNKQYTWREKKLREAGDNATKRHYEKLLANSILNEVVDLTQIAFPLIELLSVAFVISFSQNHALVTQAMRELPLWMFFGCHCYFFCHWMLTKMNTPIWWVDLIINATSTMAFALWYNMIREDRKLWSLYMIWVFGALSAYRIARISSDVLLTGTPSSRTVNAYLERTGDASSVTEKFTFVFMTPQCDFCEILWPDLESLHQTIAKNYGDAAGRVFDIQVYCTSKDSAENEALQNYVKGTALGAAGALRMERPDLDKLTSRPILDQVLKDQFTGENKPSFTANLVAFCGGTQL

SEQ ID NO: 229216 - protein, 259 aa, Glycine max
  Coding DNA Sequence Number=SeqID_112438
  Gene Ontology: Mol. function=DNA binding; Cellular component=protein complex; Biological process=regulation of transcription, DNA -dependent
  Homolog annotation: Hit_ID=Q011Q7; Match level="QueryCoverage=81%, HitCoverage=57%, E-value=8e-95, Identity=84%"; Hit description=[OT] KOG0686 COP9 signalosome
SRGEEVDREDQRAARSTRWGRLERKNRLKVYEGLYSAATRDFETATKLFLDSLSTFTSYELLSYDDFVFYTVICAVVTLPRTELKAKVIDSPEILSVLNRLPGLGDFLNALHKCDYRTFMSAFPIVASYVEKSVWVNPHFRYFLREVRVVAYAQYLQSYKSVTVKSMADSFNSRRGVANKPPGFEELSLPKFDQRRGRPLEQRVQTQSSDRSLGAVLGTPRVLARDTDRYHKNVRIQRSLGASQRESSASVRAHYTRLD

SEQ ID NO: 229217 - protein, 83 aa, Glycine max
  Coding DNA Sequence Number=SeqID_112439
  Gene Ontology: Mol. function=RNA methyltransferase activity; Biological process=RNA processing
  Homolog annotation: Hit_ID=Q011Q6; Match level="QueryCoverage=82%, HitCoverage=22%, E-value=4e-17, Identity=58%"; Hit description =Chromosome 09 contig 1, DNA sequence
MSRSIGSFPERARYVLRYIYPGSTPRNGRVIDLGELDGPSAAGLPIEATMIADGVDPARWSVRVFDNFLEGWRTLGDGATTAC

SEQ ID NO: 229218 - protein, 74 aa, Glycine max
  Coding DNA Sequence Number=SeqID_112440
  Gene Ontology: Mol. function=transferase activity, transferring glycosyl groups; Biological process=metabolic process
  Homolog annotation: Hit_ID=Q9ZWS2; Match level="QueryCoverage=70%, HitCoverage=11%, E-value=2e-09, Identity=62%"; Hit description =Flavonoid 3-O-galactosyl transferase
MTSTLLCLCLMKARVVEAMKDSENQHRENTSTFTSCHAPTRVDLVPQRNSLPLQTRGFVGEMGLLLYDWSTAYA

SEQ ID NO: 229219 - protein, 226 aa, Glycine max
  Coding DNA Sequence Number=SeqID_112441
  Gene Ontology: Mol. function=nucleoside-triphosphatase activity; Cellular component=membrane; Biological process=proteolysis
  Homolog annotation: Hit_ID=Q00RT5; Match level="QueryCoverage=98%, HitCoverage=35%, E-value=1e-105, Identity=87%"; Hit description =Homology to unknown gene
  Pfam annotation: Domain name=Lon_C; Domain location=31-200; Score= -159.9; E_value=0.073; Accession=PF05362.3; Description=Lon protease (S16) C-terminal proteolytic domain
  Subcellular localization annotation: CTP_CleavageSite=27; ConfidenceScore=5.30e-01
MSDDGLTPVASPSALFLGERVLSPDVSAAPTVTVQGSRPFMLEVQALTNERAESSQGGMTAPPIRTAVGLRFERMQLLLAVLAKFVLGRRVQKHDIFINIVGGMKLDDPSTDVAIALAIASSFVEKPLPPDMCFFGEVGLGGELRPVMQAERRIAEAATMGFKRVLLPEAGSSPDMGKKTGIELVRCNTLAQALEAALDVKPSRSAMKTQPNGSWPSKFPKQKKFG

SEQ ID NO: 229220 - protein, 115 aa, Glycine max
  Coding DNA Sequence Number=SeqID_112442
  Pfam annotation: Domain name=AT_hook; Domain location=17-29; Score =14.2; E_value=0.083; Accession=PF02178.9; Description=AT hook motif
  Pfam annotation: Domain name=AT_hook; Domain location=44-56; Score =17.3; E_value=0.023; Accession=PF02178.9; Description=AT hook motif
  Pfam annotation: Domain name=AT_hook; Domain location=66-78; Score =15.0; E_value=0.058; Accession=PF02178.9; Description=AT hook motif
  Pfam module annotation: Pfam domain module=AT_hook::AT_hook::AT_hook; Domain location=17-29::44-56::66-78
STLEDPTSEPEDPQPPTRKRGRPRKEPEPEPELETEEAGEQPAKRGRGRPKKAKVEEDPSTPKPAPRSRGRPRKTEATPKTNPALKKLGDYLSSPNKEAPAARTRRSTRNSRRGA

SEQ ID NO: 229221 - protein, 124 aa, Glycine max
  Coding DNA Sequence Number=SeqID_112443
MAKEAARSTMITQWSCDSSMADGRGKQENVVVSWLGFVSVWVWAHTAGSRESEREKCFKARNDNHSLYKTVLECQSSKTFQSTFVEIHGLSSSRGKASISMEKYPEKIYVVVFRTTTYVSQNLT

SEQ ID NO: 229222 - protein, 312 aa, Glycine max
  Coding DNA Sequence Number=SeqID_112444
  Gene Ontology: Mol. function=nucleic acid binding; Cellular component= intracellular; Biological process=DNA integration
  Homolog annotation: Hit_ID=Q1S1E3; Match level="QueryCoverage=90%, HitCoverage=100%, E-value=6e-50, Identity=33%"; Hit description=Zinc finger, CCHC-type
  Pfam annotation: Domain name=zf-CCHC; Domain location=105-122; Score =24.8; E_value=8.1e-05; Accession=PF00098.13; Description=Zinc knuckle
MTKSLANRSFLNQRLYTFKMPSGKSFEDHLDDFNTIILDLENIEIKVDDEDQVLLLLLISLPSQHDSLLDMLIYGRDSLSLDENREKDHKNKKGSRSKSHDGRKRRCFVCGSEEHLKKDCPYIRKKKEGNQKSQNGDADMAIEGGTHVRLKGSPDGHEGVLSVPEGEISAWLASLWHKRLGHISEGGLRELKKQKLIGKESLDALEFCEHCIYDKAKRLKFPVAAHHSKGTLDYVHNNLWGSVTVLSHSGARYFLSIIDDFSRKVWVFILKIKDEVFAKFKEWKVLVETQTSIKVKKLRTDNGLEFCSNEFN

SEQ ID NO: 229223 - protein, 272 aa, Glycine max
  Coding DNA Sequence Number=SeqID_112445
  Gene Ontology: Mol. function=nucleic acid binding; Cellular component= intracellular; Biological process=DNA integration
  Homolog annotation: Hit_ID=Q1S1X7; Match level="QueryCoverage=97%, HitCoverage=20%, E-value=9e-76, Identity=49%"; Hit description =Integrase, catalytic region; Zinc finger, CCHC-type; Peptidase aspartic, catalytic
MDQRSYVAKVLKTFNMNQSKAVLTPMAQHFKFSHQHSPQTKEEATYMKKVPYANAVGSIMYLMICPRPNLAYAMSLVSRYMGKSRKVHWEALKWIFRYRKGMCKAELLYAKHESSMDDVVGFVDSNYVGCLDTKRLLIGYMFKFCCNTVSWKGNLQHVVSLSINEAEFIALAEAIKEAVWMKGMAMSVHTKVKDAKVYYDSQSGIHLAKNQTYHERTKHIDVKLHFVREVIANGEVVVAKIHTEDNPMGTLIKALPRPKFKHCVQIMKVERA

SEQ ID NO: 229224 - protein, 270 aa, Glycine max
  Coding DNA Sequence Number=SeqID_112446
  Subcellular localization annotation: CTP_CleavageSite=33; ConfidenceScore=5.43e-01
MQGSSPQAVNSPCLVSQPKCQPVWTTSSWTECRAAVPPASGGVQTRRVTCSCHDTCDESQRPVDVRTCEHFDESLQKADEGLPQDWNKTKIPPIKDIHDYVLFEHRTMAVSARFPASVSTCLAACTYKPRCPGVVFSGFLTGGTCGLIAVHALNYVPFQRTGESGGCGCSSCGAKAASSHVFMRRAFLMSYPQPLLIRAIEDLGNRTEWSSALGEAVVLSNERLTRLTSNVASNDPIWRWIQDSLGAQGVPLRKSLYSLALPLHPNVVPH

SEQ ID NO: 229225 - protein, 37 aa, Glycine max
  Coding DNA Sequence Number=SeqID_112447
MGGHKGVQHYGTNNIKKMTDKNVEIIYHFPARTLETN

SEQ ID NO: 229226 - protein, 193 aa, Glycine max
  Coding DNA Sequence Number=SeqID_112448
  Homolog annotation: Hit_ID=Q00VK5; Match level="QueryCoverage=74%, HitCoverage=23%, E-value=1e-66, Identity=84%"; Hit description=[R] KOG1235 Predicted unusual protein kinase
MFQAIVTWDGSTVADTILSFADNVKANVDYSEFKKDIAAAVNQFQSSTPRAGECMGAIFETVQRYHLCLDPNVMIAVVTVMVLEGWQWRLDPTVNILDYLDDVLKASARKYARLAIADYALKDMWAPFSEPNVFSPEAADPMWALTRERFNGALPLENVERASADRRRHRDGVRGVAMALGSEGEHFRSGFRV

SEQ ID NO: 229227 - protein, 277 aa, Glycine max
  Coding DNA Sequence Number=SeqID_112449
  Gene Ontology: Mol. function=oxidoreductase activity; Cellular component=integral to membrane; Biological process=electron transport
  Homolog annotation: Hit_ID=Q9ATV0; Match level="QueryCoverage=66%, HitCoverage=55%, E-value=1e-17, Identity=51%"; Hit description =Putative cytochrome P450
MSTIQVVLGMVLVLLMHVFNVLALRSRSPRGKLHRQGIHGPSPHFYFGNIPEMKTLLLQVQSAPTTQVKDKDQHVSLSHKWPFTLFPHIQKSLILVFYWDYTVANGDRYKNGEGNHHVYLFGFREAYLFVQRSGTTLGPRHIVSKWANLAHQRKIIAPELYLDKVKKELNSKISKLIKHHQKETHEHDLLQMILEGAKNCTGSSDGLLSNSMSHDRFVIDNCKNILFAGHETIAITASWCLMLLAAHQDRQDCARAVVLEVCGRGALDASMRRSLKT

SEQ ID NO: 229228 - protein, 193 aa, Glycine max
  Coding DNA Sequence Number=SeqID_112450
  Gene Ontology: Mol. function=microtubule motor activity; Cellular component=dynein complex; Biological process=microtubule-based movement
  Homolog annotation: Hit_ID=Q00WK2; Match level="QueryCoverage=99%, HitCoverage=4%, E-value=1e-49, Identity=50%"; Hit description=[Z] KOG3595 Dyneins
MITASDAILSACAKMRISADGVKRTGKPGGNDDDRVEARVLRAVEEILRAIPSELNVDAIRDAKSSNLSPLNINLIQETQRYNQLLRSVHEWLRQLDRGIRGLVVMSRDLDELYAAVAENRVPQLFLRAYPSLKSLSAWTSDLVTRIRQLSDWSQLESTQYPATIWLAGFTYPSCFLTSVLQMTARKNFVPID

SEQ ID NO: 229229 - protein, 170 aa, Glycine max
  Coding DNA Sequence Number=SeqID_112451
MERKWESIEASPNKEEGDKPLMGLTKNTNTGIKQEDDGNMAGKANGPASTMKAYSKVHSRTRGCGKQIGHIKVDGPIDEISTKSNRNDQKVVISTSNTCDKYSPVTRGNGLKEVAEWEEQDKRQYAPCALPDIKRNETCNQRKSNIILGHGSRSGSNMRERGGIIDYYDS

SEQ ID NO: 229230 - protein, 251 aa, Glycine max
  Coding DNA Sequence Number=SeqID_112452
  Pfam annotation: Domain name=Robl_LC7; Domain location=156-250; Score= 29.5; E_value=1.2e-05; Accession=PF03259.7; Description=RoadblockLC7 domain
MDSPGRAAFGSPGMEGEMRQLREHQQTREEMLNRVHALKSELQEWRYKMDGQVKNYKGELASLRETLASETTALRKELEETNERLKRQAMTTRDEHHSISQSPGGRESYRVDDEGSVGARASPVRGVGQRLTSLFRDDGRRGRGSSSIVVLNMWMTIDEALKRVRSHADVLGAGVATANGELIRAAGDFDARAARRAVRLVAVAAHAVEDASDEEGCDSPSRSMETVRARRGDRELIVTRCGGVVLAVSTR

SEQ ID NO: 229231 - protein, 147 aa, Glycine max
  Coding DNA Sequence Number=SeqID_112453
  Gene Ontology: Mol. function=RNA-directed DNA polymerase activity; Biological process=RNA-dependent DNA replication
  Homolog annotation: Hit_ID=Q1T4N4; Match level="QueryCoverage=80%, HitCoverage=21%, E-value=1e-12, Identity=30%"; Hit description =Polynucleotidyl transferase, Ribonuclease H fold
MDDIIIYPDRVDNWTWKEDSSGVYTVRNVYTMLIGDYIDKNQDGAFNVLWKVRVPSKVSFFSWRLLRDRPPTTENLRKIHVETNDPMCPFCKSFEEDATFLFFSCKKILPLWWEALSWTNTSKAFSQCPRQHFLHHALGKTFGVWFQ

SEQ ID NO: 229232 - protein, 547 aa, Glycine max
  Coding DNA Sequence Number=SeqID_112454
  Gene Ontology: Mol. function=RNA-directed DNA polymerase activity; Biological process=RNA-dependent DNA replication
  Homolog annotation: Hit_ID=Q1SLB1; Match level="QueryCoverage=50%, HitCoverage=63%, E-value=6e-52, Identity=35%"; Hit description=RNA -directed DNA polymerase
VVNENRNFNTLRDMLVDSAWIDEIGRVKEEICSIFKNIFEEVDWVRPKLDEVRFRAIGHHNNVRLTERISEKEVKEVDAILPPKALASLGIFSRKFLKEASQGASQGSFSKNLFKEVSQESFSRKLSRKFLKEATLAINRSMCNTCASSPSFLSKALSWWRSSFFHGLFPSGWCLLSSLLLCLSLHLDGRKSPLKDLIEAQRSSLHRSPTSKLPSEVVWEYGSDKTPRPDGINFKFIKEFWEAHDPQNLNDFRPISLIRCIYKIVAKVLARRMKEVMPLIIDERQTAFIEGRHLLHNTLIANEDFLLYMLRRMGFCDRWVSWIKGCLNSASISILVNGSPSAEFIPQRGLSQGDPLSPLLFNVVTEGLSGLMREASEKKLFEGFPVGRNEAEISILQYADDTIFFGKASRENVKSIKRWKKYDATFLNCSLLAIPLLYLGIPIGTNPRRTKDTTEVSVGWRIRAKEDCLGKIRVSVPIKGERRVGNQGPKENMVNGGIGMKREGATLNRHGVEQGCDSGRMGERMMQQQSIQQMGGITRARWEWNFQ

SEQ ID NO: 229233 - protein, 289 aa, Glycine max
  Coding DNA Sequence Number=SeqID_112455
  Homolog annotation: Hit_ID=Q01EC1; Match level="QueryCoverage=73%, HitCoverage=80%, E-value=5e-49, Identity=44%"; Hit description=[A] KOG1049 Polyadenylation factor I complex
WMKYYSTRYAHNILTGDFDESPQLYSESVRPEGRSPQHKGSRQNMVPPAPAPPPGAPKQQETRLIYLPDGRMNTYNGQPPNARYNGKGQRILPGGGGGARFIPPDEYKEFLQLGHGGIFDLDLDNIDAIRRARLEQHLQNKIEAYAVDSVDTPVIDSDLPLEVRMAIGSVDSASVQDVPIAPSYGHQPKQHEVPCSTFSSQQIAKVLNSDRPGTTHGHPSGDRVNDLSDQTTVSDKNKVITEFDGLQVKVEALQQEYKSAMESGQMTPEKNFQLQQQMLQLKRRMMKFA

SEQ ID NO: 229234 - protein, 178 aa, Glycine max
  Coding DNA Sequence Number=SeqID_112456
  Gene Ontology: Mol. function=nucleic acid binding; Biological process= DNA integration
  Homolog annotation: Hit_ID=Q1SEJ7; Match level="QueryCoverage=98%, HitCoverage=17%, E-value=3e-48, Identity=47%"; Hit description =Integrase, catalytic region; Zinc finger, CCHC-type; Peptidase aspartic, catalytic
MENLCVRFNDKNYAAWEFKFKMFMKGKGMWGNVNRSSSKPTTMAELAAWETQDAQIISWLLGSIEPLMEYYFGFLNLWVEHSAILYAIVPRTSLVVVQEVYEVTKRDQFLMKLRPEFEVVRVALLNRHPLPSLDVCVGELLREEQHLLTQVALSHDSSISKAIVVAYTARDNGKGRDT

SEQ ID NO: 229235 - protein, 101 aa, Glycine max
  Coding DNA Sequence Number=SeqID_112457
  Gene Ontology: Mol. function=microtubule binding; Cellular component =cortical microtubule, transverse to long axis; Biological process =positive regulation of microtubule polymerization
  Homolog annotation: Hit_ID=Q6ZJ66; Match level="QueryCoverage=59%, HitCoverage=14%, E-value=2e-13, Identity=65%"; Hit description =Putative microtubule-associated protein
MDEQISRAKEKASSRKAIMEKVEKWMLACNEEHWLEEYSRRSSQKLETCRMCPHNGQQNASKHTKLTNNSQNLLLLLSQRTIREEGTSIPIHIFNPPIRQL

SEQ ID NO: 229236 - protein, 295 aa, Glycine max
  Coding DNA Sequence Number=SeqID_112458
  Gene Ontology: Mol. function=nucleic acid binding; Biological process= DNA integration
  Homolog annotation: Hit_ID=Q1SEJ7; Match level="QueryCoverage=83%, HitCoverage=21%, E-value=1e-72, Identity=52%"; Hit description =Integrase, catalytic region; Zinc finger, CCHC-type; Peptidase aspartic, catalytic
  Pfam annotation: Domain name=zf-CCHC; Domain location=2-19; Score =15.2; E_value=0.003; Accession=PF00098.13; Description=Zinc knuckle
MKFCNYCKQHGHIIMDCPTKPPRLQVQAFHVANSMSETPTSIPTNVDALTLEKVQQMVLSALSTLGIQASNHMTGALEHLNNIHTYNGTQNIQIADGNTLSITAVGDITPSFRDVSPRLVSNLILDDVSGKVIATGPKVGRLFPFWFTLPRLLSFNYTGVPNKYEDWHKKSGHPNSVVLSHLLKNGFLINKITIPGSSFNCPVCKLVKSKTLPFPSNAHCADKCFDIIHSDVWGISPILSHAKYKHFMEAQCSTSCEGEFMQKLIHELQCYFGGAETINYERIHIRCTRISLNFA

SEQ ID NO: 229237 - protein, 89 aa, Glycine max
  Coding DNA Sequence Number=SeqID_112459
  Gene Ontology: Cellular component=phragmoplast
  Homolog annotation: Hit_ID=Q6ZJ66; Match level="QueryCoverage=87%, HitCoverage=14%, E-value=5e-08, Identity=41%"; Hit description =Putative microtubule-associated protein
MVINLLSLSSAEVTDPGSLTLEIVQQPTTFYKTEAEVKRLDQLKASKMKELFQKKQEELKLICKKSHVEIPSREEMKNIINLINSGESN

SEQ ID NO: 229238 - protein, 101 aa, Glycine max
  Coding DNA Sequence Number=SeqID_112460
MVAQARAVDIARGDVIIAIVDGSARPWRARLLRAPGVGLWAPHSAVLKHGPRSLTCVRVNGRVNPWVTVPNCAPNLDPTKGVGRLRQQDGGHGSRNPLRSV

SEQ ID NO: 229239 - protein, 146 aa, Glycine max
  Coding DNA Sequence Number=SeqID_112461
IPPTDYREIEATLCIPGRGFILNAEGHPGRILRKDLTTLAQVWSVLSYSNLAPTSHTSNLTVDRARLIFSLVSRMDMNIGALMKGSDSSQLNLNSNVQMHWMLSPEVRLIGESSNDNPAHLHGDSNITSDQVSSVHIGNVVASGVM

SEQ ID NO: 229240 - protein, 365 aa, Glycine max
  Coding DNA Sequence Number=SeqID_112462
  Gene Ontology: Mol. function=DNA binding; Biological process=DNA integration
  Homolog annotation: Hit_ID=Q1SS72; Match level="QueryCoverage=64%, HitCoverage=14%, E-value=3e-27, Identity=32%"; Hit description =Integrase, catalytic region
MCSLQTRWSHRGCLLYQICYPPGHPKYLGQPRLPYKSSSGGGASGGRAVNDVVATLGNEAHTLPHIRDDKQDLNTLKTIGLARLKEGLFHLLIGKDRSPSTNNITTNTINDSKLWHFRLGHLSRNRLNDYVILDVNAKEIVISRDVIFHELILPFHITPINPNQHSPPLPNNSITDLLNKPPSPSIPANTPYVPFETTSLSSPLPNSLSSHVSNPPFNEPFLHSPSTTSPPSSNESPISHQPPSPRRSTHETHPPSYLSDYQYKLPSIKSAQLSSTCSYPIQACLSYARISPSHHHYLMALSSDEEPTSFHEASKHQCWRDAMQCEIEALQSNHTWDVVPTPPYVHLIGCKWVYKIKRLPDGSVE

SEQ ID NO: 229241 - protein, 403 aa, Glycine max
  Coding DNA Sequence Number=SeqID_112463
  Gene Ontology: Mol. function=N-acetyltransferase activity; Biological process=metabolic process
  Homolog annotation: Hit_ID=Q42381; Match level="QueryCoverage=94%, HitCoverage=100%, E-value=3e-99, Identity=47%"; Hit description =Putative N-acetyltransferase hookless1
  Pfam annotation: Domain name=Acetyltransf_1; Domain location=77-165; Score=66.3; E_value=9.6e-17; Accession=PF00583.14; Description =Acetyltransferase (GNAT) family
MSLKIAAEVYPKSPSETGMEPLVLVKEYEEDRHKVAVEKLERLCEVGQSGKPSLVTDLMGDPICRIRHFQLHAMLVAEYGEEGEVVGVIRGCVKTVTRGNSVYVELAYILGLRVSPRHRRFGIGTKLVEHLEEWCKQKGSKYAYMATDCTNEPSVNLFTKKCGYSKFRTLTILVQPVHAHYKPISSNVAVLRLPPRLAGSMYNHMFANSEFYPKDIELILSNKLNLGTFMAIPKKYLSKCDPKRGILPPSYAILSVWNTKDVFKLQVKGVSPWAHACCVGTRLLDEWMPWLRLPSFPDVFRPFGVYFLYGLHMEGKCGAQLMKSLCGFVHNMARDDGGCGAIVAELGQRDPVRDAVPHWRKFSWAEDMWCIKNLEDTKKDIQESDWFTSRSSSPVIFVDPRDF

SEQ ID NO: 229242 - protein, 1132 aa, Glycine max
  Coding DNA Sequence Number=SeqID_112464
  Gene Ontology: Mol. function=nucleic acid binding; Cellular component= nuclear pore; Biological process=DNA integration
  Homolog annotation: Hit_ID=Q1SRN1; Match level="QueryCoverage=70%, HitCoverage=67%, E-value=1e-91, Identity=43%"; Hit description =Integrase, catalytic region
  Pfam annotation: Domain name=rve; Domain location=745-898; Score =69.7; E_value=9.5e-18; Accession=PF00665.16; Description=Integrase core domain
  Pfam annotation: Domain name=zf-CCHC; Domain location=464-481; Score =9.6; E_value=0.026; Accession=PF00098.13; Description=Zinc knuckle
  Pfam module annotation: Pfam domain module=RVT_2::rve::zf-CCHC; Domain location=1053-1132::745-898::464-481
  Subcellular localization annotation: CTP_CleavageSite=33; ConfidenceScore=5.64e-01
MVMAMAISSPSYNLTFLLPRSGSLQPLSLTPPSCSFFAQPLRNLSLKFCAKIQSVGVGREGPASDPKAGVSLYKPKSYEVLVSDAANSLSYALQDGKLRLEIDFPPLPSNISSYKGSSDEFIDANIQLALAVVRKLKEKKETRACIVFPDKPEKRRACQLFKAALDSIDGITIGSLDDVPTGPMTSFFRSVRNTLDFDFEDDNEGRWQSSEPPSLYIFINCSTRELAYIEKYVEKFATSTPTLLFNLELDTLRADLGLPGFPAKDLHYRFLSQFTPVFYIRIREYSKTVAIAPYIVNYSGAVFRQYPGVGGSRPISPDMASIDLVEVRSIALLNATHSYEVWETIHEYFQLQTKVRVHQLCTDLRSVQLDGKSMCKYLSQIKSIADELADIGCTVKHEEYVDVILINLLQEYMPVIAVIEGNFKMPPSWWLWSGGVSERGGASDRGGHRGGAPGHGRGGRFANSQCQICLKFGHTANVCHLRADKSYQPPDSMMYDPTTQQPVNFKSSNTWTNPYKSAAPSAMITDSTSQGASAEADTTWIQDSGALNHVTGAVQNITRFSHFDGPDQIYIGNGQGLQIKGSGSSSFISPFNSQVSFKLNNLLHVPAITKNLLSVSQFAKGNSVYFEFHPRLCLVKSQETREILLQGAVGSNGLYSFPHLRLHNSSVSAVSPCKNKAHVQSVPVHSLATVTSVDVPAPAVLSSSSSTLWHTRLGLPNLHVLKLVLNQCLWGPSHVISFPGCTNLDPRGPLTDLRTCWTTCMNRTKAVSSANDNYLDLELRESSAITLTVFQHFKSMVELQLNHKIKSVQSDGAGEFRPFTSFLASHGITHRLICPHTHHQNGTVERKHRHIVESSLTLLHHASLPPKFWDFAFMTAVYLINRLPSAALNFDIPYLKSVYFLATLSLARVISVFLLLAEFTSPRMLFLMHKVIESPTNSVTHSASQSSHTAATESVSSESSSQSSPQPNVPVASPSSNTGSGQSSAAQSSGSGLSSDAQGSDSGHSSASPNSGSIFNSSAKDIPRIVNDHPMQTRSKSGFPILDFTLLFFWCTVFRVKENADGSINKYKARLVAKGFHQVHGFDFHETFSPVVKPITVRIILTLALTNAWDLFQLDVNNALLNGLLEETVYMV

SEQ ID NO: 229243 - protein, 210 aa, Glycine max
  Coding DNA Sequence Number=SeqID_112465
  Gene Ontology: Mol. function=nucleic acid binding; Cellular component= mitochondrion; Biological process=DNA integration
MCDADWASDVDDRHSTSGSSIFLVPNLISWWSRKQQVTAWSSTEAEYRAIAQTTAELTWVHALLKELHDPFSPPTLLCDNKSAVTIAHNPVFHSRTKHMEIDVFFVREKVLAKLLQIYHIPAFDQWADILTKPLSPSRFEVMLKQADGSYACIAESANRFSLGEAKEELLRVLGLQEEEGSSLEFLRRGYKASTWWEEDFDSEVSSAWRS

SEQ ID NO: 229244 - protein, 129 aa, Glycine max
  Coding DNA Sequence Number=SeqID_112466
MSGGKRAFCVRLFMSESGEKKLSISWYGERKVKRMNISPNTSSNKLFILLNDQGYFTYEKEERDQWKDYVDNPMRLSTLTNKQRTRIKAVVKSLTGSGAGCATSLREGNRCAGALANFACDMKLEFMRL

SEQ ID NO: 229245 - protein, 613 aa, Glycine max
  Coding DNA Sequence Number=SeqID_112467
  Gene Ontology: Mol. function=transferase activity, transferring glycosyl groups; Cellular component=integral to membrane; Biological process=cell wall biogenesis
  Homolog annotation: Hit_ID=Q9SWH5; Match level="QueryCoverage=73%, HitCoverage=81%, E-value=1e-123, Identity=49%"; Hit description =Galactoside 2-alpha-L-fucosyltransferase (EC 2.4.1.69) (Xyloglucan alpha-(1,2)-fucosyltransferase)
  Pfam annotation: Domain name=XG_FTase; Domain location=115-583; Score= 686.5; E_value=1.9e-203; Accession=PF03254.4; Description=Xyloglucan fucosyltransferase
MSNRKYESSYKKLKKKRKVEKLIESQRGALDKFFIIHKNDVKASSIDENVTEQPLIDHTDNEENVIEQPPIDNTDNGVEQPPRDDTDNDENVIEQPPIMENGFALALESTEKMAIEMDIESKFREKRSKIASLTSSKNDSTPAHVNLDDNDKLLGGLLTSGFDEESCISRIQSHLYRKASPHKPSPYLISKLRNYEEIHTRCGPNTRAYHRSMTMIEHSKNKGAATLCKYLIWTPANGLGNQMINLAATFLYAILTDRVLLVEFGKDKHGLFCEPFLNSTWILPRKSPFWNEKHIETYQILLEKDRASNSTEDLPSVLFINLQHTRSDPEKYFHCGHSQDLLQKIPLLTLQSDQYFVPSLFMNPFFNQEVTKMFPEKETVFHHLGRYLFHPSNEAWKLISDYYEAHLAKADKQIGLQIRVFSPVSTPQQAVMDLVLSCTLKHKILPQVDLQTSAGKNQTTVKAVLVASLYREYGDNLKRMYRKNPTLSGEVIKVYQPSHEEHQKYNDNKHNMKAWIDMYLLSLSDELVTTSLSTFGYVAQGLGNLKPWLLYKLVNNETHFPPCERDFSSEPCYHFPPKHYCNGEPLKDIVSSFPYLRPCKDFRVGLKMVKDSI

SEQ ID NO: 229246 - protein, 169 aa, Glycine max
  Coding DNA Sequence Number=SeqID_112468
MNCVDGFAFAPHWMLSFAFGGTIDYPEDADAMNIMSFGYLGCSGETLRIADIDNNDLRVCELVFPGTWHLVHMINLMEHLPTRFCSNYYKRVGEFHPYDEDIVYLHSYVDGIYTANLGTNKVVPISGYDKFDISPFQLELSPIPFKDNDFSSRKTHKNTPSDTSAPQTY

SEQ ID NO: 229247 - protein, 66 aa, Glycine max
  Coding DNA Sequence Number=SeqID_112469
MGIIRSCFSFIAGTVFGIYVAQSYQVPDVKKEADTALLQAKQVEEKYRKSNPGSVMPGVTINNCYC

SEQ ID NO: 229248 - protein, 248 aa, Glycine max
  Coding DNA Sequence Number=SeqID_112470
  Gene Ontology: Mol. function=transferase activity, transferring glycosyl groups; Cellular component=membrane; Biological process =cell wall biogenesis
  Homolog annotation: Hit_ID=Q6Z7Q2; Match level="QueryCoverage=99%, HitCoverage=43%, E-value=7e-56, Identity=44%"; Hit description =Putative galactoside 2-alpha-L-fucosyltransferase
  Pfam annotation: Domain name=XG_FTase; Domain location=1-248; Score =4.4; E_value=4.8e-10; Accession=PF03254.4; Description=Xyloglucan fucosyltransferase
MAATFLYAILTDRVLLVKFDKDKHGLFCEPFLNSTWILPEKSPFWNEKHIETYHILLEKDGASNLKEGLPSVLFINLQHTLSEPEKYFHCDHSQDLLRKVPLMILQSDQYFVPSLFMNPFFNLEVTKMFPEKDTVFHHLGRYLFQPSNEAWELISSYYEAHLAKADERIGLQIRVFNAISTPQETVMDLVLSCTLKHKILTEVELQSSASSARKNQTTVKAVLVASLYREYGDNLRRMYRKNPTVMGK

SEQ ID NO: 229249 - protein, 100 aa, Glycine max
  Coding DNA Sequence Number=SeqID_112471
MDCPLCKLCSMECSICGVNEKSESPADKGTRSGICVDARGIAGVGMGGTGVVEEEGAVVFGVAEVVGTYVLLPLAFLDPLNVTVGSSRFQQFFLIYVKLM

SEQ ID NO: 229250 - protein, 89 aa, Glycine max
  Coding DNA Sequence Number=SeqID_112472
  Subcellular localization annotation: CTP_CleavageSite=68; ConfidenceScore=5.18e-01
MSLMHRWPGQEPSLLLLEGVGPPQPSSLNQSRQQQQQQRGRMSSPLPSPFILMQVYTWLRRRRLPQTRSQSDPQHPHLMMSYHLHPHLS

SEQ ID NO: 229251 - protein, 181 aa, Glycine max
  Coding DNA Sequence Number=SeqID_112473
MDMNIGALISGQISLIAQSNSSRLEFPALITALCKALGVSSDSLTYKSLSPAINLSYIKKNCWNLDDPSVTFLGTRISKARGSEAPSSSAAPAPPTSTPSTSALPLALAAPILPEPALRLAPHYAELAGCRPVMSVEEFLQKDDPATVEGTQQASPVGTPALDLNQEAMDQDPSPPHDQDH

SEQ ID NO: 229252 - protein, 67 aa, Glycine max
  Coding DNA Sequence Number=SeqID_112474
MNPEKVCISAACVLLVCIFVASFQEQSKLWLLALGAKPDLSGYAPLCFFRLSTPCALSLSVILMRLS

SEQ ID NO: 229253 - protein, 150 aa, Glycine max
  Coding DNA Sequence Number=SeqID_112475
KCHRGSSPQRDLGGTPRPKEPAPLLSLTAIKGWSFHREGRIQLRDDEYTDFQEEIARRRSTSLVTPMAKFDPDIVLEFYANGPADGFDEEAIAQLLCIPGQDFARTAAGRRVRIMRTSMTTLTQMWMTLLLSNVLSSDHNSDLPLPKCQL

SEQ ID NO: 229254 - protein, 124 aa, Glycine max
  Coding DNA Sequence Number=SeqID_112476
MKAFKPYQPQKWCIGKLYGSIEESIRLNDKVEETKDGYKEEILNTTRKAQGGGSSGGTGSRGKTGAGGTADVNRRPRQSSAPSEPLFWVSIFNPFNSCMNNDEFCSHTAIYPVSRSCTTVYNRK

SEQ ID NO: 229255 - protein, 385 aa, Glycine max
  Coding DNA Sequence Number=SeqID_112477
  Gene Ontology: Mol. function=transferase activity; Cellular component= nucleus; Biological process=flavonoid biosynthetic process
  Homolog annotation: Hit_ID=Q8GSM7; Match level="QueryCoverage=91%, HitCoverage=82%, E-value=1e-173, Identity=82%"; Hit description =Hydroxycinnamoyl transferase
  Pfam annotation: Domain name=Transferase; Domain location=3-385; Score=260.5; E_value=3.5e-75; Accession=PF02458.6; Description =Transferase family
DKRDDDQREGIDHGAAGGGGGAAGGVELQRGPDDDGRVEIDCDGQGVLFVEADTGAVIDDFGDFAPTLELRQLIPAVDYSQGIASYPLLVLQVTHFKCGGVSLGVGMQHHVADGASGLHFINTWSDVARGLDVSIPPFIDRTILRARDPPRPIFDHIEYKPPPAMKTQQATNASAAVSIFRLTRDQLNTLKAKSKEDGNTISYSSYEMLAGHVWRSVSKARALPDDQETKLYIATDGRSRLQPPTPPGYFGNVIFTTTPIAVAGDLMSKPTWYAASRIHNALLRMDNDYLRSALDYLELQPDLKALVRGAHTFKCPNLGITSWTRLPIHDADFGWGRPIFMGPGGIAYEGLSFIIPSSTNDGSLSVAIALQPDHMKLFKDFLYDI

SEQ ID NO: 229256 - protein, 482 aa, Glycine max
  Coding DNA Sequence Number=SeqID_112478
  Gene Ontology: Mol. function=pepsin A activity; Cellular component =cellulose and pectin-containing cell wall; Biological process =proteolysis
  Homolog annotation: Hit_ID=Q69P39; Match level="QueryCoverage=91%, HitCoverage=93%, E-value=1e-116, Identity=48%"; Hit description =Putative nucleoid DNA-binding protein cnd41, chloroplast
  Pfam annotation: Domain name=Asp; Domain location=132-477; Score= -75.4; E_value=3.7e-09; Accession=PF00026.14; Description=Eukaryotic aspartyl protease
MPMAPPILLPFFLSFLSLCLLINANGVMRSFQEKKIFNVQTLQNKHQLGNQACLLPESRKEKGAIVLEMKDRGHCSEKKIDWNRRLQKQLILDDLRVRSMQNRIRRVASTHNVEASQTQIPLSSGINLQTLNYIVTMGLGSKNMTVIIDTGSDLTWVQCEPCMSCYNQQGPIFKPSTSSSYQSVSCNSSTCQSLQFATGNTGACGSSNPSTCNYVVNYGDGSYTNGELGVEALSFGGVSVSDFVFGCGRNNKGLFGGVSGLMGLGRSYLSLVSQTNATFGGVFSYCLPTTEAGSSGSLVMGNESSVFKNANPITYTRMLSNPQLSNFYILNLTGIDVGGVALKAPLSFGNGGILIDSGTVITRLPSSVYKALKAEFLKKFTGFPSAPGFSILDTCFNLTGYDEVSIPTISLRFEGNAQLNVDATGTFYVVKEDASQVCLALASLSDAYDTAIIGNYQQRNQRVIYDTKQSKVGFAEEPCSFA

SEQ ID NO: 229257 - protein, 373 aa, Glycine max
  Coding DNA Sequence Number=SeqID_112479
  Gene Ontology: Mol. function=ubiquitin thiolesterase activity; Cellular component=intracellular; Biological process=ubiquitin -dependent protein catabolic process
  Homolog annotation: Hit_ID=Q1RWR6; Match level="QueryCoverage=93%, HitCoverage=68%, E-value=8e-63, Identity=42%"; Hit description =Pentaxin
MGSRIPSHKLSNGLYVSGRPEQPKERTPTMTSTAVPYTGGDIKKSGELGKMFDIPVDGSKSRKSGPITGAPSRTGSFGGAGSHSGPIQPNAAARAAYTTSGPMTSGGMAGSTSMKKSNSGPLNKHGEPVKKSSGPQSGGVTPVGRQNSGPLAPVLPTTGLITSGPISSGPLNSSGAPRKVSGPLEATGSMKLQGSAAVHNQAVTVLSQGDDSFRRNFPKAVLWLLILLFVMGFIAGGFILGAVHNAILLIVVVVLFGLVAASFTWNTYWGRRSIMGFVAHYPDSELRTAKNGQFVKVSGVVTCGNVPLESSFQKVPRCVYTSTSLYEYRGWNSKAANPTHRRLTWGLRLLEILFTKQRMYSDGCSTLKPVTMY

SEQ ID NO: 229258 - protein, 153 aa, Glycine max
  Coding DNA Sequence Number=SeqID_112480
  Gene Ontology: Mol. function=transcription factor activity; Cellular component=nucleus; Biological process=regulation of transcription, DNA-dependent
  Homolog annotation: Hit_ID=Q1T072; Match level="QueryCoverage=76%, HitCoverage=33%, E-value=9e-49, Identity=77%"; Hit description =Pathogenesis-related transcriptional factor and ERF
  Pfam annotation: Domain name=AP2; Domain location=35-105; Score =123.2; E_value=7.4e-34; Accession=PF00847.10; Description=AP2 domain
  Subcellular localization annotation: CTP_CleavageSite=19; ConfidenceScore=5.33e-01
MAKKSQKSLKNNNNNNTTRKRTRKSVPRDSPPQRSSIYRGVTRHRWTGRYEAHLWDKNCWNESQSKKGRQGAYDDEEAAARAYDLAALKYWGQDTILNFPLSNYEEKLKEMEGQSKEEYIGSLRRKSSGFSRGVSKYRGVARYLNPALFTAKC

SEQ ID NO: 229259 - protein, 216 aa, Glycine max
  Coding DNA Sequence Number=SeqID_112481
MIYISLFLKKILLNIIKIFMIYNPGWRNHPNLRWSSPQQQQQQPAPSFQNAAGPSRPYIPPPVQQQQQPQKQPTVEAPPQPSLEELVRQMTMQNMQFQQETRASIQSLTNQMGQLATQLNQQQSQNSDKLPSQAVQNPKNVSAISLRLGKQCQGPQPVAPSSSANEPAKLHSTPEKGNSDLQKQHIPPLPFPPRAVSNKKMEEAEKEILETFRKVE

SEQ ID NO: 229260 - protein, 54 aa, Glycine max
  Coding DNA Sequence Number=SeqID_112482
MALGVRLFEPTQAALSVCSGLGKGNNNVWRIVTASLSYLDWFLPLTLSRPLTVA

SEQ ID NO: 229261 - protein, 515 aa, Glycine max
  Coding DNA Sequence Number=SeqID_112483
  Homolog annotation: Hit_ID=Q6ZK44; Match level="QueryCoverage=67%, HitCoverage=80%, E-value=1e-101, Identity=52%"; Hit description =Kelch repeat-containing protein-like
  Pfam annotation: Domain name=Kelch_1; Domain location=264-312; Score =25.9; E_value=0.00014; Accession=PF01344.15; Description=Kelch motif
  Pfam annotation: Domain name=Kelch_1; Domain location=407-468; Score =22.2; E_value=0.0019; Accession=PF01344.15; Description=Kelch motif
  Pfam annotation: Domain name=Kelch_2; Domain location=262-312; Score =9.4; E_value=2.2; Accession=PF07646.5; Description=Kelch motif
  Pfam annotation: Domain name=Kelch_2; Domain location=351-405; Score =19.6; E_value=0.011; Accession=PF07646.5; Description=Kelch motif
  Pfam annotation: Domain name=Kelch_2; Domain location=406-468; Score =9.3; E_value=2.3; Accession=PF07646.5; Description=Kelch motif
  Pfam annotation: Domain name=SSXT; Domain location=2-61; Score=12.2; E_value=7.7e-05; Accession=PF05030.3; Description=SSXT protein (N -terminal region)
  Pfam module annotation: Pfam domain module=Kelch_1::Kelch_1::Kelch _2::Kelch_2::Kelch_2::SSXT; Domain location=264-312::407-468::262 -312::351-405::406-468::2-61
MACYDTLQYLDENKKLIVAIMENMKLGKIDKCAEYQEKIQQNLMYLATIADLQHSQTLIMPPQMIPPPSRMQPEYYMQHPQGVAMVQQQGIFPPNMQLQFGNPQQQLHQHAIQGQITRIGNGTYPMHSENVLEGGHSGGSTSTASPNNACGGSMQGTSEDGDGFALVADFLWASTSSTLPTSTKPSAFVVPSNHNKKKYENATASGRFLAAAYADLDAPQLKWQKMAPAPVPRLDGAAIQIRDLLFVFAGYGTIDFIRHAERDGALAFGMVTDGRYIYVVTGQYGPQCRGPTAHNFVLDTQTRKWRDLPPLPVPSIKHKQQIQREGEGSGQTHLFPPSFLDAGFTLCLCCFWMLTVFGSKKIMGRLHVMGGSKENRHTPGLEHWSLAVKDGKALENEWRSEIPIPRGGPHRACVVVDDRLYVLGGQEGDFMAKPGSPIFKCSRRQEVVYTDVYMLDDDMKWKTLPPMPKANSHIEFAWALVNNSIVIVGGTTEKHPITKKMVLNGEVVQFNLNTL

SEQ ID NO: 229262 - protein, 177 aa, Glycine max
  Coding DNA Sequence Number=SeqID_112484
  Gene Ontology: Mol. function=FMN binding
  Homolog annotation: Hit_ID=Q01TW9; Match level="QueryCoverage=76%, HitCoverage=49%, E-value=3e-09, Identity=27%"; Hit description =Pyridoxamine 5'-phosphate oxidase-related, FMN-binding
MSIHFQKINSKCALVCTFNCSYRDTSELEEWAHKQYIAKHQQGPSQQWGNFYYFRMQNISDIYFIGGFGTVAWVDVKEYETLQPDKIAVDGGEQYLKELNAIFSKPLKKLLSSETEVDDAALISIDSKGTDIRVRQGAQFNIQRISFDEGQSVETLEEAKAALRKLIHKGKVYNLQK

SEQ ID NO: 229263 - protein, 202 aa, Glycine max
  Coding DNA Sequence Number=SeqID_112485
  Subcellular localization annotation: CTP_CleavageSite=71; ConfidenceScore=5.55e-01
MEALSFIIPKDSCSLLLRTPSSYSSSSVRTPPPPLAFFKTTQHSHSPHLLRLRVFALPNPDADEPTNDFALASHPQENLSHSETESSEDDQDAPPQMDMSWSTITAPAGSGSGGGTRAGLFRTPISGGVQSATSAHGLPRPALAVRNLMEQARFAHLCTVMSRMHHRREGYPFGSLVDFAPDSTGHDFNLVLILAEKRVRIW

SEQ ID NO: 229264 - protein, 285 aa, Glycine max
  Coding DNA Sequence Number=SeqID_112486
  Gene Ontology: Mol. function=acetylglucosaminyltransferase activity; Cellular component=membrane; Biological process=electron transport
  Homolog annotation: Hit_ID=Q5BM96; Match level="QueryCoverage=98%, HitCoverage=79%, E-value=8e-72, Identity=45%"; Hit description =Secondary cell wall-related glycosyltransferase family 14
  Pfam annotation: Domain name=Branch; Domain location=1-193; Score =81.5; E_value=2.6e-21; Accession=PF02485.11; Description=Core-2I -Branching enzyme
MLRLLKALYHPRNQYLLQLDDRSSESERMDLAISVKSIKVFEEYGNVNVIGKSYAINRMGSSALSAPLHAAALLLKLNPDWEWFITLTASDYPLMTQDDILHAFTFLPRYANFIHYTNKTVRNKQRDINQIVVDQGLHYEKNSPLFFAVESRDTPDAFKLFRAMWLILWDTDPSESQLLDMSHYDTMLETGAAFARPFGEGDVVLEKIDDLILNRSSNGLVQGEWCSNSEINKTTKASEAEEEFCSQSSNVDAVKPGPFGIKLKTLQAEIVNSRKFRTSQCKSFE

SEQ ID NO: 229265 - protein, 70 aa, Glycine max
  Coding DNA Sequence Number=SeqID_112487
MNTQTTSPVIKEEEEKEEGTKEVVQEEEEASHPYAFHVSGPRNLANLNWRDLISSSWWFLIEGSIVKWKM

SEQ ID NO: 229266 - protein, 60 aa, Glycine max
  Coding DNA Sequence Number=SeqID_112488
MFVFNNSLKGLDDTPQPKSKAGARWIVVKYFNDVRPLKSERLKALRIQWVKYYLKVRSET

SEQ ID NO: 229267 - protein, 54 aa, Glycine max
  Coding DNA Sequence Number=SeqID_112489
MKVVAKLASSPSNQPHDVEELPGSNFKVREQISLHQGVAVCQQGHWSQETREDI

SEQ ID NO: 229268 - protein, 152 aa, Glycine max
  Coding DNA Sequence Number=SeqID_112490
MKDIPSSSTLAPPSVTVGQEVQGSQTLVPMLQSLFRGQFIIMHNLQELAHNRPIITMEHFLEQVAWPEAQLPLVDPEPTNPQSLVVNPLSSLEREVVPPSPPLIIISDASSDEAAAPPDSPKGETADLPTSLVGGISDSSSGEAFTLTDSPV

SEQ ID NO: 229269 - protein, 200 aa, Glycine max
  Coding DNA Sequence Number=SeqID_112491
  Homolog annotation: Hit_ID=Q47522; Match level="QueryCoverage=14%, HitCoverage=35%, E-value=3e-10, Identity=100%"; Hit description=LacZ protein
  Pfam annotation: Domain name=Lectin_legB; Domain location=33-194; Score=-72.0; E_value=1.6e-05; Accession=PF00139.10; Description =Legume lectin domain
MSPSNSPVAAETLFSGTVFLILLHLSLFLTPTLSLDFLFNSFAGVTNLTLIKDARVDASVIRMNNDSNQYSYGRAFYPIKIPMTKTNSSISSFSTSFVFSILPQISNSCSPGDPLVLERPPPRWSSNSPYTHPPFASWRNSEEARTDRPSQQLRSLNGEWDAPCSGALSAAGVVVTRSVTATLASADVRRCFCRYAPPRQ

SEQ ID NO: 229270 - protein, 131 aa, Glycine max
  Coding DNA Sequence Number=SeqID_112492
MTEASTRASLMRVRLVTPAKELNRKSRESVGVRKRERWRRIRNTVPENSVSAATGELEGDIGVGGIEELSLSPSSLKARPRGARYQLLFPLVRVNFELGVIMRKCILAYYVGTDEGVSEVLHVAGEKRLAP

SEQ ID NO: 229271 - protein, 138 aa, Glycine max
  Coding DNA Sequence Number=SeqID_112493
MARSVFALCPYLGTYGIISRGLLITNFPTIYNSHGRSLEVSSLKIIILWRPNSQNQSPVESPTVATCPFAGERGRGSRVRFPKEERCAESPPTFIYGKHRKNRRKPVKMKILSSGVVFTLEEGISTSYVCLKGQQPIF

SEQ ID NO: 229272 - protein, 193 aa, Glycine max
  Coding DNA Sequence Number=SeqID_112494
  Gene Ontology: Mol. function=chitin binding; Cellular component =extracellular region; Biological process=chitin metabolic process
  Homolog annotation: Hit_ID=UPI00006A17C9; Match level="QueryCoverage =49%, HitCoverage=100%, E-value=2e-12, Identity=35%"; Hit description= UPI00006A17C9 related cluster
GLHVLTFRGLHALAFRGLHVLVFEGLLALAFIGLHVPTIRGLHALTFKGLHVFAIRGLHALTFRGLHVLTFRGLHVLTVRGLHILTFRGLHALAFRGLHVSSSDSLPLRDRTHKTLSGPGGVQQGPRVSSSGYGPLSVLQGARSPQQGIAPARHPVESKKSNKVLGFLALITGLCQFYGVLVVPNKVIRPPIN

SEQ ID NO: 229273 - protein, 244 aa, Glycine max
  Coding DNA Sequence Number=SeqID_112495
SIDVAIVKEFYANLYVPKDKEPKHVRVRGHLIKFDADSLNTFLKTPVVLEQGESLPSYSRFYRLRPDPQELAARLCILGRGFVLNIEGLPWKLLSKDLTTLAQTWSVLSYSNLALTSHTSDLNLDRARSRSLLSPTPRGLDFQPSSLPCARPEESPQILSIMNHSAQPLIWLKLRRIVGTWMALRSLFQGPKNPGLEDLRPHLLQLPLLLLSLQLQQPQFFQVPPLRAQSLSCLCCRACTRASS

SEQ ID NO: 229274 - protein, 129 aa, Glycine max
  Coding DNA Sequence Number=SeqID_112496
MSIEESIHVSFDESNAILSRKDILDDIAESLEQMNIHGQDSKGKGKGSNEDPPEEAKSNDELPKEWKASKDHPLDNIIGDISKVLVGLGSSSSMDSFASWKMNGSGMEKEEREETPLQGEDDSRRSSPP

SEQ ID NO: 229275 - protein, 103 aa, Glycine max
  Coding DNA Sequence Number=SeqID_112497
  Homolog annotation: Hit_ID=UPI0000612705; Match level="QueryCoverage =95%, HitCoverage=42%, E-value=8e-08, Identity=29%"; Hit description =UPI0000612705 related cluster
  Subcellular localization annotation: CTP_CleavageSite=55; ConfidenceScore=5.66e-01
MVFSPLKARTCSPLKAWTSSSLKARGCTRLKARTWTPLKARVCSPLIARTCSPPKGRTGSPLKAWICSPLKARICFPLQVRTSSPLKARTWSPLMARTCSPLR

SEQ ID NO: 229276 - protein, 145 aa, Glycine max
  Coding DNA Sequence Number=SeqID_112498
  Gene Ontology: Mol. function=nucleic acid binding; Biological process= DNA integration
MALVADFDLELHQMDVKTTFLNGDLDETIYMQQPKVITSMGFEENKVDQYIYLKANGSKFFFHVLYVNDILLASNDLGMLHDSKQMLMRSFDMKDLAPLELVGLGSSSSMDSFTSWKMNGSGMEKEEREEMPLQGKDESRRSSPP

SEQ ID NO: 229277 - protein, 150 aa, Glycine max
  Coding DNA Sequence Number=SeqID_112499
  Homolog annotation: Hit_ID=Q1RYI2; Match level="QueryCoverage=47%, HitCoverage=11%, E-value=2e-12, Identity=43%"; Hit description =Ribonuclease H
MDKLGYQRTTNLGKYLGVPLHHERASEHSYKFLLDKVTGRLPTYPWREGKDDLWARVIRAKYKCGDDVLSVIDSKRNGTNLWKGIVKTSGTVKSNLIWLMRNGRRIRFMEDCWVLSQGTLSQYKPLVLGKVEMFQFSFLLITIGNETLPN

SEQ ID NO: 229278 - protein, 78 aa, Glycine max
  Coding DNA Sequence Number=SeqID_112500
MNVGKHIKYEVATSKVINLDFDSFLEENPLVKKQKMYKNKRNERMSYATNQVDVELNNPARAAAILVYRISTKHQTCT

SEQ ID NO: 229279 - protein, 376 aa, Glycine max
  Coding DNA Sequence Number=SeqID_112501
  Gene Ontology: Mol. function=zinc ion binding
MMPSQRSISEVQGMQIDIADDSGIRPKTILELISKQVGGKDVIGFTQQAQKNYLRNKIKRELAYGGSWHLGNMMKDSSFFLKDFKACMFDSDDESKFEEAWYILLRKYNVETSTWLEGIYKMKEKWASCYMKDAYSIRMQSTQLSESFNASVKDYVRSSLDIMQIFKHFERAVDGKQYNELEAEYNSRKKLHRLRIEHLPLLKQKLPDQYTIKRWRRDARDIVVQDATARASDFEETYLYIDHVADKLHEKIDSYYKLPEDELKTLKENIIESIEQSHSLERVIENVKGLKKKETQKGRKRLRSRVEKQPKRKTNASRSKKGLNKPVKNVEVSKSMACMGPEEHTFNSSNNFQQEKTPASQLSNANSENKVCEKEI

SEQ ID NO: 229280 - protein, 470 aa, Glycine max
  Coding DNA Sequence Number=SeqID_112502
  Gene Ontology: Mol. function=nucleic acid binding; Cellular component= beta-galactosidase complex; Biological process=DNA integration
  Homolog annotation: Hit_ID=Q1T693; Match level="QueryCoverage=75%, HitCoverage=26%, E-value=1e-114, Identity=55%"; Hit description =Integrase, catalytic region; Zinc finger, CCHC-type; Peptidase aspartic, catalytic
MDEEIAAIERNNTWELTSLPKGHKTIGVKWVYKTKLKKNGDVDKFKARLVAKGYKQEFGVDYKEVFAPVARHDIVRLVIALATQHSWPIFQLDVKSAFLHGDLEEQVFIEQPPGYINFGNEHKVYRLKRALYGLKQAPRTWYSRLEAYFLKEGFQKGPYEHTLFIKISNYGKILIVCVYVDDLIFTRSDAAMFDKFKKSMMIEFDMIDLGMLHYFLGIEVMQSTAGTFISQKKYVLEILDRFQMKNCNSVSTPTKVGLKLVRDLEGRKIDNTLYKQIVGSLMYLTATRPDITHVVSLISRYMECPREMHLLATKKNFLILARDYWLWDVFKKGEKIDLIGFTDSDYAGDQDYRKSTSEVKIKLLIYLLNLSKLLYFRSYENCLDYDFFTLPSKVQPGCTLGEPDPIQKWLCAKIRENSKLASDPQLAQYPQKVKNIAQQFTWFEPDHVPSEENDRADILSRLGSSSKPGN

SEQ ID NO: 229281 - protein, 214 aa, Glycine max
  Coding DNA Sequence Number=SeqID_112503
  Gene Ontology: Mol. function=nucleic acid binding; Biological process= DNA integration
  Homolog annotation: Hit_ID=Q1S9A7; Match level="QueryCoverage=86%, HitCoverage=89%, E-value=4e-36, Identity=37%"; Hit description =Peptidase S8 and S53, subtilisin, kexin, sedolisin; Zinc finger, CCHC- type
  Pfam annotation: Domain name=zf-CCHC; Domain location=88-105; Score =11.3; E_value=0.014; Accession=PF00098.13; Description=Zinc knuckle
MAIVNKMRIHGDKKEDITVVEKILWSMTPKFNFVVCSTKEAHDIEELSIDELKKHQQHHENQFHRRGRAQGGHHFIAHIPKSADKSDVECYRFHRYGHYQSECRTNLNKDNGEKTNFAEKEEEVSLLMMCHVKEETQQNMWYLDTGCSNHMCGDKMMFSNLDETFCNTVKFSDNSTIFVLGKGMVTLQTKENSSHTISNVLFVPNLKTNLLSVG

SEQ ID NO: 229282 - protein, 112 aa, Glycine max
  Coding DNA Sequence Number=SeqID_112504
  Subcellular localization annotation: CTP_CleavageSite=62; ConfidenceScore=5.26e-01
MEQTPRGSWSWLVVLAASKLLSSLSLTQAASCQASLELVVFVGGTRGFQQNQTTTALRLRVACRLKWHGGGGDGLNGDNGIDAKNDSGATENTKRWRRKKLGLRCCMNTARE

SEQ ID NO: 229283 - protein, 303 aa, Glycine max
  Coding DNA Sequence Number=SeqID_112505
MAPKKLSAKRSRRAPRLKGPVPPPSLIRLEAIKGWSFHRERCVQLRDDEYTDFQEEIARRHWIPFDADALSQFLGDPLVLEEGQECEFSQRRNRADRFDEEAIVQLLCTPGQDFARTAAGWRVRIMHTSLTTLTQMWMMLLLSNVLPSDQNSDLPLPKCMPPTRHPLDPDKSNRALGFPTLITGLCQSFGIPVTPSKVIRPPITRAFIEKYCTPRQAQSDAPQDADAPPYQADPAGLSQQGQGFAPFACPTLEQFRVEVAWPGDWPEAQAGEAPAGSPGDVEEARMDEEITDLLSFLGGSRAT

SEQ ID NO: 229284 - protein, 189 aa, Glycine max
  Coding DNA Sequence Number=SeqID_112506
MAPSKPGIMRLLEDKARRDVAEVVAAKVVAAAANDTTGGSVTPTNNLVEKENDDSQRRNVLRHDVRKNDLINLGESQDHPGSTKSDLQSPVDANAEANRLTVIDVATKDKARELYHERKQLEKNKFALVKDLERLDKSEIEKLRKSKNEALEEINVLTARLESLDIEIKKIKVKVTNEKTKFAAPLLVR

SEQ ID NO: 229285 - protein, 216 aa, Glycine max
  Coding DNA Sequence Number=SeqID_112507
  Homolog annotation: Hit_ID=Q6AUZ9; Match level="QueryCoverage=41%, HitCoverage=8%, E-value=9e-13, Identity=44%"; Hit description =Putative pentatricopeptide repeat-containing protein
  Pfam annotation: Domain name=PPR; Domain location=11-45; Score=18.3; E_value=0.028; Accession=PF01535.11; Description=PPR repeat
  Pfam annotation: Domain name=PPR; Domain location=46-80; Score=19.5; E_value=0.012; Accession=PF01535.11; Description=PPR repeat
  Pfam module annotation: Pfam domain module=PPR::PPR; Domain location =11-45::46-80
MKTLGINSHNVVVSLIVRGLANSKKIDNAIWVLDLMLEMQIIPIVDTFTTLMHVYYKEAYVTKALELKSIMEDCHVKLGVVAYNVLISSLYTNNKIDSLYPNWKVVLEALKNLIWDDIVGTFDIPEVSNAKKKKNMMEDKRKKKQEESIESGGSTIVDPLSPIERHVKWKMTRTKHFGNMTSVEAQQISDRIATTAIGQPEHSGRVCAVGLGVTIS

SEQ ID NO: 229286 - protein, 97 aa, Glycine max
  Coding DNA Sequence Number=SeqID_112508
MSIHVGLKSLRGRRWCWQGMISKGFNSSMVPTLISMAPPPHQHRREMPTTNANDCADNKGGGGGMGCGSGGDNRGGEFGVEELAEGHLASPRETSLL

SEQ ID NO: 229287 - protein, 162 aa, Glycine max
  Coding DNA Sequence Number=SeqID_112509
MDPFNYPYSHSREVHPNEEVDASGCYGTRELVFQEFLIRQTIGPNPKNLIFELRPTTRKVICYKGNALLIEDEDAPPTRYVKARSGRLFKHELEALKHKIELTSLDWFSMKRFYKHKDHCSGLEPNEKPPTNIVHPDIKLAELLKTREAIAQALEDHVHAKK

SEQ ID NO: 229288 - protein, 83 aa, Glycine max
  Coding DNA Sequence Number=SeqID_112510
MSIMVAFLALFLRTSITNNILVVEMEELEKVWVQMKVRVVGMSFLFVGSLGLGYSFKFGCPLDGAIPDKLTPTCLMIWVKSIP

SEQ ID NO: 229289 - protein, 178 aa, Glycine max
  Coding DNA Sequence Number=SeqID_112511
  Gene Ontology: Mol. function=chitin binding; Cellular component =extracellular region; Biological process=chitin metabolic process
  Homolog annotation: Hit_ID=UPI00006A17C9; Match level="QueryCoverage =87%, HitCoverage=100%, E-value=7e-18, Identity=40%"; Hit description= UPI00006A17C9 related cluster
MRGTVHEPQVNIGADQKFSPVDVFKQEKEKGGQTLGLHVLANRGLHALTFRELHVLALRGLHVLTIRGLHALTSRGLHVLALRGLHALILGLHVLALRGLHVLTIRGLHALTSRGLHVLALRGLHALTLGTSYPHRQRTTRSRLERTTRPHHQRAARPYLQRTTCPRLERATRPHLGY

SEQ ID NO: 229290 - protein, 138 aa, Glycine max
  Coding DNA Sequence Number=SeqID_112512
MTCGDKLRSFARSMGGKRAETDSAPFIIQEQRVKWNNKLGGKRAETDSAPFIIQEQQAEWINAHRRILRPLSFRNNKLGGKRTETDSAPFIIQEQQAEWINAHRRIMCPLSFRNNKLGGKRAETNSAPFIIQEQRVGW

SEQ ID NO: 229291 - protein, 207 aa, Glycine max
  Coding DNA Sequence Number=SeqID_112513
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=4e-24, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHVLAFRGSCTFTFRGLHALTFRGLHVLTFRGLHVLAIRGLHALTFRGLHVLAFRGSCTFTFRGLHALAFKGLHALIFSGLPVLSFKGLHALIFKGLHALTFRGLHALTVRGLDVLALRGLHILAFGGLHALVFRGLYVLPLRGLHVLVFGGLHALAFRGLHVPLFRRLHALAFRGRHVLAFGGLRSPSPFGGYASSLLVGSISTP

SEQ ID NO: 229292 - protein, 68 aa, Glycine max
  Coding DNA Sequence Number=SeqID_112514
MALLLSNILPNNRNVDLPLRKYQLGSRPQDTQWTGEVQQGPGVSNFGYGPLSVLQDARTPRQCHAIAT

SEQ ID NO: 229293 - protein, 64 aa, Glycine max
  Coding DNA Sequence Number=SeqID_112515
KKKKNIWRKKKKKKDARQVVIVTCKATVDNRETRGFIYWPRQVVIVKATKDGAIIKPQGQVTGS

SEQ ID NO: 229294 - protein, 146 aa, Glycine max
  Coding DNA Sequence Number=SeqID_112516
MNERIVIIKNGEIVEAITSKIILIMPKNQGLSKFQRIRLQESSLKELRFKIYPLNLMDSCLFLMGILSFGLSGLTLLLDSKLARGLRWVVSPMRGMPCNQTISTENLAAKDWAKPELVAEVDEVTLVILLGTLKIKGSLPYELRVP

SEQ ID NO: 229295 - protein, 406 aa, Glycine max
  Coding DNA Sequence Number=SeqID_112517
  Gene Ontology: Mol. function=oxidoreductase activity; Cellular component=membrane; Biological process=electron transport
  Homolog annotation: Hit_ID=Q1S4Y7; Match level="QueryCoverage=99%, HitCoverage=75%, E-value=1e-151, Identity=66%"; Hit description =Berberine and berberine like, putative
  Pfam annotation: Domain name=BBE; Domain location=345-402; Score =89.9; E_value=7.9e-24; Accession=PF08031.2; Description=Berberine and berberine like
  Pfam annotation: Domain name=FAD_binding_4; Domain location=1-92; Score=-9.2; E_value=0.011; Accession=PF01565.13; Description=FAD binding domain
  Pfam module annotation: Pfam domain module=BBE::FAD_binding_4; Domain location=345-402::1-92
MLDMFNLRNITVDAQNKVAVVQAGATLGELYYRIWEKSDVLGFPAGVCHTVGVGGHFSGGGYGNMMRKYGLSIDHISDAQIVDVKGRILNKESMGEDLFWAIRGGGGASFGVILSYTIKLVPVPEVVTVFQVEKTLEQNATDLVVQWQQVAPYTDERLFMRLQLHPMISNVGERHKTVRAAVMTMFLGGAEELVSLLDKKFPTLGLKKENCIEMSWIESVVWWDSFPNGAHPEALLGRNLNSAKFLKRKSDYVKDPISKDGLEWIWKRMIELGQTGMAFNPYGGRMNEISANATAFPHRAGNLFKIEYSANWEEPGGSAEKNFTTQIRRLHSYMTPFVSKNPRRAFLNYRDLDIGINHHDNNSYQEGEVYGFKYFDDNFYRLAKIKTEVDPGNYFRNEQSIPTLKL

SEQ ID NO: 229296 - protein, 133 aa, Glycine max
  Coding DNA Sequence Number=SeqID_112518
  Gene Ontology: Mol. function=transferase activity
  Homolog annotation: Hit_ID=Q69KD5; Match level="QueryCoverage=84%, HitCoverage=27%, E-value=2e-12, Identity=33%"; Hit description =Ribosomal protein-like
MQLVEKDFSPLQKCTTTIHILAYRSLVDSVNEYVRITECTGIQCLEAFVRDVNEILWDIYLGRPNNNDINRLLQIRETYGLTDDVYPDLDTLVKTIPMSQGEKKIYSQNVKKGCEENIWCAKISIYSYMLSIA

SEQ ID NO: 229297 - protein, 111 aa, Glycine max
  Coding DNA Sequence Number=SeqID_112519
MTLFEMETEYYGFAMVARKCQPVAFALCTTAKPGAFHWNRPWDSVLLLEAMNLLEGAELSGGYWFIGNMLLAYCFPSCSTTLSPFSTSLLFSFCILAPSVFIAAPLASASI

SEQ ID NO: 229298 - protein, 177 aa, Glycine max
  Coding DNA Sequence Number=SeqID_112520
MVQGMVAQVQDMEAQSAWEVEPIMMRDLVAWVWGMETESAWVAESTWMAESTWVIGFVALAPGMKAQSTWKAEATVVTARRKKIGSGGWLTGLAVLEKWHPVWIPWKLGSRRSGVELQQVWPWRPRGGPPFEMCVEMEGMSLTEVVADGGNQNNTQGKGRSIGTLFQNMKVAAVLSR

SEQ ID NO: 229299 - protein, 381 aa, Glycine max
  Coding DNA Sequence Number=SeqID_112521
  Gene Ontology: Mol. function=nucleic acid binding; Cellular component= chromatin; Biological process=DNA integration
  Homolog annotation: Hit_ID=Q1SKN5; Match level="QueryCoverage=60%, HitCoverage=22%, E-value=4e-41, Identity=38%"; Hit description =Integrase, catalytic region; Zinc finger, CCHC-type; Peptidase aspartic, catalytic
MSRHVIFIEDQFPFSQSNPQPSPHNSWLPLPNIIPPLAETASPNSMAPNPQIASPHHSPISLQISPNITLSNHSTSTSHNSTVTPPLNSNNSHTPNQHTSITHQSPSTTQTSNQPTPEPHHPPSNTTSPNPLPMPPPVDYTSTSTSVPSRPVARSMNDIHKPNKKFLLVTKHPIPPSHEPTLSHKQWLPWSGVHAAMASKFNALIQQGTWDLVPKNKASNLIGCKWMFRLLKTVYMQQPPGFHNPDYPYHVCRLKKSLYGLKQAPQAWFNTLYSFLLSYGFINSKSDPSLFIYLKGNNDQAIHRCISTLATVFSIKDLGYIHLFLRVEAIPTTQGLFLSQHKYIHDLLGHTQMADAKVVDSPMSTSSQLTQYDGTSAVDAT

SEQ ID NO: 229300 - protein, 559 aa, Glycine max
  Coding DNA Sequence Number=SeqID_112522
  Gene Ontology: Mol. function=protein serine/threonine kinase activity; Cellular component=integral to membrane; Biological process=protein amino acid phosphorylation
  Homolog annotation: Hit_ID=A0F0B1; Match level="QueryCoverage=46%, HitCoverage=63%, E-value=1e-104, Identity=68%"; Hit description=Cold- induced wall associated kinase
  Pfam annotation: Domain name=Pkinase; Domain location=293-530; Score =65.3; E_value=2e-16; Accession=PF00069.15; Description=Protein kinase domain
  Pfam annotation: Domain name=Pkinase_Tyr; Domain location=293-530; Score=26.0; E_value=4.6e-14; Accession=PF07714.7; Description =Protein tyrosine kinase
  Pfam module annotation: Pfam domain module=Pkinase::Pkinase_Tyr; Domain location=293-530::293-530
MCTISESGYNICTNQKETIARFGCDSKCGNVSIPYPFGMRKPKCYASEPFEIECRHNKNGSQGEKLIAPYLKYINLEVMYIDLEYGTVGIKNPIFHPGCDNTSTGINLEGGPFVYSQDYNSFVTVGCQNAALLLSNDTILTACVSVCYDDPKNANMMDVSSCRGKYCCETSLPPYLQAYNVSVGTVEVKSEIKPECGYGLIKADYFQFNYVYDEYNSSYWVPTLGNLKKVKDVPAVLQWEIPIHMPNNSFPEFRTDADSYANYNCSYTNVTSAQSKSGWRCTCKYGFKGNPYLDQGCKLGQGTVYKGMLVDGNIVAVKKFKVNGKTEIPLLVYEFIPNGNLFEYIHGQNEDLPMTWEMRLRISIEVAGALFYLHSAASQPIYHRDIKSRNILLDGKYRAKVADFGASRMVSIEATHLTTTVQGTFGYLDPEYFRTSQLTDKSDVYSFGVVLIELLTGKEPISSAKQQELKSLVSYFLLSMEENRLFDIVDERVMKEAEKEHIVVVANLARRCLELNGKRRPTMKEVALELESIQKSKKQSAAQEQHEELELPGIDDFQL

SEQ ID NO: 229301 - protein, 179 aa, Glycine max
  Coding DNA Sequence Number=SeqID_112523
  Gene Ontology: Mol. function=protein serine/threonine kinase activity; Cellular component=membrane; Biological process=protein amino acid phosphorylation
  Homolog annotation: Hit_ID=Q1S4Z2; Match level="QueryCoverage=76%, HitCoverage=30%, E-value=1e-28, Identity=68%"; Hit description =Protein tyrosine kinase, putative
MSSGEVNVDKATLFSLKDLEKATDHFNLNIIIGKGGQGIAGALFYLHSVASQPIYHRDIKSTNILLDENVWRRIICLTLLTKRVVKEAEKGQIIAVANLANRCLELNGKKRPTMKEVTFELERIKRLVKSNAEQNHEEIELGRIEDCQPWVAYSTSNSLPTLSSETISSDSEVIPIVTL

SEQ ID NO: 229302 - protein, 386 aa, Glycine max
  Coding DNA Sequence Number=SeqID_112524
  Gene Ontology: Mol. function=oxidoreductase activity; Cellular component=membrane; Biological process=electron transport
  Homolog annotation: Hit_ID=Q1S4Y7; Match level="QueryCoverage=94%, HitCoverage=74%, E-value=1e-149, Identity=66%"; Hit description =Berberine and berberine like, putative
  Pfam annotation: Domain name=BBE; Domain location=323-380; Score =96.0; E_value=1.1e-25; Accession=PF08031.2; Description=Berberine and berberine like
  Pfam annotation: Domain name=FAD_binding_4; Domain location=3-106; Score=-1.7; E_value=0.0033; Accession=PF01565.13; Description=FAD binding domain
  Pfam module annotation: Pfam domain module=BBE::FAD_binding_4; Domain location=323-380::3-106
MQQKTMSYAEFCSKSQPNINLGGIIVNVKNEVAMVQAGATLGEVYYRIWEKSKVLGFPAGVCPTVDVGGHISGGGYDNMLRKHGLSVDNVIDAQIVDVKGNLLNRKTMGEDLFWAIRGGGGASFGVILSFTFKLVPVPKTQVAPTTDERLFMRLLLQPVSSKVVKGGNTIRASVVALFLGGANEVVPILAKQFPLLGLRKENCTEVSWMDSVLWWDDDKSLKNGAKPETLLDRHANTADFLKRKSDYVQKAIPREGLEFIWKRMIELGKTGLVFNPYGRKMAQVQYSVTWKDPSLAAAQNFLNQARKLYSYMTPFVSKNPRSAFLNYRDLDIGVNNFRKNSFQEGEVYGAKYFNGNFQRLIKVKTVVDSTNFFRNEQSIPLAPSKA

SEQ ID NO: 229303 - protein, 153 aa, Glycine max
  Coding DNA Sequence Number=SeqID_112525
MASKKRKSSDSRPQDQNDNRIFQSEEAWNRYIDNILDRRILLERNVELYHSEFNEFKVELGRQNFHKRLVNLQEGSIDVAVVKEFYANFYSPTPVLLEEGKSLPTYSRFCRLRGPTMEAPQKRSYHSGSDMERLLVLKLAPTSRTSDLNTDRA

SEQ ID NO: 229304 - protein, 165 aa, Glycine max
  Coding DNA Sequence Number=SeqID_112526
  Pfam annotation: Domain name=DUF185; Domain location=17-157; Score= -61.1; E_value=0.011; Accession=PF02636.7; Description=Uncharacterized ACR, COG1565
MQNQAHVGHGMPWYAHAIAEAIMRTANFSVPLKIYEIGGGSGTCAKGIMDYIMLNAPAKVYNSMTYISVEISPSLAEVQRETVGEVRSHIPKFRVECRDAADRIGWGQVEQQPCWVIMLEVCFIIEKLLCPPVQIFFPVKEKDLWNGHGRRVSNPIMFLKQIMHY

SEQ ID NO: 229305 - protein, 160 aa, Glycine max
  Coding DNA Sequence Number=SeqID_112527
  Gene Ontology: Mol. function=protein serine/threonine kinase activity; Cellular component=membrane; Biological process=protein amino acid phosphorylation
  Homolog annotation: Hit_ID=A0F0B1; Match level="QueryCoverage=98%, HitCoverage=75%, E-value=3e-28, Identity=61%"; Hit description=Cold -induced wall associated kinase
MAMKRKEKFFKQNGGLLLEQRLSSGEVNVDKIKLFSLKDLEKATNYFNITRVLGKAGQGQKPISSVKEQELKSLAPYFLLCMAENRLFDIIDERVIQEGEKENIIVVSNLARRCLQLNGKKRPTMKVTLELESIQKLEKQSNAQEHHEELELAGIEDSQI

SEQ ID NO: 229306 - protein, 88 aa, Glycine max
  Coding DNA Sequence Number=SeqID_112528
MLSRTRTFPLISLASKVCAPPLEALYSTHIVGDKPVLVRDFIHSALYHPLHGYFSQRSRSVGVLPNAIKFNQLQGAAPCIRLSVILVI

SEQ ID NO: 229307 - protein, 81 aa, Glycine max; identical to SEQ ID NO: 195124
  Coding DNA Sequence Number=SeqID_112529
  Subcellular localization annotation: CTP_CleavageSite=75; ConfidenceScore=5.16e-01

SEQ ID NO: 229308 - protein, 222 aa, Glycine max
  Coding DNA Sequence Number=SeqID_112530
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=O22444; Match level="QueryCoverage=88%, HitCoverage=21%, E-value=1e-46, Identity=49%"; Hit description=Alpha- glucosidase 1
MATTTVITPLLFCICVCLGFCSSSLSEATPVGYGYIISTVNSYPISVSLAANLKLIKPSSVFGPDIPHLSLAASFENKDRLRVRITDSNNQRWEIPQQVLPRGSPSQYYPLYYFNTNQGFQHSLSLTHPDSDLVFTLHNTTPFGFTVSRKSSNDVLFNTAPNPSNPETFLIFKDQYLQLSSSLPSQRASLFGLGEHTKSSFKLRPNQTLTLWNADIGSDNLD

SEQ ID NO: 229309 - protein, 47 aa, Glycine max
  Coding DNA Sequence Number=SeqID_112531
MTWAKRASTAKRNFSVLNVTEESGRASISRPRAKSKISALSAAGVFS

SEQ ID NO: 229310 - protein, 49 aa, Glycine max
  Coding DNA Sequence Number=SeqID_112532
MPRAQNFIAHYGAYFGKRALEAARGAAFVEIPRFCDFSIGKCTVALKVD

SEQ ID NO: 229311 - protein, 130 aa, Glycine max
  Coding DNA Sequence Number=SeqID_112533
  Gene Ontology: Mol. function=acid phosphatase activity; Cellular component=cellulose and pectin-containing cell wall
  Homolog annotation: Hit_ID=Q9LU48; Match level="QueryCoverage=53%, HitCoverage=27%, E-value=9e-23, Identity=71%"; Hit description=Acid phosphatase
  Pfam annotation: Domain name=Acid_phosphat_B; Domain location=17-130; Score=-55.6; E_value=0.0006; Accession=PF03767.5; Description=HAD superfamily, subfamily IIIB (Acid
MNPTDFRFLLAPSSIEAPSPVLPLKLLPLLPLKLLHLFDFIAPTSPLEVSLIGSCTVEERLEVFDREKFNNWVEKGVAPAIEPSLKLYEDVLNLGFKVILLTGRSERHRSVTVDNLINAGFKEWDQLILR

SEQ ID NO: 229312 - protein, 305 aa, Glycine max
  Coding DNA Sequence Number=SeqID_112534
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=O04893; Match level="QueryCoverage=95%, HitCoverage=38%, E-value=9e-72, Identity=45%"; Hit description=Alpha- glucosidase precursor
  Pfam annotation: Domain name=Glyco_hydro_31; Domain location=1-192; Score=1.3; E_value=1.4e-12; Accession=PF01055.16; Description =Glycosyl hydrolases family 31
MNGLLESKATNKALTNITGDNAASWNDLAYSIRAILNSGIFGIPMVGADICGFLGSTNEELCRRWTQLGAFYPFARDHSDKNSNRQELYLWDSVADSAKKVLGLRYRLLPYLYTLMMSQLNEISSQFLLGKGVLVSPVLKSGATTVDTYFPKGNWFDLFNFSNSVNGESGKNVTLDAPSDHINVHVGEGNILAMQGEAMTTEAARNTTFQLDIAGTLVSFNATLLNTTSVLVTSKVTNGAFALDKKWILEKVTVLGIPKQSKNLARKNLKFVKTQNDTSSQFDIVEVSKLSQLIGEDFKMDIKIR

SEQ ID NO: 229313 - protein, 222 aa, Glycine max
  Coding DNA Sequence Number=SeqID_112535
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=O22444; Match level="QueryCoverage=86%, HitCoverage=23%, E-value=2e-50, Identity=51%"; Hit description=Alpha- glucosidase 1
MATRWRTEVATTINTKMIFCISLTVNLNLINSLYIYGPDIKNLSLTASFETKDRLRRKGAPESSPTPQPQPQPQDSPSNLTLTHPDSDLIFTLHKTTPFGFTVSRKSSNDVLFNTTPDPSNTSNFLIFKDQYLQLSSSLPPQRASLYGLGEHTKKSFKLQPSLLTMWNADIPSANVDSNLYGSHPFYMDVRSTSSDGRVKAGTTHGVLLLNSNGIYGRRVHR

SEQ ID NO: 229314 - protein, 84 aa, Glycine max
  Coding DNA Sequence Number=SeqID_112536
MVAHEENTRIMYEQTCRTKRPGKSSLLTAYLGAQCPMCAVKKTIWIFRLPMTKDEIHIQSMCDGMMQMRKSATGGCTEYDNIHK

SEQ ID NO: 229315 - protein, 541 aa, Glycine max
  Coding DNA Sequence Number=SeqID_112537
  Gene Ontology: Mol. function=oxidoreductase activity; Cellular component=membrane; Biological process=electron transport
  Homolog annotation: Hit_ID=Q8SA60; Match level="QueryCoverage=92%, HitCoverage=92%, E-value=0.0, Identity=62%"; Hit description =Carbohydrate oxidase
  Pfam annotation: Domain name=BBE; Domain location=474-532; Score =108.9; E_value=1.5e-29; Accession=PF08031.2; Description=Berberine and berberine like
  Pfam annotation: Domain name=FAD_binding_4; Domain location=83-222; Score=98.4; E_value=2.2e-26; Accession=PF01565.13; Description=FAD binding domain
  Pfam module annotation: Pfam domain module=BBE::FAD_binding_4; Domain location=474-532::83-222
  Subcellular localization annotation: CTP_CleavageSite=96; ConfidenceScore=5.39e-01
MGVLSPHRIQLSFFSIVVLLSIPWSASAANSAPNTFVQCLLNNSEPSYPITSAIFTPNNSLFSSVLEAYIRNLRFNTSTTRKPFLIVTPSHVSHVQAAIVCAKKHKLLMKIRSGGHDYEGLSYVASQPLFILDMFNLRSIEIDMKTETAWVEAGATLGEVYYRIAEKSKIHAFPAGVCPTVGVGGHISGGGYGNMMRKYGLSVDNVIDALMVDVQGRLLDRKSMGEDLFWAITGGGGASFGVVLAYKIKLVRVPETVTVFRVPKTLEQNATDIVYNWQHVAPTINNNLFIRLVLNVVNVTQNETKTIRATFVALFLGDSKSLVSLLNDKFPQLGLKQSDCIETSWLGSVLFWTNINITAPVEVLLNRQPQSVNYLKRKSDYVKKSISKEGLEGIWRKMIELVDTSLNFNPYGGRMAEIPSTTSPFPHRAGNLWKIQYLANWNKPGKEVADHYINLTRKLHKYMTPFVSKNPRGAFFNYRDLDLGSNNYNGKNSYAKGRVYGVKYFKDNFNKLVQIKTKVDPDNFFRNEQSIPMLPYHKLLE

SEQ ID NO: 229316 - protein, 40 aa, Glycine max
  Coding DNA Sequence Number=SeqID_112538
MEVPEDIAKLNARRLQRIEQRLLISCLVSKALHKLLATAL

SEQ ID NO: 229317 - protein, 388 aa, Glycine max
  Coding DNA Sequence Number=SeqID_112539
  Homolog annotation: Hit_ID=Q1S4X3; Match level="QueryCoverage=85%, HitCoverage=86%, E-value=9e-23, Identity=30%"; Hit description=IMP dehydrogenase/GMP reductase
MPFPWKKNRVPRISQIVADLQSPKRGGSLVVETGFPTSLIDLFVKNRSRFQKHRSKKPPPPPPPKSLSATDPPPPPPPSPATSPPPRVPTFPATPIQQNDTAVSAPDRIAQCSPRSGVNAVVLVAKILMVLVLVASVERLTVGITASAFSLLLLEYAGRRVVVSCSVPESWWFQKVGMKERVERIEFESEELSNKGLSIDEIEDVETTDEVGVSCEIGDVALKVLEPCLCDEDVSECKIRPSRSGRFRSKMVKLVSKKFRGSKKEKKGEVNKHNEGESGSEISSAVGEEKLPILEIEVEEENGDNKSSNSKLDCGITCSYDNEKRVERVGNSDEDTQLVKDSCWSKRLRSEERIIPMIGTPTICWESNFMRCTLRYGWQKIEKVRRCR

SEQ ID NO: 229318 - protein, 40 aa, Glycine max
  Coding DNA Sequence Number=SeqID_112540
MAASPTKKAMDEVPNHDSQHEVSVTPANSQLPRSISRMNE

SEQ ID NO: 229319 - protein, 288 aa, Glycine max
  Coding DNA Sequence Number=SeqID_112541
  Gene Ontology: Mol. function=ribonuclease H activity; Biological process=RNA-dependent DNA replication
  Homolog annotation: Hit_ID=Q1S4X4; Match level="QueryCoverage=40%, HitCoverage=77%, E-value=3e-39, Identity=85%"; Hit description=Fatty acid hydroxylase, putative
  Pfam annotation: Domain name=FA_hydroxylase; Domain location=1-111; Score=118.2; E_value=2.3e-32; Accession=PF04116.3; Description=Fatty acid hydroxylase
VGHLGEAYEEWVHQPIVSKEGPRFFENEILEFWNLVKLMATTSTAPALFGGGLLGYVMYDCTHYYLHHGQPRTEVPRNLKKYHLNHHFRIQDKGFGITSSLWDKVFGTLPPKMDAKTKYGFGCQPVPVIRNETEASHTWRGIVMTWSHIEDNITWSINNGDSARFWTDRWIPGFQPLSSMMQNVCSTIAAINPPVQGYKDTPIWCTSRNGMLSVKTAYWYLAGYYDNPRDESGDFKMIWRYEGPQRVCLFLWKLMHGRLLPNEERIRRHMTNDSARIHYAHSVIVKTS

SEQ ID NO: 229320 - protein, 86 aa, Glycine max
  Coding DNA Sequence Number=SeqID_112542
  Homolog annotation: Hit_ID=Q6Q623; Match level="QueryCoverage=41%, HitCoverage=6%, E-value=6e-11, Identity=88%"; Hit description =Dioxygenase RAMOSUS1
MVCFILIDKVGRFRIPLDGSPYGTLEAALEPNEHGRGGIDICSIGAKGTLEYTVSKKLFVLTMATKAFKRHWYFAPSVRLKRCIGT

SEQ ID NO: 229321 - protein, 104 aa, Glycine max
  Coding DNA Sequence Number=SeqID_112543
AKAINSRRSRLDGGGRMNSARQSIHGSPNKIENGELANSARQSIRGAPDSMAINSRGSRLDGGGCINSASQSIHGSPNKIENGELANSAWQSIRDAPDSMVEDA

SEQ ID NO: 229322 - protein, 72 aa, Glycine max
  Coding DNA Sequence Number=SeqID_112544
  Homolog annotation: Hit_ID=Q94LX9; Match level="QueryCoverage=89%, HitCoverage=10%, E-value=1e-07, Identity=48%"; Hit description =Phosphoenolpyruvate carboxykinase
MPTSDYDGNGNGLTKIEVGDDEEGHPTVKAQTIDELHSLQKKKSAPSTPKGTFPASNSVFTEERNKQQLESI

SEQ ID NO: 229323 - protein, 104 aa, Glycine max
  Coding DNA Sequence Number=SeqID_112545
MTSKDLEHLTQKIKDQLELLLTEKGLVLPPKPEVGPFVAPVNTKGSSIDPSGQDPYTDESDKCGFYVDGIHPRLVALGKVYEGSTIIHNIPLGNHQVKVGVEEV

SEQ ID NO: 229324 - protein, 129 aa, Glycine max
  Coding DNA Sequence Number=SeqID_112546
  Homolog annotation: Hit_ID=Q86AI8; Match level="QueryCoverage=83%, HitCoverage=28%, E-value=8e-10, Identity=35%"; Hit description =Similar to Homo sapiens (Human). Mucin 2
MRGLHALALRELHVLILGTSYPHRQRTTRPRLERTTRPHHQRAARPYLQRTTCPRLERAARPHLGGLHVLALRGLHALTLGTSYPHRQRTTRPHLERTTRPHHQRAARPYLQRTINPRLERDTRPHLGY

SEQ ID NO: 229325 - protein, 153 aa, Glycine max
  Coding DNA Sequence Number=SeqID_112547
MGKLDHLEERFRAIAGGEDYAFANLKELFLEPNIITPPKFKVLDFDNFKGTTCPKNHLKMYYRKMGAYLKDEELLIHSFQESLTGDLVVAFVRQCQYNVVRLGCNYQNMCKKGAQIFQKEYAQKVERPDNSSGTSMTEKNDDNDSRHITSILL

SEQ ID NO: 229326 - protein, 166 aa, Glycine max
  Coding DNA Sequence Number=SeqID_112548
  Gene Ontology: Mol. function=glycerate kinase activity; Biological process=organic acid phosphorylation
  Homolog annotation: Hit_ID=Q7N004; Match level="QueryCoverage=95%, HitCoverage=42%, E-value=3e-39, Identity=50%"; Hit description =Glycerate kinase 2
  Pfam annotation: Domain name=Gly_kinase; Domain location=1-161; Score= -5.7; E_value=3.3e-13; Accession=PF02595.6; Description=Glycerate kinase family
MVAQLDAALYHYGELLERETGRAVLTQPGAGAAGGMGAALLGMLNARLRPGIEIVTETLCLDEAVRDADLVITGEGRLDSQSIHGKTPIGVARVAKRHGVPVIAIAGSLTSDYQVVHQHGIDAAFSVLDGIVTLEEALAGADRNLQVTARNVAAVWRLAQGGGPQA

SEQ ID NO: 229327 - protein, 44 aa, Glycine max
  Coding DNA Sequence Number=SeqID_112549
MAADIPTQNGMPAGKEMRGTEMKQEKHGVLLVNLGTPDAPTSSA

SEQ ID NO: 229328 - protein, 49 aa, Glycine max
  Coding DNA Sequence Number=SeqID_112550
MDQGISQLCGPACPRTLGSCISFLNNHLEETPGPTKIGENHSKCINLTQ

SEQ ID NO: 229329 - protein, 177 aa, Glycine max
  Coding DNA Sequence Number=SeqID_112551
  Gene Ontology: Mol. function=transition metal ion binding; Cellular component=chromatin; Biological process=chromatin assembly or disassembly
  Pfam annotation: Domain name=Transposase_21; Domain location=1-92; Score=-105.9; E_value=1.4e-05; Accession=PF02992.5; Description =Transposase family tnp2
MVFCTIDDFPTDGNFTGYSVKGHHACPICERNTSFTQLKHGKKKFYTRHRRFLKPYHPYRRLKKTFNGSQENESAPQPLAVNEVHDQVKDIITIFGKTQKKTSSKMNIWKKRSIFFDLPYWSSLRVRHCLDVMHVEKNVCDSLIDTLLNVKGKTKDGLKCRQDLVDMGIREQLHPIS

SEQ ID NO: 229330 - protein, 451 aa, Glycine max
  Coding DNA Sequence Number=SeqID_112552
  Gene Ontology: Mol. function=oxidoreductase activity; Cellular component=membrane; Biological process=electron transport
  Homolog annotation: Hit_ID=Q1S4X9; Match level="QueryCoverage=98%, HitCoverage=92%, E-value=1e-149, Identity=57%"; Hit description =Berberine and berberine like, putative
  Pfam annotation: Domain name=BBE; Domain location=391-447; Score =103.0; E_value=9e-28; Accession=PF08031.2; Description=Berberine and berberine like
  Pfam annotation: Domain name=FAD_binding_4; Domain location=46-185; Score=93.0; E_value=9.2e-25; Accession=PF01565.13; Description=FAD binding domain
  Pfam module annotation: Pfam domain module=BBE::FAD_binding_4; Domain location=391-447::46-185
  Subcellular localization annotation: CTP_CleavageSite=63; ConfidenceScore=5.29e-01
MAFSSGLEDSNSTTEVILTQSSSSYTSLLQSLIRNLRFLNSSVPKPNLIVTPQNLAHIQAAITCSRKHGLQVRVRSGGHDYEGLSYVSDVPFLIIDLINLRSINIDINDESAWVQAGATLGELCYAIAKTSNMCGFPDGSCPTVGVGGHLSVVGFGTIFRKYGLAADQVIDAEMVDVNGNILNRTLMGEDLLWDIRGGGGSSFGVITAWKVKLVPVPPKVTIFNVAKTLDQGARTAENLLPLMQNNFAELGLQLNSFTEMSWIQSVLYKYRLFNQWTLGGFASEKPNIQKLQSNIRLCYRTHSCGRFGRAVEHVARREHSQHTNLILTPYGGRMSEISGSETPFPHRNGSIYGIQYLVYWDSNEETPKHIYGMRRLYSYVTPYVSKCPRAAYLNYRDLNLGVNRGSTSYEEAKSWGVKYFKFHFERLARVKAEFDPSNFFWHEQSIPPSFN

SEQ ID NO: 229331 - protein, 354 aa, Glycine max
  Coding DNA Sequence Number=SeqID_112553
MVLEGLAEDQNIIKEDNDEVTEIWPENGIHHCLKRGGGVGIYKAERVWVCIWDEVNAMIGGSRGWVFCWGKLEMKVGACSVFTNSSTKLMRGDEIPLIPARETLAIAHPEQDWFRTGAGHEDQHRRLRKEGDNPTCDHCPPSPARELFGTVTSLRLGPPGAGFQGRDGPKGVFERLFIIPNKQKCPGGTLVAAMKFFIAVETKALFALQCQLLQLEALDRNRGEQQPPAAREALVKKRKMIEDVAADDRQIVSPPGDGPTLPPGPSPEMKQVKRNCGGKPTIRLAKFSNFARGWGRKRWYSCGRKGDKWFCESLVMASSKWFEFALERVDSTINKVNESTNVREKRRMRLDFEG

SEQ ID NO: 229332 - protein, 438 aa, Glycine max
  Coding DNA Sequence Number=SeqID_112554
  Gene Ontology: Mol. function=RNA-directed DNA polymerase activity; Cellular component=chromatin; Biological process=chromatin assembly or disassembly
  Homolog annotation: Hit_ID=Q94HV4; Match level="QueryCoverage=99%, HitCoverage=35%, E-value=9e-65, Identity=32%"; Hit description =Putative retroelement
  Pfam annotation: Domain name=rve; Domain location=266-432; Score= -5.7; E_value=0.018; Accession=PF00665.16; Description=Integrase core domain
  Pfam annotation: Domain name=zf-H2C2; Domain location=207-248; Score =11.6; E_value=0.01; Accession=PF09337.1; Description=His(2)-Cys(2) zinc finger
  Pfam module annotation: Pfam domain module=rve::zf-H2C2; Domain location=266-432::207-248
  Subcellular localization annotation: CTP_CleavageSite=3; ConfidenceScore=5.04e-01
MVSSQGVASVPMKILAIRQWPTPHSAQTLRSFLGLAGFYRRFIWGYASIAAPLTRLLGQDPFEWSPEADRAFLDLRQVLTNAPVLQLPDFELSFTVETNSSGVDVVLSQKRYPLAFFSKPFPPKLLRASTYVHKLFAITTTMKKWHQYLLGHRFTIITDHRSLRELIMQVIQTPEQQTYLAKLMGYNYSIQCRSRSAFIPTLLTEYHSSPIGGHMGISKTLACINDNFFWPGMCKDVASFVVQCLDCQHTKYETKKQASLLCPLPVSLRPWEDFSLDFIVGLPPFRGYTKILVVVNRFSKGIHLGMLPTQHSTHSVAMLFMDIVGKFHGMPQSLISGHESVLAGLIPAKWHDFANELCLPSADQWSDGGIEQGHQAMSSSLRASEAIIVGQVFKLDRVVLQHLDPFWFGFVPILIHLCQEAPFHSTIPYRHFKAGRSG

SEQ ID NO: 229333 - protein, 139 aa, Glycine max
  Coding DNA Sequence Number=SeqID_112555
MPPTRHPLDPDKSNRALGFLAFITGLFQSFGVPVTPSTMIRPPITQAFIEKYCTPKQAQGEAHQAVVAPPPPHQADPAGSLGMEHYLQHLVHQQAANHRGQPEAQVGEEPTGSPGEVEEARMDEEMIDLLGFLGGSGAM

SEQ ID NO: 229334 - protein, 262 aa, Glycine max
  Coding DNA Sequence Number=SeqID_112556
  Pfam annotation: Domain name=GRP; Domain location=1-101; Score=-3.3; E_value=0.00015; Accession=PF07172.2; Description=Glycine rich protein family
MASIHSLNCFVFFLLLALGISSARRSLLTLDGGYGVGHGIGGGYGGAAAGGYGGGGGGGSGGGGGYGGEHGVVGYGGGSGGGQGGGVGYGGDHGAGYGGGGGGGSGGGAGYGGGVEHGSGGGYGEGEGGGAGGGYGAGGEHGIGYGGGGGSGAGGGGGYSEGGAHGGGYGSGGGAGGGEGGGGVGGYGGGEGAGTGGGYDAGGEHGGGYGGGQGGGSGGGYGAGGDHGAAGYGVGEGGGAGGGYGAGGEHGIGYGGVVEVEE

SEQ ID NO: 229335 - protein, 231 aa, Glycine max
  Coding DNA Sequence Number=SeqID_112557
  Gene Ontology: Mol. function=DNA binding
  Homolog annotation: Hit_ID=Q1SFS3; Match level="QueryCoverage=84%, HitCoverage=37%, E-value=9e-22, Identity=31%"; Hit description =Lambda repressor-like, DNA-binding
MGTNQTGKRFYQVKVKGLDTSSIKELGQLMEPLRMQAFRKTYGKILDLTIAEISIEAITSLTQYYDQPLRCFMFGDFQLVPTIEEFEEILGCPLEGRKPYLFFGCLPSLSRIATVVKDSARGLDRVRQTRNGIAGLPWKYLEDKARDMANQEDWVPFMDVLALLIFGVVLFPNVDGLVDLAAIDAFLAYHYSKESPVVAVLADLFDTFDRSKTRDTRVRFRAIARVLKRGE

SEQ ID NO: 229336 - protein, 120 aa, Glycine max
  Coding DNA Sequence Number=SeqID_112558
LAAQRGNIALADQAAQGDVEGLVGHGGALQANGAWRPPVTQAGRGRRAGARNRQQAVIRGAVRPAGSGSICVSMRGGCRPGLPWPVALLSAPEWDGPRGSWVSPAIPWYSRHAQRQSRAQ

SEQ ID NO: 229337 - protein, 109 aa, Glycine max
  Coding DNA Sequence Number=SeqID_112559
  Subcellular localization annotation: CTP_CleavageSite=8; ConfidenceScore=5.30e-01
MTKNWSTMLATLSTSMPNFTCQKNMNKINNFNYLNQECLTIMPNFRVHNAKLSPEFILPKEECLTSMRQSKTERHNDNRGEMEPRTQSNNEEEQRATEMETGRKGSGKE

SEQ ID NO: 229338 - protein, 42 aa, Glycine max
  Coding DNA Sequence Number=SeqID_112560
MYREPRGSFGVEGRSKVGPCDHTSTNAPDPIRTPQLSVLGRE

SEQ ID NO: 229339 - protein, 580 aa, Glycine max
  Coding DNA Sequence Number=SeqID_112561
  Gene Ontology: Mol. function=methyltransferase activity; Biological process=metabolic process
  Homolog annotation: Hit_ID=UPI0000E68C83; Match level="QueryCoverage =99%, HitCoverage=81%, E-value=0.0, Identity=68%"; Hit description =generic methyltransferase
  Pfam annotation: Domain name=DUF323; Domain location=122-378; Score =54.5; E_value=3.4e-13; Accession=PF03781.6; Description=Domain of unknown function (DUF323)
  Pfam annotation: Domain name=Methyltransf_11; Domain location=433 -557; Score=46.5; E_value=9.1e-11; Accession=PF08241.2; Description =Methyltransferase domain
  Pfam annotation: Domain name=Methyltransf_12; Domain location=433 -555; Score=48.5; E_value=2.2e-11; Accession=PF08242.2; Description =Methyltransferase domain
  Pfam module annotation: Pfam domain module=DUF323::Methyltransf _11::Methyltransf_12; Domain location=122-378::433-557::433-555
MAGGYLQQRIDDRIEAMMAIGVDEMSWDDLDDSHYSWPDVAEVRDYRGKVKTVVSEFIRTMPLDLPIDWDSPAWVILMGIEHERIHLETSSVLIRQLPLEWIKPQPHWPACPQARHDRASVPANTLVAMPGGRVTQGKTDDTYGWDNEYGSLTTELKPFKASKMLVSNAEFFHFIAANGYNERRWWDDEGWGWREFAQAQMPTFWVGDIAQPDDLRLRLMTEEVAMPWDWPAEVNQLEAAAFCRWLAEESGKAIQLPCEAEWMQLREQVAGDQPDWIDAPGNINLARWASSCPVDHFAQGDFFDIVGNVWQWTTTPTNGFEGFRVHPLYDDFSTPTFDGKHALIKGGSWISTGNEALKSSRYAFRRHFFQHAGFRYVVSSHQESMALNPYETDSMVSQYLDFQYGPGYYGVPNYAAALVDIVLPHCAQRGHALDIGCATGRASFELARHFAAVTGMDYSARFIDVALQLTSGEDFRYVVPEEGELVEYRQVRLKEFGFDETLAQRIQFVQGDACNLKPQPDGYDLVLASNLIDRLRQPKRFLQDITPMIRSGGLLAISSPYTWLEEFTPKENWLGGFREN

SEQ ID NO: 229340 - protein, 75 aa, Glycine max
  Coding DNA Sequence Number=SeqID_112562
  Homolog annotation: Hit_ID=UPI0000E68C83; Match level="QueryCoverage =83%, HitCoverage=8%, E-value=1e-20, Identity=74%"; Hit description =generic methyltransferase
MAKVEDQRMAQGDGFIKVRALIGEAVEQAFVQLPGLGEIGQQFGAFGVAAAAGKPNGAGGRRQLIVKMSGCHSEL

SEQ ID NO: 229341 - protein, 109 aa, Glycine max
  Coding DNA Sequence Number=SeqID_112563
  Homolog annotation: Hit_ID=UPI0000612705; Match level="QueryCoverage =86%, HitCoverage=45%, E-value=4e-07, Identity=37%"; Hit description =UPI0000612705 related cluster
MTDLLNESISCFLIRVDSWVLVPSPSEDYTSSPLEGYTSSLLEGCTLILRELHVLAIRGLHTLAIGGLHILAFRRLHALAIRGLHVLTFRGLHVLAIKGLHSLAFRGLH

SEQ ID NO: 229342 - protein, 100 aa, Glycine max
  Coding DNA Sequence Number=SeqID_112564
  Pfam annotation: Domain name=Transposase_23; Domain location=1-65; Score=-17.7; E_value=0.099; Accession=PF03017.5; Description =TNP1ENSPM transposase
MGDLDKCGLYIEENSSQLVALGRVYEGSITVHNIPLLHGQVRVGVEEVKDAEAPVPVPTDEAVVSPAKPVDRVHPEVNDLLYLMTLVIPQLFLRPLQASN

SEQ ID NO: 229343 - protein, 68 aa, Glycine max
  Coding DNA Sequence Number=SeqID_112565
MESLLIVISYAGSFFKATYCERGLSRASVTEYLIQHMLEMNTNVLVCVLISSSKSLCSFFNLPRVSCV

SEQ ID NO: 229344 - protein, 72 aa, Glycine max
  Coding DNA Sequence Number=SeqID_112566
IPEHKGWVVPVWFRSCKWIFTKIVEISSGLLEYWTCHIGNWKGGLVPSLEEFESRSKGPTTLRAIGLRSTPN

SEQ ID NO: 229345 - protein, 89 aa, Glycine max
  Coding DNA Sequence Number=SeqID_112567
  Gene Ontology: Mol. function=ribonuclease H activity; Biological process=DNA integration
  Homolog annotation: Hit_ID=Q1S8I9; Match level="QueryCoverage=98%, HitCoverage=17%, E-value=3e-24, Identity=60%"; Hit description =Probable integrase-common tobacco
MKAVLPFEVEVPSQRILAKSGLEESEWARTRYDQLNLIKGMRLTAMSHGRLYQQRMKNAFDKKVHLRKFHEGDLVLKKMSHAVKDNQGK

SEQ ID NO: 229346 - protein, 193 aa, Glycine max
  Coding DNA Sequence Number=SeqID_112568
MDRPVGRKRAQVCELNQKASPWRQPDLSCSRHDSRCASGRRGSPRQCPATSDFETRPDSQWRVVMSEQSAALPSLPFAPVDVCDGIHAAVAFEVLRDQYSLHAATIAAWCAIDARTQGDEVRYRFWFGVFCELRKASPVFSLVLPTASKLRPFLPEGTYFLSANGRGSDVDRLLHSKDIGSAIIRQIRSIIEN

SEQ ID NO: 229347 - protein, 207 aa, Glycine max
  Coding DNA Sequence Number=SeqID_112569
  Homolog annotation: Hit_ID=Q1SP02; Match level="QueryCoverage=62%, HitCoverage=29%, E-value=1e-13, Identity=35%"; Hit description=IMP dehydrogenase/GMP reductase
MKGITRVPYRARCDALTVTDVCWLPYTEHRGVKGFELISSFQGQLRWGPMVVTARPERVLRQFGYIQSIPPPPVSASLSYDDINDRWVHFADHVLAVGELCADYMEWFFRISHPFMISTQAGDQPRHAPTPDHEEYMQPAIPQVPVAFDPPPLAVDDYEGYEAIAERLERVLNLRMVTVGTKLHDIMQDCLTIARGGASADGSVRAR

SEQ ID NO: 229348 - protein, 215 aa, Glycine max
  Coding DNA Sequence Number=SeqID_112570
MARMKKTGQMTSEAAKEIADRIASQGSFVPHGRQDILAATIGRPEHPGRARVVGAGVTIKQYFGSASRTSRSSSSMPPEDLEQLTQQIRDQLEESITEKVTRKMMASFSQMQSQFQSQMQSQGLALPPEPKVGPSGPRVSTKESCVAPSGNDPGTSDSDKCGLYIEENPSRLVALGRLYEGSTTVHNIPLLHGQVKVGVEEVKDAEALVPVPTNE

SEQ ID NO: 229349 - protein, 126 aa, Glycine max
  Coding DNA Sequence Number=SeqID_112571
MGQLAKQIADKSSNSFGANTENNPKEECKAVMTRSKRFVEAEDEENEVDKEQLSEKTGVEVKKNDVKEKSRSGKVVEESVEVPYHVVPSKNEKDRHLARFMDIFRKLEITCPLAKLCSRCHSTLNF

SEQ ID NO: 229350 - protein, 295 aa, Glycine max
  Coding DNA Sequence Number=SeqID_112572
  Gene Ontology: Mol. function=transferase activity; Cellular component= cytoplasm; Biological process=translation
  Homolog annotation: Hit_ID=UPI00005F9A0B; Match level="QueryCoverage =99%, HitCoverage=63%, E-value=1e-102, Identity=63%"; Hit description= COG0154: Asp-tRNAAsn/Glu-tRNAGln amidotransferase A subunit and related amidases
  Pfam annotation: Domain name=Amidase; Domain location=1-288; Score =109.3; E_value=1.1e-29; Accession=PF01425.11; Description=Amidase
MLREADRLDQQRQRGEPLPALAGIPYAVKNLFDVAGHSTLAGASLFSERPVAQQDAWAVSKLQQSGALLSGMLNMDAYAYGFTTENTHYGATRNPRDLSRVAGGSSGGSAAAVAAGLVHFSLGTDTNGSIRVPASLCGIFGLKPTFGRLSRSGSHPFVASLDHIGPFARSVEDLSLVYDALQGGDASDAFQAARPAEPVSDRLSAGSEKLRSAVLGGFFADWCSDEARAAVAVAASALGATEEVTLPQAELARSAAFIMTAAEGGNHYLPALRTQPERFEPNSRERLLAGTMLPN

SEQ ID NO: 229351 - protein, 183 aa, Glycine max
  Coding DNA Sequence Number=SeqID_112573
MRAHPEREAITHLLCIPGQDFTRAAAKRPVWIMRTNVTTFTYILPGDHNANLPLQMYRLGSCPQDAQWARRSPTGPWGFQLWLRASVVLQGARSPRQGHVIIGIAPAKHPVDPKKSNRVLELSSSNYGSVSSTECLSPPARASGPLLIKLSSRSTASPGRRRAKHHSSLGMAGSGQQTHRHHL

SEQ ID NO: 229352 - protein, 439 aa, Glycine max
  Coding DNA Sequence Number=SeqID_112574
  Gene Ontology: Mol. function=protein kinase activity; Cellular component=integral to membrane; Biological process=cell division
  Homolog annotation: Hit_ID=Q35ED7; Match level="QueryCoverage=97%, HitCoverage=41%, E-value=1e-116, Identity=50%"; Hit description =Probable RND efflux transporter
MAMLALLLAGVGTTYMQGEFFPASDRPELLVSLALPASASQQATLRQVQRLEQIVSASRDVDHYSSYVGTGAIRFYLPMDVLLDDENSAQLVVVAKSLAARERLQRSLDAVLARDFSDITTRVAPLELGPPVGWPIRYRISGPDYRQVQQLAERLAAALGSSALTRDVNQTAGEPERVITLQVNQTAARAAGLSSDLIAQYLHTLWSGTLITTVRDRNRLIDVVLQGNAAARHDLSSLSGLLLTAPSGAKIPLTQVATPQWGLEDPVIWRRQRLPFITVQTDTAPGLRAEAVSAALTPLIATFRASLPAGYRLSEDGAVAESDKGNQSVIAILPVTLLCMLLLLMLQLRRISRMLLALLMAPFGLPGIVLTMLPTGTPMGFVALLGVIALAGMIIRNAVILISEADNNVDAGMPPDAAIAAAAEHRARPIVLTASAAIL

SEQ ID NO: 229353 - protein, 89 aa, Glycine max
  Coding DNA Sequence Number=SeqID_112575
MVGYAPSSFADLVFADERIEVGLKRGKFNHPTWTNEETGANEEGENEGETHAASVVPTWKLPTNPTNIITQPISTLLRTHHTVIHKGHP

SEQ ID NO: 229354 - protein, 125 aa, Glycine max
  Coding DNA Sequence Number=SeqID_112576
MYYGTQSDIRVKSYGRSKILRASVFNFEFLDILRDSFRHPSKNLELQNSISSVSIYYGTHSDIRVKSNCRLKLPRASTFNFERLNRLRDSIRQTSKKLLSFELAQSFRIQFRSSRYITGLNQTSE

SEQ ID NO: 229355 - protein, 79 aa, Glycine max
  Coding DNA Sequence Number=SeqID_112577
MRILLIGQGSKNSKVVSQWGLLSWEPDLDIWARWALKHPVYGIVILRLGIYTNRPNVSKLCSFISSMNSSILISVIQEK

SEQ ID NO: 229356 - protein, 110 aa, Glycine max
  Coding DNA Sequence Number=SeqID_112578
TLFSTATPLGLKVIPQVKELLDEGLTWVLIWDTLVIKRFPQTLREKGVEGRSPEFQEPMDLRSNPFQGRGDNAILPPRTLDRRSQEDWTRDAREGPTVLMSLNVDFGPMD

SEQ ID NO: 229357 - protein, 219 aa, Glycine max
  Coding DNA Sequence Number=SeqID_112579
  Homolog annotation: Hit_ID=Q5V9K1; Match level="QueryCoverage=88%, HitCoverage=51%, E-value=3e-75, Identity=68%"; Hit description =Klebicin C phage associated protein
QWPGNAGGMSAVNRHQTGRKRVIIMAEEKKNAQVINGVNDDIAELKSLSTLRQRVVSDGEIVSKSANGFRLANGNTGVMLRNDGRDFYALTTPGGQALNGQWNTLRPFSFNLASGRVAMQNGVDISGGAVVSHNAGISTSTTGPTPLINGQIYNSAPLKSDFTSGIVTTTTMLGSRVIPGKDNFGLISYRDWQGNWNELQVRTNAELSVGQLTKRNSDG

SEQ ID NO: 229358 - protein, 166 aa, Glycine max
  Coding DNA Sequence Number=SeqID_112580
MTEDIFVFKMCADYRIRRLHMLPDFSQVGVTYLCVCADNPWVSPHATWLFTGPGSRTVCVWITVGYICLPPDSWVRINRCCVCTDNHLGYFHLPPDAWVKINKCCVCMDNHLGYFCLPHDAWVRVNRYCLCTDNHLGISACHLTHGSGSADVVFVRIITWVYLPPT

SEQ ID NO: 229359 - protein, 58 aa, Glycine max
  Coding DNA Sequence Number=SeqID_112581
PPLIAISLGPLSTYYTKFIAGQPPQASLLCGLVFLLSVDCQELACLGTSQVLTDRLCP

SEQ ID NO: 229360 - protein, 133 aa, Glycine max
  Coding DNA Sequence Number=SeqID_112582
MFGEDIEEDADIPLILGCPFMSIASCMEDMGKKILQMGIEDQKISFDLFHEDKDPPRQNVYLKVHVMEEKRPEKKEPLSANLLRFLNSSKCAKRACCAKHACCTKHACCAKPELLSKALSAACYAKPQMLTVP

SEQ ID NO: 229361 - protein, 97 aa, Glycine max
  Coding DNA Sequence Number=SeqID_112583
MSEIEEVQEQIKDDMEVMKEQMTTMMEAMMSMRKMMEVNKAIVVAASTATEVDPTHPSGLNQVQSKHCFPPYGLPPNVSHAPDDNIDNSIPTPIVIP

SEQ ID NO: 229362 - protein, 62 aa, Glycine max
  Coding DNA Sequence Number=SeqID_112584
MGGPGWLDTNGKGSGGGKACGGATGIGGGLNEEKHVTKYQPRRYGVTEAIEEIAKKGRWSGP

SEQ ID NO: 229363 - protein, 238 aa, Glycine max
  Coding DNA Sequence Number=SeqID_112585
  Gene Ontology: Mol. function=structural molecule activity; Cellular component=protein storage vacuole; Biological process=lipid transport
  Homolog annotation: Hit_ID=Q6H7R1; Match level="QueryCoverage=82%, HitCoverage=67%, E-value=5e-23, Identity=37%"; Hit description =Putative vesicle-associated membrane protein-associated protein
  Pfam annotation: Domain name=Motile_Sperm; Domain location=5-129; Score=16.3; E_value=0.00051; Accession=PF00635.16; Description=MSP (Major sperm protein) domain
  Subcellular localization annotation: CTP_CleavageSite=60; ConfidenceScore=5.26e-01
MATELLQIDPPQLTFTFELKKQSSCLVHLINNNSSHHVAFKVPSFASPTSFTLLTLLNIRSKPRRPRNTASDQLSASSSHTEHVISPAQRTAPPDLHCKDKFLVQSAVVPKGTTEDEISSDLFVKDSGRLVDEKKLRVVLINSPSSPVNGDLKQDPPSQMLPSLTAEKGMEAAQDMEEDGADKGTFPSTRSVEKVGDMKQVNDAVNLSFATKDSEELKSRLSIMDAKLREVSHQCFLT

SEQ ID NO: 229364 - protein, 404 aa, Glycine max
  Coding DNA Sequence Number=SeqID_112586
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=3e-54, Identity=29%"; Hit description= UPI00006A17C9 related cluster
LAFRGLHALTFRGLHILAFRGLHTLALRGPHALGFKRLHALTFRGLHVLAFRGLHVFAFRGLHVLACRGLHAFAFTGLHALAFIALHALPFRVLHVLAFRGLHALTFRELHVLAYRELHALALRGLHALGFKGLHALALRGRLHALAFRGLHFFAFRGLYTLAFRGLHAFSFKGLHVLTFRGLHVLAFRGLHVLPFRGLDVLAFSGLHALTFRGLHVLAVRGLHALAFRGLHALSFKGLHVLSFRGLHVLAFRGLYVLGFRWLHVLAFRGLHVLPFRWLHMLSFRGLHALAFRGLHVLALRVLHVFAFRGLDVLTYRGLHVLSFRGLHALALRRLHTLAFRGLNVLTFSGLHVFAFRGLHVLACRGLHALVFGRLHALSFRGLHALPFRGLHVLTFRGLHAITF

SEQ ID NO: 229365 - protein, 74 aa, Glycine max
  Coding DNA Sequence Number=SeqID_112587
  Subcellular localization annotation: CTP_CleavageSite=37; ConfidenceScore=5.32e-01
MVKVVSRIRPLDLMIKYVQFQWAKRASTAKRSFSAPSATKESGRASISRSHGKREISAPSTVVVFSQAQCTTGA

SEQ ID NO: 229366 - protein, 59 aa, Glycine max
  Coding DNA Sequence Number=SeqID_112588
  Homolog annotation: Hit_ID=Q1SAV4; Match level="QueryCoverage=85%, HitCoverage=12%, E-value=2e-07, Identity=50%"; Hit description =Integrase, catalytic region
MKYFVDSHLREANFQEGYWVIVKLRPYHQSSVTGTTHTKLAKRYYGPFETIPPRKIGPP

SEQ ID NO: 229367 - protein, 141 aa, Glycine max
  Coding DNA Sequence Number=SeqID_112589
MAQIVQTLEQQKYLSRLMGYNFTIQYISDCLNVVADALSHISKVSKGTVFLLSMPHFMFLVELKRELVDHLKFIALRRDLQDRPENHPDHTYTNGLILQNGHIWLPSNFNIIPFDPHRWSYGDHKDIGQIAGKFYMEFYQE

SEQ ID NO: 229368 - protein, 185 aa, Glycine max
  Coding DNA Sequence Number=SeqID_112590
  Subcellular localization annotation: CTP_CleavageSite=58; ConfidenceScore=5.26e-01
MVLLSPNLEKLNANPCGNGQLSELCLAKRPVARARPAEFPSTSTTPTPASTSAAPSVPAQTNSQEMVAWPGTQPSLHREDAGTQPSLHREDEGPTAQVPQHVEDESSEATIPEPFVVGEEAGETQVRQVAAATPERSLEATLNPPAPVEDLPSPQHAADPSTPTLEIPEDLTTPVLTLTLLLQLL

SEQ ID NO: 229369 - protein, 52 aa, Glycine max
  Coding DNA Sequence Number=SeqID_112591
MSVSPKGSQELLSSLSRSADYDPEKIVFVTPAKRMSGELDYDEYTQYELSTN

SEQ ID NO: 229370 - protein, 205 aa, Glycine max
  Coding DNA Sequence Number=SeqID_112592
  Gene Ontology: Mol. function=nucleic acid binding
  Homolog annotation: Hit_ID=Q1RXW3; Match level="QueryCoverage=64%, HitCoverage=20%, E-value=5e-09, Identity=30%"; Hit description=Zinc finger, CCHC-type
  Pfam annotation: Domain name=zf-CCHC; Domain location=79-96; Score =22.8; E_value=0.00017; Accession=PF00098.13; Description=Zinc knuckle
MFKQGMTTKENDKKKKGISLKASSSIQEESDKEDLNEIEEDDDFSLFIKRFNKFLRNKGNQGKTNFNPNKRGEDLSSIPKCYECNQPGHLRVDCLGFKRRMEKSGRKTFKDKKAKKADITWEDNNMDSSRDSENEVMNLSFMAKNYESEEEVTSSNNNLSISFDELQNAFNDLQKESVKLAKLVSFSKKTISNLENEVLKLNEEL

SEQ ID NO: 229371 - protein, 49 aa, Glycine max
  Coding DNA Sequence Number=SeqID_112593
MYKQNQKDFLRLVVRSKSTKNQQEFKDPVIGPGCPVSDPPPLPTNEVQE

SEQ ID NO: 229372 - protein, 72 aa, Glycine max
  Coding DNA Sequence Number=SeqID_112594
MVSQGGQYGVGGFETVGKEETVIMTEEKGATMVTILDGGSKEGNLGIFETKEMQVAKNRMQEAIANIYYSIH

SEQ ID NO: 229373 - protein, 357 aa, Glycine max
  Coding DNA Sequence Number=SeqID_112595
  Homolog annotation: Hit_ID=Q9LSD5; Match level="QueryCoverage=91%, HitCoverage=99%, E-value=3e-64, Identity=49%"; Hit description =Genomic DNA, chromosome 3, P1 clone: MOJ10
  Pfam annotation: Domain name=TCP; Domain location=57-240; Score =145.2; E_value=1.8e-40; Accession=PF03634.4; Description=TCP family transcription factor
MDPKGSKQQQPQEVVPKFLSLPQHHYQQQGNSNNNNMGENKPSEVKDFQIVVAAEKDESKKQQQLAPKRSSNKDRHTKVEGRGRRIRMPALCAARIFQLTRELGHKSDGETIQWLLQQAEPSIIAATGTGTIPASALAAAGNSLSPQGSSLSSALHHQHQKIDELGCGSGGSSRASWQMVGGNLGRPHLGVATTGLWPPHVSGFGFQTATTTTTTTSSGPSNATLATESSNYLQKIAFPGFDLPTSATNMGHMSFTSILGGAGSQQMPGLELGLSQDGHIGVLNPQALNQIYQQMNHQAQAGRVHQQHQHQQQQHQQTPAKDDSQGSGGQCKQLNVGGGNGKAALSRGLSVSNQHHT

SEQ ID NO: 229374 - protein, 69 aa, Glycine max
  Coding DNA Sequence Number=SeqID_112596
MVKNLKEGAMARDFEEGLATQGFKKGGEALVGLLPRRKNIFMEKRRNRNRNIIGNVERKRKHNRKRKRY

SEQ ID NO: 229375 - protein, 310 aa, Glycine max
  Coding DNA Sequence Number=SeqID_112597
  Homolog annotation: Hit_ID=Q5XM22; Match level="QueryCoverage=28%, HitCoverage=64%, E-value=1e-15, Identity=44%"; Hit description =Resistance-like protein HAAS-2
MATGYLSKEMRGPTVDSCSSCVSPTLVHLDAFRDLAQSGTYAWGVATLAHMYDQLNEASQSTSRQIAGYVTLLQCWIYEHFPGVHNSVIDDGYDETSPRACWWLTTKAYMKGLSALSYKTCIDALTVPDVCWMPYGDHRGVRAFDLISCFQGLHLSPLGPSSFSTQGLCPSPLGPSPFSTWAFSLYLASFMILIRWGPIVVSRDYMEWFFPISHSFITPTQATDQPRHQHVPQHEAYVEPDILEDACEAIAKSLERMLNLRMVTEGTELHEIMEDCLRITRGVTSDGNVYVRVRRRWRTDHSEIMFMSCI

SEQ ID NO: 229376 - protein, 76 aa, Glycine max
  Coding DNA Sequence Number=SeqID_112598
  Subcellular localization annotation: CTP_CleavageSite=36; ConfidenceScore=5.27e-01
MGSETVSNGHIKERVCPSPMYKNITSRGLSSKTSVVVNLVSVQTNKMKREVNSREEEAEFQLCWHPAPKPPTRYTS

SEQ ID NO: 229377 - protein, 356 aa, Glycine max
  Coding DNA Sequence Number=SeqID_112599
  Gene Ontology: Mol. function=RNA-directed DNA polymerase activity; Cellular component=chromatin; Biological process=RNA-dependent DNA replication
MNALFRPYLLRFIIVFFDDILIYNHSFSDHLTHLEQAFQLFLQGQFVLKISKCSFTQAQIEYLHHVVSTQGVQPVASKVQAVQHWPIPHSTRALRSFFGLAGFYQAPLTSLMMKEPFLWSTEAQLAFNKIKEALSSALVLSLPNFTLPFTVETDASGTAPVKKWRQYLLGHHFVILTDHDSLKELMTQVVQTPEQQMYLARLMGQDYSIQYHTGADRLIQTTEVWMTPLLVKEDKSRVTQPFLLSWIAFPREFSWACYPIITYLTQWRSYSWTSSASSTACHELFCMSGTQLWMSSTYHPQTNGQTKVINYVIEQCLRPFVHNKPASWGKFINWAEWSYNTSWHYGSGTTPYKITF

SEQ ID NO: 229378 - protein, 218 aa, Glycine max
  Coding DNA Sequence Number=SeqID_112600
  Gene Ontology: Mol. function=RNA-directed DNA polymerase activity; Cellular component=chromatin; Biological process=chromatin assembly or disassembly
MSTYLSEFEYLANRIIGLPPPLLLNYFISSLTPKIRREVQAIQPLTLKLSPKELASRREHGLCFNCEEKYHCGHKCSSRVHVLIAEKDDDPQEDTLALGPLPNPPDHPNPTMTQISFHSLAGHLAPETLLLVGYIGSQHMVILIYGGSNHNFIQESLALQLGLPTHTSPSLSVMVGNGQYFPCNRLYEAITILIQDISFTLDLYVLPLCGANLVLGVQ

SEQ ID NO: 229379 - protein, 36 aa, Glycine max
  Coding DNA Sequence Number=SeqID_112601
MEQMQAEIEALKAQVSQVDVSKEQIAFLMQNVRGNE

SEQ ID NO: 229380 - protein, 85 aa, Glycine max
  Coding DNA Sequence Number=SeqID_112602
MVTRTEKKKERKSSLLYSLDTPFPQNRATIEDSDNQHIEEYLPHCLQPLSLTLLTRVNEVGAMQRGWRLQQGCKEGKTHQKGLIS

SEQ ID NO: 229381 - protein, 79 aa, Glycine max
  Coding DNA Sequence Number=SeqID_112603
  Gene Ontology: Mol. function=DNA binding; Biological process=DNA integration
MEYMSHVPYASVVGSLMYAMVCTRFDLAQAISVVSSWKTSLQPTLALSTTEAEYMALAEATKEGIRLKGLISNLKFPED

SEQ ID NO: 229382 - protein, 84 aa, Glycine max
  Coding DNA Sequence Number=SeqID_112604
MIKLRAMLSIIFGMTSICGSSAVTKLLGDAFHPHEIDSVLCRSKLHDELRLIQRSFDDNKGDDKKLKCQEHIMITKMMISRIKE

SEQ ID NO: 229383 - protein, 137 aa, Glycine max
  Coding DNA Sequence Number=SeqID_112605
  Subcellular localization annotation: CTP_CleavageSite=44; ConfidenceScore=5.35e-01
MPMQSLDWIMLSARLALSSNPLTRAKREGGAKRNVGNNNNKKARAQNSTSRHNAYFGKRALEAARGTTFAEMLRFCKLIIVRDLEAVATPEEEPRSFEASSSFPIARHSHIEPVEGTIMAEEPRRVTLEDYSSSNVP

SEQ ID NO: 229384 - protein, 100 aa, Glycine max
  Coding DNA Sequence Number=SeqID_112606
MKRSSRQHYSYLKLQCPSQVPEPTQIFRPPRKSENARVEVVVLLNARYQKFSVHNFMYEKKSTVRSDCGIGEAAYERRDVAKKVNVALLEWGSRYFGGKQ

SEQ ID NO: 229385 - protein, 126 aa, Glycine max
  Coding DNA Sequence Number=SeqID_112607
  Gene Ontology: Mol. function=RNA-directed DNA polymerase activity; Biological process=RNA-dependent DNA replication
MAWTPRPELGGKCQNLQIKKEDESMTSIGLNLDGTTKEAFSLFLKEKANVFAWKPVDMLSIDPNFFCHKLIVNPLVKPVCQRRRKMTLECLEEIERQVKELLRKLKGKSTLQRNLSYDLAGQDHPS

SEQ ID NO: 229386 - protein, 382 aa, Glycine max
  Coding DNA Sequence Number=SeqID_112608
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q6QZN8; Match level="QueryCoverage=98%, HitCoverage=48%, E-value=3e-77, Identity=42%"; Hit description=DNA -directed DNA polymerase
TFVGVYYSEELKYARDIGYTIIPICGYLFEEMESPFKDYINSLFESRSNAKKKGNNALSFVYKLLMNSLYGRFGINPQSTKTEMCNKSKRDRIFRRPEFIDDVFIREDLYMVSYLTNPGKGPSYWDPPKNSAVQLAAAITAGSRIYMYKYISREDCLYTDTDSIVLNPLPEEDVSSSVLGKFKLEDKILEGFFLAPKCYSYTTEESDGNKKVYKYKGPGRNVITPEWYKEQYADPSRSLIKKVTYQFQPDWKELSVKKKESTTTLRTLSNSKRIPFFNEKGKYVSTDPLDIDDLSSLNYIGTKLLESFKRKTAILEKENSALSQKLQKLEQERGIIAQRRVEEGNNTEDNNTLEQNNPKRAEDNINGDLLDPDTMPRDKKPP

SEQ ID NO: 229387 - protein, 125 aa, Glycine max
  Coding DNA Sequence Number=SeqID_112609
MSRQEGWTCQIRARVAGHVSSLKRKCWPETNFFEFWAFRCRPCSNEPMSPVIYFGFSDVQTWDRPPLESLTAFPDNLKKNPKQGYLGKFTWPETNFFEFWAFRCRPCSNEPVSLVIFFGFVDVQT

SEQ ID NO: 229388 - protein, 98 aa, Glycine max
  Coding DNA Sequence Number=SeqID_112610
MYEYLRRTRTLTRKHSFQNSYGYSCFVGKGKWLQRNSPRRSLEETPQEKGPVPPPSLIVIVSGVPSTSSASRPSEDGHSIGRGVSSSGRMSIRTFKRR

SEQ ID NO: 229389 - protein, 194 aa, Glycine max
  Coding DNA Sequence Number=SeqID_112611
MHRSPTGNIVPLDLEIEATLRRNRAERRRKLLQDRKIASILEEEAQSSDSTSSDSLSSRESAIYLPEASVMADEHHKRVILEDYSSSSVSGTYFMDYQMRTPMHIWQREAKKWLHSFKGNNLKTWGEVVEKFMKKYFPESKTAEGKAVISSFHQFPNESFSEALERFRGLLRKTPTHGFSEPIQLNMFIDGLRP

SEQ ID NO: 229390 - protein, 35 aa, Glycine max
  Coding DNA Sequence Number=SeqID_112612
MTKVVSYTLHVGWRMAFVKRTRGGTIKTQDFDTQA

SEQ ID NO: 229391 - protein, 119 aa, Glycine max
  Coding DNA Sequence Number=SeqID_112613
MGPQNTCGKLYGTPIHTLALHVSPDTGAWTSTFSSRALNRHDAILPPKVVATYPSAGGRRGAHGSIFQGRKARGVATNVYLTKMSEKPEKVWSTLSVKGSGVVFKNGKGISTPRVRHKG

SEQ ID NO: 229392 - protein, 188 aa, Glycine max
  Coding DNA Sequence Number=SeqID_112614
  Gene Ontology: Mol. function=nucleic acid binding; Biological process= DNA integration
MFLTRSKRKESLGKEERVEEVVEDVSDKEVEDDRKEKEADNKEKELRDEKNEKEKIVSKAFIDLGANINLMPLSMCQRIRNLKITPTRVTLQLVDFSITMPYGVVEDVLVKVQQFTFPMDFGIMDVKEDLDIPLILGCPFMLTAKCVMDMGNGNLEMSVEDQKVTFYLFETIKHPSDNKTCFKVKMIE

SEQ ID NO: 229393 - protein, 280 aa, Glycine max
  Coding DNA Sequence Number=SeqID_112615
  Gene Ontology: Mol. function=protein transporter activity; Cellular component=membrane; Biological process=protein secretion
  Homolog annotation: Hit_ID=UPI000068BF27; Match level="QueryCoverage =56%, HitCoverage=44%, E-value=3e-46, Identity=58%"; Hit description =efflux transporter, RND family, MFP subunit
  Pfam annotation: Domain name=Biotin_lipoyl; Domain location=137-193; Score=-17.7; E_value=0.069; Accession=PF00364.12; Description=Biotin- requiring enzyme
LYSGQIPEYPDFDVNFNSKSVSDDSSENNIKHSYAFLRDHELHDQYVVSHLPYHKLRANLSESDNENDDNVETSGFTGPPICLGTDIGHLKPDFVTIFHNRQSAVSLANSEHLKYFNDDLYIHCQSEKKEKAEAAVFNVTSPLVKDTLIDKDYVAQIRSINHIELRAQEKGYIQTLYVDEGQYVKKGQLLFKIMPNLYESDVNRAKAEAKYAQIEYQNTKNLSDKDIVAPQEMAMAKAKYEKAQAELSSMNTHLKFTEIRAPFNGIVGRLHVRKGSLVDE

SEQ ID NO: 229394 - protein, 188 aa, Glycine max
  Coding DNA Sequence Number=SeqID_112616
  Homolog annotation: Hit_ID=Q1SIS3; Match level="QueryCoverage=37%, HitCoverage=17%, E-value=5e-14, Identity=60%"; Hit description =Peptidase M14, carboxypeptidase A
MGAVYDIAKSGIGVASMGHAGAGLILCLIQEEREFDELSSQDRISHSRSTPNPHPPTPIVHKHTKSKKKRSDFEKDDFVSCNKCRPHSCDKIFILPLDPIIMASGYLVYLLSTIFLPFILYALLLHKFVMKKEFWRTTTAVQNQYFNEVRPLEAERFKALGIQWAQYYLKVRNQTLDVRQLCNFRLLN

SEQ ID NO: 229395 - protein, 88 aa, Glycine max
  Coding DNA Sequence Number=SeqID_112617
  Gene Ontology: Mol. function=microtubule binding; Cellular component =membrane; Biological process=protein transport
  Homolog annotation: Hit_ID=Q8LBA9; Match level="QueryCoverage=85%, HitCoverage=63%, E-value=2e-32, Identity=88%"; Hit description =Putative microtubule-associated protein
  Pfam annotation: Domain name=MAP1_LC3; Domain location=5-85; Score =143.9; E_value=4.3e-40; Accession=PF02991.6; Description=Microtubule associated protein 1A1B, light chain 3
MAIWLSGSLIRIVNCKRYLVPADLTVGQFVYVVRKRIKLSPEKAIFIFVKNILPPTAAMMSAIYEENKDEDGFLYMTYSGENTFGLVF

SEQ ID NO: 229396 - protein, 179 aa, Glycine max
  Coding DNA Sequence Number=SeqID_112618
MAAEAQCPYALHARGKEILIEDDEYTPSTHYVKTRLSRLFKHEVAALQQKRDLTSKDWLALKRYYKLGAHCSSLESKENPPLDGVHHKTEHCYQTTSHNLFEVLHTPPSPSFIKLSPSLKKVNSDNEILVFTEDTTIEVYDGPPPSWEYVHLHEEALLKTRGSLAEAFQDKTHVERKAK

SEQ ID NO: 229397 - protein, 483 aa, Glycine max
  Coding DNA Sequence Number=SeqID_112619
  Gene Ontology: Mol. function=galactosyltransferase activity; Cellular component=membrane; Biological process=protein amino acid glycosylation
  Homolog annotation: Hit_ID=Q8LEJ9; Match level="QueryCoverage=88%, HitCoverage=93%, E-value=1e-155, Identity=65%"; Hit description=Avr9 elicitor response-like protein
  Pfam annotation: Domain name=Galactosyl_T; Domain location=192-393; Score=232.9; E_value=7e-67; Accession=PF01762.12; Description =Galactosyltransferase
MTWKSRGELPSRSVISQRWALFLCLGSFCAGMLFTTRIWTIPENNKGLARPTASEAEKLSLVSEGCNSRILQEMEMKHDKDTYGEVFKSHNSIHFSSYFLVLEVLRDKLTQKGPWSCYFLLFCMSNLCESIECRTLDKAISNLEMELAAARATQESLRSGAPISDDIRLSESSGKRKYLMVIGINTAFSSRKRRDSVRSTWMLQGEKRKKLEEKGIIMRFVIGHSATSGGILDRAIEAEDRKHGDFLRLNHVEGYLELSAKTKTYFATAVNLWDADFYVKVDDDVHHYILSVSATLGETLVRHRSKPRIYIGCMKSGPVLSQKGVRYHEPEYWKFGEAGNRYFRHATGQLYAISNDLATYISINQNVLHKYANEDVSLGSWFIGLDVEHIDDRRLCCGTPPDCEWKAQAGNICVASFDWSCSGICRSAERIKEVHRSVEKKMSFYTRKAGVREKYDACPMDLQHFKRRLTMVAASKRTCARDI

SEQ ID NO: 229398 - protein, 95 aa, Glycine max
  Coding DNA Sequence Number=SeqID_112620
MVKRTQPAYQRQAKNANRRSIYDEKISGGWTCSMFMYKTQRERERERDRKDTHTLNITKSLKSFKEGSAQHETTKYGYSGGGIEGVALNSQPPWH

SEQ ID NO: 229399 - protein, 67 aa, Glycine max
  Coding DNA Sequence Number=SeqID_112621
MGFGTPCRQIDPRLFVITVSETSRGRNNMAFRQWGWQNRHDISSLELTKQAPITSRQQWVLLVVLAK

SEQ ID NO: 229400 - protein, 84 aa, Glycine max
  Coding DNA Sequence Number=SeqID_112622
MDVIRVVHSYLDMEENYEEKELHGKQFELDSDGKIHFKIRQLLLNVTHFRDMLKEFRILEGFKLWRVKNEKSRMIVECENMEGV

SEQ ID NO: 229401 - protein, 85 aa, Glycine max
  Coding DNA Sequence Number=SeqID_112623
MGSNQAHAFKKKFSSSQGQVWKKECALQGPYQTCAKARVMSEIEEVQEQMKVDMEAMKDQMAAMMDAMLSMKKIMESNAAAIATM

SEQ ID NO: 229402 - protein, 111 aa, Glycine max
  Coding DNA Sequence Number=SeqID_112624
MFRNVVVLKYSDESDLINVVLDMLPDTEVVFSQQFVFVTADDVRSMLDSTDPIELESQSVSVTADHDPLLRIPLTPTKHVSSDELDDEPKNFEISPAQVSSNKLPKHCQAE

SEQ ID NO: 229403 - protein, 93 aa, Glycine max
  Coding DNA Sequence Number=SeqID_112625
MAFQITCLYLVVALDVIGVVDEMVEDERPIVILLTHARIKEGQAPIISASNNSLKASKLMTNELVLEIQEFKKRLLDLGIKVRSVLTPIGQGS

SEQ ID NO: 229404 - protein, 744 aa, Glycine max
  Coding DNA Sequence Number=SeqID_112626
  Homolog annotation: Hit_ID=UPI00005FA75B; Match level="QueryCoverage =48%, HitCoverage=75%, E-value=1e-105, Identity=54%"; Hit description= COG1263: Phosphotransferase system IIC components, glucose/maltose/N -acetylglucosamine-specific
  Pfam annotation: Domain name=PTS_EIIC; Domain location=384-694; Score= 228.7; E_value=1.3e-65; Accession=PF02378.9; Description =Phosphotransferase system, EIIC
DSRTVHDMRDPIQTGIVQEGFRLAEVANQDIIHIQRGQFVLRNVELAHVLQHALQPALRIAGTREQKQFYGLIAGEYFFQYCTAQKSGKEIRWRYWTLQGKRGAGGLLANVPVMTIQRNHGRGQQLNQQHNPNLSIERACAQWSLRFGGHQLHIAKGRQRATWRIAERQHRNAALAGQFHHRGRIHGRTVHIAKQLRRFAQPQQLIVQILPEYGAGRNAVNLHGLCLMQRQRGLFQQRAVEESGGILQSLHRFLHDVINFVPGLTHGLALLNIQRKRHLKFVIALAAQRAAKTRDAGLAGMAFAGQLGDRQVEHPGRIAEDKLTEFLLCWAVPGSLLAELQQQVFMIRHATSLMRFSAPSVAESGGKMPVISKKYDRAPAQRFGKSFMLPIAVLPAAGLLLGIGGALSNPNTLTAYPFLDVGWLQAIFTIMSSAGSIVFANLPVLFAVGVAVGLAKSDKGTAGLAALLAFLVMNATINALLILTGKLAHENPGAVGQGMTLGIQTLETGVFGGVVIGLVTCALHHRFNKIALPQFLGFFWRLALCSYYQLAGGDTRRCAHDRGLAAFPEADFWSGRAGGCDRLSGHPAVRLYSSHAGPGTQRIFFAQLADPNTQHFYEGTSRFMSGRFITMMFGLLGACLAMYHTAKPENKKRVAGLLLSAALTSFLTGITEPIEFSFLFIAPVLYVIHALFDGLAFMLAHMLHITIGQTFSGGFIDFVLFGILQGEAKTNWMFVPLVGVPCSS

SEQ ID NO: 229405 - protein, 241 aa, Glycine max
  Coding DNA Sequence Number=SeqID_112627
  Gene Ontology: Mol. function=DNA binding; Cellular component=oxygen evolving complex; Biological process=DNA integration
  Homolog annotation: Hit_ID=Q1SS72; Match level="QueryCoverage=95%, HitCoverage=15%, E-value=5e-72, Identity=58%"; Hit description =Integrase, catalytic region
MLLALAALHNWHLRQLDVNNAFFHGDLDEEVYMTLPPGLHVHDRNLVCRLQRSLYGLKQASRQWFTRLSSFLISHDFRQSATDHSLFLHFNNSDITAVLVYVDDIIIAGNNLDTITHITNLLDIAFSIKDLGTLKFFLGLEVARNNKGIHLSQRKYVLDILSNSGMLASRPASTPMDYSTRLTASLGTPLSEASSSSYRRLIGRLIYLTNTRPDITHAVQQLSQYMAHPTSAHSQAAFRVL

SEQ ID NO: 229406 - protein, 145 aa, Glycine max
  Coding DNA Sequence Number=SeqID_112628
MAFLRKTDIQTGPFTCGCGKDNDQPVLRYRVEVMVSQNNDSSKFLLWDRECAELIGEIADEVNRVKIEDGDVDLNASPQALDRLLGYVLAFKVRIQSKFRNVIVLRYSNELDLINVVLDMLADTEVCSKIDASNVDCNNAMHPEC

SEQ ID NO: 229407 - protein, 120 aa, Glycine max
  Coding DNA Sequence Number=SeqID_112629
  Gene Ontology: Mol. function=transferase activity, transferring glycosyl groups; Biological process=metabolic process
  Homolog annotation: Hit_ID=Q5IFH8; Match level="QueryCoverage=78%, HitCoverage=26%, E-value=1e-11, Identity=35%"; Hit description =Triterpene UDP-glucosyl transferase UGT73K1
MPNSSSHAKVFIFLASWMAIVFCSHTLGKLSRIFSKKQQLEIACGIEASGHEFLWVSPKNMYVDVEEWLPHDFEERIKENNKGMVVRALLHQQLMLKHMFLNEKLVIEVHKIGVKVRECE

SEQ ID NO: 229408 - protein, 130 aa, Glycine max
  Coding DNA Sequence Number=SeqID_112630
  Gene Ontology: Mol. function=protein tyrosine/serine/threonine phosphatase activity; Cellular component=intracellular; Biological process=protein amino acid dephosphorylation
  Homolog annotation: Hit_ID=Q570P7; Match level="QueryCoverage=93%, HitCoverage=82%, E-value=4e-48, Identity=71%"; Hit description =Pollen-specific protein-like
MAEAGGSSQTETTTKPQLIYRCKKCRRIVASEENIVSHERGKGESSFKWKKRSSESWEMEKQSVDCTSVFVEPMKWMQAVQEGHVEEKLLCMGCNARLGYFNWAGMQCSCGAWVNPAFQLHKSKLDECNM

SEQ ID NO: 229409 - protein, 153 aa, Glycine max
  Coding DNA Sequence Number=SeqID_112631
MKVSTAIPILDTQIDFYESASHDKMRLNKRANINHQSHIAKCTETNPVNYKTEHKDYGRKHYTRMIVKVLIKKNKPTFTIAQVQTNGVHNEAISKTKREGRKVYKICLFGGNNGDNSNNDHASGANDRALVVLGGGGRYANGGMMVEWWQCKW

SEQ ID NO: 229410 - protein, 121 aa, Glycine max
  Coding DNA Sequence Number=SeqID_112632
  Subcellular localization annotation: CTP_CleavageSite=58; ConfidenceScore=5.15e-01
MVVEVLAIKVSILANIGSNQAHAFKKRFSSSEGKNTLLLCPYRTRARARVMSEIEEVQEQMKADMEAMKEQMTTMMSMRSMMEVNAATVVAASIATEVDPTHPPSFVGSSGLRIIKKGGLN

SEQ ID NO: 229411 - protein, 199 aa, Glycine max
  Coding DNA Sequence Number=SeqID_112633
MTLKLPYCPIFVQVFYNNLEIHDGVIFSKVHKIPIVVDQSLFYSLTKLSSQGVPFEGTLVDDYSSHDARKIVCVENADKTGRLLVGSFTFECRVMHFILCHVLLHRSTNLSQASEKDLILLWAQQTGLQKDYLASAPKERTPSPPPRDPSSTLLNDVLNEIQDLRAFVGERFDSMDSRITPLEDDMGFIRRCFDPPTNP

SEQ ID NO: 229412 - protein, 202 aa, Glycine max
  Coding DNA Sequence Number=SeqID_112634
  Gene Ontology: Mol. function=oxidoreductase activity; Cellular component=integral to membrane; Biological process=electron transport
  Homolog annotation: Hit_ID=Q2LAK5; Match level="QueryCoverage=99%, HitCoverage=75%, E-value=2e-83, Identity=73%"; Hit description =Cytochrome P450 monooxygenase CYP71D54
  Pfam annotation: Domain name=p450; Domain location=1-197; Score= -153.4; E_value=0.00055; Accession=PF00067.12; Description=Cytochrome P450
DIFAAGTDTSASTLEWAMAEMMRNPRVREKAQAELRQAFREKEIIHESDLEQLTYLKLVIKETFRVHPPTPLLLPRECSQPTIIDGYEIPAKTKVMVNAYAICKDSQYWIDADRFVPERFEGSSIDFKGNNFNYLPFGGGRRICPGMTLGLASIMLPLALLLYHFNWELPNKMKPEEMNMDEHFGLAIGRKNELHLIPNVNL

SEQ ID NO: 229413 - protein, 56 aa, Glycine max
  Coding DNA Sequence Number=SeqID_112635
MELSAITVSETLCDWNSMTFRQWDWRNKHGISPLRLAKQAPITSRQQWVSLVVLAK

SEQ ID NO: 229414 - protein, 195 aa, Glycine max
  Coding DNA Sequence Number=SeqID_112636
MQNQEIQVGNSYSMENYQWEQELQPYNQYEEERTSNLDNLLMQFKEVTEYTQQAFKSFEIQVGKLAEEVTKFMARREENFIKVEAQEESPVRNHDSKEKDEDKSEEKAQQWEKYSQVEIQQESILQVNTHPHQLIVKEERHGEHEKALSAILSLITSTSLAMIWKVLPEYMTFMESLARRQKYKEYVFFVTFMPP

SEQ ID NO: 229415 - protein, 116 aa, Glycine max
  Coding DNA Sequence Number=SeqID_112637
MGEQWRQFKYDLTSKWAFAADKESVDDTDMRKKAQANQKHNIAPHVLSREGYEYSENKLMDEKRKKKLEEAAQSGSTNTVIDPLSPIRQHMKWKMARTKKTGQMTSEAAKEIAEKI

SEQ ID NO: 229416 - protein, 195 aa, Glycine max
  Coding DNA Sequence Number=SeqID_112638
MQNQEIQVGNSYSMENYQWEQELQPYNQYEEERTSNLDTLLMQFKEVTEYTQQAFKSLEIQVGKLAEEVTKFMARREENFIKVEAQEESPVRKHDSKEKDEDKSEEKAQQWEKYSQVEIQQESILQVNTHPHQLIVKEERHGEHEKALSAILSLITSTSLAMIWKVLPEYMTFMESLARRQKYKEYVFFVTFMPP

SEQ ID NO: 229417 - protein, 142 aa, Glycine max
  Coding DNA Sequence Number=SeqID_112639
MVTGHNYFLWPLIRLIIVGTEEVQQSVDRKIELPNIHGSNRVSQIAQVEKIFKVQQMKPNEKFQFTFMIMEGSAGHLFVLLRKKTSDLTWENLTVAMVQRFPGRQLCSLYERLPTLQQMDLLTSTYKILESWWHRQNTLGRI

SEQ ID NO: 229418 - protein, 669 aa, Glycine max
  Coding DNA Sequence Number=SeqID_112640
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=96%, HitCoverage=59%, E-value=1e-123, Identity=42%"; Hit description =Chromo
  Pfam annotation: Domain name=zf-H2C2; Domain location=541-582; Score =14.2; E_value=0.0046; Accession=PF09337.1; Description=His(2)-Cys(2) zinc finger
MEMVNTWIELRRALESQFGPSLFDCSMAELNKDIRRDVVAQAPNCMRRSLCYFCDEKFSFNHKCPNRQFLLLQSENDDAELEPHDSEDRFDSVADNAEVILEDHHLSLNALKGDSLDNFLQPRVAKFLKLPVEPAPFFKVMVGNGNYMEAEGMISKLTIKAQNARFQLPVFLLPVSGADLILGASWLETIGPHIADYDKRMLNTDAVAEIFTMQLIEPNSVQFPLLELPTDMEPKLALLLHSYSAVFGTPTYPHSQKEEIEKLVNGMLEEGIIQPKIDYLGHTLSGAGVAMETTKLQAVLDWPLPNSLKQLRGFLGLTGYYRRFVKGYATIAASLTTDLLKKDSFKWSASASATTALNKLKEVMTSAPVLAIPNFKEPFVLETDASATGIGAVLKFHAITEALAKFRHYLLGHKFIICTDQKSLKELLEQRLHTPDQQQWLPKFLGYDFVIQYKLGRENIPADALSRSFSMAWSEAVGVWMTQVATLIKEDAILAALYKQCIEGTVSGTEYTVKDGLLFWKGRMMIPLNEALKQKIMHEFHASKIGGHEGITKSVSRICKQFYWPKMQQDIRDFVRKCIICQQAKVEQALPVGLLQPLPIPQRIWEDIAMDFITHLTSSYDAFIVNIVKMHGFPKTIVSDRDRVFISAFWQQLFKAQGTTLVMSSAYHP

SEQ ID NO: 229419 - protein, 142 aa, Glycine max
  Coding DNA Sequence Number=SeqID_112641
MAVLMRFVGRDKNTTFSVDVVGPLHQRVVPTIRHHVFTIYVSEDMIQQNYQLVLPPEASIYLIASKKYMVVDRGSGRHQKWMITMNNGLSCVADVWIHYLDECHLKAGDEVIFFYNIDQHLWEVLYRKQVTWDDTEDEADSP

SEQ ID NO: 229420 - protein, 104 aa, Glycine max
  Coding DNA Sequence Number=SeqID_112642
GSKGSLNCKHHEPHDEGSSIKSMLYKLLVNLRSGVFMLQIDAFANPNLVKPEILQHFRNDVAGSCIQIHKKDEWIWKIDPTRQYSVIKGETTNKDKFEEEKGGN

SEQ ID NO: 229421 - protein, 157 aa, Glycine max
  Coding DNA Sequence Number=SeqID_112643
MMSFKRERKKSLSKALKVHMQESDGSNNSGGFTYDEVALTSRKLKQMMKKKNKYQYSSRRKDDSNSKKNKNSYDEQANIYLVEDTDDKVKTLEESLSLGSKPDETFIVEKLRKKVACLTKEFEKFFESSKTLTTLLKFHQHPHDKSGLGFEKGTTLM

SEQ ID NO: 229422 - protein, 72 aa, Glycine max
  Coding DNA Sequence Number=SeqID_112644
MTIVDSCTWRSLVSKVFLAGKSIHGVQAVGLVGVVEVQDIRAYWWQWLSEVGKPWLSLKGHHGILVNENDFP

SEQ ID NO: 229423 - protein, 174 aa, Glycine max
  Coding DNA Sequence Number=SeqID_112645
  Gene Ontology: Mol. function=chitin binding; Cellular component =extracellular region; Biological process=chitin metabolic process
  Homolog annotation: Hit_ID=UPI00006A17C9; Match level="QueryCoverage =49%, HitCoverage=100%, E-value=1e-10, Identity=37%"; Hit description= UPI00006A17C9 related cluster
TTCPRLERTTCPRHQRTLHVLAFRGLHVLTIRGLHALTSRGLHVLALRGLHALTLGLHALSFRGLHVLANRGLHAFTFRGLHVLANRGLHALTLRGLHALTFRGLRVLIFRTGSFLLTVPGPPPDIGGGPTVRAQPEREAITQLLCIPGQDFTRAAAKRRVRIMRTNMTTLTQI

SEQ ID NO: 229424 - protein, 69 aa, Glycine max
  Coding DNA Sequence Number=SeqID_112646
MKLAKKGESFWEESNRDICERCNKGKQGKGAPKTSAFKRILGVRVISRFLELKGDNLSWKAKALVGNFC

SEQ ID NO: 229425 - protein, 210 aa, Glycine max
  Coding DNA Sequence Number=SeqID_112647
KDEELRGSSNGVIDDYHKWLKARTQGITWLSKLKISSGEEAEVPEEREEVQALKVKLERTRVVKEKFKMTAIRVWKDCKELRDVNMVATEALERETKRARKEEWGQNKFRGALWAATVNSSFEGIKGTSRGSKRSLTEQLSRTEENIWTIVDQYKGKLNQAVSHEQRLEDEHAKVSALQAEREARERVIESLHGEAMKWMDKFAFTLNGS

SEQ ID NO: 229426 - protein, 64 aa, Glycine max
  Coding DNA Sequence Number=SeqID_112648
EFVSDCEILEVKETSSPLVVLQSFILFFSLLLRRLPGSFNSGNWSDSEVLDSAGLSCHAFTRNR

SEQ ID NO: 229427 - protein, 49 aa, Glycine max
  Coding DNA Sequence Number=SeqID_112649
VCLKARDSLWYLDCGCSRHIPGDKSKLYDFVSKDGGHVMFGDNNKEKIM

SEQ ID NO: 229428 - protein, 52 aa, Glycine max
  Coding DNA Sequence Number=SeqID_112650
MEELPPASSTVIRSAPDEYSKAWLQSTESLGQSVQGWQKWAELRGRHSVSQE

SEQ ID NO: 229429 - protein, 146 aa, Glycine max
  Coding DNA Sequence Number=SeqID_112651
MHKALRSNAPLPYPHLITLFLQHFNIPLDSEPFVKVKRSFSIGANVVSSFGNRKERDGSWVKKDAPVQATEDCSPSPHSQRDDSSSLLHNILERFDGLQTYVGERFDALERQVDTRFDAMDSRITKVEEDVTIIRDYLDLPPPPPL

SEQ ID NO: 229430 - protein, 156 aa, Glycine max
  Coding DNA Sequence Number=SeqID_112652
  Homolog annotation: Hit_ID=Q10QM7; Match level="QueryCoverage=68%, HitCoverage=35%, E-value=6e-09, Identity=39%"; Hit description =Expressed protein
MSLNLELNLTCESPRKKEEGYGYDMNEKKSSRSSPGGLRELREDLFTDQPSKFNKKDSDGKILSPSWLSLSEDDYKEMVATVCMRCHMLVMLCKSSPSCPNCKFMHPPDQNPSKFLKRSILDHPKPIHVARAELNFGTYFQDLETRQPIVMDDGGS

SEQ ID NO: 229431 - protein, 87 aa, Glycine max
  Coding DNA Sequence Number=SeqID_112653
MNYIIEESIHVVFHETNPIRPRKETLDDITDSLEDMHINEKGHKGKGNGNEEDFQIDENKTNIDPPREWRTSRYHPFDNIIGDISKG

SEQ ID NO: 229432 - protein, 51 aa, Glycine max
  Coding DNA Sequence Number=SeqID_112654
MVLSQSLENELKGAEDSEFPVKEIGNEGLTKRILRKGVTWQTPFSGNEVKG

SEQ ID NO: 229433 - protein, 81 aa, Glycine max
  Coding DNA Sequence Number=SeqID_112655
MEILILSQGLWWFEVLGQKACRTTGHDVCQGVGLASGSGIKGMSHIYFHDTHTTMMISKFYAKLVMHAPMWTLKHQVFMVM

SEQ ID NO: 229434 - protein, 139 aa, Glycine max
  Coding DNA Sequence Number=SeqID_112656
MASTKRKAPSTPSQVRFDRSRFTSQEAWERYTDIVVPRKLPERNMEFYTNLFGPEDKSPKQVRVRGHLVKFDEDTLNTFLKTPMIMEEGENFCAYSRFALLRPDPQELAAKLCIIGRGFKLNADGQSLKILRENMTTLA

SEQ ID NO: 229435 - protein, 147 aa, Glycine max
  Coding DNA Sequence Number=SeqID_112657
PSTHGETHEVPRDHTLADFEPHLGYATEGQAFGGVPLPNTLGGPQYRPQPQPLHFMVGRVLPAMIEREKFDHIEERLRVIRGGRNYVFADMAKLCLVLDVVNPLKFKVTNFDKYMGTTCPKNHLKTYCRKMEAYAKDEKLLMHFFQE

SEQ ID NO: 229436 - protein, 159 aa, Glycine max
  Coding DNA Sequence Number=SeqID_112658
  Gene Ontology: Mol. function=O-methyltransferase activity; Biological process=lignin biosynthetic process
  Homolog annotation: Hit_ID=Q1SAC6; Match level="QueryCoverage=92%, HitCoverage=40%, E-value=9e-75, Identity=89%"; Hit description=Blue (Type 1) copper domain; O-methyltransferase, family 2
  Pfam annotation: Domain name=Methyltransf_2; Domain location=1-159; Score=62.8; E_value=1.1e-15; Accession=PF00891.8; Description=O -methyltransferase
MTLAPMLLLENHPIHLNPAHYISEIIREGTKNGTAFFKCHGHEQFEMTGLDPEYNRLFNEGMVCTARVVSKAVITGYKDGFNQIKSLVDVGGGIGGSLSEIVRAYPHINAINFDLPHVVATAPKFDGITHVGGDMFVSIPSADAIYMKVYQKLINTISS

SEQ ID NO: 229437 - protein, 84 aa, Glycine max
  Coding DNA Sequence Number=SeqID_112659
  Subcellular localization annotation: CTP_CleavageSite=37; ConfidenceScore=5.18e-01
MARLGCKASKTNPMGVTFLFHHSSINNFFQVRLDRVLMNQEWRIESPIVKSTTRTLVIPYRLKLQCQNFDSGHGRYYHYLSELN

SEQ ID NO: 229438 - protein, 445 aa, Glycine max
  Coding DNA Sequence Number=SeqID_112660
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=4e-46, Identity=31%"; Hit description= UPI00006A17C9 related cluster
GLHAVSFRGQHILAIGGLEALTFRGQHVLAIRGLHTLAFRGLHVLAIRGLHALTIRELHLLAIRGLHALTFRGLHVLAIRGLHVLAKRELHVLAIKGLHALTFRGLHVLAIRGLHALTFRGLHVLSIRGLHALTFRRLHVFTIKGLQHLAFRDLHVLAIKGAASPHLQRTTRPRRQQLHTLAIRELHILAITGLLPLTLRRIHVLAIRELDVLASRRLHALTFRGLHVLTIRGLHALSYRGLHVLAIGGLQTLTFRGLHVLASRGLHTLIFRGLHVLAMRGLHTLTSRGLHVLTIRGLHALTFRGLHVLAIRGLHALAFTGLHVLAIRGLHALTLRGLHVLAIRGLHTLTLTGLRVLAIRELHALTFRGLHVLTIKRLHALIFRGLHVLAITGLGLHVLAIRGLHALTFRGLHVLAIRGLHTLPFRGLHVLAIRGLHTLAFRGLQ

SEQ ID NO: 229439 - protein, 121 aa, Glycine max
  Coding DNA Sequence Number=SeqID_112661
  Gene Ontology: Cellular component=cytoskeleton; Biological process =phagocytosis
  Homolog annotation: Hit_ID=Q1SD88; Match level="QueryCoverage=96%, HitCoverage=37%, E-value=2e-39, Identity=66%"; Hit description =Engulfment and cell motility, ELM
  Pfam annotation: Domain name=ELMO_CED12; Domain location=1-103; Score= 63.4; E_value=7.6e-16; Accession=PF04727.4; Description=ELMOCED-12 family
MKASFHKLLLKKDGNRATWEYPFAVAGINISFMLIQMLDLCSEKPRCIPGMNFVKLLGENEEAFDVLYCIAFEMMDAQWLALHASYMDFNDVLQATRMQLERELSLEDINKIQDLPAYNLL

SEQ ID NO: 229440 - protein, 73 aa, Glycine max
  Coding DNA Sequence Number=SeqID_112662
MVSTDLPVYNEEGEVQLQPLVVWDKRMKKKGNRAIMEVLIQWRHTNLKDAELSLAIRGMCVAKLYLLKEASQG

SEQ ID NO: 229441 - protein, 93 aa, Glycine max
  Coding DNA Sequence Number=SeqID_112663
MKVKVAVFSIAVVVGGGIQGVRLIVRIKLICKAPPPHRQTPVEENARGRSRAEQHNSTTTTPPTMVKKQPTSPAPTVHSRSRNHAEEEEVWSR

SEQ ID NO: 229442 - protein, 291 aa, Glycine max
  Coding DNA Sequence Number=SeqID_112664
  Gene Ontology: Cellular component=chloroplast envelope
  Homolog annotation: Hit_ID=O80503; Match level="QueryCoverage=99%, HitCoverage=66%, E-value=3e-68, Identity=47%"; Hit description =Expressed protein
MAKLKTSIDSSFWDFNVASPQLHEGWVKSVPGDPFPLDGSVASRVLRPRQLSVIGNGLPLPVIVPSLSPTSPKDLGSFCLQSLLLKLANPRWWLTMTGQFRPRKLIADVKNEISNAEEFDLSTVKDVAKHFINKSLYSFGLTSQFAFPPSTSLLLAIEGHGEKERLRSKVMLPDHDLTLEAAWPQLFVDHKGKYWDVPESLSVDLSSLVSESGLRYHIGMHKNSVNPQAMNATNGNPPLSLLPGLCAKVAVSYEKIKYFWRDKGAAEQENEEALPYDVRLKEPHAAVSGII

SEQ ID NO: 229443 - protein, 106 aa, Glycine max
  Coding DNA Sequence Number=SeqID_112665
MAPPPLALPRRSCHVERDAQKVTGCTVLQQTVVAAGSRKETPLEPAGCVCRSNAPSRGALSSFYMQFSCCIVLPVCSTFFKLASLLPLVGSLLPLHLWFLLLVTSW

SEQ ID NO: 229444 - protein, 461 aa, Glycine max
  Coding DNA Sequence Number=SeqID_112666
  Gene Ontology: Mol. function=transporter activity; Cellular component= integral to membrane; Biological process=transport
  Homolog annotation: Hit_ID=Q21A62; Match level="QueryCoverage=55%, HitCoverage=59%, E-value=1e-108, Identity=71%"; Hit description =Major facilitator superfamily MFS_1
  Pfam annotation: Domain name=2-Hacid_dh_C; Domain location=1-150; Score=170.4; E_value=4.5e-48; Accession=PF02826.9; Description=D -isomer specific 2-hydroxyacid dehyd
  Pfam annotation: Domain name=MFS_1; Domain location=221-459; Score =88.1; E_value=2.7e-23; Accession=PF07690.6; Description=Major Facilitator Superfamily
  Pfam module annotation: Pfam domain module=2-Hacid_dh_C::MFS_1; Domain location=1-150::221-459
TTAAIETRAGHWPRIFATDVYGKTLGIIGLGNIGKQVALRAKGFNMRILAFDFYPDDAFAAEHGVTFVSLDQLTEHSDFITLHMPLTDQTQNLFDAARLKRMKKSAFLINASRGGVVNEQDLYQALQDNVIAAAGAASAVHPEQLYPHGAPCRLYRRCHQRHRRTLRDADCAVYKTGRTPDECHERAGLTPPSSVTLFAWIMIMTNTARSTRIRWWIAGLMWLAIAINYIDRTVLSAAAPHLITELDINPEMMGFIMAAFFWSYALLQIPAGWFADRFGQKKGLGIAVGWWSIATMAMGLATGFKSLLALRLALGVGEAAAYPSNAGITARWFPDRERATVSGLFDSASKFGGAVAMPLIVFMIALFDWRLTFLAIGAVGLIWVIAWYFIYAENPEDHKAISADEVRLIRDGQAQKHGDKNVRPMKWYKLLRYRNIWAMCIGFFTINYTSYFFITWLPTYL

SEQ ID NO: 229445 - protein, 151 aa, Glycine max
  Coding DNA Sequence Number=SeqID_112667
  Homolog annotation: Hit_ID=Q0TK06; Match level="QueryCoverage=96%, HitCoverage=34%, E-value=5e-22, Identity=43%"; Hit description =Putative inner membrane protein
MTSSPWKTPVLVIADDFTGANDAGSGFALAGARVHVLFNNLTPSEAGAADVLVISTDSRAVSAAEAASRTHAAIQPHQQIAQHGWLFKKIDSTLRGNPGAEVAAALQVSAKRLALVVPAVPKLGRITRGGEVWIHQQRLTDTEFASDPKTP

SEQ ID NO: 229446 - protein, 384 aa, Glycine max
  Coding DNA Sequence Number=SeqID_112668
  Gene Ontology: Mol. function=oxidoreductase activity; Cellular component=membrane; Biological process=metabolic process
  Homolog annotation: Hit_ID=Q6D0N6; Match level="QueryCoverage=97%, HitCoverage=100%, E-value=1e-144, Identity=69%"; Hit description =Putative alcohol dehydrogenase
  Pfam annotation: Domain name=DHQ_synthase; Domain location=10-252; Score=-142.8; E_value=0.052; Accession=PF01761.10; Description=3 -dehydroquinate synthase
  Pfam annotation: Domain name=Fe-ADH; Domain location=4-369; Score =184.7; E_value=2.2e-52; Accession=PF00465.9; Description=Iron -containing alcohol dehydrogenase
  Pfam module annotation: Pfam domain module=DHQ_synthase::Fe-ADH; Domain location=10-252::4-369
MNINSTVISGYQALNDLSYLLQDKQKALLVTDKNILGIPAVQALIARLQQQIASLSLVDTVPPEPSQHDVAAIVAALPHGDVDLVIGIGGGSVLDVAKLLSVLCVADAPTLTALLAGEKPHTRTASLLIPTTAGTGSEATPNAILAIPEKETKVGIISPVMLPDYVALIPELTTSMPAHIASSTGIDALCHLIECFTATVANPVSDNYALIGMKKLFASLEKTLAEPDNLEARLNMLWASYYGGAAIAHAGTHLVHAMSYPLGGKYHLPHGVANAILLAPCMQFVRPAAVSKFAQAYDLLPDANSALDEEAKSHALVAYFAALVQRLKLPASLEALGIGPDHLPYLVEAALDVQRLMKNVPMKVSADDVRNVYLTLFPALNHSA

SEQ ID NO: 229447 - protein, 442 aa, Glycine max
  Coding DNA Sequence Number=SeqID_112669
  Gene Ontology: Mol. function=transcription factor activity; Cellular component=intracellular; Biological process=regulation of transcription, DNA-dependent
  Homolog annotation: Hit_ID=Q6D1W3; Match level="QueryCoverage=46%, HitCoverage=84%, E-value=1e-104, Identity=82%"; Hit description=S -adenosylmethionine decarboxylase proenzyme (EC 4.1.1.50) (AdoMetDC) (SamDC) [Contains: ...
  Homolog annotation: Hit description=S-adenosylmethionine decarboxylase beta chain; S- adenosylmethionine decarboxylase alpha chain]
  Pfam annotation: Domain name=DeoR; Domain location=76-231; Score =145.0; E_value=2.1e-40; Accession=PF00455.13; Description=Bacterial regulatory proteins, deoR family
  Pfam annotation: Domain name=HTH_11; Domain location=6-57; Score =11.0; E_value=0.0056; Accession=PF08279.2; Description=HTH domain
  Pfam annotation: Domain name=HTH_5; Domain location=3-51; Score=10.7; E_value=0.031; Accession=PF01022.11; Description=Bacterial regulatory protein, arsR family
  Pfam annotation: Domain name=HTH_DeoR; Domain location=6-62; Score =60.6; E_value=5e-15; Accession=PF08220.3; Description=DeoR-like helix-turn-helix domain
  Pfam module annotation: Pfam domain module=DeoR::HTH_11::HTH_5::HTH _DeoR; Domain location=76-231::6-57::3-51::6-62
MKGQSRLDQIMDYLKSHNLVTVEQLVSAISASPATIRRDLIKLDKEGVISRSHGGVTLNRFIPTQPTTLEKMQRNLAEKQAIAQFAASYVQSGDAVVLDAGTTMLELARQLTHLQLRVITADLHIALFLSEFKQIETTIIGGRIDDSSQSCIGEHGRRLLRSINPDIAFVSCNSWSIERGITTPTEDKAGLKMDMLANACRRILMADSSKYGSWSLYCAAPIDSLTDVVTDSRLDEAVILQIKFLQQHLGMKDVFLINVNVHHVVHRFHILGHEVLNRIDLMVDEMLHAIDVAGEAAHAVIHGHDIRLQLVDEIIQRLQGRNHAAGRDFNVGAEDVTLVEVRHHRTGQRAGMLGIIDILRIDRLFADQNRHAGTLRLIILARDIQHVSTDNRAGLGEDFRQAVGVILLINIGDIAITFGFAIGIANVVDTKTQAFGQIIEAM

SEQ ID NO: 229448 - protein, 72 aa, Glycine max
  Coding DNA Sequence Number=SeqID_112670
MVAISPTKITQPSFPQGYNSNVTWAYHGGVPGHSIEHCMTLKHKVMTNNSSRYAETYTGVGSSGLRIIKKGG

SEQ ID NO: 229449 - protein, 75 aa, Glycine max
  Coding DNA Sequence Number=SeqID_112671
  Homolog annotation: Hit_ID=Q9SD67; Match level="QueryCoverage=57%, HitCoverage=5%, E-value=3e-11, Identity=75%"; Hit description=FtsH metalloprotease-like protein
MHVCVHYGKILPTPYVGGNVLKIMTRPCLKGIEEKTANLEGSEKALVARHEASHAVVGTAVANLLAGQPHVEICG

SEQ ID NO: 229450 - protein, 60 aa, Glycine max
  Coding DNA Sequence Number=SeqID_112672
MAPKYLMDLLWDTTCLCGCEIYRQVHRAVKHLQTEIMIVNESKSMFYPNYKAINMSKLKY

SEQ ID NO: 229451 - protein, 139 aa, Glycine max
  Coding DNA Sequence Number=SeqID_112673
MPQDAVVGLCLERWACLALCHSRERFGLSRAWGALSEWMIEIFSKFFPHPMLQRSFCQPDASSIGACRPRIFFINGFLCFLEDEWQRNGERERERRRHFKEKMSLEEAHHHRRPWIRAWRKKEMNEGRGREEHEILCSK

SEQ ID NO: 229452 - protein, 75 aa, Glycine max
  Coding DNA Sequence Number=SeqID_112674
  Subcellular localization annotation: CTP_CleavageSite=58; ConfidenceScore=5.14e-01
MVLFSEGALSKSVSLSAQWPPRRENHPPPDLKNLMTLRDSFLRSLGSVMSRTCIPETVEAMLSKFILMMPKTRVK

SEQ ID NO: 229453 - protein, 147 aa, Glycine max
  Coding DNA Sequence Number=SeqID_112675
MVRLLSWPPAMVFHFFGRIESMVRLFNVLSVPVEFANCYGLPFLRRVDQMVRWLFNLHFTPPLEQQACGRPLLAARMHVWTLELTQSLLGDPKPLVLPPLVAIHLPSCGFHMTILRRFGPPLQWPVLPVGPGFHDKCVARPWYRFLA

SEQ ID NO: 229454 - protein, 289 aa, Glycine max
  Coding DNA Sequence Number=SeqID_112676
  Pfam annotation: Domain name=DUF1675; Domain location=89-258; Score =69.8; E_value=8.7e-18; Accession=PF07897.2; Description=Protein of unknown function (DUF1675)
MEDYKKNHPYQQQQQHQHQQEEEKEVVCEKMERYPRDLLQGFSISGVATIRDDNNKINNNNMMQQQHHVLHHHHEQQQQQEQHEEDDEEVELNLGLSLGGRFGVDKNAKKKRLLRSSSVVGTMPLFRQDDAVAPSAAAFPALMRTSSLPTETEEEWRRRKEMQTLRRMEAKRRRSEKQRGSREVFAGAGEEVEAGGTMAMGFNKFGSSAVAVPPPGWGVPAKQVVLGDVLGKGRGFQGLFGQPSSQGSADSQGGSSSSMSEMDSKAFLDCGSRCGETENLCRKMWPLRL

SEQ ID NO: 229455 - protein, 142 aa, Glycine max
  Coding DNA Sequence Number=SeqID_112677
  Gene Ontology: Mol. function=RNA-directed DNA polymerase activity; Biological process=RNA-dependent DNA replication
MVERGNFDHIKERLRAIKGGDNYAIADMAELCLVPNVVIPLGFKVSDFDKYKGTTCPKNHLKMHCRKKGAYAKDEKLLMHFSQESLTGAALTWYTNLEPSRVHSWKDLMVAFIRQYQYNSNMAPDRMQLQNMCKKEHESFKE

SEQ ID NO: 229456 - protein, 356 aa, Glycine max
  Coding DNA Sequence Number=SeqID_112678
  Gene Ontology: Mol. function=UDP-N-acetylmuramate dehydrogenase activity; Cellular component=cytoplasm; Biological process =peptidoglycan biosynthetic process
  Homolog annotation: Hit_ID=Q4UTX4; Match level="QueryCoverage=62%, HitCoverage=63%, E-value=5e-73, Identity=63%"; Hit description=UDP-N- acetylenolpyruvoylglucosamine reductase
  Pfam annotation: Domain name=FAD_binding_4; Domain location=160-293; Score=44.9; E_value=2.7e-10; Accession=PF01565.13; Description=FAD binding domain
MLVKVAPDLSERDIDAAARVLGELQQGGRRPAGQRGRRPVRCAGAGAVHAGAAPPAFAPARIGTADRCRRHPVRCRCGGQDGRRRGAGAVLQRPDLPWPGAGLRMRGGDPSPSRSTKPRRGGPTVSAPMDTVDGNAPLRWTLTRNAPLQALNTFHVQASAAQLLELHDAALLPDVLALPEVANGPLLVLGSGSNVLIAEDLLGTVLVFGNRDISFLEHRADHAVIRAGAGVPWHGLVMWSLQEGLSGLENLALIPGTAGAAPIQNIGAYGAQVGEFIQAVEAWDCQERAWVRLDNEQCGFAYRDSVFKQQPDRYLITAIELKLPLLHDLRMDYAGIREELQAQGVELPSAVHVANA

SEQ ID NO: 229457 - protein, 249 aa, Glycine max
  Coding DNA Sequence Number=SeqID_112679
  Gene Ontology: Mol. function=dihydroorotate dehydrogenase activity; Cellular component=membrane; Biological process='de novo' pyrimidine base biosynthetic process
  Homolog annotation: Hit_ID=Q9F1U7; Match level="QueryCoverage=83%, HitCoverage=59%, E-value=1e-90, Identity=79%"; Hit description =Dihydroorotate dehydrogenase
MAGSQGFLAVTQLADQLAQRGFFLQLTQAGGVGRGDVDRDVVGQRIDLVQAGDVIVHRLFVGGVLVLADVDAEQAATVARAFDVAHQRVHARIVEAHAVDDRIVRRQPEQARLRVAGLRTRGDGADLDEAETQREQCIDVLAILVQAGGQADRIGERQPKHRARHRRDACGQQRRGAGAIGQVQCGQAEAVGALGVEREQEGAGKRIHASVQSSVPRNARVRYSKATWPSTAWAANRSCRAAIISAWRG

SEQ ID NO: 229458 - protein, 46 aa, Glycine max
  Coding DNA Sequence Number=SeqID_112680
MMHAPDSTLRCNVGTVLSLSRSPGYARNSPPPIGDQPGSPKVFPTR

SEQ ID NO: 229459 - protein, 54 aa, Glycine max
  Coding DNA Sequence Number=SeqID_112681
MAIQFKKKTNVNQKQIFIVNQRIKNRCLGEKFPSNDTKNLIELGKCTGHTSSIK

SEQ ID NO: 229460 - protein, 85 aa, Glycine max
  Coding DNA Sequence Number=SeqID_112682
MAWEMITMIVDTLPVLYYEKMVGYKPSSFANLVFIGDRIEVGLKRGKIDNPVLMNGKPGANREDEKAEGTHVVTAIPSWPNFPPA

SEQ ID NO: 229461 - protein, 192 aa, Glycine max
  Coding DNA Sequence Number=SeqID_112683
GQWFFKKNIGVNVEDDDLTVDTRLSPFSTQMPPTVNREEEVDNERLVVHVDLATRKSDGPHKKKFIMYLGIITQDMVDATIDNWKQVPIAQKDLIWEDIQLDLTSKWALADDKEGEDDKDVLIAIIGQPEHPGHVRVAEPMQSQMPLRMQSQRLGLPFEPEVGPSAASVSTKENYVDLLGQDPDTGGSKKSG

SEQ ID NO: 229462 - protein, 269 aa, Glycine max
  Coding DNA Sequence Number=SeqID_112684
KDSFITHRAFCDALAEESARLSANQLAAVATTTSNPFQSLHLFQTQQQNFQNHQISSFNQWDSSQENPNPTNIIATTSLHIKPESQTFHNPTLSSLLQQQQPTNNKGMIASTFGNLHVATQASATSAYMSATALLQKAATVGAAAITGPVGPQQRVTGHVNHVTHHLGSGEFGIGTVSQLDPVVAVPDNNYMRTTFKGDRLTRDFLGLTADATGGAVDVSTNVKDMLTFAGGVEYHQPHRQHHHHALLKPQQGFGFLGTATAPETWGNC

SEQ ID NO: 229463 - protein, 142 aa, Glycine max
  Coding DNA Sequence Number=SeqID_112685
  Homolog annotation: Hit_ID=Q1SAS4; Match level="QueryCoverage=49%, HitCoverage=3%, E-value=7e-19, Identity=57%"; Hit description=RNase H, putative
MGPHQEETELVDLGTDSAKKEVKIGTGMTAPIREELIALLNQDIFAWSYLDMPGLSFDIVKHRLPLNPECSPVLRLQSDNVATYPSAGGRRVTRGMRVPRKEYARSRHQRLFEENVGKTGKDAIYELLSERFGSCIYARGRY

SEQ ID NO: 229464 - protein, 65 aa, Glycine max
  Coding DNA Sequence Number=SeqID_112686
MELRTPIKVENGVPANMLVPLAVPIGQRAVLLGPREAVQFKQAIYYMHFHFSKYTLYPILPLNYP

SEQ ID NO: 229465 - protein, 139 aa, Glycine max
  Coding DNA Sequence Number=SeqID_112687
  Gene Ontology: Mol. function=ATP-dependent helicase activity; Cellular component=integral to membrane; Biological process=transport
  Homolog annotation: Hit_ID=Q9LIL4; Match level="QueryCoverage=98%, HitCoverage=64%, E-value=9e-62, Identity=79%"; Hit description =Coated vesicle membrane protein-like
  Pfam annotation: Domain name=EMP24_GP25L; Domain location=1-47; Score= 13.6; E_value=0.041; Accession=PF01105.14; Description=emp24gp25Lp24 family
PGGNLAYSLNGTSGDKFQFKASQNGIYKFCFHNPASTPETVSFYIHVGHIPNAHDLAKDEHLDPINVKIAELREALESIISEQKYLKARDARHRHTNESTRKRVVFYTILEYVLFAATSLLQVVYIRRLFSKSFAYNRV

SEQ ID NO: 229466 - protein, 102 aa, Glycine max
  Coding DNA Sequence Number=SeqID_112688
MTSGLAPVMLAQPGGSSGERVETRGYDDLMTTFGQGQLLKSLTIRYLLVDANTSYFALIGRKTLNKLGVIVSMWHLKMKFHTLTGEIVTIKEDQKEAQKCYS

SEQ ID NO: 229467 - protein, 193 aa, Glycine max
  Coding DNA Sequence Number=SeqID_112689
  Gene Ontology: Mol. function=RNA-directed DNA polymerase activity; Biological process=RNA-dependent DNA replication
MRDHKAQELASVDPESTFFQVEAHVIFVELFQDLFQIYHVLGYALGFDNHVVNVDLDISFDLLLEHSVHQSLFYLEQTSRKLSTWNLEAPSTSLLRLGRGDAPMFMAGEVPTELHTLPVFGFELQLDELFDGLLASSRSVTARIYIEFVVHAHLVDDQGSDGRPFVHVHDLTTLSLYRVRLGRLPSGRIGCHL

SEQ ID NO: 229468 - protein, 95 aa, Glycine max
  Coding DNA Sequence Number=SeqID_112690
MSLAVDGTYQRLSGVLFHTCHSPWVARIGDLVLKGELTKGSPWVLRASELQLWILFAPLSRLAMTMNGPSQLGPSFLAQGSLLASPRTRHMRSPG

SEQ ID NO: 229469 - protein, 125 aa, Glycine max
  Coding DNA Sequence Number=SeqID_112691
MPPVHVSSRVTHMQEHNITSPVRDTYARARCPKPRSNNSLVDPPKGSQNPRSALGIQVYKKPRSLLGTKNPRSTLGMHAYKTQGTPLVCSFAATTTAKVQGLGSMSQDDLPLNWLARASTKCSPN

SEQ ID NO: 229470 - protein, 124 aa, Glycine max
  Coding DNA Sequence Number=SeqID_112692
MLVLANTDLRYIPSKVAKGSHVEERDKMACKSNELIGHTIQGDQTNLASQIHLDEKQEDWHTRSNVEEGAQNFKGPHHGPPIRAELGRGHIQVLKKSTQKSGQGKNEAQYHKQKPVHGKERQIT

SEQ ID NO: 229471 - protein, 257 aa, Glycine max
  Coding DNA Sequence Number=SeqID_112693
MGLRALRQAVEMTPGMGPPSSLQDLPPAPSVVEAPALATTVAATLAPPCPPVVPVWEVTPVVGVDALATSVSFVAASTSTVTTPLLSDDVATTSAPVMLPPHFLAPSVPPSTMLAVASPSLSSRPHVFLDHLYTSSDVDSLWEWAAAPGGFAQVVILGDEECLKVANTTITFAEAISSNHQLSSKVGNVLAKLLSTWLDSDELFARCKGIVAEKDKLAKVVANLEARLKESVFGLEESELQVVEEREDNKELEEELK

SEQ ID NO: 229472 - protein, 62 aa, Glycine max
  Coding DNA Sequence Number=SeqID_112694
MADGKLIEKKGRVNLGLKSENDCGKAWAVQRRKMNDQSEGKSHFKGKLGVEESNFDSVEFSS

SEQ ID NO: 229473 - protein, 92 aa, Glycine max; identical to SEQ ID NO: 151243
  Coding DNA Sequence Number=SeqID_112695

SEQ ID NO: 229474 - protein, 67 aa, Glycine max
  Coding DNA Sequence Number=SeqID_112696
MVTSMLQLDSMNLFVKARAWFNPITQGMAILIANTSSTIHRDARLENMHAMHGKFEGENARVTHEQT

SEQ ID NO: 229475 - protein, 316 aa, Glycine max
  Coding DNA Sequence Number=SeqID_112697
  Gene Ontology: Mol. function=transporter activity; Cellular component= outer membrane; Biological process=transport
  Homolog annotation: Hit_ID=Q2P1Z2; Match level="QueryCoverage=77%, HitCoverage=23%, E-value=1e-89, Identity=67%"; Hit description=TonB -dependent receptor
  Pfam annotation: Domain name=Plug; Domain location=90-199; Score =74.4; E_value=3.6e-19; Accession=PF07715.5; Description=TonB -dependent Receptor Plug Domain
MSLQIRSIQVVRATSPDQSRREGEMGMKHSTRTHGQDVLALAIALALAAAVIPAGAAAQQAASTGAQDATNLDSVQVTGYRYAIEKSLEQKRDANAVVEVITAEDVGKFPDKNVADALQRVPGVVITRSGGEGKTVSVRGLAPDLTLTQLNGNYVATSETNDEATRSFNYTLLPSNMLSSAELFKSPEARIDEGGIGGTVILHTRRPLDMESNSGFVTLEGTSSDTHHDIDPQASALYSWHSKDERFGVLIGVTQQKRTTRTMEASTEDYQWYGAGKARDAYGNVQAQDGIHYWWGKSGFNNQTGGNYSDFFMPTS

SEQ ID NO: 229476 - protein, 378 aa, Glycine max
  Coding DNA Sequence Number=SeqID_112698
  Gene Ontology: Mol. function=DNA binding; Cellular component =chromatin; Biological process=DNA integration
VFAPVARIETVRIITAIASKKGWHMHHMDVKSAFLNGPLEEEVYVSQPPGFEIKGSEEKVYRLNKALYGLKQAPRAWNRRIDGFLMKLGFLKCTTEHGVYIKGNNTTNLIVVFLYVDDLLVTGNNETEIANFKGEMTREFEMTDLDLISYFLGIEFKRTDEAVIMYQGRYARDVLKKFRMVDCNSADTPIATGVNLVKDPNEEEVDVLSIMVLCFPVLPKNVMFWDIVILIGVEIRVIGRAQQVMCSSMVMPQSRGAQRRNKWWLSPHEAEYIAAAMAACQAQWLDNIFGELKMKEKGAITMMVDNKSAINLAKHPVAHGRSKHIETRFHFLREQVTKGKLSVKYCPTTVQVADIFTKPLKIDQFKELRSRLGVIEVQ

SEQ ID NO: 229477 - protein, 205 aa, Glycine max
  Coding DNA Sequence Number=SeqID_112699
MEGNLYFTINGVEMIIDAGVWKKVVGIDMGGIRKFEEFAYGYNKMQTYRGMLLDPTRILRNRLGVGGLIVEDRMLVYLITYILPLRSSNNAQVTDDDLQIVYGMKSSIQMNWILLIKDIMLKSHQLVDYEFPYVVLASGFIDYFNIDVSNEIVDFTKASNEITKRHLKKLGMRYVYHELIMVREPPTAENINQMEEEAQQEPAQQ

SEQ ID NO: 229478 - protein, 79 aa, Glycine max
  Coding DNA Sequence Number=SeqID_112700
MGPKSTLRLMRTLGPSPASLPNLLGVFYRMPLGGRIASPSMSDLWDVYGEWDETYMFIRHLPSYRELAMLELVTADNVH

SEQ ID NO: 229479 - protein, 212 aa, Glycine max
  Coding DNA Sequence Number=SeqID_112701
  Gene Ontology: Mol. function=serine carboxypeptidase activity; Biological process=regulation of GTPase activity
  Homolog annotation: Hit_ID=Q2PER6; Match level="QueryCoverage=51%, HitCoverage=22%, E-value=2e-34, Identity=70%"; Hit description =Putative Asp1
MAPARYRLMKDIYTRSQLEALAANKEGFFARKMAENKSRPEGLPPSQGGKYVGFGSSLTSSPQRRNDAQNDYFSSVSQGIRKLSLVAASMANVVQAGMKEFTSKPQEATVDLPYVAFAVRPNPGVWEFPPVDFQHYAGYVTVNETNGRVLFYWFYEAMTKPQDNPLVLWLNGGCSSVGYGATQDLDPFLADTDGRGLKFNNFSWNKGMKREI

SEQ ID NO: 229480 - protein, 97 aa, Glycine max
  Coding DNA Sequence Number=SeqID_112702
  Subcellular localization annotation: CTP_CleavageSite=54; ConfidenceScore=5.43e-01
MGCRLSKNHKIDIKITSKKQSEILAKNRFTRSRPNSNLRFSKLTPSPLFLSLPSARHSDALASIKKYNSMSDGKLLQIEFVGTYACSATPVVTPLSN

SEQ ID NO: 229481 - protein, 201 aa, Glycine max
  Coding DNA Sequence Number=SeqID_112703
MPRTMSSQSSTNFGQSNLLPGLVVHRFDATFDVHKNYIEVPLAYHRQWYPRYPSFVVFNCNGINHFMIRLQKYGERYFFADRLNEFRRTMKIFETVKITFVAPDKDTTFHVLPTDALKFLVASKKCIHVKRSHGRRYLWKMTMDNGLPSVVDPWYEYLTENDLMSGDEVVFYYRFNERAWEVMFRKHVKWDEVGCLLLFDD

SEQ ID NO: 229482 - protein, 227 aa, Glycine max
  Coding DNA Sequence Number=SeqID_112704
MSRSRRWIDMNPELEHLLANVPKITPEEQPEWKELTKKIQDTVAPPDAIFVIVSARDQIFGEVGKVYTVKFKDVLEGVWHLVDRDDTYHTVVYNRDLDQPAIVAGWTALCHFYHLTIDHLVSLHHYGFLACRSHSLSGTLCIIKCLDIPSTIYYILKDKGWYNLHLGNVAECRLVFNHHRMPLKIGAGWKQFYQTLSLDAGAKIVFEFINPRVNCVLYWLCSVDEMR

SEQ ID NO: 229483 - protein, 37 aa, Glycine max
  Coding DNA Sequence Number=SeqID_112705
MGILVWSEDLRSVNLSHELALTLLDIPGGGKRMVKEF

SEQ ID NO: 229484 - protein, 318 aa, Glycine max
  Coding DNA Sequence Number=SeqID_112706
  Gene Ontology: Mol. function=RNA-directed DNA polymerase activity; Cellular component=viral capsid; Biological process=RNA-dependent DNA replication
MRTIPFTGTSQTVSGHNPVTESINQHPGILNRFFRRKNSQTIQLEQIVDIGSNIDIGSNSRINSFNPRQLYNLNWLSSDRTSLYRYKRINDFYLLAGRHEIITLTSEQTGRQHLSINRRYVHPGLIAIGVRSLTRSFVGAKAFVVLFDQRFRDNNSQTIIGMIEIDLNQTVSLMYITPNYTVNLSDFIQNINLEVQTIGFGRNFVGHNLHLDITFIVRISGQISPRYRINTNPLVTTLSSDGIQFLPPEIFYSSRNQNNQWQTHNNVGSFRSAITTPGPTIITNRRNSLSISNIEEPETTTELNKIYEEGEEKKLKRR

SEQ ID NO: 229485 - protein, 73 aa, Glycine max
  Coding DNA Sequence Number=SeqID_112707
REFAKRNLQWLSARKNPEEDELSSSLSASLQVIKRTASAHLLRETSALSQNLLMRAKRCRSVLSAQARTRPPI

SEQ ID NO: 229486 - protein, 198 aa, Glycine max
  Coding DNA Sequence Number=SeqID_112708
  Gene Ontology: Mol. function=protein binding; Cellular component =anaphase-promoting complex; Biological process=regulation of mitotic metaphase/anaphase transition
  Homolog annotation: Hit_ID=Q9ZPW2; Match level="QueryCoverage=53%, HitCoverage=52%, E-value=6e-15, Identity=45%"; Hit description =Anaphase-promoting complex subunit 10
MKNQVKGLIGKDEDLQFIMEIVNQRQLLRHQTNGTNNIKKVHWRHFKKVIALGMDCITISLGIGHLMMCHLPNMCTSRRSLERVTAFEDDGDYQLQAVDANNQQNFDQTQSSHNDTTLRKPTTSSIRTNSFVEPSNKNNVVGAQSSKLSTLPVNKLIVLYVVFKLDESYTPSKVSILAGDGFHNLKEIKTVELVKPTG

SEQ ID NO: 229487 - protein, 159 aa, Glycine max
  Coding DNA Sequence Number=SeqID_112709
  Gene Ontology: Mol. function=RNA-directed DNA polymerase activity; Cellular component=chromatin; Biological process=RNA-dependent DNA replication
  Subcellular localization annotation: CTP_CleavageSite=64; ConfidenceScore=5.52e-01
MIQSKIASAFFHIRIEPPSTQTSTSPQQMSTINTLTQKYSSLFQPLTTLPPSRPTNHTITLIPNASPVNVRPYRYPCYQKQEIESQVAFMLKHSLIQPSTSPFSSLVLLVKKHDGSWRFCVDYRALNAITVKDRFPIPTVDELLDELGGTKWFSKLDLM

SEQ ID NO: 229488 - protein, 139 aa, Glycine max
  Coding DNA Sequence Number=SeqID_112710
MAQQGVKANLGWGRVFNWFNGNRVQGREGGERRLKGMEGEGCLVGLGSRGVGETGGGGHGPSGLVAREAVWINDGSCKDPRTLMGQTRLQGHEREEGQTNKSTQSDQSRRSKELRASNDVEYQMVGKSPILVDMERWDE

SEQ ID NO: 229489 - protein, 111 aa, Glycine max
  Coding DNA Sequence Number=SeqID_112711
  Homolog annotation: Hit_ID=Q0ZCF0; Match level="QueryCoverage=90%, HitCoverage=7%, E-value=1e-11, Identity=35%"; Hit description =Transposase
MYFHPKLQTRCTQVPQNDDGGHHMVNQCLSIFKYPYRSIGSGSNRFLTEVEVQIAETYVLVNCKEIEPFLQQFEDLLRQSYLGIADVQILKLRDENFNGWLKQLVSIFIYY

SEQ ID NO: 229490 - protein, 74 aa, Glycine max
  Coding DNA Sequence Number=SeqID_112712
MEGLRVLATAYQVSHQRHTGKEHEIQQGRNDPVSAPQCHYRDGDILVRHHFQLLCATSLCFSCGGPKLKPNGAE

SEQ ID NO: 229491 - protein, 42 aa, Glycine max
  Coding DNA Sequence Number=SeqID_112713
MAYVGCFMQKYCLVVGGSLNYEVEMRKARYDALKLSISTLFD

SEQ ID NO: 229492 - protein, 150 aa, Glycine max
  Coding DNA Sequence Number=SeqID_112714
MIAKFGYDNSLSEGRWLEGQYLMAQFWCKAGNGATHQECWSKAHNAISQVFEFRECCLGGIEFQIQCYLGLGEGRVTLGKAINRFFQPLSYGLEGIVARHVGWQVGPVVRSLGSKKTNKRRRTNKSLDNGISEMVECVGSGICYWCLGLK

SEQ ID NO: 229493 - protein, 104 aa, Glycine max
  Coding DNA Sequence Number=SeqID_112715
  Gene Ontology: Mol. function=RNA-directed DNA polymerase activity; Biological process=DNA integration
MLPLYMYKVEMIGEASSMFTIKVKGHSVVHEASGLQVSSLCFNFLLMKKIQGLQAPMELHQREFKDAFPKEIPHGLPPSRGIERQISLLPKASLPNRPTYKSNP

SEQ ID NO: 229494 - protein, 102 aa, Glycine max
  Coding DNA Sequence Number=SeqID_112716
MVSRCDGDDGGNGTPISLDNATKNHMLGHYAKILVDLDLLGSFPSDIMDLNHISNLWVDMVDEDTESISPAHYLAIDDVGSTTIISQSQQKKTRQKKNKTLV

SEQ ID NO: 229495 - protein, 227 aa, Glycine max
  Coding DNA Sequence Number=SeqID_112717
  Gene Ontology: Mol. function=phospholipid binding; Cellular component= coated pit; Biological process=endocytosis
  Homolog annotation: Hit_ID=Q9LHS0; Match level="QueryCoverage=92%, HitCoverage=51%, E-value=2e-47, Identity=38%"; Hit description =Putative clathrin assembly protein At5g35200
  Pfam annotation: Domain name=ANTH; Domain location=14-216; Score =108.9; E_value=1.4e-29; Accession=PF07651.6; Description=ANTH domain
  Pfam annotation: Domain name=ENTH; Domain location=14-125; Score= -37.0; E_value=0.056; Accession=PF01417.11; Description=ENTH domain
  Pfam module annotation: Pfam domain module=ANTH::ENTH; Domain location=14-216::14-125
MKKAFRLTKVSGDHKGLDAAIVKATGYEHLLPKEKHIRTIFQSLSPSKPRSEVVYCIHGLTTRFSQTNNWAVAMKTLIIIHRAIRELDTSILEELVNYSQKYSQKLDTQDLLEQLPVLQNLLSRLLDCKVASESVKLYVAITIRVVELLDKFFEMHHNDACSSLQIYQKSMSQAERLTEFFETCKGLEFGKGQKFINIKMPPASFIITMEEYIKEAPSSLMLEYNMV

SEQ ID NO: 229496 - protein, 69 aa, Glycine max
  Coding DNA Sequence Number=SeqID_112718
MNKKGIASTPVDMFMAKRKDVPQWISGKDDLHKHDLHNVVAVTEAQATLTQGERRRTIGFKCKEKEEER

SEQ ID NO: 229497 - protein, 115 aa, Glycine max
  Coding DNA Sequence Number=SeqID_112719
MGTGYGRERLKAKHKVDHKYENHQKVNGKQSAFGAKVKERPSGLKVANQLLATLPMVENNIAPKMTSSARVPQVITEDCNGKIEMQQHTPDDTMMCNRGLGTSCKGGVMVVELMP

SEQ ID NO: 229498 - protein, 108 aa, Glycine max
  Coding DNA Sequence Number=SeqID_112720
MHETSGFSSSGDNIEHRNIVRSPTGNIVPLDLEIEATLRRNRAERRRKLLQDRKIASILEEEAQSSDSTSSDSLSSRESAIYLPEASVMADEHHKRVILEDYSSSSVS

SEQ ID NO: 229499 - protein, 114 aa, Glycine max
  Coding DNA Sequence Number=SeqID_112721
  Homolog annotation: Hit_ID=O65047; Match level="QueryCoverage=98%, HitCoverage=72%, E-value=8e-17, Identity=60%"; Hit description =Hypothetical protein Sb07
MNSGCFGCCVKPTPIIAVDEPAKGLRIQGQTVRKPHISDGFWSSSTCDLDNSNIQSQRSISSVSTSNQILYHSGGTSTPGANPEFAFFSGMRAGFSGLEVANLGSMANKKENPD

SEQ ID NO: 229500 - protein, 134 aa, Glycine max
  Coding DNA Sequence Number=SeqID_112722
MARTRGLGRAIGRLVGRDRHDDHAAADVPERRRPTASARRQQVHQMTTDARYLAEEVADMTDDVPDLAEEAPEMLADVEGADGAEGSDADDATEGFPGRPRDPSVLTSFADHVAHAVWSGHERPDLKLVLHGRK

SEQ ID NO: 229501 - protein, 117 aa, Glycine max
  Coding DNA Sequence Number=SeqID_112723
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=94%, HitCoverage=50%, E-value=4e-27, Identity=45%"; Hit description =Protein ULTRAPETALA2
MANRKNSAMRKQNFHRGEFLCCTRYGKERRFHLKSKLDIKNYHDALNNKCWTCSLWPYQKITFNDDDERSSLKASRGCSRSSTCQGCSTCYCEGCIECHFEDCNCQECKDFMLYVEP

SEQ ID NO: 229502 - protein, 156 aa, Glycine max
  Coding DNA Sequence Number=SeqID_112724
MRKWALATDQDGVEDTVCDKYGISKEKWAQFCQTRRDPSWEKLLAEKTKKKLQEAAQSGSVDGVIDPPSPVRRHVKWKMARTKKTGEMTTEATKEIAEKINSFEEQPHRDRSSPMDVRMFWPLLLDVQSTLDVSVPARGVHHRESDEAGHGILQPA

SEQ ID NO: 229503 - protein, 354 aa, Glycine max
  Coding DNA Sequence Number=SeqID_112725
  Gene Ontology: Mol. function=3-phosphoshikimate 1-carboxyvinyltransfer ase activity; Cellular component=chloroplast; Biological process =nucleobase, nucleoside, nucleotide and nucleic acid metabolic process
  Homolog annotation: Hit_ID=Q0Z5L5; Match level="QueryCoverage=96%, HitCoverage=56%, E-value=1e-125, Identity=65%"; Hit description =Cytidylate kinase:3-phosphoshikimate 1-carboxyvinyltransferase
ADEVRPFLNFGAQLAQLPGHGRDARGKTIGIQGHDGQRHGGIGDVVAVQVDGLERPCATAYAQTVRASLHLGAHGARGFDKADIALDGVQSHAEDADAFGAVRGDGAQCDEVAGRRGVCLDMDIARRAVATAGRDGEALPVLVVHGNAEAGQQFQRDVDVGLGDQLATTSMVMSRVLASSGSAISSERRKALVAQIVDAAAELAQRIDQIADGALMHARHAAELEVAAQHGQGCHQRPHGRAGVAHEQFGAGAGGQDAAQAGDAHGLAKGDGRGLHRAAQLLQGPEHDARVVRVEQVVDHGRALAQCREQQHAVRDALGARQAHRALRAGKRGDVEKGGTEHGDSDANRLSRGI

SEQ ID NO: 229504 - protein, 158 aa, Glycine max
  Coding DNA Sequence Number=SeqID_112726
  Gene Ontology: Mol. function=ribonuclease activity
  Homolog annotation: Hit_ID=Q9LZA0; Match level="QueryCoverage=70%, HitCoverage=14%, E-value=7e-44, Identity=75%"; Hit description =Ribonuclease II-like protein
VFLIHIGATFSYGGVLLGALLTCTLLKLDAHDAAHLHPAPAGSCQCGAIETATLDTRIKVSNPEDPEPSMKLYVENQADPAMRLVSEMMILCGEAVATFGSRNDIPLPYRGQPQSDMNVSEFSHLPEGPVRSFALVRVMRAAEIDFRKPARHGVLGIP

SEQ ID NO: 229505 - protein, 51 aa, Glycine max
  Coding DNA Sequence Number=SeqID_112727
MRIDEFCALCHSDFTSRVINAQRQILRPLSFGDSSAGREVHWPNGVSLERN

SEQ ID NO: 229506 - protein, 57 aa, Glycine max
  Coding DNA Sequence Number=SeqID_112728
VVIIKKGEIVEAKLHGESKGFASWIGQLTGGHGKQVAPDTTRMEASPCHFLSLCNRH

SEQ ID NO: 229507 - protein, 68 aa, Glycine max
  Coding DNA Sequence Number=SeqID_112729
MVKASLLFPCSIVLFLVVSTIGFANANACTKCDLEHDCGHLHCFGPRCLKECIDGCCGCNCRPPSKIV

SEQ ID NO: 229508 - protein, 120 aa, Glycine max
  Coding DNA Sequence Number=SeqID_112730
MVVPNFLGLGLRLSFSMHCGAKESRVGIKRKETRILKGEYLLHVNSSLVGTTPCFCSSTIGNHKQESHVELSFGSDIDVAVQEAPNYFYFVAKTNKIGDVRIHTMEIHLNGTKIVVKNNN

SEQ ID NO: 229509 - protein, 163 aa, Glycine max
  Coding DNA Sequence Number=SeqID_112731
MRSKKETLRERKEEGSTHGGDFTVEAFNEGSDGADPRTGSERRGGMEAVAPPRNGAEEGTSGGGEGRSAGSERSEVSRRRGKEEFRPGCSEERRGRGRGRCYIHVGQPGQGWVEKRLKSDQNCNGFVLWRLLLRRQREKWKGMVRALMMMTMTIDCGTIEAEL

SEQ ID NO: 229510 - protein, 121 aa, Glycine max
  Coding DNA Sequence Number=SeqID_112732
  Gene Ontology: Mol. function=4 iron, 4 sulfur cluster binding; Cellular component=mitochondrion; Biological process=tricarboxylic acid cycle
  Homolog annotation: Hit_ID=Q9SIB9; Match level="QueryCoverage=94%, HitCoverage=11%, E-value=4e-55, Identity=88%"; Hit description =Aconitate hydratase 2, mitochondrial precursor
MMRGNLTSLPKPGGGEFGKFYSLPSLNDPRIDRLPYSIRILLESAIRNCDNFQVKKEDVEKILDWENNSTKQVEIPFKPARVLLQDFTGVPAVVDLACMRDAMNKLGSDSNKINPLIFEGE

SEQ ID NO: 229511 - protein, 658 aa, Glycine max
  Coding DNA Sequence Number=SeqID_112733
  Gene Ontology: Mol. function=4 iron, 4 sulfur cluster binding; Cellular component=mitochondrion; Biological process=metabolic process
  Homolog annotation: Hit_ID=Q6YZX6; Match level="QueryCoverage=99%, HitCoverage=72%, E-value=0.0, Identity=88%"; Hit description =Putative aconitate hydratase, cytoplasmic
  Pfam annotation: Domain name=Aconitase; Domain location=1-328; Score =181.3; E_value=2.3e-51; Accession=PF00330.10; Description=Aconitase family (aconitate hydratase)
  Pfam annotation: Domain name=Aconitase_C; Domain location=456-586; Score=217.8; E_value=2.5e-62; Accession=PF00694.9; Description =Aconitase C-terminal domain
  Pfam module annotation: Pfam domain module=Aconitase::Aconitase_C; Domain location=1-328::456-586
MVLPGVVGFKLSGKLRNGVTATDLVLTVTQILRKHGVVGKFVEFYGDGMGELSLADRATIANMSPEYGATMGFFPVDHVTLQYLKLTGRSDEIVAMIESYLRENKLFVDYNEPQQDRVYSSYLELNLSDVEPCISGPKRPHDRVPLKEMKADWHACLDNKVGFKGFAIPKEAQGKVAKFDFHGQPAELKHGSVVIAAITSCTNTSNPSVMLGAGLVAKKAHELGLQVNPWVKTSLAPGSGVVTKYLLQSGLQKYLNEQGFHIVGFGCTTCIGNSGELEESVASAISENDIVAAAVLSGNRNFEGRVHALTRANYLASPPLVVAYALAGTVDIDFEKEPIGTGKDGKNVYLRDIWPSTEEIAKVVQSSVLPEMFRSTYEAITKGNPMWNQLQVPADTLYSWDPDSTYIHEPPYFKSMTMDPPGPHGVKDAYCLLNFGDSITTDHISPAGSIHKDSPAAKYLVEHGVERKDFNSYGSRRGNDEVMARGTFANIRLVNKLLNGEVGPKTIHIPTGEKLYVFDAATRYKASGQDTIVLAGAEYGSGSSRDWAAKGPMLLGVKAVIAKSFERIHRSNLVGMGIIPLCFKPGEDADTLGLTGHERYTIELPSIINEIRPGQDVTVTTDNGKSFTCTARFDTEVELAYFNHGGILPYVIRNLIKQ

SEQ ID NO: 229512 - protein, 121 aa, Glycine max
  Coding DNA Sequence Number=SeqID_112734
  Subcellular localization annotation: CTP_CleavageSite=74; ConfidenceScore=5.63e-01
MSWLLRSTKSKLLSSSSSLSRTFPSLSRSGPTLDLPQIGAISPLPDLFHRNTATMPFAKENASGGNLAGLPKVPANTLGSDSNAINSPLLKCSQVDIRLMGSGHAYEVCWSQKLKLVAVVV

SEQ ID NO: 229513 - protein, 213 aa, Glycine max
  Coding DNA Sequence Number=SeqID_112735
  Gene Ontology: Mol. function=succinate dehydrogenase activity; Cellular component=membrane; Biological process=tricarboxylic acid cycle
  Homolog annotation: Hit_ID=Q94FP3; Match level="QueryCoverage=73%, HitCoverage=100%, E-value=1e-76, Identity=94%"; Hit description =Succinate dehydrogenase subunit 3
  Pfam annotation: Domain name=Sdh_cyt; Domain location=122-213; Score =15.6; E_value=1.9e-05; Accession=PF01127.12; Description=Succinate dehydrogenase cytochrome b subunit
MTVAIMPEIMSFQLFMALESDNNLNSQLEPDFHTFSSVFSGTGTSSFEDIWKRYKASGLDTNVLAGARCVSGVWAAQGPMRLVVNTVMARSFERSMEAGTLGMIGHKRFMSDIPSKTSETNLSGFRPLSPHLPLYQPQLSSTLSIFNRIAGAFLAGVILLFYMIYMKLGLVSLTYDSFYQFIFYSSKLNLLVMEISALAVSYHLYSAIRHLFL

SEQ ID NO: 229514 - protein, 325 aa, Glycine max
  Coding DNA Sequence Number=SeqID_112736
  Subcellular localization annotation: CTP_CleavageSite=60; ConfidenceScore=5.02e-01
MKLEETLTQFMQVSMSNQKSTKSAIKNLEVQVGRLAMQLAEKSSNSLTTNTEKNLKEECKAVMTRSKMAIQAEGERADQKVEGLKQQLAAQPALDLVDTFVELEEIDEEAKVDKEEETPIKIKEEQEKEKEIEKEEKEKETEKEKNVKNGKQKEKVGEDEKKKGKSKANREKKKKTTPIEGKEVPYPLVPSRKEKERHLARFLDIFKKLEITLPFGEALQQMPFYAKFLKEMLTKKNRYIHSDRIVVEGNCSAVIQRFLPPKHKDPGVVTIPYSIGEVAVDKALMDLGASINLMLLSMCHRLGELEIMPKCMTLQLADRSITRPY

SEQ ID NO: 229515 - protein, 279 aa, Glycine max
  Coding DNA Sequence Number=SeqID_112737
  Gene Ontology: Mol. function=DNA-directed RNA polymerase activity; Biological process=regulation of transcription, DNA-dependent
  Homolog annotation: Hit_ID=Q0K0G4; Match level="QueryCoverage=58%, HitCoverage=97%, E-value=2e-35, Identity=48%"; Hit description=DNA -directed RNA polymerase sigma subunit PrtI
  Pfam annotation: Domain name=Ni_hydr_CYTB; Domain location=2-104; Score=2.6; E_value=1.5e-05; Accession=PF01292.10; Description =Cytochrome b561 family
  Pfam annotation: Domain name=Sigma70_r2; Domain location=120-187; Score=52.1; E_value=1.8e-12; Accession=PF04542.4; Description=Sigma -70 region 2
  Pfam annotation: Domain name=Sigma70_r4; Domain location=215-264; Score=43.7; E_value=6.5e-10; Accession=PF04545.6; Description=Sigma -70, region 4
  Pfam annotation: Domain name=Sigma70_r4_2; Domain location=209-262; Score=61.6; E_value=2.6e-15; Accession=PF08281.2; Description=Sigma -70, region 4
  Pfam module annotation: Pfam domain module=Ni_hydr_CYTB::Sigma70 _r2::Sigma70_r4::Sigma70_r4_2; Domain location=2-104::120-187::215 -264::209-262
MPASVPGWQQTVAHLTHLALYLLMLAQPLVGWAMLSAGGFPVTIGEGLVLPPLLPVSVESYAVLRPLHSLLAFSLFALILAHLAAALLHGLILRDGVLSSMTGLRRVREQKIMSALSDDEIRALLPHLQRFALGLTRERMAAEDLVQNTLVKALDAARDDTRSLRAWLFSILWHQFIDGERRRKRWQAIMTLFSRAEPFAESAEHHAIADEMLALFARLPADSRALLLLVNVEGMRYQEAADTLDIPLGTVMSRLSRARKQLQHMTEGLPAPVTLRRLK

SEQ ID NO: 229516 - protein, 81 aa, Glycine max
  Coding DNA Sequence Number=SeqID_112738
MDTRLRVIGDPMNGVQRYTKMKFGGAVPFLIPMTRGGAHNPLFEDSPSECGGGAATVRYGLISKGHSRNKIQAQGHVTRYH

SEQ ID NO: 229517 - protein, 80 aa, Glycine max
  Coding DNA Sequence Number=SeqID_112739
EEVGDTQKAQVATATPKRSSEAISEPPTLAVDPSSPQHAADPSTTVLEIPKDQTTPVLTLDTSPSATLVLHLTDEEDVQT

SEQ ID NO: 229518 - protein, 140 aa, Glycine max
  Coding DNA Sequence Number=SeqID_112740
MGNCLRNNKISSQNHENYDDALVIDAKVDKVKALSLSKMEETPRMEQSIKKKVRFKTQNYDSAYEGERGSDGNSRSVRIRVVMTQEELKRMLRFKDEHTSLEQLLHAVKLRGGRVSDVGEFDDEGVNSWKPSLDSIPEDQ

SEQ ID NO: 229519 - protein, 57 aa, Glycine max
  Coding DNA Sequence Number=SeqID_112741
MQEIRDPTWLAGGWWLRGRWKMIIKKRKLRVVKSGIISIWGTHGERRRIKIHKGHRW

SEQ ID NO: 229520 - protein, 61 aa, Glycine max
  Coding DNA Sequence Number=SeqID_112742
MLNIQSKIYYFLAASSVSMVLLIVTVVALFSLLNTALFREAGVEAQTDRVSAPIVQKTSKL

SEQ ID NO: 229521 - protein, 43 aa, Glycine max
  Coding DNA Sequence Number=SeqID_112743
MAIILSKSKRICFSGPRDYDFLRSHDKRMNGLASSTTDQLASS

SEQ ID NO: 229522 - protein, 83 aa, Glycine max
  Coding DNA Sequence Number=SeqID_112744
  Homolog annotation: Hit_ID=Q1SZM6; Match level="QueryCoverage=98%, HitCoverage=32%, E-value=2e-07, Identity=35%"; Hit description =Ribonuclease H
WSVWQIINQVHILHSDVIKVLGHPKQATTTRLVSWEPLSLPFVKLNTNNNLGDSGFGAFFGACGVTTSLKAELYATLYGLRKA

SEQ ID NO: 229523 - protein, 448 aa, Glycine max
  Coding DNA Sequence Number=SeqID_112745
  Gene Ontology: Mol. function=metalloendopeptidase activity; Cellular component=integral to membrane; Biological process=proteolysis
  Homolog annotation: Hit_ID=O80885; Match level="QueryCoverage=95%, HitCoverage=96%, E-value=1e-155, Identity=66%"; Hit description =Expressed protein
  Pfam annotation: Domain name=PDZ; Domain location=167-272; Score =13.1; E_value=0.029; Accession=PF00595.14; Description=PDZ domain (Also known as DHR or GLGF)
  Pfam annotation: Domain name=Peptidase_M50; Domain location=91-437; Score=222.8; E_value=7.6e-64; Accession=PF02163.12; Description =Peptidase family M50
  Pfam module annotation: Pfam domain module=PDZ::Peptidase_M50; Domain location=167-272::91-437
  Subcellular localization annotation: CTP_CleavageSite=91; ConfidenceScore=5.44e-01
MVVNLSPSPPLHSSSIIRLANSKSPISEPWLRLKTHFPKPLLSPSFASPSVNFTCKKQFLHGNSRNVLDFRTWSIAGFDYGNFEGPQSVLEAAAVLTAIIVVHESGHFLAASLQGIHVSKFAVGFGPILAKFNAKNVEYSIRAFPLGGFVGFPDNDPESDIPVDDENLLKNRPILDRVIVVSAGVVANIIFAFAIIFAQVLSVGLPEQEVFPGVVVPDVRAFSAASRDGLVPGDVILEVNGSEFSKPGPSAVSEVVDVIKRNPKRYVLLKIKRGEQNFDIRVTPDENFDGTGKIGVQLAPNVKIAKVRPKNLVQAVEFTGQEFWGLASNVLDGLKQTFLNFSQSASKVSGPVAIIAVGAEVARSNIDGLFQFAAILNINLAVINLLPLPALDGGTLALILIEAARGGRKLPLEVEQTIMSSGIMLVIILGLFLIVRDTLNLDFIKDLL

SEQ ID NO: 229524 - protein, 61 aa, Glycine max
  Coding DNA Sequence Number=SeqID_112746
MAQCVCLCVWVSVCVCGSGSKGSLNCKHHEPHDEGSSIKSMLYKLLVNLRSGVFMLQIDGF

SEQ ID NO: 229525 - protein, 73 aa, Glycine max
  Coding DNA Sequence Number=SeqID_112747
MALKLIVDLTENPTPLAWDEARVLEPIGDWLGAGDSSRDLSGLNTGHSFQNDNHMTRNTLVERSIPIWRKTGP

SEQ ID NO: 229526 - protein, 74 aa, Glycine max
  Coding DNA Sequence Number=SeqID_112748
MGSSQKPSLKKRFYQVKIKSLEVTSLRKLGQLMGQLQRQAFRKAYGIRPPKASRKWGGRNTEKIFGGKSKNLGR

SEQ ID NO: 229527 - protein, 152 aa, Glycine max
  Coding DNA Sequence Number=SeqID_112749
  Subcellular localization annotation: CTP_CleavageSite=24; ConfidenceScore=5.33e-01
MPSPRHAASPAQPLNAAPARYRSRASAIRDGASIVRRRTIPVLIFVGRTQMPLNGAFGKHFGLMQIAQRAIAHLVPQLALIHRSQSADRRGRGAVQPQFAPLIIVAVSIFTARAGGCHHQPLRIPAPGILAVGQFIAAARNTFFQPEVFIVA

SEQ ID NO: 229528 - protein, 272 aa, Glycine max
  Coding DNA Sequence Number=SeqID_112750
  Gene Ontology: Mol. function=methyltransferase activity
  Homolog annotation: Hit_ID=Q7CIB6; Match level="QueryCoverage=67%, HitCoverage=56%, E-value=2e-87, Identity=85%"; Hit description =Putative enzyme
  Pfam annotation: Domain name=Methyltransf_9; Domain location=1-186; Score=317.0; E_value=3.3e-92; Accession=PF08003.2; Description =Protein of unknown function (DUF1698)
MWRMIGAGAQLVVGIDPMQLFLCQFEAVRKLLGDDRRAHLLPLGIEQLPALQAFDTVFSMGVLYHRRSPLDHLLQLKNQLVSDGELVLETLVIEGDENAVLVPGERYAQMRNVYFIPSAAALKNWLEKCGFVDVRIADYAITSVEEQRRTDWMTSESLAEFLDPHDSSKTIEGYPAPLRAVLRAPQRHRSAGRDKLRQESDVKDPDFGIEQVTGQATRKAGQIALFPLLPLLPAGHRAARVKQQSDAEIQQVHGTDAFQQVISHFRSQQQRA

SEQ ID NO: 229529 - protein, 83 aa, Glycine max
  Coding DNA Sequence Number=SeqID_112751
MSNSITRTPAISTLGHILEISNGGNAQNWVTNVVLKFHDDPTVDESEIVIFLRQVRWHAGKGEGFGRREKKRNCKAEEAEELV

SEQ ID NO: 229530 - protein, 243 aa, Glycine max
  Coding DNA Sequence Number=SeqID_112752
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=4e-28, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GGPLRTTRPHLQRTTRPHLQRTTRPHLQRTTCPRLENYMPSPSEDYMSSPSKDYMSSPLEEYTSSPSEGYTSSPSEDWLHALAFRGLHALVFRGLLALAFRGLHVLAIRGLHALTFKGLHILVISRMHALTFRGLHILAFSGLPVLAFKGPHALAFRVLHVLTFGGLHVLAFRGLHALAFRGLHVLAIGGLHVLAIRGLHVLAIRGLHALAIRGLHVLVFRGLHALASEDYTSSPSEDYTSSP

SEQ ID NO: 229531 - protein, 111 aa, Glycine max
  Coding DNA Sequence Number=SeqID_112753
LYTFAFVGLHALTFRGLHVLAFRGLHAFSFRGLHVIAFRGLHALAFIGLHALAFIGLHICTFRELEGPGVSSFGYGPLSVLQGARPPSKGSRPQDTQWTRRSPTGSWGFQL

SEQ ID NO: 229532 - protein, 184 aa, Glycine max
  Coding DNA Sequence Number=SeqID_112754
MAFADVNKLMLRNETPAADIYQRKVNAHTHEDDHHWPWYLEDLDKLGYNRCVDTVAHLETLWSDSTQANRLLTYRLCALVSGLGGLERIVVIEAIEATGNVLFGLTAPLATRMHQATGVELRYCGEFHLALESGHAQLQDHAELAAIPLTDGIRRRCIAHVDHPGGEFSHDLIVPIAQQQGINA

SEQ ID NO: 229533 - protein, 233 aa, Glycine max
  Coding DNA Sequence Number=SeqID_112755
  Gene Ontology: Mol. function=trans-aconitate 2-methyltransferase activity
  Homolog annotation: Hit_ID=Q2KXC3; Match level="QueryCoverage=49%, HitCoverage=54%, E-value=6e-40, Identity=69%"; Hit description=Trans- aconitate 2-methyltransferase
GAAHRSGRPQHGGRMGPPHGHERTHAGAPGAAGGRHELWPLAPADAYRDGAAAAVVRRIGATHRRRPGLRIGQRLHHHVPQDAGADAGALFRRQGVGSVCTGTRGTRLAAHRVSPGGPPPGTGAGKAAARCHRPAPDRRARSRRGNAPGRPPAHRHPACRAPDVQSTAMRLEQLVVPGGAVARRMLDAADLAGPGAVGGDLARQLVGRLFQVVRSLHRQAAARRQLAHQARIE

SEQ ID NO: 229534 - protein, 490 aa, Glycine max
  Coding DNA Sequence Number=SeqID_112756
  Gene Ontology: Mol. function=transporter activity; Cellular component= outer membrane; Biological process=transport
  Homolog annotation: Hit_ID=Q5NZ77; Match level="QueryCoverage=60%, HitCoverage=45%, E-value=9e-18, Identity=28%"; Hit description =Putative TonB-dependent receptor
LKNPLSKCAGDERGLAGRRGAGAAGHGLHGHVDAAAARVIGLNALELAGRKVLQLALMAAELHGVGAVGVGLQPDVVGLGQRCAGQQRSERCGGEGMAGCHRARRAGREQRHAADDRGRRGIGLVPQVGDHGVDAAARRRQAPAQAQVPGGVAAIEDAVVGGDGIAAHAAPGERAFPLRQRAPGQAHGGRLPGHAGHLVADQGRVAVLGHARMGAAPGHLQVQVLAHGPQRAGLHARAARCAEVLIHAGRHVADLARGLQPIGGHIQHQARHGLDLRAHFGLPEDIGIELRGAQRVLGEIAGQRKSFGPAGAQQHARRHLRAQAQLGAGMRGARQRAAGVAARLGAVGTATAREAVPAQAGGQLQQAVDGRLHLGKGRDGVEPGKKVVNGCTRALAPLQAVVELVVGGFAHGLQPGHPVERGQRRDMAAIEAGAGAVDGAVIAFLALAPLQCVDGPAEPAREALLRGVGMAQPGQPGRERVLHIGAQWGE

SEQ ID NO: 229535 - protein, 216 aa, Glycine max
  Coding DNA Sequence Number=SeqID_112757
  Gene Ontology: Mol. function=peptidase activity; Cellular component =membrane
  Homolog annotation: Hit_ID=Q7VSB5; Match level="QueryCoverage=82%, HitCoverage=62%, E-value=1e-78, Identity=83%"; Hit description =Putative exported protein
MFVGLREADFLDLHAHHLDRRAFHGLEHGVVHVQAQLLAFLDGAHGGVLSEHVLDRVRRLAFEHAHLQVADGAVFGIQLGHVLGRHAVGHRHAQRGRLLVIAVGFQLLEHESVVAHRHRHHVVDEGRLEVQAGLGHAHQLAVAQHHAAFALVHLEPGTEREAQDEHEQHARADGQLQAARLDGLDDLEVGRLHLESLSDLLRLRSESTAAMPRASK

SEQ ID NO: 229536 - protein, 89 aa, Glycine max
  Coding DNA Sequence Number=SeqID_112758
  Homolog annotation: Hit_ID=Q1SNY7; Match level="QueryCoverage=48%, HitCoverage=10%, E-value=5e-07, Identity=52%"; Hit description =Peptidase aspartic, active site
MELGLRCDALKDSLSNVLLGMTFNDEPLSIRTLATMWSKHLMDTCEVIVGGNIVDDAPEALNRDVLGYMGLLMILTPVEANDARLRQRL

SEQ ID NO: 229537 - protein, 115 aa, Glycine max
  Coding DNA Sequence Number=SeqID_112759
MEVKQNFAQVQKNACVWLAVESLVQNEFWMFASRSQRSKCRLMHYRLPFVLFECCITLMLGKLGRIDGDPVLRETRIWATWEYVSSVGGGQQGMVGLCAHCGCGKLVVHHRPTGT

SEQ ID NO: 229538 - protein, 110 aa, Glycine max
  Coding DNA Sequence Number=SeqID_112760
MSTFRQLRSAMLIWTTTRCYHVRVGGFPQRRLSRRYLQQRKGSAWIISGFQMSAECHMRSIDQSKSFIRFLVSQDSSAGGLLLWTHYSDHPAPAGDICVVPGQCVPDYID

SEQ ID NO: 229539 - protein, 103 aa, Glycine max
  Coding DNA Sequence Number=SeqID_112761
MIRGDTYGYSHPFCHPEAAGPMTSRDQVWSFCTHDTRRYLTVIRTPLPFRHSRVRWHAETKFGADTVFCTFCSSGNNKVIYMRKFHGRPRLSSTERSEINVIH

SEQ ID NO: 229540 - protein, 65 aa, Glycine max
  Coding DNA Sequence Number=SeqID_112762
  Subcellular localization annotation: CTP_CleavageSite=33; ConfidenceScore=5.29e-01
MGVQIATRPTWAFQDVPPEGGCFWRKQPSSLGRAGKSKPRRFRNVSVGDFAKIFNRSSTFFGLQP

SEQ ID NO: 229541 - protein, 64 aa, Glycine max
  Coding DNA Sequence Number=SeqID_112763
  Gene Ontology: Mol. function=catalytic activity; Biological process =cellular metabolic process
  Homolog annotation: Hit_ID=Q1T188; Match level="QueryCoverage=83%, HitCoverage=16%, E-value=1e-21, Identity=90%"; Hit description=NAD -dependent epimerase/dehydratase
MRWYTLSKTLAEDAAWKFVKENNIDMVTINPAMVIGPLLQPVLNTSAASILNIINGNYYLYIML

SEQ ID NO: 229542 - protein, 76 aa, Glycine max
  Coding DNA Sequence Number=SeqID_112764
  Gene Ontology: Mol. function=catalytic activity; Biological process =cellular metabolic process
  Homolog annotation: Hit_ID=O04391; Match level="QueryCoverage=80%, HitCoverage=18%, E-value=2e-20, Identity=77%"; Hit description =Cinnamyl alcohol dehydrogenase
AELLDPALKGTLNVLKSCVNLPTLERVVLTSSVAAVANNGKPLTPYVVVDETWFSDPDLCREAKMQLNKVAQTVRE

SEQ ID NO: 229543 - protein, 108 aa, Glycine max
  Coding DNA Sequence Number=SeqID_112765
IVPTRHPVDPEKPNRALGFPALVMGLYQSYRVPIPPARSCHRDIGIAPARHQVDSEKSNRVLGSTECLSPPARSSGPLPTELSLRSIAPSGRRIARHHISPGMAESGQ

SEQ ID NO: 229544 - protein, 261 aa, Glycine max
  Coding DNA Sequence Number=SeqID_112766
  Homolog annotation: Hit_ID=Q1SDG1; Match level="QueryCoverage=36%, HitCoverage=8%, E-value=5e-14, Identity=39%"; Hit description =Integrase, catalytic region; Zinc finger, CCHC-type
MIAFFESTHIDMWDVVEKGNHIPLDARRNETPRDRWIDEHKSKFLLNSHARNALLCTLSQEEYSNVQNFRSVKQMWDTLAIIYEGSFEVKRNKLSLLIQTKHFKLECSNLEKPKDKKKFFKPKKKSLMSTWEDLDDSSSDEDSEEEANLCLMADVSTSKADPTLDTSSNDEDSQPDDNVNSGKEVVFKSKEELIKGYNTLLFVSARVSKAYRKLNKCFQHLEKEHEDLKKAHEVHLVDLSWKPLHLVVYKMPLFLRKSRHY

SEQ ID NO: 229545 - protein, 104 aa, Glycine max
  Coding DNA Sequence Number=SeqID_112767
MGIAPARHPVDPETSNKALGFSALVTGLCKSYRAPVPPSSLCHRDLGIVPTKHSVDPKKANRFYGVPVAPNKVIRPRINRAFIKKYCAPRQAQGETPQQHWDGR

SEQ ID NO: 229546 - protein, 190 aa, Glycine max
  Coding DNA Sequence Number=SeqID_112768
  Gene Ontology: Mol. function=RNA-directed DNA polymerase activity; Cellular component=signal recognition particle, endoplasmic reticulum targeting; Biological process=RNA-dependent DNA replication
MKVKQLFTCHHTSDERKVPLATLSFQGYTLYWWTSLVRERRIHGDPPVKYWNDLKSALRKRHISSYYERELMDKLQRLRQGSMSVEEYRQQMKLLLLRVGLMEEERTSIARFISGLNMEVRDKVELLPYRDLNDLVQLCIRVEQQLKRKPTSKSYGSHSHPKKDQGQGILGVAPSKPKDDKGKTIEKQPP

SEQ ID NO: 229547 - protein, 105 aa, Glycine max
  Coding DNA Sequence Number=SeqID_112769
  Gene Ontology: Mol. function=protein binding; Cellular component =integral to membrane
  Homolog annotation: Hit_ID=Q5N7I7; Match level="QueryCoverage=85%, HitCoverage=25%, E-value=4e-36, Identity=79%"; Hit description =Putative NTS2 protein
  Pfam annotation: Domain name=DUF803; Domain location=1-102; Score= -108.6; E_value=8.2e-05; Accession=PF05653.4; Description=Protein of unknown function (DUF803)
MVYIGVYSLIGSITVMSVKALGIVIKLTMSGMNQLIYPQTWAFSLVVIVCVLTQMNYLNKAVDTFNAAVVSPIYYVMFTAFTIVASVIMFKGFIAYALNYGLITW

SEQ ID NO: 229548 - protein, 95 aa, Glycine max
  Coding DNA Sequence Number=SeqID_112770
  Homolog annotation: Hit_ID=Q9FFL9; Match level="QueryCoverage=69%, HitCoverage=23%, E-value=1e-07, Identity=43%"; Hit description =Arabidopsis thaliana genomic DNA, chromosome 5, P1 clone:MIK22
MSVVVSKEWGTLLHVVAGTDQVHFVDLLVKLLNPNDLELQNFNRNMAFCYSAASGNLYIASLMIKKNAGLPKIQGSGGYSYLYEPLWWVGMITSE

SEQ ID NO: 229549 - protein, 139 aa, Glycine max
  Coding DNA Sequence Number=SeqID_112771
MTMIVDTLPVFYYGKWWATHLQSFEDLVFANERIDVGLKKGKFSHPAWTNEKTGANEEGEKEGETHAVTAIPIRPSFPPTQQCHYSANNKPPPYPPPSYPQRPSLNQPQSLSTALPMTKTTFSTNQKTPTKRNFAAKSL

SEQ ID NO: 229550 - protein, 59 aa, Glycine max
  Coding DNA Sequence Number=SeqID_112772
  Homolog annotation: Hit_ID=Q2QM87; Match level="QueryCoverage=85%, HitCoverage=11%, E-value=8e-13, Identity=66%"; Hit description=SRP40, C-terminal domain containing protein, expressed
  Pfam annotation: Domain name=SRP40_C; Domain location=2-58; Score= -1.3; E_value=0.00075; Accession=PF05022.3; Description=SRP40, C -terminal domain
MKKSVNAAFQRVQVDKIQFVDERLQDNSYWAKDGAENGYGAKATEIVDQVRGRSVNSYG

SEQ ID NO: 229551 - protein, 112 aa, Glycine max
  Coding DNA Sequence Number=SeqID_112773
MDSKIYPKVHENPRAFFSSSSPSLLESSIQYPWGQSLSITADHGRSRLGSSEPTEFESQSVSVTGDHDPLLRIPLTPTKRVSFDELDNERKNFQISPAEVSSNKLAKLSQPE

SEQ ID NO: 229552 - protein, 110 aa, Glycine max
  Coding DNA Sequence Number=SeqID_112774
  Gene Ontology: Mol. function=actin binding
  Homolog annotation: Hit_ID=Q1S960; Match level="QueryCoverage=86%, HitCoverage=14%, E-value=1e-12, Identity=48%"; Hit description =Prefoldin
MKNDTAELKMEAEVTKVVLQDVETTLRVAVEEVEAANAAEASVVDKIKVLCMRTSPSHSSPSEPGARITISREEFESLVYKVKESDKLEDIKVAAATTTLKFQRLPKTKL

SEQ ID NO: 229553 - protein, 62 aa, Glycine max
  Coding DNA Sequence Number=SeqID_112775
MECRCMRLFFSFVSKADVIGCGMKGRIWLTKASRFRSSVWRVGGKRPGYNASDSESDEEEDS

SEQ ID NO: 229554 - protein, 101 aa, Glycine max
  Coding DNA Sequence Number=SeqID_112776
MGHKLLFQHLVKTKGDAGEDQKGRWVKSGKGWLEDVEILLKGSLNEPDWLSETHPLSKEVCPLSKNKTLENVEPKSSALSAQLVHPARTLSLLALSASKLA

SEQ ID NO: 229555 - protein, 270 aa, Glycine max
  Coding DNA Sequence Number=SeqID_112777
  Gene Ontology: Mol. function=3-oxoacyl-[acyl-carrier-protein] synthase activity; Cellular component=chloroplast; Biological process=fatty acid biosynthetic process
  Homolog annotation: Hit_ID=O82520; Match level="QueryCoverage=98%, HitCoverage=52%, E-value=1e-117, Identity=77%"; Hit description=3 -oxoacyl-[acyl-carrier-protein] synthase
  Pfam annotation: Domain name=ketoacyl-synt; Domain location=17-270; Score=200.3; E_value=4.5e-57; Accession=PF00109.16; Description=Beta- ketoacyl synthase, N-terminal domain
MASPTVGAPKREKDPKKRVVITGMGLVSVFGSDVDAFYNKLLEGESGISLIDRFDASNFSVRFGGQIRDFCSEGYIDGKNDRRLDNCWRYCIVAGKRALDDANLGKQVLDTSWSFTLVINVIKMDKTRIGVLVGSGMGGITTFSNGVEALVQKGYKKITPFFIPYSITNMGSALLAIDTGLMGPNYSISTACAMANYCFCAAANHIRKGEADIMVVGGTEAAIMPSGLGGFIACRALSHRNEDPKKASRPWDKDHDGFVMGEGSGVLVET

SEQ ID NO: 229556 - protein, 177 aa, Glycine max
  Coding DNA Sequence Number=SeqID_112778
APVSLALARPRRARCDTIKPSSHDSKGETFSRSRPKDADISEKVDEGADNPWVSPHVIRLAITLGYLRMSSDLRSWMTKTCRLWMTKTKVRITLGYLRMPPDSQSLPEDVDIFGKGADDHIGLCLSIGLRVCAGYRIWRLRVPPDSQVMIAKGGVVDKNGAFAPMYPQFVMRNSDLR

SEQ ID NO: 229557 - protein, 137 aa, Glycine max
  Coding DNA Sequence Number=SeqID_112779
  Gene Ontology: Mol. function=chitin binding; Cellular component =extracellular region; Biological process=chitin metabolic process
  Homolog annotation: Hit_ID=Q86AI8; Match level="QueryCoverage=96%, HitCoverage=35%, E-value=2e-16, Identity=35%"; Hit description =Similar to Homo sapiens (Human). Mucin 2
MTSPLNKSISCFLIRVDPWVIVPSPSKDYTSLPSEGYTPSPSEAYTSSPSEDYTPSPSEDYMSSPSEGYTPSSLEDYTSLPSEGCTPSPSEDYMSLPSEDYTSSPSEGYVPSPLEDYTSSPSEGYMPSPSEDYVSSP

SEQ ID NO: 229558 - protein, 87 aa, Glycine max
  Coding DNA Sequence Number=SeqID_112780
MSFARFDSSSNDIEASFSTLMSPRSLLPESWVPLEVGLVDLVSEDEGEDLEEDTSYEEDPSMDEEDPVTKPKFMEEDSSQDSSEDSC

SEQ ID NO: 229559 - protein, 77 aa, Glycine max
  Coding DNA Sequence Number=SeqID_112781
  Gene Ontology: Mol. function=transition metal ion binding; Cellular component=cytoplasm; Biological process=fucose metabolic process
MQKCPRCGVSWYKVKDDDKCSSNKSTKKGPLLKVLWYLPIIPRFKCLFANGNDTKDLTWHADGTNYDGMLCHPADSS

SEQ ID NO: 229560 - protein, 366 aa, Glycine max
  Coding DNA Sequence Number=SeqID_112782
  Homolog annotation: Hit_ID=Q9M3A6; Match level="QueryCoverage=38%, HitCoverage=28%, E-value=5e-12, Identity=32%"; Hit description=SF16 -like protein
MTMRCMQALVRVQARVRARRFQLSHADQEREKKEEPKPIPVPVPMSPLRRIDDINDWDNRRQSSYKIKENDLRKHEAVMKRERALAYAFNYQQKKQPRERQCLGIKSLDLGSRFIKRWGWRRHNLVAFSGGHGSRRKRRCSVWESRNLMLHSTTKRERHQQQKQFLQPDWNGNDDVGTNYEHEKAQWGWNWLERWMSSQPYNVRNMGPHETSYMTLASTTSTTTDNMSEKTVEMDMVATPGPTNTRNVSPMNQDFVDLSPVSNRHRHIPPSPNRPSYMTPTQSAKAKVRAQGPSKPRVSVGQWNFSTKGGSTGDSSSSGGRIVAYQFPRSPGPKINGIRSQSKRIVGSSPDYTEDWTLPLGAHGWA

SEQ ID NO: 229561 - protein, 372 aa, Glycine max
  Coding DNA Sequence Number=SeqID_112783
  Gene Ontology: Mol. function=nucleic acid binding; Biological process= DNA integration
  Homolog annotation: Hit_ID=Q1T010; Match level="QueryCoverage=52%, HitCoverage=14%, E-value=5e-50, Identity=48%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MGLNHLVSKQGLTMSLPNLEDHNREHHTNLPHVLSQSIKPAPYHTLDKYLVQEYVSVKGTSCDIKSLNDSRNPRSRMGQDGGNLLANLPILDSKNWHRWYAHMKVILGYQEVLEIVEKGYSPFVEDATKEHKVAYNENKKNDCKALCLIYQSVDKAHFEKIVGAKTSSKAWKILEKGNEGVEQLKKVHLQTMHRQFELMQMEGNERVAEFFNRVFNLTNAMKSCGEKVTDLTIIEKVLRTLNPKFDHIVVAIEESRNLEILKVEELQGSLEAHKQQLLERSGGGHKGRGRDKVAKDNPERNNETQEHFRIEQDVPESSTQNFVLFSYSSPSSSKLLSMASYGEAKDSIDEEDPRPTSSNGVYIMWYQEHLHV

SEQ ID NO: 229562 - protein, 74 aa, Glycine max
  Coding DNA Sequence Number=SeqID_112784
MVKARQKGGTENKRNENKSTRNKWGPLRAHRMNCKGKRGRWLPPNWPRRAGLLPPEGTAFCWNTLEGSSGPGQN

SEQ ID NO: 229563 - protein, 154 aa, Glycine max
  Coding DNA Sequence Number=SeqID_112785
  Homolog annotation: Hit_ID=Q1SKD7; Match level="QueryCoverage=95%, HitCoverage=38%, E-value=6e-09, Identity=26%"; Hit description =Ankyrin
MPKYDPEVIMEFYANAWPIEEGVMDKRSKVRGQWIPYDTDAINQFLGNPLILEKGKQCEYTTRRGQTTGFDEEAIGQLLCFPGRDFVRSMTRKRLRIMHTNMTTLTQIWMTFLLSNILPSDQNYDLTLPKCQLVYSIMEHISVHVVQLILDAIH

SEQ ID NO: 229564 - protein, 58 aa, Glycine max
  Coding DNA Sequence Number=SeqID_112786
MWVFSGHVELLRANSRVIRGVLQPWAHLGQSGSFYMKQPARLGEHVTSNLSHQLDWAS

SEQ ID NO: 229565 - protein, 299 aa, Glycine max
  Coding DNA Sequence Number=SeqID_112787
  Gene Ontology: Mol. function=DNA binding; Biological process =regulation of transcription
  Homolog annotation: Hit_ID=Q8LFS2; Match level="QueryCoverage=92%, HitCoverage=75%, E-value=3e-90, Identity=55%"; Hit description =Regulatory protein
MQQANYDPKLESVLRDASMKDKTVIITTLNDAWAEPGSMFDLFLESLQLGNGTQWLSNHLVVITWDQKTLARCLVVHKHCYQVETKGGNYTGEVFYMTPNYLHMMWRRTEFLGSILEMGYNFVFTDTDIMWLRDPFKQFYKDTDFQIACDSFNGNSSDLNNFPNGGFKYVQSNNRTIWFYKFWFDSRNFYPGLNEQDVLNNIKMHPLISKMKLKIRFLSTSYFGGFCQPAEDFNKVSTMHANCCVGIENKVNDLKILLEDWKKYMALSEIEKKESHPSWSVPQLCRTSFERAKERNLIN

SEQ ID NO: 229566 - protein, 75 aa, Glycine max
  Coding DNA Sequence Number=SeqID_112788
MKKNTSAMENAGGIKAWSFRRHQLLVRRVMQLTMFIAGLPVLWVFLSNSASSIEFHTFSHYFTAQSTKFMEKFNA

SEQ ID NO: 229567 - protein, 100 aa, Glycine max
  Coding DNA Sequence Number=SeqID_112789
MSKTLLNPTKTLLKIIKITRTMISLSKKALREKHIVRARVKSDFTMSESDFTVSKRWFHRRESESDIMSDSGFSAVRVSETDRGGFVRETKHEGETSELS

SEQ ID NO: 229568 - protein, 107 aa, Glycine max
  Coding DNA Sequence Number=SeqID_112790
MSYLLWRKANEYDELPSSQERFKRCGRTRVGPDGRTSPRRCSMKRKTEKKALYEAYDTLEKGLCLENEKDSKERDTLMKGFNILEAKIEVLQKELKELNELQDHLTK

SEQ ID NO: 229569 - protein, 69 aa, Glycine max
  Coding DNA Sequence Number=SeqID_112791
MVNDIFVKVKLEVTRISTILNVFGSRRSNDRKMQGSCMKTKDMQFVEQKVCRMHMHDDSMTHAKCEAGI

SEQ ID NO: 229570 - protein, 74 aa, Glycine max
  Coding DNA Sequence Number=SeqID_112792
MVVDRGSGRHHKWMITMNNGPSCVADAWIHYLGDCHLKAGDEVIFFYNIDQHLWEVLYRKQVKWDDKEDEVDSP

SEQ ID NO: 229571 - protein, 580 aa, Glycine max
  Coding DNA Sequence Number=SeqID_112793
  Gene Ontology: Mol. function=nucleic acid binding; Cellular component= intracellular
  Homolog annotation: Hit_ID=Q6K687; Match level="QueryCoverage=78%, HitCoverage=90%, E-value=1e-129, Identity=55%"; Hit description=Zinc finger (CCCH-type) protein-like
  Pfam annotation: Domain name=G-patch; Domain location=382-426; Score =58.7; E_value=2e-14; Accession=PF01585.13; Description=G-patch domain
  Pfam annotation: Domain name=zf-CCCH; Domain location=230-255; Score =22.1; E_value=0.0016; Accession=PF00642.15; Description=Zinc finger C-x8-C-x5-C-x3-H type (and similar)
  Pfam module annotation: Pfam domain module=G-patch::zf-CCCH; Domain location=382-426::230-255
MGSEEERVLENQLELQLQEQRDSLSAIGQALLSDPTNPELLAVLCWSVEFGRVVGQKGRILRIGISSKKISIMYMLQVSAMTTVLGLRQLLSQKLALDLSLYSSYSHSQVSTQIVFYLGSGPQKLVHEELVQAIKDAEEGLLHLKRARLLQEADSVLHNTNIFTEEEKVEPLDSTDVEPEPLEDKCYSVGSKCRFRHKDGRWYNGQVVQLDNAVAKVSFLTPTSENMLNAKVQMCKFFLQQRCRFGSNCRLSHGLDVQLSALKKYVPTIWKQSLVGSSIWAVSTANAGTWREAELESLDEKAGVGQVVFRDNGSSVKVGAEEMALSEHAEMSDLESDSSLVQSDSSDYEEEEPQGLGFLESTNLRRGIQTETATFATWENHTRGIASKMMANMGYREGMGLGVTGQGMLDPIPVKVLPPKQSLDHALESHKREGKEGKKKRSRGGKRKREKKFAEVNRAAKEEEESASDVFALINNHLAMHSEAFGSGSMKKQQSKGSEEGKKVDRRALVAYEEEVKDLKMRVEKLEHIVNANRKEKAVYEGAMRKLNETRKALADAEAVHASASNSVTSKEKEKRWLKF

SEQ ID NO: 229572 - protein, 635 aa, Glycine max
  Coding DNA Sequence Number=SeqID_112794
  Gene Ontology: Mol. function=oxidoreductase activity, acting on CH-OH group of donors; Biological process=electron transport
  Homolog annotation: Hit_ID=UPI000034F0B9; Match level="QueryCoverage =96%, HitCoverage=81%, E-value=0.0, Identity=58%"; Hit description =electron carrier
  Pfam annotation: Domain name=DAO; Domain location=126-465; Score= -63.1; E_value=0.095; Accession=PF01266.14; Description=FAD dependent oxidoreductase
  Pfam annotation: Domain name=GMC_oxred_C; Domain location=472-626; Score=-40.4; E_value=0.0023; Accession=PF05199.4; Description=GMC oxidoreductase
  Pfam annotation: Domain name=GMC_oxred_N; Domain location=172-405; Score=298.3; E_value=1.4e-86; Accession=PF00732.10; Description=GMC oxidoreductase
  Pfam module annotation: Pfam domain module=DAO::GMC_oxred_C::GMC _oxred_N; Domain location=126-465::472-626::172-405
MVTYLESSPTLLELDYLRKIIRELDEAEDNPSWKAINYCGPDPEFKSQLKNHFFTKERGQEEKEDEDYDDGTEDVRGPLYKGLIYINYPRDIITDSLRRVGFSVSATPKKTKASSLSSPSLVIQCDAVVVGSGSGGGVVAGVLANAGYKVLVLEKGSYSARNNLSLLEGPSMDQMYLSNGLVATKDMSVLILAGSTVGGGSAINWSASIRTPQHVCKEWCDGHELELFESKLYKEALDVVCEKMGVQSEIDDEGFNNAVLRRGCLEMGYPVCDIPRNASSDHYCGWCCMGCKDGRKKGTLETWLVDLVKSGNGAIIPSCEAIQVLHKKKKGRDRKIARGVAFAIEYKGKRDICVVESKVTVVACGALSTPALLKRSGLKNENIGRNLHLHPVAMAWGYFPDSLSPELWPEKHKKSYEGGIMTAMSTVVAQFDKSGYGAVIQTPALHPGMFSILMPWTSGKDIKDRMRKFSRTAHVFALARDQGSGTVNSPSHISYQLKDVDKENLKIGLEKVLRILAAAGAEEIGTHNNKGRSINVKQVSYHEFEKFVKEESSMSLTDISTPLCSAHQMGSCKMGTNPRESVVNQMGETWEVEGLYLADTSVFPTALGVNPMVTVQAISYCTAQYVLEVLRRKRK

SEQ ID NO: 229573 - protein, 76 aa, Glycine max
  Coding DNA Sequence Number=SeqID_112795
METRLHTGKYPCGMRFRYGKGVHSDGCAGRHSDSREELHPQSLKDVDCMGGGRARAGALCNSDGGDWWWCNVEEIG

SEQ ID NO: 229574 - protein, 64 aa, Glycine max
  Coding DNA Sequence Number=SeqID_112796
  Subcellular localization annotation: CTP_CleavageSite=49; ConfidenceScore=5.12e-01
MGKGGYGGVFRKNRDGFFRNFRKKVFRKLSGRTVLPKVTKGHPEEHFFRKASGTPSFGNFPEEG

SEQ ID NO: 229575 - protein, 311 aa, Glycine max
  Coding DNA Sequence Number=SeqID_112797
  Gene Ontology: Mol. function=RNA-directed DNA polymerase activity; Biological process=RNA-dependent DNA replication
MGKVEEVQEQMKADIEAVMSIKEIMEVNAAAIVVTSTIVEDGWPSFSAKNKHAFPPYGLPPNYTPPNVAYTPSEDVNNSASILIESRQPQTDHAYVSQPMGETHEIPYHNLADFKPCLRYATEGQAVGGIPVQNTLEVPQYHPQPHPLHSTAGKNPHAMTKMGKLDHLEERLRAIEGGEDYAFANIEEFFLVPNIITPPMFNVSDFDKYKGTTFPKNHLKMYCRKMGAYAKDKELLIHFFQESLTGIAVTWYTNLEPSRVHSWKDLMVAFVRQYQYNSDMAPDRMQLQNICKKGARIFQRKFIKVERSGSP

SEQ ID NO: 229576 - protein, 158 aa, Glycine max
  Coding DNA Sequence Number=SeqID_112798
  Gene Ontology: Mol. function=catalytic activity; Biological process =metabolic process
  Homolog annotation: Hit_ID=Q89H44; Match level="QueryCoverage=96%, HitCoverage=67%, E-value=3e-63, Identity=73%"; Hit description =Hypothetical isochorismatase family protein
MPDYIVNSTPYPWPFDGNCTVQNTALLVIDMQTDFCGKGGYVDTMGYDISLTRAPIKPLQQVLARMRESGFPIIHTREGHRPDLSDLPANKRWRSRRMQAEIGAPGPCGRILVRGEPGWEIIPELAPLPDEVIIDKPGKGSFYATDLELICTVAVSAT

SEQ ID NO: 229577 - protein, 315 aa, Glycine max
  Coding DNA Sequence Number=SeqID_112799
HCRRALRHTGRHAVRLFRATAGPGADWLERPAYVPDHHAQRRHRDVAAGVSMTTSTQPVFSLHYVGLNLKKGVNAATFEAFLKARGTQIPAYPGWQWSLLKGLRGERQEQYLMLYQAPSQPEYDRYITPTGALTAEAIAFWQQRPEASALLEEWKNFATYGELPTLFSTFSLLAENRHSSLPPGPNFQPDAQPAVARVVGFHHLALRTGVTAADFDRFMIENVARIDDYPGWKFHILKGTGGNRSEQYAVMLVIESLDSLNSFHPAMDVSTEKSLTFVKNHQESERMYDEWRTMASFSGAPQMYTDYLTIAGNVG

SEQ ID NO: 229578 - protein, 79 aa, Glycine max
  Coding DNA Sequence Number=SeqID_112800
  Subcellular localization annotation: CTP_CleavageSite=43; ConfidenceScore=5.08e-01
MAKIQGPKEGKPILIFTKKSGYNLDPWAQKSTLRFMRTLGHPRAFFSSSSPILLEPLAHGSGTWSLPREDCIIMMTILV

SEQ ID NO: 229579 - protein, 71 aa, Glycine max
  Coding DNA Sequence Number=SeqID_112801
MGTLEVISKPWRFTVGSWLCDSDLVNPTGIERVLTEKNLPADSYSNLEAFILDEKEFLLLKVEEQTVWPYP

SEQ ID NO: 229580 - protein, 571 aa, Glycine max
  Coding DNA Sequence Number=SeqID_112802
  Gene Ontology: Mol. function=translation release factor activity, codon specific; Cellular component=cytoplasm; Biological process =translational termination
  Homolog annotation: Hit_ID=Q75I90; Match level="QueryCoverage=70%, HitCoverage=92%, E-value=0.0, Identity=88%"; Hit description =Eukaryotic peptide chain release factor subunit 1-3
  Pfam annotation: Domain name=eRF1_1; Domain location=6-140; Score =241.1; E_value=2.4e-69; Accession=PF03463.6; Description=eRF1 domain 1
  Pfam annotation: Domain name=eRF1_2; Domain location=144-278; Score =221.5; E_value=1.9e-63; Accession=PF03464.5; Description=eRF1 domain 2
  Pfam annotation: Domain name=eRF1_3; Domain location=281-412; Score =168.4; E_value=1.8e-47; Accession=PF03465.5; Description=eRF1 domain 3
  Pfam module annotation: Pfam domain module=eRF1_1::eRF1_2::eRF1_3; Domain location=6-140::144-278::281-412
MADAHGTDKNIEVWKIKKLIKALEAARGNGTSMISLIMPPRDQISRVTKMLGDEFGTASNIKSRVNRQSVLGAITSAQQRLKLYNKVPPNGLVLYTGTIVTDDGKEKKVTIDFEPFRPINASLYLCDNKFHTEALNELLESDDKFGFIVMDGNGTLFGTLSGNTREVLHKFSVDLPKKHGRGGQSALRFARLRMEKRHNYVRKTAEHATQFYINAATSQPNVSGLILAGSADFKTELSQSDMFDPRLQAKILNVVDVSYGGENGFNQAIELSAEILSNVKFIQEKRLIGKYFEEISQDTGKYVFGVDDTLKALEMGAVETLIVWENLDMNRYVLKNSATGEVVIKHFNKEQDSNQSNFRDPESNADFEVQEKLSLLEWFANEYKRFGCTLEFVTNKSQEGSQFCRAITEKLPTTGAGKGSQDTCTNMGGGGGCTCCSSSSSICSAPKVLLSDTSYLVLLTCTLWHHKFLQSFWQHLLPCSLLLTPRKARTKTCLLEKHYAEAVMLSKVLMKMLTVNRLFCLKVWRFFSQLPWEISGEARHDSAIKCNGMFIWLNFGLPPCSAIDNTGVNND

SEQ ID NO: 229581 - protein, 288 aa, Glycine max
  Coding DNA Sequence Number=SeqID_112803
  Gene Ontology: Mol. function=oxidoreductase activity; Cellular component=intracellular; Biological process=metabolic process
  Homolog annotation: Hit_ID=Q8W2K0; Match level="QueryCoverage=97%, HitCoverage=61%, E-value=3e-88, Identity=59%"; Hit description =Forever young oxidoreductase
  Pfam annotation: Domain name=adh_short; Domain location=60-273; Score= -15.6; E_value=5.8e-05; Accession=PF00106.15; Description=short chain dehydrogenase
MATTSSSSEEAPNTKKNKKECLGWIEWLRGWFYVVYEMLFQRIMASHLHNPMPLPPVNDLTCIVTGSTSGIGLEIARFLSLRISSYSKSSLEEADMNSNCLYSLKTNKDADIWYLLRSLSKLPLRQLAQSGAHVVMAVRNTKAAQELIQKWQVDSEGLSIPLNVEVMQVDLLSLDSVTRFAEAWNARSAPLHVLINNAGIFSIGEPQKFSKDGYEQHLQVNHLAPALLSILLLPSLIRGSPSRIVNVNSIMHHVGFVDTEDMNLTSGKRKFSSMVGYSSSKLAEVHFI

SEQ ID NO: 229582 - protein, 131 aa, Glycine max
  Coding DNA Sequence Number=SeqID_112804
  Gene Ontology: Mol. function=DNA binding; Biological process=DNA integration
MSPYQVVFGKACHLPIEIEHKAYWAVKTCNFSIDQAGEERKLQLSELDEIRLEAYENSKFYKEKTKKFHGSLIAKKDFVVGQKVLLYNSRLGLMSVDIKSESTNKSFKVNGHRLKPFLTNPSFLHPTSLLP

SEQ ID NO: 229583 - protein, 89 aa, Glycine max
  Coding DNA Sequence Number=SeqID_112805
MTFLAGLLKRTHYRLAKATEIQLLHNWLSWQEPAKPKISRKDMCLAPHKLHLAALNRAKISLSYGSLANRVTQLRKCYNEFRLAYRSST

SEQ ID NO: 229584 - protein, 130 aa, Glycine max
  Coding DNA Sequence Number=SeqID_112806
CVRWHAETKFGHSAPMIRGDTLRLSAPLCYADTVVSDGTQRPKTKFGHSAPMIRGDTLRLSAPLCYADTVVSDGTQRPKTKFGHSAPMIRGDTLRLSAPLCYADTVVSDGTQRPKTKFGHSAPMIRGDTL

SEQ ID NO: 229585 - protein, 106 aa, Glycine max
  Coding DNA Sequence Number=SeqID_112807
MVELFKTVRSGVANCRNLPFGERATRDSSVRLPRKENARSRHQCLFEEKVGKIGKVWSTNINRERNLPVEDRRTVKNLHEIAYGNISEALWKCLGLEFFHENNFSH

SEQ ID NO: 229586 - protein, 36 aa, Glycine max
  Coding DNA Sequence Number=SeqID_112808
MHPRVTHRAPAEGCKAPLPAIKDKLKVDATRVMDNP

SEQ ID NO: 229587 - protein, 52 aa, Glycine max
  Coding DNA Sequence Number=SeqID_112809
  Homolog annotation: Hit_ID=Q1SAZ0; Match level="QueryCoverage=98%, HitCoverage=3%, E-value=4e-14, Identity=67%"; Hit description =Integrase, catalytic region
MIHGKPPNWRKKGGSDGLALQASTSDQEKQSPSTPLPLTKEQLHQLYKLLES

SEQ ID NO: 229588 - protein, 41 aa, Glycine max
  Coding DNA Sequence Number=SeqID_112810
MDSSSDSENEIINLGLMAKDYESKEEMHSMNCIKNLSNLPN

SEQ ID NO: 229589 - protein, 111 aa, Glycine max
  Coding DNA Sequence Number=SeqID_112811
MHGSDGDYYGGNNNSSDGGGCYNSVVCFDDVKKNLLDNDCHHQKMGENVNVRIQIIQGEESFCSSLKLSCNQETGCLLDCENLEHKGEGSQGVLKVCKRFTEIVENLKWVA

SEQ ID NO: 229590 - protein, 155 aa, Glycine max
  Coding DNA Sequence Number=SeqID_112812
MAAQLIRDRVEMECLEGAWETLEGNTRCRFRGTIRFTATSLVHPDEPARTLQRTVEWILPTPTPYRLVEPAQVIEVTSSEEDPEEDLEELPPEPAMDALDFLEGDEDPLLEVDSPEEVMSASEADSTEDSGRGRWRSAGALHPSGQLFGLVLYTF

SEQ ID NO: 229591 - protein, 90 aa, Glycine max
  Coding DNA Sequence Number=SeqID_112813
MGLASGSTSIPESIRTESLEVYFGNYTMIKMEKSSGFPVLFGGENSNPPDDGGKDKILGLQLSARLQNNGLKDKIFLGLELIARLQHRTR

SEQ ID NO: 229592 - protein, 69 aa, Glycine max
  Coding DNA Sequence Number=SeqID_112814
MKEKGKRKKDREGRCVIVKKYKSFVKSRRIFWKQGIDAKSLFSGKTEIRMDEFIELIKEHNWETLGLFV

SEQ ID NO: 229593 - protein, 284 aa, Glycine max
  Coding DNA Sequence Number=SeqID_112815
  Homolog annotation: Hit_ID=Q8H348; Match level="QueryCoverage=40%, HitCoverage=34%, E-value=7e-20, Identity=43%"; Hit description =Putative fiber protein
  Pfam annotation: Domain name=DUF761; Domain location=5-278; Score =75.2; E_value=2.1e-19; Accession=PF05553.2; Description=Cotton fibre expressed protein
MWIAKLVLMSMGVISTLVLLKVAIVPYTFHLLLSTLPQFCVSVRSWLTLPFLYIIVNFIIITIAASSNFPPKTFSDSPAPSDPKHTTTVISDTANHPTESENQTNEPKEEEKEVEEEEEELEQEEVVEEELEQEEVIEESGLTYDKFMIQPSLESCTNDYVLPDSDGDDTLEATWRAIMEGQGKTMKPQLKKSDTWGARIAKAEPFHRNGEGGGGDDDPVAWAQKELKKSDTFNDRASLRRDKSMSPEELNRRAEAFIKKINNQMKLQRLESYQRFREMVNRGV

SEQ ID NO: 229594 - protein, 247 aa, Glycine max
  Coding DNA Sequence Number=SeqID_112816
  Gene Ontology: Mol. function=zinc ion binding
  Homolog annotation: Hit_ID=Q47522; Match level="QueryCoverage=21%, HitCoverage=64%, E-value=1e-23, Identity=100%"; Hit description=LacZ protein
  Subcellular localization annotation: CTP_CleavageSite=31; ConfidenceScore=5.24e-01
MTTNLVESINLVLKKTQNLPMSTLVKSTYTRCNALFNQRGREATTMITFGQIYTQVLSKTMEDTQRKETINLREVRLARNFMVRLDERWCDYLKFQKVHMSCSHVVVTSKRIGHRAMSQKSASTQRRKEILKARLKIGSCPGDSVLVLERPPPRWSSNSPYSESYYNSLAVVLQRRDWENPGVTQLNRLAAHPPFASWRNSEEARTDRPSQQLRSLNGEWDAPCSGALSAAGVVVTRSVTATLASAD

SEQ ID NO: 229595 - protein, 75 aa, Glycine max
  Coding DNA Sequence Number=SeqID_112817
MTYCRQAQFLMAITELSHPESGLARVAAFRSANLAKRSDPHAKPKLAKRAYRAKRVHLLRMNTHPLAKLPMAKRG

SEQ ID NO: 229596 - protein, 153 aa, Glycine max
  Coding DNA Sequence Number=SeqID_112818
  Homolog annotation: Hit_ID=Q8L555; Match level="QueryCoverage=42%, HitCoverage=33%, E-value=5e-12, Identity=46%"; Hit description =Uclacyanin 3-like protein-like protein
  Pfam annotation: Domain name=Cu_bind_like; Domain location=1-58; Score=31.9; E_value=2.7e-08; Accession=PF02298.8; Description =Plastocyanin-like domain
FSYTAAHDVMEVNQLDYDTCKIANALATYDNGETVIHLSDAKTRYFVCGRMGHCQQGLKLQVQILAQSNNGTSNDQNQSPGGSPPSTSPPPPPPPPPPQDDEQPPADEPVPCDCSRAEERHGVVPLITLVIVLAFARTHFFIAFPHLRFHNIR

SEQ ID NO: 229597 - protein, 193 aa, Glycine max
  Coding DNA Sequence Number=SeqID_112819
  Gene Ontology: Mol. function=translation initiation factor activity; Cellular component=eukaryotic translation initiation factor 3 complex; Biological process=regulation of translational initiation
  Homolog annotation: Hit_ID=Q6Z730; Match level="QueryCoverage=97%, HitCoverage=80%, E-value=1e-40, Identity=50%"; Hit description =Putative eukaryotic translation initiation factor 3, subunit 1 alpha, 35kDa
  Pfam annotation: Domain name=eIF3_subunit; Domain location=1-193; Score=114.4; E_value=3.4e-31; Accession=PF08597.1; Description =Translation initiation factor eIF3 su
APAAPAVKTTEKAPKKSSDKATEKKGKTVEPIKEEPLDPVAEKLRQQRLIEEADYKATKELFSGGKEKDEKNLDTFIPKSESDFLEYAELISHKLRAFEKSYHYIGLLKAVMRLSTISLKGADAKDIASSVTAIANEKIKAEKEANAGKKKIDVFKVFAVTAGGKKKQLNVDKPDEDFVPADRYDALDDYDFM

SEQ ID NO: 229598 - protein, 57 aa, Glycine max
  Coding DNA Sequence Number=SeqID_112820
MELLGDGGFSAHVCKTLTVLVVESQRRKSKQRKFRGEHGWGCSDNEKNTDIPFILVC

SEQ ID NO: 229599 - protein, 433 aa, Glycine max
  Coding DNA Sequence Number=SeqID_112821
MGGDSIVSHGTDEGSCLEENFPLLSSHSSPALRDNLGLQDEDNRMKAENGLTCSETDEEIIHPSRVDFEVNERRRVINYQEILQCCDELKIHSKDLKREKQKILRYKPGAWIEKAGGLKISDYDVPKTTCLLLVGPRGSGKSSLINRISKVVEDDRFAPARAQESYNSLLGDGTSFLQEYMIPRYSNSICLYDTRSLSDNSEKDENIRMLKSWMTKGVHHGELVVRKTDNQRLRKSLKGKAHKKGYLSTMENDGALETQCVQSIVSTFNCPFLSFKGEEERGRQKLSASWDLWTGKTLDPYDKPVLVFTHGDLLSFSERALVREHLGTLLGIPPTKQIFDIPDCDCPATESAIIGMLRYSLAHADRHFPQRSKVMDKVHKMSLSLYMILLILGIGIAIGWAQNTENRRVQFPRPKQKVPKSKPIEWHKIRHIW

SEQ ID NO: 229600 - protein, 80 aa, Glycine max
  Coding DNA Sequence Number=SeqID_112822
MAVATRGGREKGEWISDLEKKNHVESEAISYGGDIDIDIDIDIDIDIDRKKMKWLSSESQSSENKSLAGDRRPWSGLEQV

SEQ ID NO: 229601 - protein, 467 aa, Glycine max
  Coding DNA Sequence Number=SeqID_112823
  Gene Ontology: Mol. function=GTP cyclohydrolase I activity; Cellular component=cytoplasm; Biological process=aromatic compound biosynthetic process
  Homolog annotation: Hit_ID=Q8VYU3; Match level="QueryCoverage=99%, HitCoverage=99%, E-value=1e-173, Identity=66%"; Hit description=GTP cyclohydrolase I
  Pfam annotation: Domain name=GTP_cyclohydroI; Domain location=102 -202; Score=34.2; E_value=4.6e-07; Accession=PF01227.12; Description =GTP cyclohydrolase I
  Pfam annotation: Domain name=GTP_cyclohydroI; Domain location=337 -442; Score=65.4; E_value=1.8e-16; Accession=PF01227.12; Description =GTP cyclohydrolase I
  Pfam module annotation: Pfam domain module=GTP_cyclohydroI::GTP _cyclohydroI; Domain location=102-202::337-442
MGCVIDGRFTVEIQNGVSNGCGEVGLWNDGGGAIEDAVKVLLEGLGEDVNREGLRKTPLRVAKALHEGTRGYRQKVNDIVQGALFPEAGLDNRVGHAGGAGGLVIVRDLDLFSYCESCLLPFPVKCHVGYVPSGERVVGLSKLSRVADVFAKRLQEPQRLADEVCSALHQGIRPAGVAIILQCSHIHFPDIESVFLDSNYQGWVKILVSSGSGVFENKNADVWADFFGLLKFRGINMDKIHFRGSSDPCWCPSQSSLSAKVSSKIGPVNPVMVTAVASVIESLGENPLRKELIGTPTRFVKWLMNFQKSNFNIKLNGFLCDGIDSLNVNEDVNINKKITSELNIPFWSQCEHHLLPFHGVVHIGYLMSDGFNPILKSLLQSIVHFYGFKLQVQERLTRQIAETIAPLLGGDVIVVVEASHTCMISRGIEKFGSSTATIGVLGHFSTDPTARASFLKSIPYPTSSGEQ

SEQ ID NO: 229602 - protein, 135 aa, Glycine max
  Coding DNA Sequence Number=SeqID_112824
MVSFFMMGQKHHMTLVEFNVTLVFETDASILTNGDRQAKLRAHEGYAWASTWKKITGQGRYNAQLSQGQLDSRPYSLSYSQVAFRLARHLGYDLDTNDTQHVPMFVFHHTTLLSIGCIFQEGNGYAFIEHAPHQQ

SEQ ID NO: 229603 - protein, 58 aa, Glycine max
  Coding DNA Sequence Number=SeqID_112825
MAPKKLPAKRARKDATGEGSSAAPQVDVEFDKHRFRKLVMEFYVNAWPTKEGVKDKCS

SEQ ID NO: 229604 - protein, 243 aa, Glycine max
  Coding DNA Sequence Number=SeqID_112826
  Gene Ontology: Mol. function=chitin binding; Cellular component =extracellular region; Biological process=chitin metabolic process
  Homolog annotation: Hit_ID=UPI000044A8F0; Match level="QueryCoverage =97%, HitCoverage=99%, E-value=1e-48, Identity=35%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MVNTLAFRGLHALAIRGLNILAFRGLHAFAFRGLHILAFRGLHILAVRGLHTLAFKGLHAITFRGLQDLAFRGQHVLAFRGLHVLAFRGLHVLAFRELHVLAFRGLHVLAFRGLHILAFRGLHVLAFRGLHILAFRGLHALAFRGLHFLAFRGLHFLAFRGLHVLALRGLHALAFRGLHVLAFRGLHDLAFRGLHILAFKGLHVFAFRGLHALAFKGLHALVFRSLHVLAFRGLHILAFRGLH

SEQ ID NO: 229605 - protein, 32 aa, Glycine max
  Coding DNA Sequence Number=SeqID_112827
METTAAGATSNSLYGDFEPYSKWLTKATSYPY

SEQ ID NO: 229606 - protein, 96 aa, Glycine max
  Coding DNA Sequence Number=SeqID_112828
MVVQEAIEDLKSIINGEGKKEKERRKSGEEGREKDKMLYGGSDGSVVPVMLAVTLSSAKQRKVRNDKKYKKGQNWNRGGKIKFRTVQCKTSLGCAR

SEQ ID NO: 229607 - protein, 148 aa, Glycine max
  Coding DNA Sequence Number=SeqID_112829
  Gene Ontology: Mol. function=chromatin binding; Cellular component =chromatin; Biological process=chromatin assembly or disassembly
MAEEGVKCERRGDFDTAKGETQIQHRRRDIDSLFVSHFWQALFRASGTQLRLSSAYHPKSDGQTEVLNRVVEQYLRAFVHRRPGRWGKLLPWVECSHNSSWNASSGSTPFEITFGRKPFTFPKYITGSSKLDAVDSSLVERDATIQAI

SEQ ID NO: 229608 - protein, 294 aa, Glycine max
  Coding DNA Sequence Number=SeqID_112830
  Gene Ontology: Mol. function=transmembrane receptor activity; Cellular component=membrane; Biological process=defense response
  Homolog annotation: Hit_ID=Q9FVK2; Match level="QueryCoverage=66%, HitCoverage=57%, E-value=4e-70, Identity=69%"; Hit description =Resistance protein MG13
  Pfam annotation: Domain name=TIR; Domain location=14-144; Score =135.5; E_value=1.4e-37; Accession=PF01582.10; Description=TIR domain
  Pfam annotation: Domain name=efhand; Domain location=201-229; Score =25.6; E_value=0.00017; Accession=PF00036.22; Description=EF hand
  Pfam annotation: Domain name=efhand; Domain location=267-294; Score =28.9; E_value=1.8e-05; Accession=PF00036.22; Description=EF hand
  Pfam module annotation: Pfam domain module=TIR::efhand::efhand; Domain location=14-144::201-229::267-294
MAATTRSRASIYDVFLNFRGEDTRYGFTGNLYRALSDKGIRTFFDEEKLHSGEEITPALLKAIKDSRIAITVLSEDFASSSFCLDELTSIVHCAQYNGMMIIPVFYKVYPSDVRHQKGTYGEALAKHKIRFPEKFQNWEMALRQVADLSGFHFKYRDEYEYKFIERIVASVSEKINPARIHVADLPVEQESKVQDTHQEQEYREAFKVFDKDQNGYISASENLLVLTKNCIYAQRHTYTCPHILKSFRAMQLRQVLIKLGQNTTVGEVEEMIATADFDGDGQISYDEFVKTMKI

SEQ ID NO: 229609 - protein, 51 aa, Glycine max
  Coding DNA Sequence Number=SeqID_112831
MQRYHACSCTSAVNNNAIGGPSTRDIRRTDSSSLQANFPVSSRCCYCNTHK

SEQ ID NO: 229610 - protein, 149 aa, Glycine max
  Coding DNA Sequence Number=SeqID_112832
  Subcellular localization annotation: CTP_CleavageSite=94; ConfidenceScore=5.00e-01
MKILGQAVRKVVIVALCFLAIGSAKAKKFHARSGSTNGNLEQCPWPPTGLNPYCHFSRRTSSPRAQRHLIPFLLRFLLMLPTCDPTSLFLRGVVDQIQKGDAGRATDTKGNEKLKMRNTREEEQTRGEERKGMECESAWNHEIIKIHSQ

SEQ ID NO: 229611 - protein, 487 aa, Glycine max
  Coding DNA Sequence Number=SeqID_112833
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=3e-48, Identity=28%"; Hit description= UPI00006A17C9 related cluster
GLHALSFRGLHVHAIRGLRVLTFRGLHVLAFRGPHALAFRGLHVLAIRGLHVLSFRWLHALTFRGLHVLSFRGPHVLAIVGLHVLAFNGLHVLAFSGLHVLAFRGVHALSFRGLHVLAFRGLHVLAFKGLHVLAMRGLHVLAFIGLHILTFRELHIPPIRGLHTLPSEDYASSLSEDYTSSPSEGYTSSPSKDYTSSPLEKYTSYPSEDYTSSASEGYTPSPSEDYTSSPSEDYMCYPFSGLHVLTITGLHTLTFGGLHAITFRGLHVLANKGLHALTLRGLHVLSFRGLHIAAFIGLYVLAIRGLHLLAFIGLHALTIRGLHILTFRGLHVLAFRGLHTLEFRGLHVLAFSGVHVLPFQGLHILAFRGLHALTSRGLHVLAIRGLHVLPFRVLHVLLFRGLHALAFRGLHVLPFRGLHVLTFRGLHVLAFRGLHAHKGLHVLAFKGLHLLAIRGLHILTFRGRRVLACRGLHALNFRGLNVLSFRG

SEQ ID NO: 229612 - protein, 64 aa, Glycine max
  Coding DNA Sequence Number=SeqID_112834
MERIQKSTSSDKSQWWFHGLSTTMHHKNRKTLDEASLLSSESKTQQDHRSTSTPYGSHRPGYRS

SEQ ID NO: 229613 - protein, 66 aa, Glycine max
  Coding DNA Sequence Number=SeqID_112835
RGAGSGIYEGAGGIIGISVEEEEGSVEEEGVGASDCAVEGASDLLPLAFLGPLKVTVDHQDSNSSS

SEQ ID NO: 229614 - protein, 143 aa, Glycine max
  Coding DNA Sequence Number=SeqID_112836
MEKATLPQEKEGLTKDSQEANKEGEKEVLIPLQRLGDEEEVFKDFGLTINSSSSSTCNFVQATNKMKTTVAKPHPSVEKEDPPRKKIIPKDPEWNKKKRDNITIQAFGYGVDDHTKGSMQKRKITLFEGGRFSSLFHPLGLRR

SEQ ID NO: 229615 - protein, 91 aa, Glycine max
  Coding DNA Sequence Number=SeqID_112837
MVREVYGSLLMNENLENEKFHKQILHLPIPSNVKESTRHLLFDYRFSYYIWSIYLWFGDMQKINGSGMEKEERSLKMPLQGEDESRTSSPP

SEQ ID NO: 229616 - protein, 77 aa, Glycine max
  Coding DNA Sequence Number=SeqID_112838
MIDCSKEPYLAKGRSYLAGQRRQGYCSGYYGDSFCHRNPDAKGMYPILYSKRDRRVPGQVKLDSHSKLKLELKFNES

SEQ ID NO: 229617 - protein, 259 aa, Glycine max
  Coding DNA Sequence Number=SeqID_112839
MAYPPGLHIFKATDIKMVADRVHLLLPVWVLPRRGDLSCIVRHKCLRGRQRKYYFDDACIYLTRDDDNYSFIQRLLQLPSIPYRGAYNLKKMMEAQMIAHRRVDVVEIAAKEVATTVQAKAYAKAMDDTIVCGFLIDLTNTGVMDEIVGTLTPYPESKQSTTSNEATSQDKGDHEVVIVYSTSSCPTPLNYAQPTTVTHDQSIQQAQLSMLRIVAAPAPASVSQPASLEPPPQPLALIPPPPPSFSPPSRPLPSSPFQD

SEQ ID NO: 229618 - protein, 72 aa, Glycine max
  Coding DNA Sequence Number=SeqID_112840
MNVWDMHHKCAYVFKMENEGKLIEEGMNELMYDSILGGYPIWNLQVAHVDPVGWSTLAKLGNLDGPLAVSSQ

SEQ ID NO: 229619 - protein, 230 aa, Glycine max
  Coding DNA Sequence Number=SeqID_112841
  Gene Ontology: Mol. function=RNA-directed DNA polymerase activity; Cellular component=extracellular region; Biological process=RNA -dependent DNA replication
MYKFSFHAGALEWRCSLTIFNRLEEFAKETSFLLICLCCALKGFSLIKIAVDQNLWSPIQLSRGGPQLSYLAFADDILLFVEATPSQAEVLKKVLDTFYKSSGQKVNADKTRIYSRNVHWKTNDQVANHLGFQRTADLGKYLGVPLHHERVSKQNYQFLLDKVNSRLSNWKASNLSMAGRMTLTKAILQALPNYVMQTTYLPASVSDEIDKKCRQLLCGEIQQITRRFMG

SEQ ID NO: 229620 - protein, 141 aa, Glycine max
  Coding DNA Sequence Number=SeqID_112842
  Subcellular localization annotation: CTP_CleavageSite=57; ConfidenceScore=5.78e-01
MVSKFVNYNKLPSPIVSSPSVPFCVSHRPFSFMFVSPNTMFYIPNRRKFSIDFKNKVNNNIWSQLPLSKHKGLRSVSDSTKRRRHFEIPITPILAGSNDGSWWPPVVVDGEGGRVRAWISLCELVSLSGSPLLALSATFRA

SEQ ID NO: 229621 - protein, 40 aa, Glycine max
  Coding DNA Sequence Number=SeqID_112843
MTCTLPNVAYAFSMMSRYQYDPNESRRIVVKNIIKYLRRN

SEQ ID NO: 229622 - protein, 144 aa, Glycine max
  Coding DNA Sequence Number=SeqID_112844
MNLIIVIKKKRTRFTAPRTRARSRVMGEVEEVQEQMKADMEAMKEKMATMMEAMMSMKKIMEANAVVVAATSAVAKVNLTPPSGLNHMNHPTSDMVGKDLGNTGSPYYVQIQNKHAFLPYGLPPNYTPPNVAYTDAILPCKGIG

SEQ ID NO: 229623 - protein, 172 aa, Glycine max
  Coding DNA Sequence Number=SeqID_112845
  Subcellular localization annotation: CTP_CleavageSite=11; ConfidenceScore=5.05e-01
FTDSPSVVMVSASLFSSSSRPSVSLEHVYTSHDTDSMRSMGLAILKENGKRHQEALSKMAYLEAKVAKSNHQLSPKASKVESTVVEKEELAKVVVDLEARLKEAKSKLEETELRASKEREAIKELEEELLVYKKKVVEQDEKGFYKVIRQAGWSRSLEAHARCPSLPQCKAL

SEQ ID NO: 229624 - protein, 50 aa, Glycine max
  Coding DNA Sequence Number=SeqID_112846
LEMNLKKTGSDFGTQPQGSCPKIPHAYTIRNNRNIGRSPTSTIPVDETDI

SEQ ID NO: 229625 - protein, 40 aa, Glycine max
  Coding DNA Sequence Number=SeqID_112847
YGTRSGIPDTQRVPDEYGDEIINCNPSGIGYGYGDMLGSR

SEQ ID NO: 229626 - protein, 41 aa, Glycine max
  Coding DNA Sequence Number=SeqID_112848
MEGFSSQHEMEACAQWGCALPGQHDDGLMMISCIRKPPTGA

SEQ ID NO: 229627 - protein, 152 aa, Glycine max
  Coding DNA Sequence Number=SeqID_112849
MSGLTPDSPQISASPHQLDHAPYASGPYNAQWNAPGLLHDKHTLRSSHILGEMEVEEPWLGLWLPLNYRMDMGASQHRTPELGHVVSRQALWLFWGWPLWMIGHNKGFSLIPSFAPVFAFCLFSNPLRSFRRRRPNLQNLKVPLELPGLSTF

SEQ ID NO: 229628 - protein, 89 aa, Glycine max
  Coding DNA Sequence Number=SeqID_112850
ITLARHPVDPEKSNRVLRFPVLITGLYQFYGVPVAPSKGETPQQLGDGRQWATDAPPPSPEFTSAHPQKGCSVAYDTWPTSRRPSPKQR

SEQ ID NO: 229629 - protein, 111 aa, Glycine max
  Coding DNA Sequence Number=SeqID_112851
MKVALEQTLKEAPKVGVEAINKRKQNRLGKSIADDDLEEDEEMLAKEHQTKRRHESVVSTLACPSTVNPVTQRLKDLSETDDDGEGLVRVALQKRKVVALDAPALKKAKKA

SEQ ID NO: 229630 - protein, 103 aa, Glycine max
  Coding DNA Sequence Number=SeqID_112852
MASTNTPITKVIPTIKIITIHTNNEPSIHVEHFFDIQELKKFINKKTIASKVLGVKIILSRDTIAKATRCLRKGSTYQEGWEKNYNSHIIRALYHDNAEKASD

SEQ ID NO: 229631 - protein, 134 aa, Glycine max
  Coding DNA Sequence Number=SeqID_112853
  Subcellular localization annotation: CTP_CleavageSite=66; ConfidenceScore=5.04e-01
MKLGGKQRYPSGYPYKHAFAICQTQSPRYPSGYPYKHSFAIRQTQSPVTGGDTQAVLRTNDFQYPSDSKSGSMQRQMSSFALLLIRTRERYPSGYPYKHAFAIRQAQSPAEIPKRFSVQTISVDPDTGSQVADG

SEQ ID NO: 229632 - protein, 124 aa, Glycine max
  Coding DNA Sequence Number=SeqID_112854
MSTSYLLLKIFVLIIPELDASLSVERPSFDGLEALLVLGAPETVAIKLEGGTGPFSRGVPPISLRGKLFRSHFLLEMNNSAKWNQKLGKNGYLRDAKLVNPVAFIFLNEGGEFLGAENFPLPPF

SEQ ID NO: 229633 - protein, 92 aa, Glycine max
  Coding DNA Sequence Number=SeqID_112855
MAKFDLDIVLEFYANAWPTEEGVRDIRSWVRGQWIPFDADALSQFLGDPLVLKEGQECEFSQRRPLLSYYAHRVKISPGPLQGGECGSCTPV

SEQ ID NO: 229634 - protein, 410 aa, Glycine max
  Coding DNA Sequence Number=SeqID_112856
MSSLPVEPKQQQLEAHCRGYILRLIDEVLMPDKIGNRCVGPLTLMPKPWATMRHCCNLVHGMPFIAARVNQIPSFSLVTSGSGLGFTGTPHGDVIDYRMRPKEEKVQVADDSLSEANPLSEWHPLSEAYSSLSGAPSLAKPKFTYSRLASLRKLKGSRAFKTLKLAESDRDRAKRALRAKHALCAKRIMLISEGTLSESISLSAQWPPERGNLPPLDLKSPMIPRDSFPRSHGRALTRKPDGCIDVALVKEFYANLYDPEDKSPRQVRVRGKLIKFDGETLNTFLETLVVLEPGERYLAYSRFYHMHPDPQELATKLCIPGRGFVLNAEGTPRKLLRKDLTTLAQTWSVLSYSNLTPTSHTSDLNMNRARAQGPSNASTSTPNSTSALATTPAPTSAPVPMTSWNFYPKF

SEQ ID NO: 229635 - protein, 99 aa, Glycine max
  Coding DNA Sequence Number=SeqID_112857
MTLGGALVKDESASCFHYRSQKRAAEEGSSAGTRKTVLPWMTNRACGRTFFCGIYCLPAEEGSSASERRFVFNVRKKVLPLDHAEETSSADIRGRNIFC

SEQ ID NO: 229636 - protein, 94 aa, Glycine max
  Coding DNA Sequence Number=SeqID_112858
MVMGGGEEGVRVWVGVWRGGEGEIVFFTLKNLVSLSGSPLFTLSATIHAKHNSLCTNSRSGRQFSLSAIPSWVGIALSALILAQRNSLSGWNYT

SEQ ID NO: 229637 - protein, 131 aa, Glycine max
  Coding DNA Sequence Number=SeqID_112859
  Homolog annotation: Hit_ID=Q8S1P4; Match level="QueryCoverage=90%, HitCoverage=46%, E-value=4e-28, Identity=48%"; Hit description =Membrane protein COV-like
  Pfam annotation: Domain name=DUF502; Domain location=1-105; Score =36.2; E_value=5e-09; Accession=PF04367.3; Description=Protein of unknown function (DUF502)
MALVRYLYVASTQISATISPDQSSNAFKEVSIIRHPHVGEYALGFITSSMVLRNIDEKEIFCVYIPTNHLYLGDIYLISLEDILRPNLSVREAIDLATHNPVKRAMYSTIVPTSKENKHFMDRGSYLHRHL

SEQ ID NO: 229638 - protein, 111 aa, Glycine max
  Coding DNA Sequence Number=SeqID_112860
MAKHMDNSGRRMSCIEALSESQLAKRIFITFKLSEFFGYQEIKRELSLKRKPSWGTLDEILRDCEEASLLWRAKSSVGSSYGVLDYLILVCLCLDHALACLVRVTQHWEMV

SEQ ID NO: 229639 - protein, 115 aa, Glycine max
  Coding DNA Sequence Number=SeqID_112861
MSFSKDFLAGNRLPKYVIDYQCSKMNYTVFAHWNLIVTLCNRLHINGNRLLVAEATEHPVSIFKPRNRLPTNGNRLPEGIFHITPKINSWPASTHASLLHGLLFLYWFTARSSPA

SEQ ID NO: 229640 - protein, 840 aa, Glycine max
  Coding DNA Sequence Number=SeqID_112862
  Gene Ontology: Mol. function=protein binding; Cellular component =integral to membrane; Biological process=xylan catabolic process
  Homolog annotation: Hit_ID=Q1S5Q1; Match level="QueryCoverage=71%, HitCoverage=94%, E-value=1e-155, Identity=36%"; Hit description =Leucine-rich repeat; Leucine-rich repeat, cysteine-containing type
  Pfam annotation: Domain name=LRRNT_2; Domain location=103-142; Score =36.2; E_value=1.1e-07; Accession=PF08263.3; Description=Leucine rich repeat N-terminal domain
  Pfam annotation: Domain name=LRR_1; Domain location=257-279; Score =14.3; E_value=0.45; Accession=PF00560.23; Description=Leucine Rich Repeat
  Pfam annotation: Domain name=LRR_1; Domain location=281-303; Score =18.6; E_value=0.023; Accession=PF00560.23; Description=Leucine Rich Repeat
  Pfam annotation: Domain name=LRR_1; Domain location=305-327; Score =8.1; E_value=8.9; Accession=PF00560.23; Description=Leucine Rich Repeat
  Pfam annotation: Domain name=LRR_1; Domain location=329-352; Score =5.3; E_value=30; Accession=PF00560.23; Description=Leucine Rich Repeat
  Pfam annotation: Domain name=LRR_1; Domain location=425-444; Score =7.4; E_value=12; Accession=PF00560.23; Description=Leucine Rich Repeat
  Pfam annotation: Domain name=LRR_1; Domain location=467-490; Score =11.9; E_value=1.7; Accession=PF00560.23; Description=Leucine Rich Repeat
  Pfam annotation: Domain name=LRR_1; Domain location=495-516; Score =12.7; E_value=1.2; Accession=PF00560.23; Description=Leucine Rich Repeat
  Pfam annotation: Domain name=LRR_1; Domain location=519-541; Score =9.8; E_value=4.3; Accession=PF00560.23; Description=Leucine Rich Repeat
  Pfam annotation: Domain name=LRR_1; Domain location=543-565; Score =13.7; E_value=0.67; Accession=PF00560.23; Description=Leucine Rich Repeat
  Pfam annotation: Domain name=LRR_1; Domain location=567-588; Score =14.9; E_value=0.3; Accession=PF00560.23; Description=Leucine Rich Repeat
  Pfam annotation: Domain name=LRR_1; Domain location=589-611; Score =5.5; E_value=26; Accession=PF00560.23; Description=Leucine Rich Repeat
  Pfam annotation: Domain name=LRR_1; Domain location=613-635; Score =3.9; E_value=53; Accession=PF00560.23; Description=Leucine Rich Repeat
  Pfam annotation: Domain name=LRR_1; Domain location=679-701; Score =5.1; E_value=31; Accession=PF00560.23; Description=Leucine Rich Repeat
  Pfam annotation: Domain name=LRR_1; Domain location=703-725; Score =12.8; E_value=1.2; Accession=PF00560.23; Description=Leucine Rich Repeat
  Pfam annotation: Domain name=LRR_1; Domain location=727-749; Score =15.6; E_value=0.18; Accession=PF00560.23; Description=Leucine Rich Repeat
  Pfam annotation: Domain name=LRR_1; Domain location=751-772; Score =8.2; E_value=8.3; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1; Domain location=103-142::257-279::281 -303::305-327::...
  Pfam module annotation: Domain location=329-352::425-444::467 -490::495-516::519-541::543-565::567-588::589-611::613-635::679 -701::703-725::727-749::751-772
MASKVTKKYITKIYTGPTTRNFNVAEMCSLSLRAYEMCTCITGVPKAPEVRSGVGWIVCLPITNTSSHMIMDASASNVKFFLICSLCLIMFNSVICSLKAQCNEKDTNTLLHFKQGVTDPSGLLSSCFPELDCCHWTGVKCDNITGRVTQLNLPCHINHPKVVDYGEKDDKSNCLTGEFSLNLLELEFLSYLSRANRNSNCCNRIITTSKLVECCNKLRKILQALGAFAQLELKRSPASSQNEIHSQLPKTLPNLRSVKSLILSHNYLKGSIPNWLGQLEQLQELVLSDNFFSGPIPASLGNLSSLIELILDLNELNGNLPDTLGQLFNSETLRVGGNSLTGIVSERNLLSFPKLQRLYIGSPDLIFNFDPGWVPSFQLLRIGLGYVRDQLPAWLFTQTSLKYLSILHSTASFEPLDKFWNFATQLEYIDLTNNTIHGDMSNVLLSSKFVWLASNNLSGGMPGISPQVTVLNLGNNSLFGSISPLLCDNMTDKSNLVHLSLGHNHLSGEITSCWNNWKSLVLIGLQSNNLTGKIPHSMGSLSNLRFLYLGSNKFFGEVPFSLKNCKNLRILDLGHNNLSGVIPSWLGQSVKGLLLRSNQFSGNIPTELCQINSIMVMDFASNRLSGSIPNCLQNITAMISSYASTRRVVFTVNLTGIPVHIYCNIWMLIKGNELAYVDLMNVIDLSSNNLSGSVPLEMYMLTGLQSLNLSHNQLMGTILEEIDNLKQLEAIDLSRNNLSGEIPESMSALHYLAVLNLSFNNFVGKIPTGTQLGSTNLSYIGNPDLCGAPLTKICPQDDESHDTKPREEEDDDEKSEVYSWFYMGLGIGFAVGFWGVLGTT

SEQ ID NO: 229641 - protein, 179 aa, Glycine max
  Coding DNA Sequence Number=SeqID_112863
  Homolog annotation: Hit_ID=Q1RYI7; Match level="QueryCoverage=47%, HitCoverage=28%, E-value=6e-11, Identity=50%"; Hit description =Abortive infection protein
MLMLIQCVGFPFTLPVYVWISIKCKKVVPEVEAEPNGCALVSLVGVEAPIQWPFLSVTVMHTETINPIHQSPVWHCHQCPPPFLPFPSLSHFAKIPGLPFSIHPPLLFHPNQQSRFLKRHGNTSSETDGSELKEDKLSEDLVKLEGDQSKNLKKDWLATILTLWFWLLCDYVRHSCAKP

SEQ ID NO: 229642 - protein, 102 aa, Glycine max
  Coding DNA Sequence Number=SeqID_112864
MRGTRIRATWGYVSLVESGQLVMWYLEICRGAHETLGTLGGVLLPKTKLDQSRPNPGIACVVAGQLWILSDIWDMASGNRLPREVEMASGNRLPRGVIDYKA

SEQ ID NO: 229643 - protein, 1208 aa, Glycine max
  Coding DNA Sequence Number=SeqID_112865
  Gene Ontology: Mol. function=ATPase activity, coupled to transmembrane movement of substances; Cellular component=integral to membrane; Biological process=transport
  Homolog annotation: Hit_ID=Q1S0T1; Match level="QueryCoverage=88%, HitCoverage=88%, E-value=0.0, Identity=63%"; Hit description=Cyclic peptide transporter
  Pfam annotation: Domain name=ABC_membrane; Domain location=528-797; Score=50.2; E_value=6.9e-12; Accession=PF00664.13; Description=ABC transporter transmembrane region
  Pfam annotation: Domain name=ABC_tran; Domain location=296-467; Score= 168.3; E_value=2e-47; Accession=PF00005.17; Description=ABC transporter
  Pfam annotation: Domain name=ABC_tran; Domain location=869-1052; Score=152.4; E_value=1.2e-42; Accession=PF00005.17; Description=ABC transporter
  Pfam annotation: Domain name=MMR_HSR1; Domain location=870-956; Score= -11.2; E_value=0.011; Accession=PF01926.13; Description=GTPase of unknown function
  Pfam annotation: Domain name=SMC_N; Domain location=858-1056; Score= -124.3; E_value=0.016; Accession=PF02463.9; Description=RecFRecNSMC N terminal domain
  Pfam module annotation: Pfam domain module=ABC_membrane::ABC _tran::ABC_tran::MMR_HSR1::SMC_N; Domain location=528-797::296 -467::869-1052::870-956::858-1056
VVDSVSQRHWFFDARRSGLKIRSALMVAVYKKQLKLSSSARRRHSTGEIVNYIAVDTYRMGEFPWWFHISWTSAVQLVLSVGVLFGVVGVGALPGLVPLVICGLINVPFAKILQHCMAQFMISQDERLRSTSEILNSMKIIKLQSWEDKFKNLVENLRAKEFIWLSKSQMMKSYGTFLYWMSPTIVSAVVFLGCALFNSAPLNAGTIFTVFATLRNLSEPVRMIPEALSMMIQVKVSFDRLNTVLLDEELDSSNANRRNINQSSVNAVEIQAGNFIWDHESVFPTLRDVNLQIEQGQKIAVCGPVGAGKSSLLFAVLGEFPKISGTVNVSGTVAYVSQTSWIQSGTVRDNILFGKPMDKTRYDDAIKVCALDKDINDFSHGDLTEIGQRGINMSGGQKQRIQLARAVYNDADIYLLDDPFSAVDAHTAAILFNDCVMMALREKTVILVTHQVEFLSQVDTILVMEGGKVTQAGNYVNLLTSGTAFEQLVSAHKEAISELEQNNENKTHTEESQGFYLTKNQSEGEISYKGQLGVQLTQEEEKEIGDAASTFWLVQAIEIPKLSSVTLIGVYSLISFGGTVFAFLRTSIGAHLGLKASTAFFSSFTTSIFNAPMLFFDSTPVGRILTRASSDLTILDFDIPFSITFVASVPIEILMIIGIMVYVTWQVLIVAVPAMVASKYVQGYYQASARELIRINGTTKAPVMNFAAETSLGLVTVRAFNMADRFFKNYLKLVDTDAALFFYSNAAMEWLVLRIETLQNLTVITAALLLVLVPQGYVSPGLVGLSLSYTFTLTGTQIFLTRWYCNLLNYIISVERIKQFIQLPEEPPAIVEDNRPPSSWPSKGRIDLQALEAKLHPLLKGITCTFKEGSRVGVVGRTGSGKSTLISALFRLVEPASGDILIDGINICSIGLKDLKIKLSIIPQEPTLFKGSIRTNLDPLGLYSDDDLWKALEKCQLKETISRLPNLLDSLVSDEGGNWSLGQRQLFCLGRVLLKRNRILVLDEATASIDSATDAILQQIIRQEFAKCTVITVAHRVPTVIDSDMVMVLSYGKLVEYDEPSKLMDTNSSFSKLELETSDSKAKSFSEFLYRYCKMEGDQSYTNSMKAVSGYLQKRMTCKSILQNLWEIEDFERKNGCYRVCLNYCGYITQRFIVNASQSNIIISNTLNDVNIRKTFPNLDAFSAFVFVLNPHTTKKCTGSSSMARETQ

SEQ ID NO: 229644 - protein, 241 aa, Glycine max
  Coding DNA Sequence Number=SeqID_112866
  Subcellular localization annotation: CTP_CleavageSite=28; ConfidenceScore=5.69e-01
MTTPTRSPPPSLHPPTTDAASHSSPTLKQTRKATRLRSLATRPVKVERPLVHVDPTTGKADGPHSKKLRTYLKIVARDKVDVTYKNWKQVPAAQKDLIWEDIQSRRDPSWEDVQKKTQAIQKQNIASHVLSRGGYEFLENKLMEEKKKKQLEEAAKSGSTDTVIDPPSPIRQHVKWKMAHTKKTGQMTFEAAKEIADKIDVLTTAIGRPEHPGHVRTTGAGVTIKQYFGPAPRTSRTYSSM

SEQ ID NO: 229645 - protein, 299 aa, Glycine max
  Coding DNA Sequence Number=SeqID_112867
  Gene Ontology: Mol. function=phosphoric monoester hydrolase activity; Biological process=metabolic process
  Homolog annotation: Hit_ID=Q8GUC1; Match level="QueryCoverage=99%, HitCoverage=99%, E-value=6e-87, Identity=54%"; Hit description =Putative phosphatase
  Pfam annotation: Domain name=Put_Phosphatase; Domain location=4-257; Score=351.7; E_value=1.2e-102; Accession=PF06888.3; Description =Putative Phosphatase
MAGIVVIFDFDSTIIECDSDNWVLDETGLTEKFYQLLPSTHWNPLMDKMMNELHSQGKTIQDIVQILSRTPMHPRIVPAIEAAYSLGCDLKIVSDANIFFIETILKHHGVWNCFSDVIANPIHVNEGRLNICPYHDYLKSSHGCNLCPPNMCKAIIALIPKIYLLMAKQLILIFILGLVIERIQNSLAAAGKKKLIYLGDGNGDFCPSLRLKDGDYVMPRKDFPLCDLVSKNSNKIKAEVHGWRDGKELEHVLLHVINKEIGEGNNINNSTQKVSVDCKMGPIAIDTRQPLPKALSVPQ

SEQ ID NO: 229646 - protein, 412 aa, Glycine max
  Coding DNA Sequence Number=SeqID_112868
  Gene Ontology: Mol. function=hydrolase activity, hydrolyzing O -glycosyl compounds; Cellular component=cell wall; Biological process= carbohydrate metabolic process
  Homolog annotation: Hit_ID=Q9AT33; Match level="QueryCoverage=57%, HitCoverage=71%, E-value=1e-109, Identity=76%"; Hit description =Endoxyloglucan transferase
  Pfam annotation: Domain name=Glyco_hydro_16; Domain location=177-362; Score=309.1; E_value=8e-90; Accession=PF00722.11; Description =Glycosyl hydrolases family 16
MESVVIDAIEEDAIIWDEKSSGEYTTKSAYKCLIDTPPELFIHDVDEWIFQNLRAPQETTHHNISSLPSRMVCWSPPVDFDYKLNTDRSSLGNPSQAGIDRLIRDNLGLQIAWDKGVTSIICEYDSKLVVDMISLGGKACANLLARNGSSSFDKLVIFDKCPFFINVALLSDVCVTLHDGYTPLFGDHNLAIHRDGKSVHLSLDERTGSGFVSHDLYLHGYFSASIKLPADYTAGVVVAFYMSNGEMFQNNHDEIDFEFLGNIRGKDWRIQTNVYGNGSTSIGREERYGLWFDPAEDFHQYSILWTDSKIIFYVDNVPIREVKRTESMGGDFPSKPMTMYATIWDASDWATNGGKYRVNYKYAPYVAEFSDLILHGCAVDPIEHVAKCESAQGSEKVPSGVTPVQITKMRNF

SEQ ID NO: 229647 - protein, 138 aa, Glycine max
  Coding DNA Sequence Number=SeqID_112869
  Subcellular localization annotation: CTP_CleavageSite=67; ConfidenceScore=5.07e-01
MNKKPYRRTPNSNVPPPQPRPQLQTPTLLCRGLDHNPKPQRSFCHTPNPNHNGEGVNNFDVDSGTMVMRTGWQWLHHDDKSKKGLRILARELECFRHMRARVFHSIPKTVINASTYLQKWHWQFFKDDFGRIIVAPTS

SEQ ID NO: 229648 - protein, 64 aa, Glycine max
  Coding DNA Sequence Number=SeqID_112870
  Gene Ontology: Mol. function=ribonuclease H activity; Biological process=DNA integration
VHSCKFSEGDLVLKKVSQAQKDYRGKWASNYEGPFVVKKAFLGGALLLASMDYEELPSPMNSDI

SEQ ID NO: 229649 - protein, 82 aa, Glycine max
  Coding DNA Sequence Number=SeqID_112871
MDDTVLSILTFDQKLSSTKWWFVRVDRVDGWRCSHSSRHCVLDKGVEWQEEQTRDVLEMWWWSIYGLLEVKALQMKGWKGKR

SEQ ID NO: 229650 - protein, 58 aa, Glycine max
  Coding DNA Sequence Number=SeqID_112872
MSEKIIEIQSYIEREANKVPLYPFYFKTPKLEFFPKWRSVHHWTCKGNYDAHKVFDKS

SEQ ID NO: 229651 - protein, 225 aa, Glycine max
  Coding DNA Sequence Number=SeqID_112873
  Homolog annotation: Hit_ID=O04892; Match level="QueryCoverage=49%, HitCoverage=26%, E-value=3e-30, Identity=59%"; Hit description =Cytochrome P450 like_TBP
STLEDPTRCGMNRKLGYGAQLRANLDPTKGVGRLRQQDGGHGSRNPLRRRGGRCKTQGASPGGAVVGADLGGTGEARLIALCARTPKGNRPAHPGNGSAGGRVQRLEEHRTSRASGRWNNVGKGSRQNGSVTSGKGLALRAGHGGPSPEPVGCRWTARAASAARAGRRVPVGGRIGNGPFGASSPGVEQSTQNCALNVKVKKFNQARVNGGSNYDSLKVAKCLVI

SEQ ID NO: 229652 - protein, 58 aa, Glycine max
  Coding DNA Sequence Number=SeqID_112874
MDACEAVTERLERVLNLKMVTAGTKLHDIMEDCLRITRGVTSYGNVYVRAQRRQRMDQ

SEQ ID NO: 229653 - protein, 61 aa, Glycine max
  Coding DNA Sequence Number=SeqID_112875
MLYMECDPIPKAVENEDDLDDVPVAGHEEDVGAGEHVGAGEQRDAGEQRDAGEQRDADAGE

SEQ ID NO: 229654 - protein, 131 aa, Glycine max
  Coding DNA Sequence Number=SeqID_112876
MPSLCSKKSSPSLVQEVMNLFRSWRGSITMPIGGDNTEEEELTDLRSNPLQGSFLPLASQGSFPCARHFLGGEASLSMAYSLVDGTSSHLFSFIFHCNSMAENHHRRTLLKLKDPASIEASQASFHYCCFC

SEQ ID NO: 229655 - protein, 94 aa, Glycine max
  Coding DNA Sequence Number=SeqID_112877
MTAYSGHQWSWVVENEVLGLGWHFGEEESEKSLHLWVLSAIPSLVGIALSAPFSLCERPKVLTFKITTVKLWEHVLGGSQQNLRRIQRLKNPGF

SEQ ID NO: 229656 - protein, 78 aa, Glycine max
  Coding DNA Sequence Number=SeqID_112878
MKNKKVAVASVSLNEVYALSEQHPLSKALARLASEENLVENLPRMHALSAPSARPESHLSLLAPSALDSLSQKSLTRT

SEQ ID NO: 229657 - protein, 84 aa, Glycine max
  Coding DNA Sequence Number=SeqID_112879
  Gene Ontology: Mol. function=DNA binding; Biological process=DNA integration
ELPWVSKLLEKGERQEHAFALLKEKLTKLSPRGDEPFQVLERINNNAYRFDLPEEYGVSTTFNIYDLIPFAGGDNTEEEELTDL

SEQ ID NO: 229658 - protein, 147 aa, Glycine max
  Coding DNA Sequence Number=SeqID_112880
MAPPVLVQARPKVRREHPGLAEGCPELLWAMDPKHKPCWRLCNIVTRTSELCMEVSEGAGTDADGGGAGAEGAKGVEEEGVVGGASSPRACALQVPGKVIMGSSRFQQFFFMYAKCRNLPFGGRATRDSRDACSTKGIRAESPPTFI

SEQ ID NO: 229659 - protein, 143 aa, Glycine max
  Coding DNA Sequence Number=SeqID_112881
  Gene Ontology: Mol. function=RNA-directed DNA polymerase activity
  Homolog annotation: Hit_ID=Q2HSF6; Match level="QueryCoverage=45%, HitCoverage=4%, E-value=2e-16, Identity=60%"; Hit description =Glycoside hydrolase, family 1; Zinc finger, CCHC-type; Polynucleotidyl transferase, Ribonuclease H fold
MSLEEAHHHRRPWIRAWRKKEMNEGRGREEHEGHAQTHGPEIYPKAHENPRAFSCISGPIFLESSIQCPCGVGLNQERSKFDPIGYCDNDVVGDKVERKNTIGASQFLGKPLVSWTSKKQSIIVLSTSKAKYVLATSCCSQIL

SEQ ID NO: 229660 - protein, 58 aa, Glycine max
  Coding DNA Sequence Number=SeqID_112882
MVGAFSQNTVTLTGLPMILPSESDLTYYCVMNRWMTMKNLMLEDTGTPRSDRSVTLGY

SEQ ID NO: 229661 - protein, 112 aa, Glycine max
  Coding DNA Sequence Number=SeqID_112883
MDDVGDDINVDYMFEELDNMDDLDRDDNIKPKKLLSILTQFKEAIMENTVLNAKEGTCQSLQGMVEISEHRFCLTHLYNNFRKRFGGGIMIRGLMMGALEATYHSAWEAKML

SEQ ID NO: 229662 - protein, 418 aa, Glycine max
  Coding DNA Sequence Number=SeqID_112884
  Gene Ontology: Mol. function=oxidoreductase activity; Cellular component=mitochondrion; Biological process=retinoid metabolic process
  Homolog annotation: Hit_ID=Q1S9K7; Match level="QueryCoverage=81%, HitCoverage=79%, E-value=1e-143, Identity=73%"; Hit description =Alcohol dehydrogenase superfamily, zinc-containing
  Pfam annotation: Domain name=ADH_N; Domain location=68-164; Score =0.3; E_value=0.00056; Accession=PF08240.2; Description=Alcohol dehydrogenase GroES-like domain
  Pfam annotation: Domain name=ADH_zinc_N; Domain location=200-375; Score=101.4; E_value=2.7e-27; Accession=PF00107.16; Description=Zinc- binding dehydrogenase
  Pfam module annotation: Pfam domain module=ADH_N::ADH_zinc_N; Domain location=68-164::200-375
MGEGCCTQPYPCICKEAVSGFEPMINKSPRHNFTAAPGLALKNFVPHCPEALRYAKYSFPCVSTETTQNLIRLRVVESVGKDVTEVTKGDVVIPVILPECGECIDCKSTKSNRCTNFPFKVSPWMPRDGTTRFTGQNGEIIYHFLFISSFSEYTVVDIANLIKIDPEIPPDRACLLGCGVSTGNFLTRVGAAWRTAGVEPGSTVAIFGLGSIGLAVAEGARLCGATRIIGVDINPEKFEIGKKFGVTDFVNAGECGGKPVGQVIIEITDGGADYCFECVGMASLVHEAYASCRKDENIYLVCARGPRRRLVTAFGGSYFIPYQYHGWGKTIVLGVDKPGARINLSSYEVLHDGKSLMGSLFGGLKPKSHVPILLKRYMDKELQLDKFVTHEVEFKDINKAFDLLSKGECLRCVIWMDK

SEQ ID NO: 229663 - protein, 117 aa, Glycine max
  Coding DNA Sequence Number=SeqID_112885
  Gene Ontology: Mol. function=ceramidase activity; Cellular component =endoplasmic reticulum membrane; Biological process=sphingolipid metabolic process
  Homolog annotation: Hit_ID=Q1S9K8; Match level="QueryCoverage=85%, HitCoverage=19%, E-value=5e-37, Identity=56%"; Hit description =Neutral/alkaline nonlysosomal ceramidase
MTKKGCAYNFARSRYPDEILSTKIIGERQFKTVVELFESTSEELSGKIDYNHINPFWKNVRDFLKEPSQHQEHCQKPKPVLLSTGEMFFPYPWAPAILPIQIIRLGKFIILSVPGGL

SEQ ID NO: 229664 - protein, 90 aa, Glycine max
  Coding DNA Sequence Number=SeqID_112886
MEGKTSYIAGPPQIFGGEEYKLWAARMTTHLKVFDLWEAVEENYDVQELPLNPTINDNGWKRRKGDWRRHFKEKMSQEQAHYHRRPWIRA

SEQ ID NO: 229665 - protein, 174 aa, Glycine max
  Coding DNA Sequence Number=SeqID_112887
MEKRVLPEASSKSFFSLGMEWQGHVLEATTANPWRKGGTQGSSAHEGQAIIEGFSSHIPCLIPCLHLTKESSSSSSSTAHSRDKGVLEGKNQSGRSWSEKLGNTSCVMTMTRCEFCTSEFNVKFFQGVALEEDDNKAEALDSRMCSTRMPPKPSYMLSKSLDLTFSFSFVPPLL

SEQ ID NO: 229666 - protein, 125 aa, Glycine max
  Coding DNA Sequence Number=SeqID_112888
MDIENSHYALCIIFLFPSVIELGMDTWVIDSPHQRTFNHQIDLMLFRTWIMLKRIIENCSLHDILKVEKFHAVYSQRSTQANYKSIGRHQIFHIILETMAFKRMLKGYCFSMYQTLMKEKVIARS

SEQ ID NO: 229667 - protein, 110 aa, Glycine max
  Coding DNA Sequence Number=SeqID_112889
MCLSGKESMLMKFLITVNEILDVSISFLNDHLEETLGPTKIGKNHSKCINLTQNGWSRYMSGFGQRFTDKGDVPHYFHDTHATKMLKKFYAKLVMHAPMWTLKHQVFMVM

SEQ ID NO: 229668 - protein, 91 aa, Glycine max
  Coding DNA Sequence Number=SeqID_112890
LPLYNFERLDISWASIIHWSEKLCPFVFAECFCVQLCGSLMQAPLELVGLGSSSSMDSFASWKINGSGMEKEEREETPLQGEDESRRSSRP

SEQ ID NO: 229669 - protein, 79 aa, Glycine max
  Coding DNA Sequence Number=SeqID_112891
MQRIPKRRGKRVFLLSFLDLSSPRLASGSPGPSKDFNVKKPVRLGELQLTWAGRGVKEGVLRFRLEGIERIKRKEEERR

SEQ ID NO: 229670 - protein, 210 aa, Glycine max
  Coding DNA Sequence Number=SeqID_112892
  Gene Ontology: Mol. function=ubiquitin thiolesterase activity; Cellular component=soluble fraction; Biological process=ubiquitin -dependent protein catabolic process
  Homolog annotation: Hit_ID=Q9C8H9; Match level="QueryCoverage=94%, HitCoverage=37%, E-value=1e-71, Identity=68%"; Hit description=TRNA -guaninine transglycosylase, putative
  Pfam annotation: Domain name=UCH; Domain location=2-203; Score=-7.3; E_value=4.8e-06; Accession=PF00443.19; Description=Ubiquitin carboxyl-terminal hydrolase
MKIGCFFVVLFLPWYLTVQFVRFFWKRESNQKAKILRKVDYPLELDVYDFCSDELRKKLEAPRQILRNEEGKKLGLKVNEKSSVQKENDVKMSDAEPFIPKAAKLRNRNGHFVTGATSGGGEPSVVPMEEGEKETQMTGIYDLVAVLTHKGRSADSGHYVGWVKQENGKWIEFDDDNPKPKLEEDITRLSGGGDWHMAYIIMYKARVVSV

SEQ ID NO: 229671 - protein, 359 aa, Glycine max
  Coding DNA Sequence Number=SeqID_112893
MGAYRNLKEAARKHGKVAAAAASSNEPPPPPPPGERLLRCKCCNAEFDCSNALREHEKFLEEEMEEECRNSSTLPQNESIQRQLGQETSNSSILSQAAQNIIMHQFQSLMAQGISGSSHQPLVSCSAVPVTVQGLPSSSSQPNGNFGQESSSSRRPQNESLERPHFNVNERQFGQERSNSSILPQTQNIDMHPQFQSLMAQGSTGPSHQPLVSSIRPQIASIGSAASHQHHSSYQPLVSSSVTSSSRSHPSLCYEGSSGQESNSLVRPQNASIERRSDKRKFGQESTSSSIRERSPADSNVKRLKPSCDERKFDQSSSSSVIVPQNTITEVEGPQQISSSSTPVNGAQEEEKFDLNLKP

SEQ ID NO: 229672 - protein, 119 aa, Glycine max
  Coding DNA Sequence Number=SeqID_112894
MVIQAVGMVSPFKKHLILWRACYGGSYIHQNVTEAASFRYLRGFGDDMGKSKVPPLKLYLVCILSMENLTTDTLFLCSYVPSCIRDVPLVYNFESIYGLPRIKIPPKIVRISILMCCHN

SEQ ID NO: 229673 - protein, 242 aa, Glycine max
  Coding DNA Sequence Number=SeqID_112895
  Homolog annotation: Hit_ID=Q39262; Match level="QueryCoverage=86%, HitCoverage=73%, E-value=1e-07, Identity=25%"; Hit description=Zinc finger protein 3
  Pfam annotation: Domain name=zf-C2H2; Domain location=31-53; Score =19.5; E_value=0.012; Accession=PF00096.16; Description=Zinc finger, C2H2 type
MESNVEAESNHGKVSASASTSNKSPPMKNDLICKYCNKKFSNYQALGGHQNAHKEERAAAQKEKILNMASAYNKNSYVGGFVNSNQSYGFGGKTLGVSPLSMTRFKPHYYSNWPHMSHVAWPRHQILNSVQPTIHQLQTLMMADQGSGFYQHHKSYQPLAFPILREGAVINSGSQSQLLLNPSLCYKGNNFGQASNSSIIPQNKIIEGSDDLNIKISGEAKNSFSSMPSNGDVKELDLTLKI

SEQ ID NO: 229674 - protein, 194 aa, Glycine max
  Coding DNA Sequence Number=SeqID_112896
MEINHGKVVIAAASNKSASLMKEVFCKYCNKKFSSYQALGGHHNSHKAEREQKNKTKFLARLLLIIKNHLLIQIMLMLMGPNSGSQPQPNHIHTFMTDGSASHQQYKSHQPLISCTVGEGPTNSGSKPHSSHPSLCDKGNFGQATDSSMIHQKAIIEGSDLNVKTSCDHENSAPENSSSSVNGAVENLDLILKL

SEQ ID NO: 229675 - protein, 292 aa, Glycine max
  Coding DNA Sequence Number=SeqID_112897
  Gene Ontology: Mol. function=ubiquitin thiolesterase activity; Cellular component=soluble fraction; Biological process=ubiquitin -dependent protein catabolic process
  Homolog annotation: Hit_ID=Q5JK78; Match level="QueryCoverage=98%, HitCoverage=53%, E-value=6e-92, Identity=60%"; Hit description =Putative ubiquitin-specific protease 6
  Pfam annotation: Domain name=UCH; Domain location=88-290; Score=-3.8; E_value=3e-06; Accession=PF00443.19; Description=Ubiquitin carboxyl -terminal hydrolase
MQDDADWSTVGVKEGQKLMMMGTADEVVKTPEKGTVFVEDLPEEEQVVAVSFIEHRNSAIKTGLGRVVEPETSASPAHDQIGYAFDLGHTAGLFNLGNTCYMNSTLQCLHSVPELKSALTNYSHSGRNNDVDQSSHLLTIATRDLFSELDKSVKPVAPMQFWMVLRKKYPQFGQLHNGVFMQQDAEECWTQLLYTLSQSLRSPGSSENPDAVKALFGIELISRIHCQESKEESSEAESVYSLKCHISQEVNHLHEGIKHGLKSELEKASLVLGRSAIHLKESRINALPSWSF

SEQ ID NO: 229676 - protein, 230 aa, Glycine max
  Coding DNA Sequence Number=SeqID_112898
  Gene Ontology: Mol. function=metal ion binding; Cellular component =cellular_component; Biological process=protein amino acid phosphorylation
  Homolog annotation: Hit_ID=Q5KM71; Match level="QueryCoverage=66%, HitCoverage=32%, E-value=5e-17, Identity=32%"; Hit description =Expressed protein
  Pfam annotation: Domain name=PHD; Domain location=152-200; Score=4.3; E_value=0.021; Accession=PF00628.19; Description=PHD-finger
  Pfam annotation: Domain name=SWIM; Domain location=59-89; Score=31.3; E_value=3.5e-06; Accession=PF04434.8; Description=SWIM zinc finger
  Pfam annotation: Domain name=zf-C3HC4; Domain location=153-197; Score= 10.7; E_value=0.012; Accession=PF00097.15; Description=Zinc finger, C3HC4 type (RING finger)
  Pfam module annotation: Pfam domain module=PHD::SWIM::zf-C3HC4; Domain location=152-200::59-89::153-197
MESRASNSNSPYHYHHHHPRFKPSQPISDRIVRALRHRLRLLHRSGSTFFILGATGNVYTVTLSSSPSCTCPDRTTPCKHILFVFIRVLGVSLDDVCLRRRTLRPCQLQRLLGAPTLPEVVAGGTLRQRFHQLFFGGGSTAGPKIEMEEGATCPVCLEEMGKEQNLVACGTCRNPIHEECLIKWKRTKGRSASCVICRARWRDRVEQDEYLNLSAYVGEDDMEEPDVCTC

SEQ ID NO: 229677 - protein, 96 aa, Glycine max
  Coding DNA Sequence Number=SeqID_112899
  Homolog annotation: Hit_ID=Q8S160; Match level="QueryCoverage=41%, HitCoverage=7%, E-value=6e-08, Identity=62%"; Hit description=BNR repeat domain protein-like
MDGQLGINGEESHDNEYAIGENSLVPCLQNKFLELHPPDSSSTGGLALVSSFTPSPVWDFQGHTVVKVACGNEHVVARPWPIRLGGSREQTASGSC

SEQ ID NO: 229678 - protein, 78 aa, Glycine max
  Coding DNA Sequence Number=SeqID_112900
  Homolog annotation: Hit_ID=Q10QQ9; Match level="QueryCoverage=95%, HitCoverage=5%, E-value=7e-12, Identity=44%"; Hit description =Expressed protein
DQFQKLGNDLELAKGRDMDRYYDIVEQLKESYRRCGPQPDIALAAMRHKRLRKIFVVLHTELENLKRRIKDFANSYNK

SEQ ID NO: 229679 - protein, 222 aa, Glycine max
  Coding DNA Sequence Number=SeqID_112901
  Homolog annotation: Hit_ID=Q1H8M4; Match level="QueryCoverage=97%, HitCoverage=38%, E-value=1e-70, Identity=58%"; Hit description =Regulator of chromosome condensation family protein
MEKGLGLCPDASRAGTDSGDALSPRLMSCKPQQPKFPDPVKVACGAAHTVIVAREGYRMWSWGRGRSGALGDGKGLDCYTPMVMLWPSTMEDFEEEEVKSSGEQDKAREKDTEVATETEEKLSSALNELRLLQTKLSIMEKYASILHGSVFGKPFDEQDIPVSLRNSGSFDIAKEWEAADQRKLSRLEMFCRHMLTGVKDELMKRRIKEIVKECLQSSEVKK

SEQ ID NO: 229680 - protein, 274 aa, Glycine max
  Coding DNA Sequence Number=SeqID_112902
  Gene Ontology: Mol. function=RNA-directed DNA polymerase activity; Cellular component=extracellular region; Biological process=RNA -dependent DNA replication
  Homolog annotation: Hit_ID=Q1RXD8; Match level="QueryCoverage=95%, HitCoverage=28%, E-value=4e-26, Identity=35%"; Hit description=RNA -directed DNA polymerase
MEGGMWRQNQILGGQMDCWGQTTNEKISYSVPNFQSTTANYQPHGSHKDEATTAAEFLEEIGLSTIQQHEADSWTWKADPSGNYSTKTAYELLQEAIRGDNEDGIFVQLWKLKIPPKAPVFTWRLINDRLPTKVNLRRRQVEISDSLCPLCNNSEEDAAHLFFNCNKTLPFWWESLSWVKTVGAFPKDQREHFLQHNSGNAAGTKATRWRCWWIALTRTIWQHRNKLVFENQTFSASKVMDDALLLIWSWLTVMEKDFELHFNHWSSNLKDAFG

SEQ ID NO: 229681 - protein, 464 aa, Glycine max
  Coding DNA Sequence Number=SeqID_112903
  Gene Ontology: Mol. function=RNA-directed DNA polymerase activity; Cellular component=membrane; Biological process=RNA-dependent DNA replication
MRPQAPTELETANHNNEGQNIPMDSGPRELKTHPEKRKTSQSRIQCNTHIRDEAIAQWEVAKDLGMTSGKEQSEIIDKITSMEIRGRKEAEETKREQIDKAICQALWGDTDLSWKYSRQQIQLADCCVYGMRRYLKWRGGSLLALWESIRQLKNLQPGGFWCILRDINSIRHPSERVCTTQREGDLNSILEFNDWLSDLAVEEASKWPDSTQFILDRDFSDHCPILLRAKTVNWGPKPFRVLDCWLKDKTFQNLVKETWTNTQPRGWGGYSLKEKIKTLKQRMKHWNKEHFGDTFNRVQQIQNELNNLETGSNDRQMSPQELAARKKLQEDLWTATQAHESLLRQKARTKWIKEGDCNSRYFHKLMNYNCRNNAVKGVLIEGSRVEEPTRVKEEVCNFFQIRFSEPDYGRPKINGTRFRGIGQQQNEWLVGRFQEDEIKSAVWDCGSEKSPGPDGLNFKFIKHF

SEQ ID NO: 229682 - protein, 381 aa, Glycine max
  Coding DNA Sequence Number=SeqID_112904
MFERVEDEIFWTLGSDVMPKYLGDDMVILLGLSDMKAEVMIKEEIDKGSSLFYSLEKWKPKMRPENRLVWIHCWGIPLAAWEIGYIRKIVAAMGDLVDVDDDVEEMRRLDRARVLIRTPWKLVIHHSVAVHIGDETHTVYLVEENANKEGMYVRHRRSTIGSSEEILSDDSDPDTPFSRLSVLSPGIIADEHTGGHSVRWIEKVPNDGQGSEDPTVKDQGSRAHYSITELCMPDRVRRNQLESAAEPRPEVSVGYDKMKMSNDQKTNKLETEKKLVVKKSKGSMESKVEEQTKDIAQGQKEVGIKCLNRKQQHPLKLKLPLDPNVEPAGPNNKMGLANNAPVEDSQGPCTEYTGLTSNTHGQKSQDLCTNYHQHLVENGSA

SEQ ID NO: 229683 - protein, 99 aa, Glycine max
  Coding DNA Sequence Number=SeqID_112905
MKKKNVTTKPKPKPKPDLRFGIGRRRSRGIMEAVVGGAVEVENGFDGGMTERRRQGKRRESASAALGFAAERCEVEEHVSVVEGREWLGEAQHVRNGRH

SEQ ID NO: 229684 - protein, 174 aa, Glycine max
  Coding DNA Sequence Number=SeqID_112906
  Gene Ontology: Mol. function=glutamate synthase (ferredoxin) activity; Cellular component=chloroplast; Biological process=amino acid biosynthetic process
  Homolog annotation: Hit_ID=Q9T0P4; Match level="QueryCoverage=82%, HitCoverage=8%, E-value=7e-43, Identity=61%"; Hit description =Ferredoxin-dependent glutamate synthase 2, chloroplast precursor
  Pfam annotation: Domain name=GATase_2; Domain location=73-174; Score=- 37.6; E_value=3.7e-08; Accession=PF00310.11; Description=Glutamine amidotransferases class-II
MWEEGTSAAARVSVARCTRFSPLWGLSYFRALFLKCFANQLFNIVACNLHVTFQSLVAQVANLEDIISERGACGVGFIANLENKESHEIVKDALNALSCMEHRGGCGADNDSGDGSGLMTGVPWELFDNWANTQGIASFDKLHTGVGMVFLPKEAQLLNEAKKGNSVLVLNVED

SEQ ID NO: 229685 - protein, 98 aa, Glycine max
  Coding DNA Sequence Number=SeqID_112907
MHLIRTNDGSIDIVVTNLSVRNKEHDEGENKTKRHNDVTYEEDAQCFDFIKGRITISNLAPVLDFLKQEKFEFDPNPNHNQPDCFQSNSGRVQINPYG

SEQ ID NO: 229686 - protein, 182 aa, Glycine max
  Coding DNA Sequence Number=SeqID_112908
  Gene Ontology: Mol. function=oxidoreductase activity; Cellular component=soluble fraction; Biological process=amino acid metabolic process
  Homolog annotation: Hit_ID=Q9C8I0; Match level="QueryCoverage=99%, HitCoverage=37%, E-value=3e-64, Identity=69%"; Hit description=NADP -specific glutatamate dehydrogenase, putative
  Pfam annotation: Domain name=ELFV_dehydrog; Domain location=12-180; Score=44.7; E_value=9.7e-13; Accession=PF00208.11; Description =GlutamateLeucinePhenylalanineValin
GSFTGPRIFWSGSSLRPEATGYGLVFFAQLMLADMNKELKGLRCAVSGSGKIAMHVLEKLIAYGALPISVSETIQRPMLGPNIMMKQNHGVKGCRILVEGSNMPCTPEAVQILRKASVLIAPAMAAGAGGVVAGELELNHECSLMHWSPEDFESKLQEAMKQTYQRAMKAATDFGYQKESPE

SEQ ID NO: 229687 - protein, 85 aa, Glycine max
  Coding DNA Sequence Number=SeqID_112909
  Gene Ontology: Mol. function=RNA-directed DNA polymerase activity; Biological process=RNA-dependent DNA replication
MPPKSLGPKSVLDFYHGRESKRGKVQQLIESQKERKSLLHMALSSRRTIENCPFLPFNQVEKAPLVGICVKEQESIHTLNSLQEL

SEQ ID NO: 229688 - protein, 72 aa, Glycine max
  Coding DNA Sequence Number=SeqID_112910
MDPRLEIGFSYRMIKRLCYIRYEDTVGGSHKWREKAARYCDNGFRERVKLIIAGERRKKREAGGLNAVDIDG

SEQ ID NO: 229689 - protein, 419 aa, Glycine max
  Coding DNA Sequence Number=SeqID_112911
  Gene Ontology: Mol. function=transporter activity; Cellular component= integral to membrane; Biological process=transport
  Homolog annotation: Hit_ID=Q9SL56; Match level="QueryCoverage=99%, HitCoverage=85%, E-value=1e-157, Identity=65%"; Hit description =Putative membrane transporter
  Pfam annotation: Domain name=MFS_1; Domain location=1-383; Score =114.8; E_value=2.6e-31; Accession=PF07690.6; Description=Major Facilitator Superfamily
  Pfam annotation: Domain name=Sugar_tr; Domain location=1-416; Score= -164.7; E_value=0.1; Accession=PF00083.14; Description=Sugar (and other) transporter
  Pfam module annotation: Pfam domain module=MFS_1::Sugar_tr; Domain location=1-383::1-416
MSSIDAGWPPFNGTRGTRRLGELDLAFLTSYSIGMYLAGHVGDRIDLRLFLVFGMMGSGLFTVLFGLGYWLDVHVLGFYVGVQIFCGVFQSIGWPCVVAIVGNWLGESKRGLIMGVWNSHTSVGNIIGSVVASGVLEFGWGWSFVVPGILIILVGILVFLFLVVNPEDMGFVHPGMDIEMSVETDSAENRQKVESEEAKLIASEISDSSSAIGFLEAWKLPGVAPFAFCLFFSKLVAYTFLYWLPFYIRHTGVHMSHKTAGLLSTIFDIGGVLGGITAGFISDLIEARAITSILFLFLSIPALALYRIFGSLSMLINIILMFLSGFLVNGPYSLITTAVAADLGTQSMNDRNSRALATVTAIIDGTGSVGAALGPLLAGYISTRGWNSVFFMLILSIFFAGLFLIRIARTEIREKLSGK

SEQ ID NO: 229690 - protein, 97 aa, Glycine max
  Coding DNA Sequence Number=SeqID_112912
  Gene Ontology: Mol. function=small conjugating protein ligase activity; Biological process=protein modification process
  Homolog annotation: Hit_ID=Q38HU0; Match level="QueryCoverage=76%, HitCoverage=29%, E-value=2e-08, Identity=42%"; Hit description=RWD domain-containing protein
MYGRRKTGKKRVGVGRLLMPESVLTAPKEKKLSGRQWFESGRVKGVAAVAEESDVEDEEDIDFDEDDFEADDEEEDMLEHYLAEKSDLSTHSSMRAS

SEQ ID NO: 229691 - protein, 86 aa, Glycine max
  Coding DNA Sequence Number=SeqID_112913
IVRHQIPKIGGVMNALGGATLFCKITRAPNIFMICVHRDSLGRNNQHENTEKGVPMNPKRIKVIPEWPAPPSVLRKKAQSFKNLGI

SEQ ID NO: 229692 - protein, 38 aa, Glycine max
  Coding DNA Sequence Number=SeqID_112914
MATVDSCECSFLAMALVHGAVISAFLTIAQAMTDQGSI

SEQ ID NO: 229693 - protein, 146 aa, Glycine max
  Coding DNA Sequence Number=SeqID_112915
  Gene Ontology: Mol. function=phosphatidylinositol phosphate kinase activity; Biological process=phosphatidylinositol metabolic process
  Homolog annotation: Hit_ID=Q2HW52; Match level="QueryCoverage=99%, HitCoverage=17%, E-value=3e-47, Identity=67%"; Hit description =Phosphatidylinositol-4-phosphate 5-kinase
  Pfam annotation: Domain name=PIP5K; Domain location=1-142; Score= -93.4; E_value=2.9e-05; Accession=PF01504.9; Description =Phosphatidylinositol-4-phosphate 5-Kinase
MDYSLLLGIYFKDISPDGEIIPLQSHTPTGDSENEGTPHTSSEDTDQSHYDPSSIILGMNMPAKVERTIRRSGCELQLVGEPIGEFYNGVLTFGIIDILQDYDISKKLEHAYKSIQYDPTSISAVDPIQYSRRFRDFIFRIFTEDS

SEQ ID NO: 229694 - protein, 127 aa, Glycine max
  Coding DNA Sequence Number=SeqID_112916
HVKMSVAEAEPFGGVDSGIEGKEGDAWGFLLSGRWTAAMVSGAGKGTGFYDMSVGRGGGVGMVVGAEEDGGGIGIGGGGDCTEEGGDNEFNQDGLKAVLSSRRKFKVVWRVLWVVVEGGLAAMEASF

SEQ ID NO: 229695 - protein, 68 aa, Glycine max
  Coding DNA Sequence Number=SeqID_112917
MRRRPGIGGLETHTAARDQFRLLGQNVAKIKTNLMKEQLGTFHSQLEDFSRKHSSKKVRARKQEKGCF

SEQ ID NO: 229696 - protein, 766 aa, Glycine max
  Coding DNA Sequence Number=SeqID_112918
  Gene Ontology: Mol. function=ATP binding; Cellular component=nucleus; Biological process=regulation of transcription, DNA-dependent
  Homolog annotation: Hit_ID=P59278; Match level="QueryCoverage=99%, HitCoverage=96%, E-value=2e-81, Identity=39%"; Hit description =Uncharacterized protein At1g51745
  Pfam annotation: Domain name=PWWP; Domain location=13-98; Score=-5.7; E_value=0.087; Accession=PF00855.8; Description=PWWP domain
MGSSGESNLNVIDASVGGLVWVRRRNGSWWPGRIMGLHELSESCLVSPRSGTPVKLLGREDASVDWYNLEKSKRVKAFRCGEYDECIEKAKASAANSSKKAVKYARREDAILHALELESAHLDKESLSLCSRLDKPGSEHGGSAGELPLMSNSGEDNEDVVDDLSDSDDNSNAAPELSQSGISFEEPNHYGTLKMQSVQGRRRRTPNDSEDDGFEGVKRMRGLEDLGIGVVSKRQVQGTSATEIVHHISASLNNSTAGNCLANGTSVNGGKGYSSTLKRKRSQVANAHELLKRKNRRRPLTKVLESTAMVSVPVICNQLPSSSSSPLCGVTDGRISGLDSNGSKKTFPTTTHNSDSTEAACENGTSLIVHDHGSDDASQINHEVKENETFGIPGLVGKDSPDELFDVPFVGVLGEEKHTTDFSPIQVSCSSGKPQVSALGEQSCNASQCEAVSLRNESKNEPGCTSSAAGHIIVGHRADKGSSKWQSKGKRNSRHTSKNIKHASRKYVDTDPQSSAYLSGIGISDGIYQGACQKVDWNGMGAPNTSYKCTSQVKCKPVAVGQLEGFRDLNKHIKGTTTEAKLLPDGSLTPQRLLPYRHSRFTVNSRYQTADFPGRNYYSDASLYDVKLEVKSSYRPQHVPLVSLVSKLNGKAFIGHPLAVEVLVEGHCDKMLSDIGCDLEVGDVYCAAKPNSVTRRIHSKNLTRFSPSKSSKMKKTGLLNKKIRKLSSLTGHKQLEEERKPVVDKLKGPVIACIPLKVVFSRINEA

SEQ ID NO: 229697 - protein, 305 aa, Glycine max
  Coding DNA Sequence Number=SeqID_112919
  Gene Ontology: Mol. function=phosphatidylinositol phosphate kinase activity; Cellular component=plasma membrane; Biological process =phosphatidylinositol metabolic process
  Homolog annotation: Hit_ID=Q2HW52; Match level="QueryCoverage=99%, HitCoverage=40%, E-value=1e-154, Identity=84%"; Hit description =Phosphatidylinositol-4-phosphate 5-kinase
  Pfam annotation: Domain name=PIP5K; Domain location=161-305; Score =89.6; E_value=9.5e-24; Accession=PF01504.9; Description =Phosphatidylinositol-4-phosphate 5-Kinase
MSVDGRVSVGLERPSDRLQIWDGGESDARTPTMGSDLDEDLMALRVDDGSESLTQLQPLKAPKKSKRQGETICKGHKNYELMLNLQLGIRHSVARPAPTASLDLKPSAFDPKEKVWTRFPPEGSKYTPPHPSCDFKWKDYCPVVFRTLRKLFKVDPADYMLSICGNDALRELSSPGKSGSFFYLTHDDRYMIKTMKKAEVKVLLRMLPAYYNNFRDQQNTLLTKYYGLHCVKLNGPIQKKVRFIIMGNLFCSEYITHRRYDLKGSSLGRFSDKPETEISETTILKDLDLNFIFRLEKSRFEEFCR

SEQ ID NO: 229698 - protein, 180 aa, Glycine max
  Coding DNA Sequence Number=SeqID_112920
  Gene Ontology: Mol. function=protein dimerization activity; Cellular component=endoplasmic reticulum; Biological process=proteolysis
  Homolog annotation: Hit_ID=Q0GXX4; Match level="QueryCoverage=95%, HitCoverage=26%, E-value=5e-30, Identity=43%"; Hit description=Auxin conjugate hydrolase
MAATNVIISLQNLVSREADPREKRMSKRNTTSPQAFNDHRGIYMGSRPLGSMYMKGSIPEGLNLLLMLRIFCVFFTYVPTVSKLQGGAAFNVIPDYVIIDGTFRALSRETLKHLKQRIEQVIIGQAAVQRCNANVNFHDEEKPLYPPTINNDDLHKFFVDVAGNLLGINKANTDANRLGR

SEQ ID NO: 229699 - protein, 103 aa, Glycine max
  Coding DNA Sequence Number=SeqID_112921
  Subcellular localization annotation: CTP_CleavageSite=37; ConfidenceScore=5.41e-01
MSVKKSVSLNGGNSVAKLKGQKPSKRRRLNRCFSSVELSMEPGKQLKDMDSNKLKGEIKRWAKAVVAYARQKCWWSLKMSFTSTGFSLENWCIDVKVVVVYLL

SEQ ID NO: 229700 - protein, 354 aa, Glycine max
  Coding DNA Sequence Number=SeqID_112922
  Gene Ontology: Mol. function=L-isoleucine transporter activity; Cellular component=integral to membrane; Biological process=amino acid transport
  Homolog annotation: Hit_ID=Q1T4Y8; Match level="QueryCoverage=99%, HitCoverage=85%, E-value=1e-127, Identity=62%"; Hit description =Amino acid/polyamine transporter II
MAKNEYKERDSEFFMNKINENEEEQDIEAIGYHSDINDQCGSDNEGNRRTEPDSSSSQIWPQSYREATDSYSISAAPNLESIIRAPSVIYSSFIGGGGFGGAGFGSKSYLEHDERTSFLSGEELANQGITRRQSTWWEKASIQMQIPEELPVGYGCSLTQTIFNGINVMAGVGLLSTPYTVKQAGWAADLMKHCFESREGIISYPDIGQAAFGRYGRLIVSSYCVEFIILEGDNLTRLFPGTSLHWGSFQLDSKHLFGILTALVILPTVWLRDLRIISYLSAGGVVATALITICVFLVGTTDSVGFHLTGPLVKWSGMPFAFGIYGFCFAGHSVFPNIYQSMADKREFTKAVIA

SEQ ID NO: 229701 - protein, 67 aa, Glycine max
  Coding DNA Sequence Number=SeqID_112923
  Homolog annotation: Hit_ID=Q2HW52; Match level="QueryCoverage=55%, HitCoverage=4%, E-value=3e-08, Identity=78%"; Hit description =Phosphatidylinositol-4-phosphate 5-kinase
MIGKDSGVMKAWEATMRKTHAVAKKRANSIFGTISLAHVADEEENNDGYDDDEENENEAFEVYIEEK

SEQ ID NO: 229702 - protein, 155 aa, Glycine max
  Coding DNA Sequence Number=SeqID_112924
  Homolog annotation: Hit_ID=O80667; Match level="QueryCoverage=90%, HitCoverage=90%, E-value=7e-25, Identity=41%"; Hit description =Expressed protein
MVDAENAGADKKKHEELVPIIEEIYKEKVKNAKEFSEFYHAVCEIVEQLNEKLGNTQIKLPETKAIEKEYRRRGDNDTDKKPLTKAEFQEIMQNLVKTSGFTGIGAKEAILCIFGVPLAALFIKQRVMPEAVRDEFFIPGVTSATVFTLAALNKI

SEQ ID NO: 229703 - protein, 456 aa, Glycine max
  Coding DNA Sequence Number=SeqID_112925
  Gene Ontology: Mol. function=protein dimerization activity; Cellular component=endoplasmic reticulum; Biological process=proteolysis
  Homolog annotation: Hit_ID=Q0GXX4; Match level="QueryCoverage=99%, HitCoverage=98%, E-value=0.0, Identity=72%"; Hit description=Auxin conjugate hydrolase
  Pfam annotation: Domain name=M20_dimer; Domain location=210-330; Score=36.0; E_value=1.3e-07; Accession=PF07687.4; Description =Peptidase dimerisation domain
  Pfam annotation: Domain name=Peptidase_M20; Domain location=105-436; Score=229.8; E_value=5.9e-66; Accession=PF01546.18; Description =Peptidase family M20M25M40
  Pfam module annotation: Pfam domain module=M20_dimer::Peptidase_M20; Domain location=210-330::105-436
MCFFKWFNLFIIFHVLAATPIFSLTDSSNQVSTNFLDNTNKPEVFDWMVKIRRKIHENPELRYEEVETSKLIREELDKLGIPYKYPVAITGVIGYIGTGSSPFVAIRADMDALPIQEMVEWDHKSKVPGKMHACGHDAHVTMLLGAANILKQHEKEIQGTVVLVFQPAEEGGAGAKKILDAGALENVTAIFALHVMPDIPLGEAASRSGPILAGSGTFEAIISGKGGHAAIPQHSIDPVLAASNVIISLQHLVSREADPLDPQMMKGLVPQGLYLFMVVTVAKFQGGGAFNVIPDYVTIGGTFRAFSREKLDQLKQRIKQVVIGQAAVQRCNATVNFLDETRPSYPPTVNNGDLHKLFVDVAGNLLGTNNVNIEKTPIMAAEDFAFYQEVIPGYFIMLGVKSASPEPHQSLHSPYLKISEDALPYGAALHASLATSYLLRYQQDVAKVVGKYHDEL

SEQ ID NO: 229704 - protein, 67 aa, Glycine max
  Coding DNA Sequence Number=SeqID_112926
MESRHNERSWWVWVRRRTASSKWSVILECVLCSAIEDGRQIRGCVGLSPRSWVGLHIVMLPIKEPLI

SEQ ID NO: 229705 - protein, 231 aa, Glycine max
  Coding DNA Sequence Number=SeqID_112927
MQRMLNTRRTATAPTAIPTTTPVEILDEEDDGVVGLDPDGGEGELRDGGLGVLPPPPPLGGDGGECDGGDGGEVDGGEVDGVVGVDGGGEAEGVDGGEAEGVAGGGEEGVDGGGEEGVAGGGDDGVAGGGDDGVAGGGDEGVEGGGAEGVAGGGAEGVDGGGAVPLVGGGEDGAGAVDITENDYRKKNVRLKKKEKTLRKRRISQPAKTKRVPWDPHQCPSDTSSYNSFNY

SEQ ID NO: 229706 - protein, 144 aa, Glycine max
  Coding DNA Sequence Number=SeqID_112928
EMVAAQLAQASQVASSRSNSLLEESSGGPKDVGVNVGGSTSFDDPSELTRRPLSRWGLKNNMSILSVEMLHRSRMNPYQKLLVMPSSARLALSPNPLTRAKREGGAKRNNFEKARAQISTAHHSAYFGNRALEAARGAAFAEIH

SEQ ID NO: 229707 - protein, 436 aa, Glycine max
  Coding DNA Sequence Number=SeqID_112929
  Gene Ontology: Mol. function=protein serine/threonine kinase activity; Cellular component=membrane; Biological process=protein amino acid phosphorylation
  Homolog annotation: Hit_ID=Q94JZ6; Match level="QueryCoverage=90%, HitCoverage=61%, E-value=1e-142, Identity=66%"; Hit description =Protein kinase-like protein
  Pfam annotation: Domain name=Pkinase; Domain location=70-337; Score =45.2; E_value=2.9e-11; Accession=PF00069.15; Description=Protein kinase domain
  Pfam annotation: Domain name=Pkinase_Tyr; Domain location=70-337; Score=14.5; E_value=2.3e-13; Accession=PF07714.7; Description =Protein tyrosine kinase
  Pfam module annotation: Pfam domain module=Pkinase::Pkinase_Tyr; Domain location=70-337::70-337
  Subcellular localization annotation: CTP_CleavageSite=65; ConfidenceScore=5.52e-01
MPPKPSPPPAPPAYAAQPPPPPPPFIISSGGSGSNYSGGEFLPPPSPGIALGFSKSTFTYEELARATDGFSDANLLGQGGFGYVHRGILPNGKEVAVKQLKAGTFYHKIPFKILFSWSIFSAESGLGTNYQYYCGIMLLVEAVLMVICTAGRGRPTMDWPTRLRIALGSAKGLAYLHEDCHPKIIHRDIKAANILLDFKFEAKVADFGLAKFSSDVNTHVSTRVMGTFGYLAPEYASSGKLTDKSDVFSYGVMLLELITGRRPVDKNQTFMEDSLVDWARPLLTRALEEDDFDSIIDPRLQNDYDPNEMARMVASAAACIRHSAKRRPRMSQVVRALEGDVSLADLNEGIRPGHSTMYSSHESSDYDTAQYKEDMKKFRKMALGTQEYGASSEYSAATSEYGLNPSGSSSEAQSRQTTREMEMRKMKNSQGFSGSS

SEQ ID NO: 229708 - protein, 205 aa, Glycine max
  Coding DNA Sequence Number=SeqID_112930
  Gene Ontology: Mol. function=ligase activity, forming carbon-nitrogen bonds; Biological process=tRNA processing
  Homolog annotation: Hit_ID=Q8RY55; Match level="QueryCoverage=88%, HitCoverage=23%, E-value=1e-26, Identity=42%"; Hit description =RASPBERRY3
  Pfam annotation: Domain name=ATP_bind_3; Domain location=113-204; Score=-95.9; E_value=0.047; Accession=PF01171.11; Description=PP -loop family
  Subcellular localization annotation: CTP_CleavageSite=18; ConfidenceScore=5.32e-01
MARGLILSSPTLTATTCLFASISKTPPKSFNLSFGLKLIHHHYHLIPSPCSFSVDSSPSQCSIDISKYTETFSRRMAMAGLKPHHRIGQLLFVSLIFPAEKLNLFCKMQIFAQLALGVSGGPDSMALCVLTAGWKTAGADAVTSENGGFIDGLLAIIVDHGLRAESKEEANIVSHRVSKMGVSKFGCFICIAGMEPGSSRVKFFA

SEQ ID NO: 229709 - protein, 212 aa, Glycine max
  Coding DNA Sequence Number=SeqID_112931
MIILGMLHFLAIYTAPKSAAIDLSTHVNNKYDGGAFLQCWTVLYTVDGSTCELSLVKYVDKDGNINYLSCQCIILRKRRTETDIGLSMNYSSLKWMKRNTTTDAQGGATETKVYSYGSGNWVGLLVEVCQKNSTDNEEVNAVVILAHYFANSSGTTFNRSTESDIGLSNAISIANDGRFRGHANGSSIRCKKIYAKGTYPNMSCTPTFVGTN

SEQ ID NO: 229710 - protein, 472 aa, Glycine max
  Coding DNA Sequence Number=SeqID_112932
  Gene Ontology: Mol. function=ligase activity, forming carbon-nitrogen bonds; Biological process=tRNA processing
  Homolog annotation: Hit_ID=Q9LV47; Match level="QueryCoverage=99%, HitCoverage=69%, E-value=1e-100, Identity=46%"; Hit description =Arabidopsis thaliana genomic DNA, chromosome 3, P1 clone: MOB24
  Pfam annotation: Domain name=ATP_bind_3; Domain location=2-89; Score=- 63.1; E_value=0.00012; Accession=PF01171.11; Description=PP-loop family
MQAELFILRLSRNSGVLGLAGMPFTSQIFPTYTQSYREVQANQGILLVRPLLEFSKEDMYKICQGGSENWVEDPTNQSPLYARNRIRMVLNNLSSSAFKFELQALISACRITRTYVDQIAYSLIRDAVVIKDHGYVVIDLQILCPLKVEDICLMKFLSLILQFVSQRQRQIRGSALKLLMDYIRTFPCKNSVTAAGCYLCPDPGSRGSRVLVCCCSNGCAFPLKIEYFESQSQGQQGCCVANELEKIIEAEKSYANHLVLDASDVHFLDVNPELVLTEAKRLNIIGESTYNSIFALQKQETAHFRSKTEVISDSASKHGVTPFSKSLQPGQFCYFMDRFILTWKLKNNIDNDKLSGLVDYEMDLGEETRSLCCTSCVAGNNKVPEVRHMIESDWLYLAELSKYPLSKNFPQYEVKSVNGTKQIMDRTSPCLHYASVSAKQALRLLKSIPVAARRSLPVLINQQGQLLSIPVS

SEQ ID NO: 229711 - protein, 349 aa, Glycine max
  Coding DNA Sequence Number=SeqID_112933
  Gene Ontology: Mol. function=copper ion transporter activity; Cellular component=integral to membrane; Biological process=copper ion transport
  Homolog annotation: Hit_ID=Q9LT31; Match level="QueryCoverage=87%, HitCoverage=65%, E-value=2e-54, Identity=36%"; Hit description =Similarity to vacuolar protein sorting-associated protein VPS9
  Pfam annotation: Domain name=VPS9; Domain location=92-214; Score =82.4; E_value=1.4e-21; Accession=PF02204.8; Description=Vacuolar sorting protein 9 (VPS9) domain
MMGKEYKTFFVSMEAAIRDHSLWTTASEEDIDCAMQGLEKYIMTKLFSRTFSASAEDAKIDNEISSKICLLQTFLKPEHLDIPPILQNEALWLLAEKELLKINAFKAPHEKLLSIMNCCRIINNLLLNAAMSEYVPAGADGFLPVLIYVTIKASPPWPIESTLHYPLTRANPPKLHSNLKFIKLYTRQAKLISEAEYYFTNLVSAKTFIVDLNAKSLSMDEIKYKESMQAAKLTNKVTSELSAACQMSQQETDDSSCSKKMHNKLDDTGVLLHGSNYPYMEAKSKELTVGDVDMLLSDYKDLVAKYTILCKAIGCLSTAEREPLLRHLEMQGPETLLNFTAPSDHHRHK

SEQ ID NO: 229712 - protein, 562 aa, Glycine max
  Coding DNA Sequence Number=SeqID_112934
  Gene Ontology: Mol. function=kinase activity
  Homolog annotation: Hit_ID=Q5DK69; Match level="QueryCoverage=84%, HitCoverage=89%, E-value=1e-166, Identity=64%"; Hit description =Pollen-specific kinase partner protein
  Pfam annotation: Domain name=DUF315; Domain location=14-444; Score =740.5; E_value=1.1e-219; Accession=PF03759.4; Description=Domain of unknown function (DUF315)
MVRAFHRQISMQKSKSFHFRKMFEIPGKHIHGLFDKDHDEAGESDSKIYSKSFESRSSLDQQFEIQLNSDHSPAASLGIEAPRMPPKPPTEADLMKERFAKLLLGEDMSGAGNGVSSALALSNAITNLAASVFGEQSKLEPMSSERKARWRKEIEWLLSVTDYIVEFAPSQQIAKDGTSMEIMTTRQRTDLLMNIPALRKLDAMLIDTLDNFRDQNEFWYVSKNDENSEDNTNSQRKSDKWWLPTVKVPPTGMSEPAGKWIQFQKDNVNQVLKAAMAINAQILSEMEIPENYIESLPKNGRESLGESVYKSITVEYFDPGQFLSTMDMSTEHKVLDLKNRIEASIVIWRRKMTNKDSKSAWSSAVSIEKRELFEERAETILLMLKHQFPGLPQSSLDISKIQYNKDVGQAILESYSRVIESLAYTVMSRIDDVLYADSVTKNPSLAVSSRRYSLDSSPAATEQTSPNSEDENSYLQSSETPPSMTLSDFMGWSSTKGGSDIKNTNSTRDIEDTNSTGDIEEYVKEKDEKSITKSPKLTTPSKSYYLEKLEYLNALKSPIARH

SEQ ID NO: 229713 - protein, 659 aa, Glycine max
  Coding DNA Sequence Number=SeqID_112935
  Gene Ontology: Mol. function=oxidoreductase activity; Cellular component=cytoskeleton; Biological process=fatty acid metabolic process
  Homolog annotation: Hit_ID=Q1SWD4; Match level="QueryCoverage=99%, HitCoverage=87%, E-value=0.0, Identity=77%"; Hit description=IQ calmodulin-binding region; Fatty oxidation complex, alpha subunit FadJ
  Pfam annotation: Domain name=3HCDH; Domain location=458-546; Score =65.6; E_value=1.6e-16; Accession=PF00725.12; Description=3 -hydroxyacyl-CoA dehydrogenase, C-terminal domain
  Pfam annotation: Domain name=3HCDH_N; Domain location=275-456; Score =276.9; E_value=4e-80; Accession=PF02737.8; Description=3-hydroxyacyl- CoA dehydrogenase, NAD binding domain
  Pfam annotation: Domain name=ECH; Domain location=2-152; Score=150.2; E_value=5.4e-42; Accession=PF00378.10; Description=Enoyl-CoA hydrataseisomerase family
  Pfam annotation: Domain name=Peptidase_S49; Domain location=60-202; Score=-53.2; E_value=0.035; Accession=PF01343.9; Description =Peptidase family S49
  Pfam module annotation: Pfam domain module=3HCDH::3HCDH _N::ECH::Peptidase_S49; Domain location=458-546::275-456::2-152::60 -202
MGLKNRFDEAARRNDVKAIVLTGKGGRFSGGFDISVMQKVHQTGDSSHLPDVSVELVVNSIEDSKKPVVAAVEGLALGGGLELAMGCHARVAAPRAQLGLPELTLGIIPGFGGTQRLPRLIGLSKAVEMMLTSKPITSEEGRKFGLIDAIVSSEELLKASRLWALEIGERRKPWIRSLHRTDKIGSLSEARAVLKTARQQVKKTAPHLPQQQACVDVIEHGIVHGGYSGVLKEAEVFKQLVISDTSKGLINVFFAQRAISKVPGVTDIGLKPRNVKKAAVIGGGLMGSGIATALILGNIRVILKEINSEFLLKGIKTIEANVNGLVRRGKLTKQKADAALSLLKGVLDYSEFKDVDLVIEAVIENISLKQTIFGDLEKICPPHCILASNTSTIDLDVVGKTTSSQDRIAGAHFFSPAHIMPLLEIIRTDKTSAQVIVDLITVGKIIKKAPVVVGNCTGFAVNKTFFPYSQGAHLLVNLGVDVFRIDRLICNFGFPIGPFQLQDLAGYGVAVATSKVFADAFSDRIFKSPLLDLLIKSGRNGNILCEYNQLFLTLAISALPGKNNGKGYYIYEKGGKPKPDPSILPIIEESRRLCNIMPNGKPISITDQEIVEMILFPVVNEACRVLEDGVVIRASDLDIASVLGMSFPNYRLDFLFFTL

SEQ ID NO: 229714 - protein, 115 aa, Glycine max
  Coding DNA Sequence Number=SeqID_112936
LPLLAYLVWIHAPLNFATVAAIPSCAIHARGIPIPAAFSDFVFVSRAMGEGEGGGDCVQKNASLSEVVAPSAASLEVPAKKLARQLDFTGAPEHPPQLPVAVLPLPLQAPPARVG

SEQ ID NO: 229715 - protein, 897 aa, Glycine max
  Coding DNA Sequence Number=SeqID_112937
  Homolog annotation: Hit_ID=Q9LJ43; Match level="QueryCoverage=23%, HitCoverage=27%, E-value=9e-28, Identity=39%"; Hit description =Arabidopsis thaliana genomic DNA, chromosome 3, P1 clone:MSD24
MSFSSGFGIGAADSDEQLKQNQGILLASQFVDEISVTEYPPQDSVMYRPFMTCDDPKGVVECGAIRKYRTSSQKMKEKTKNRRPAETSLANKQDKEEKVSKGSTERSFDPSSLQLMEVSRGAQRLNNMIDSWSRGLRYDGRSEDIAKDLLKGALDLQESLLMLRKVQEASQHMASLKRRQNEKPERGKFDAKVIDRTTHCDHFGEQSYPMGFQRRWPSADGSSSSCNEELKKVIKESLVRQNLFTTTEGLDSASTFRSTNSSQSSVAWNDRLSDSSSFSPTTSRRERGSNLVAKLMGLEEASSRSFPAVIQKQLESPKILNHKRPVSDIDMPKVRKNVGKVNLEHKMTLTEILETTHFNGLLKSPVREPKVQVHHSIDPHYKHFGDLPPIVLMKPRCTPYRECVKSYEHVVPPEELSLRNLKAKFVPSKVFQHREGSTTNMGKKMEEHVSKRLAKEERTKLLSEVVELKEKEIKPIENEKAPGGKVKLHSHVSHKSHVNETVDKKAKVKTITTSKKLSEKEASKPKQQQQQSLIPRGEVPKLKVVTKSQDQGEISSTSTKLRKPQSGSRIDKNEIPNRKTTASNSNTISKPKSQKISNTNSKEQKKNQMKKQKPAVAEPEAAKPVLGPEEADSLDVSCKDDCPEIRIITTITDDLAVEHEEVDASANKIREICEQSQGSSSDDILMLKSEHENDSIPAEEAHSITNISETDREPDKDSSELKYLLLTSQSFIGHAEELLNLDVDCPKILPRSKTKEIANLRLYLDCANELTERKSLQGTQAVHPLLLTCAGHSRYHISLGRLVDEVYSAIEHLTSYSEKLASDNIYAMMERDIKSNNGLINGIWNWGWRHGFSADEAEQVVNEVENLVLGELIEEPLDISIFTLYIRSHSIDKRKKS

SEQ ID NO: 229716 - protein, 189 aa, Glycine max
  Coding DNA Sequence Number=SeqID_112938
MEVDFKSPSLEKTEAAETEVEENMHFHKSLQELRELQSQLHHAADYCETTFLKSEAKRDLLSGSGFIFPMVVHEAPILERPSSEELRDSKTEDPSKLDDKHILEKHEDLPLFLYTQKPHGDKNLKPTSFTTLKEHNLTMVVPVRDGLSVLTKVSNPTFHFQGSPKVARHRRSLHGSNILWLIRRTKRIQ

SEQ ID NO: 229717 - protein, 241 aa, Glycine max
  Coding DNA Sequence Number=SeqID_112939
  Gene Ontology: Biological process=regulation of transcription
  Homolog annotation: Hit_ID=Q1SWC6; Match level="QueryCoverage=80%, HitCoverage=32%, E-value=9e-84, Identity=78%"; Hit description =Tesmin/TSO1-like, CXC
  Pfam annotation: Domain name=CXC; Domain location=37-78; Score=87.2; E_value=5.2e-23; Accession=PF03638.5; Description=TesminTSO1-like CXC domain
MYLQEVGLFMAYFYGKTGAYHQMTWQEDAGEVLILGKHNKGCHCKKSGCLKKYCECFQANILCSENCKCMDCKNFEGSEERQALFHGDQNNMAYIQQAANAAITGAIGSSGYSSPPVSKKRKGQELFFWPTTKDPSISKLGQQVNHVRGPAPSSSLSPVSGARVGTATLGPSKFMYRSLLADIIQPQHLKELCSVLVLVSGQAAKTLTEKGDRGCIRTHDMARWLVSVRLGFSSANDYFNR

SEQ ID NO: 229718 - protein, 202 aa, Glycine max
  Coding DNA Sequence Number=SeqID_112940
  Gene Ontology: Biological process=regulation of transcription
  Homolog annotation: Hit_ID=Q1SWC6; Match level="QueryCoverage=98%, HitCoverage=35%, E-value=7e-70, Identity=66%"; Hit description =Tesmin/TSO1-like, CXC
MEKQAEDQTETSLASSSQEQLPSQKEGHIEKTVADDCSSANQTDKISPDNSSSDGADVPKGRPMSPGTLALMCDEQDTMFMTTASPIAPMAHACNTSSQFPYGQGMTEVYPEQERIVLTKFRDFLNRVITMGEINGKNELESQKDPIINGIGNASSEIVLQQGATSNGVTKPGSPLVTTSTSMIPGNIAENGETKVKIEKEI

SEQ ID NO: 229719 - protein, 73 aa, Glycine max
  Coding DNA Sequence Number=SeqID_112941
MVSPTLSAGWTELREFYGHTGNHKDVSSTMYSFMKAARFMHLNLEETTKCKIVYNHHRKTANWKWMEEFCTIT

SEQ ID NO: 229720 - protein, 369 aa, Glycine max
  Coding DNA Sequence Number=SeqID_112942
  Gene Ontology: Mol. function=protein-tyrosine kinase activity; Cellular component=integral to membrane; Biological process=protein amino acid phosphorylation
  Homolog annotation: Hit_ID=Q1T4P8; Match level="QueryCoverage=94%, HitCoverage=93%, E-value=8e-68, Identity=47%"; Hit description =Harpin-induced 1
  Pfam annotation: Domain name=Hin1; Domain location=212-347; Score =19.5; E_value=3.4e-05; Accession=PF07320.4; Description=Harpin -induced protein 1 (Hin1)
  Subcellular localization annotation: CTP_CleavageSite=66; ConfidenceScore=5.08e-01
MAHAKTDSDVTSMDTSSSPKRAVYYVQSPSRDSHDGDKSSTATHATPACNSPVDSPSHHSYGHHSRASSSSRVSGGSYNIASWGRKVTRKNKLGWPHECKVIEEEEEGYYGERQGFSRKTQIFVGVLGFAFIFTLFCFIIAAAARPYNVRISVKLEGIDNLYVFVEIVVPIYIIRGWVGGVHIYCVNVPQTGLSESLGFRMMNETGRNVESGTNVSFTVHNFLFGEGSDMTGVPTKMLTVNCSARMTVHNPATFFGIHVSSKAVNLMYSEMTVATGELKKHYLSRKSTRTVSVNLQGSKVSLYGADASLTGLVDNGKIPMTLVFEVGSLGNIVGRLVRSKHRRRVSCSVAIDSHNIEPIKLKENACTYN

SEQ ID NO: 229721 - protein, 445 aa, Glycine max
  Coding DNA Sequence Number=SeqID_112943
  Gene Ontology: Mol. function=sugar porter activity; Cellular component=integral to membrane; Biological process=carbohydrate transport
  Homolog annotation: Hit_ID=Q1T4P5; Match level="QueryCoverage=99%, HitCoverage=80%, E-value=1e-172, Identity=72%"; Hit description =Sugar transporter
  Pfam annotation: Domain name=MFS_1; Domain location=50-445; Score =39.5; E_value=1.2e-08; Accession=PF07690.6; Description=Major Facilitator Superfamily
  Pfam annotation: Domain name=Sugar_tr; Domain location=49-444; Score =82.2; E_value=1.6e-21; Accession=PF00083.14; Description=Sugar (and other) transporter
  Pfam module annotation: Pfam domain module=MFS_1::Sugar_tr; Domain location=50-445::49-444
MWMGHSSMYKRTPSRDNSNMEDVEENSDLLDIGLDKGTSNPSLMLSLPHVLVATISSFLFGYHLGVVNEPLESISVDLGFRGNTLAEGLVVSICLGGALIGCLLSGWIADGVGRRRAFQLCALPMIIGASMSAATNNLFGMLVGRLFVGTGLGLGPPVASLYVTEVSPAFVRGTFGAFIQIATCLGLMGALFIGIPVKEISGWWRVCFWVSTIPAAILATAMVFCAESPHWLYKVWRGMAQIPWQFFFCNSKPLENQGRTAEAEAEFERLLGVSEAKFAMSELSKADRGDDSDSVKLSELLHGRHSKVVFIGSTLFALQQLSGINAVFYFSSTVFKSAGVPSDIANVCIGIANLAGSIVSMGLMDKLGRKVLLFWSFFGMMFYYVAYHYRVIIMHLKIWDTCGSCTILNPDLVFVAIAMILQATGATSLVSNMGAQYFSVGGMFL

SEQ ID NO: 229722 - protein, 143 aa, Glycine max
  Coding DNA Sequence Number=SeqID_112944
  Gene Ontology: Cellular component=integral to membrane
  Homolog annotation: Hit_ID=Q8S1P4; Match level="QueryCoverage=90%, HitCoverage=50%, E-value=2e-57, Identity=78%"; Hit description =Membrane protein COV-like
  Pfam annotation: Domain name=DUF502; Domain location=6-143; Score =196.1; E_value=8.5e-56; Accession=PF04367.3; Description=Protein of unknown function (DUF502)
MLKLFANIWSGLGFITSITFIFLVGVFMSSWLGASVLGLGEWFIKRMPLVRHIYNASKQISAAISPDQNTQAFKEVAIIRHPRIGEYAFGFITSSVTLQNYSGDEELCCVYVPTNHLYIGDIFLVNTKDVIRPNLSIREGIGE

SEQ ID NO: 229723 - protein, 160 aa, Glycine max
  Coding DNA Sequence Number=SeqID_112945
  Gene Ontology: Mol. function=sodium:hydrogen antiporter activity; Cellular component=integral to membrane; Biological process=sodium ion transport
  Homolog annotation: Hit_ID=Q4VT46; Match level="QueryCoverage=55%, HitCoverage=17%, E-value=3e-31, Identity=76%"; Hit description=Nhx1 antiporter
MQTWNNSFFPPISTYLSQLNAAIGVIFSATDFVCTLQVLNQDETPLLYSLVFGEGVVNDATSVVLFKAIQNFDLSHIDLTTALQLLANFLYLFIASTVLGIFIRKSYTITKQRERWTDEEHKKFLEALKLYGRPGDGLKELHASFWSLMFYKPDLSPLKK

SEQ ID NO: 229724 - protein, 349 aa, Glycine max
  Coding DNA Sequence Number=SeqID_112946
  Gene Ontology: Mol. function=zinc ion binding; Cellular component =intracellular
  Homolog annotation: Hit_ID=Q1T4P7; Match level="QueryCoverage=54%, HitCoverage=50%, E-value=4e-52, Identity=54%"; Hit description=Zinc finger, RanBP2-type
  Pfam annotation: Domain name=zf-RanBP; Domain location=132-163; Score= 24.5; E_value=0.00038; Accession=PF00641.9; Description=Zn-finger in Ran binding protein and others
MVVELLLNPDIFHADALAGILTEIVPKRVKQVVDWGIKVWEDGKNWHQGYEGGYRIRAGSSSPVHRRDADRRFASDYNNLSRSRGYGGGRDPGRYRDPSPPYGRGRVGGRPMGSGLARGEGNNRNNPNVRPREGDWICPDPLCNNLNFARRDHCNSCNRSRNAPARSPRRSFPAPPPLHAPPRRFPGPLIDRSPERTLNGYRSPRGLARDGPREYGSAALPPLRHEGRFPDPHVRRERMDFIEDAYRGRNKFDRPPPLDWDNRDRGRDGFSDERKGFERRPLSPPVPFLPSLPHHRGGRWARDVRERSRSPIRGGPPPKEYRRDTFMHRARDDRHDRHGMGRDRIGGMY

SEQ ID NO: 229725 - protein, 189 aa, Glycine max
  Coding DNA Sequence Number=SeqID_112947
MASIPHTVFTHFSSFIPFYTYAVPNASRHRNDNTNNCSTHKIPLLPKEKHPNEQKLKLDHQNQNLLNVDFAALCEEGNLDQVLELKGQGVVADYRVYLTLLNFEKNACRVLDQMLDRNIASWHLMIAGYTSRGGGGLVGVKGGVVVGGTTVTKEVEGVIDDVALARAIPCGGWNRSHTRDMVAAINYNM

SEQ ID NO: 229726 - protein, 251 aa, Glycine max
  Coding DNA Sequence Number=SeqID_112948
PDPQELAARLCIPGRGFELNADGLPLKILRNNLTTLAQTWSVLSFSNPTPTSHTSDITLDRARLGFPALIIALCKARGVTFDSLTFESLSLTINLAYVKKNCWNLDDPTVTFRGPIKAKHKRSKAPSSDIPPTSTPSTSIAALSAPASSTPLPIPTPSSGLQPIMSVEEFISQDELIPPEPFVYETDLASAQEEVASLEPVPQSSPAAVLDDPQPSAPASVPDQPIVQDPPVAPVLDLNEHAQDHSHDQDF

SEQ ID NO: 229727 - protein, 81 aa, Glycine max
  Coding DNA Sequence Number=SeqID_112949
  Gene Ontology: Mol. function=protein kinase activity; Biological process=protein amino acid phosphorylation
  Homolog annotation: Hit_ID=Q9FID5; Match level="QueryCoverage=59%, HitCoverage=6%, E-value=2e-13, Identity=65%"; Hit description =Receptor protein kinase-like protein
MEDVTEDEKELAKKMIIVALWCIQLKPNDRPSMNKVVEMLEGDIESLEIPLNLNPSLYPLETMVSYDMEIGVVLGLTAMGL

SEQ ID NO: 229728 - protein, 88 aa, Glycine max
  Coding DNA Sequence Number=SeqID_112950
MSFIILRSCTYSIIQRFMQKSLPNKFKNPDHVSDPVHAHSSPTPVQLVDLEQWADQAPMLEQMVVDHQELQLEMTEERALVMLPPPEH

SEQ ID NO: 229729 - protein, 41 aa, Glycine max
  Coding DNA Sequence Number=SeqID_112951
MVDLNSTRGSSTQELCIVLLQYLYERGLEFIDGRKLRELKK

SEQ ID NO: 229730 - protein, 305 aa, Glycine max
  Coding DNA Sequence Number=SeqID_112952
  Gene Ontology: Mol. function=protein serine/threonine kinase activity; Cellular component=ubiquitin ligase complex; Biological process=protein amino acid phosphorylation
  Homolog annotation: Hit_ID=Q1S8T0; Match level="QueryCoverage=71%, HitCoverage=41%, E-value=1e-39, Identity=38%"; Hit description =Protein kinase
  Pfam annotation: Domain name=Pkinase_Tyr; Domain location=217-299; Score=-162.7; E_value=0.017; Accession=PF07714.7; Description =Protein tyrosine kinase
VDDTGSSIHMLTIVSYWMVTIHENYMLEKKASPTEIWTLTGKVWIRHVTMSFAKIQSGQEDAWGEEQFGSGTPGSATWKASSTGNRQLRNMEQADPYSEDTISCPIYMFDSDNSVLKLDLTSCTKMFDIVAPVKEFNQQDNWLALRWSKPNCTECEAKGKRCKWKNNNTGDIECFDCKGKQNGIQIPRSLIFAATDYRTEKPARFTYADVKRIMGGFKEKLGEGAHGAVFRGKLSNKILVAVKILNNTDKEGNELINEVEIMGKIHHINVVRLLGFCVEGHHRALVYCLFPKGSLQSFIFPPEDC

SEQ ID NO: 229731 - protein, 111 aa, Glycine max
  Coding DNA Sequence Number=SeqID_112953
DLCRFYGVPVVPSKVIRPPTNQAFIKKYCAPRQAQGETHQQLGDGRQWATDALLSPLEFTSTHPQKSRTHLVAHDPRNLNKTSTSSEGHPLYPRPAGQNPDIYHDQPFYKP

SEQ ID NO: 229732 - protein, 97 aa, Glycine max
  Coding DNA Sequence Number=SeqID_112954
  Homolog annotation: Hit_ID=Q8S1P4; Match level="QueryCoverage=98%, HitCoverage=38%, E-value=1e-20, Identity=56%"; Hit description =Membrane protein COV-like
MSSWLETSILTLAEWFYKKMPLVSYLYVVSKQISAAISPDQSSNAFKEVAISIPVLVSMHLGSSLLQWFYRTEMTNSLFVFTFPPITCTLVIFISLA

SEQ ID NO: 229733 - protein, 88 aa, Glycine max
  Coding DNA Sequence Number=SeqID_112955
  Subcellular localization annotation: CTP_CleavageSite=55; ConfidenceScore=5.51e-01
MLQNTETSLKTILVTGNQLPPNGNRLPESKNSGKNPCLSSVCFPSMWVLWLNSVCSQSKGCLFVVFCNRVKLNGNVRYVSFVRAGPSL

SEQ ID NO: 229734 - protein, 229 aa, Glycine max
  Coding DNA Sequence Number=SeqID_112956
  Gene Ontology: Mol. function=4 iron, 4 sulfur cluster binding; Cellular component=mitochondrion; Biological process=tricarboxylic acid cycle
  Homolog annotation: Hit_ID=Q1XPB9; Match level="QueryCoverage=98%, HitCoverage=29%, E-value=1e-107, Identity=83%"; Hit description =Aconitate hydratase, mitochondrial
  Pfam annotation: Domain name=Aconitase_C; Domain location=43-173; Score=209.6; E_value=7.3e-60; Accession=PF00694.9; Description =Aconitase C-terminal domain
MTMGIKAPSEDGSSVVVKVSPTSDRLQLLEEFPAWDGKNITGAKVLIKAFGKCTTDHISMAGPWLKYRGHLDNISNNMLIGAVNAYNMETNHVKNELTGEYGEVPAVQRAYKAAGIPTIVVGDQNYGEGSSREHAAMEPRHLGVKAVLVKSFARIHETNLKKQGMLGLTFANEADYDKIQEDDTVNFLDLDQFAPGKQLTLEFVHADGTKDIIMANHTYNDQQIDWFKA

SEQ ID NO: 229735 - protein, 93 aa, Glycine max
  Coding DNA Sequence Number=SeqID_112957
MALKGGLEREEKQETISREASINGKERSLRNKVEDPFTLFSLTLELRQISMEVGIALNEAPVKGKLRRVLQGERERERSSMIGIINLRLSFIS

SEQ ID NO: 229736 - protein, 168 aa, Glycine max
  Coding DNA Sequence Number=SeqID_112958
  Gene Ontology: Mol. function=glutamyl-tRNA reductase activity; Biological process=tetrapyrrole biosynthetic process
  Homolog annotation: Hit_ID=Q6AVG1; Match level="QueryCoverage=79%, HitCoverage=36%, E-value=6e-38, Identity=52%"; Hit description =Expressed protein
MQSRLEEGKDPAGFRTTPSRPFPLRLLQFFLAFLVIGLGASFLSMYMIRHFGIHNVALVQSSFKPCFEQPATLESWIRPRSSLLHTMNDTELFWRASFVPRIKSYPFKRTPKIAFMFLTKGPLPMAPLWEKFFRGHEGLYSIYVHSLPSYNADFSPSSVFYRRQIPSQ

SEQ ID NO: 229737 - protein, 709 aa, Glycine max
  Coding DNA Sequence Number=SeqID_112959
  Gene Ontology: Cellular component=nucleus; Biological process =regulation of transcription, DNA-dependent
  Homolog annotation: Hit_ID=Q6UEI3; Match level="QueryCoverage=99%, HitCoverage=99%, E-value=1e-57, Identity=29%"; Hit description=Early flowering 3
MMNRMSGGIEEDKEISPMFPRLHVKDAERGGPKAPPRNKMALYEQFSLPSQNFAPGSASLFPLPLRNYTGPTSSSHISSNQSIQFCTSSMPSILAEKSQTYNSRKTNLTKFMQDDFINSKNSLRTLDGEDTFITCGSAHRKNSSCSIIQNFKDEDKLSHSNLSGSLKSPNSFRKVNSPGAVDLKSAQYGKNRMEDHTEVSQNGQKPEEVLPHSLDGFGDMTDASLISLVKGKNSKSMNKEHRSLKEEKRSILIDSLKTSQGSSVRTHEELAVFEDQVNSRDHHIEKPTANDVHKCAGELEIGRRCFLDKVDMNEDEETYRHSDAVSKVNSECTLAMDISPDNVVGAIGEQQFWKVRRTIINQQKIFVKQVFELHRLIKVQRLIAGSPHVLLEDNLLLNKPPPKTSTSKKFQSDFASQKPSSVVKLDNKSVKVNTAEKATNSAVGKIPIPCISNTTKGHANQLPNYGHHLGNPALASADSNSKQSPSYVYPPPGNQWLVPVMSPSEGLVYKPIIWPCPPNAGFMAPIYGSCGTVSFNPLSKDASSDAALAPSSHQKLGILSGSSLPQFLPPSFMNHPSSISASAVEQMGQSNGPENHHSWGEVNSAILFQSSSNMSSPTSQVMPRNISTYHHSLQDKELHRSTASSPSKRVSGEALPLFPLAPTCWQSEDTNTQVEQQPRVIKAMPHNPKTASETAAKIFRSIQEERKHL

SEQ ID NO: 229738 - protein, 101 aa, Glycine max
  Coding DNA Sequence Number=SeqID_112960
  Homolog annotation: Hit_ID=Q2HUD0; Match level="QueryCoverage=85%, HitCoverage=7%, E-value=9e-36, Identity=86%"; Hit description=WD40 -like
MEFGLNSVYDFLLVQHRVRLGKYKRDSDSSQREGENLQAAWSPDAKLIAILTFAFFLHIFKVQLSDKRIHTGGKQPSALCLATISLLLTEQVPFAVKDLSV

SEQ ID NO: 229739 - protein, 102 aa, Glycine max
  Coding DNA Sequence Number=SeqID_112961
MEATMCSKGGVWFACGKRQGDDEEEVELSAPTCWVASNRACPTVQPCPVTAETPDTVSHRSRVHIRVRCKSDAGHTAEVPRPCFLGRDSMTMKKQDKKNRKR

SEQ ID NO: 229740 - protein, 71 aa, Glycine max
  Coding DNA Sequence Number=SeqID_112962
MRDDKLFDEEKTLFLLTSLPRSFKVLVQMLLVGSSTLNLDEVVAALKENKRMMRIGNVDYEDHAIAVVESE

SEQ ID NO: 229741 - protein, 128 aa, Glycine max
  Coding DNA Sequence Number=SeqID_112963
MLLMFRTLELVFVKACVGLWGRTGTLFNGSLPGLLRGELLLPARTCPDGWPPAGRPRVVGNAPAFVDELRWTLEVVAGYGDGRSDDLAGGDRHPVGLTEARNQSWKPQNPFGLLRVHWMSCGRDPCKQ

SEQ ID NO: 229742 - protein, 431 aa, Glycine max
  Coding DNA Sequence Number=SeqID_112964
  Gene Ontology: Mol. function=transcription regulator activity; Cellular component=nucleus; Biological process=regulation of transcription
  Homolog annotation: Hit_ID=Q8S0N2; Match level="QueryCoverage=27%, HitCoverage=30%, E-value=2e-34, Identity=64%"; Hit description=BHLH transcription factor-like
  Pfam annotation: Domain name=HLH; Domain location=341-388; Score =24.2; E_value=0.00039; Accession=PF00010.16; Description=Helix-loop -helix DNA-binding domain
MDGLSWDASQLWGTIQQPPVFGGGYSMPLNVLNQIQEMQKAQTGHVFSNSERAIYQSAGATTTSSEIMDVMQKQDKNLSQHVSTMPVKPGAGASWGETLTSQSYPSLSVNGPHSMNLISNYTPDFNMAHHQQLVNGSQNGKGGCSLEPFDCLISATNSNTDTSVEDDDGISMILSDCGNLWNNFSYGSVASTGESESNASNGRNKDMQCPVNEVDETVSQTVESEANCSKRSHDQSKMIQVGDSCFSIVQNSSPIEEGGFRLISDNPPECKKPRWDMSSSSNNINFQQPNSSISSSIEEPDPEAIAQMKEMIYRAAAFRPVNFGLEVVEKLKRKNVKISTDPQTVAARHRRERISEKIRVLQKLVPGGSKMDTASMLDEAANYLKFLRSQVKALESLGNKVDAMNCPPTSIAFSFNPSFPMQTPLSHIHHS

SEQ ID NO: 229743 - protein, 101 aa, Glycine max
  Coding DNA Sequence Number=SeqID_112965
  Homolog annotation: Hit_ID=O81225; Match level="QueryCoverage=61%, HitCoverage=7%, E-value=9e-12, Identity=61%"; Hit description=Extra -large G-protein
MLSLEYPSTRVSSLKAEDIDAKCPHVITFDVDTYVLQLTAGTKLVCSFLFLSVPSKSSNSLGEQPSSLASRTLPDYVEHGIVQKLLLVGCSGSGTSIIFKQ

SEQ ID NO: 229744 - protein, 59 aa, Glycine max
  Coding DNA Sequence Number=SeqID_112966
MEVAQAVHMKGGPGDASYGNQDVHLSQQTFRHKDYECPQHIRSKTNPLVVRDTGPRNFT

SEQ ID NO: 229745 - protein, 70 aa, Glycine max
  Coding DNA Sequence Number=SeqID_112967
MVLELLVSSTLELPPKSDKSLELSFRVENLNAPELLSSSTLLCEAQCSNAITEVGETVVSDASLETLASV

SEQ ID NO: 229746 - protein, 156 aa, Glycine max
  Coding DNA Sequence Number=SeqID_112968
  Gene Ontology: Mol. function=protein serine/threonine kinase activity; Cellular component=integral to membrane; Biological process=protein amino acid phosphorylation
  Homolog annotation: Hit_ID=O81066; Match level="QueryCoverage=92%, HitCoverage=16%, E-value=1e-39, Identity=53%"; Hit description =Putative receptor-like protein kinase
MGALICPLLFAGTPGYLDPEYSISSRLTEKSDVYSFGVVLLEMVTGKPAIAKTPEKTHISQWVKFMLPNGDIKNIADSRLQEDFDTSSVWRVVEIGMASVSISPVKRPSMSNIVNELKECLTTELARKYSGRDTENNDSIELVTLNFTTELGPPAR

SEQ ID NO: 229747 - protein, 653 aa, Glycine max
  Coding DNA Sequence Number=SeqID_112969
  Gene Ontology: Mol. function=protein serine/threonine kinase activity; Cellular component=integral to membrane; Biological process=protein amino acid phosphorylation
  Homolog annotation: Hit_ID=Q1SB06; Match level="QueryCoverage=96%, HitCoverage=69%, E-value=0.0, Identity=55%"; Hit description=Protein kinase
  Pfam annotation: Domain name=LRR_1; Domain location=409-431; Score =8.8; E_value=6.4; Accession=PF00560.23; Description=Leucine Rich Repeat
  Pfam annotation: Domain name=LRR_1; Domain location=433-455; Score =17.7; E_value=0.043; Accession=PF00560.23; Description=Leucine Rich Repeat
  Pfam annotation: Domain name=LRR_1; Domain location=457-476; Score =13.7; E_value=0.66; Accession=PF00560.23; Description=Leucine Rich Repeat
  Pfam module annotation: Pfam domain module=LRR_1::LRR_1::LRR_1; Domain location=409-431::433-455::457-476
MMGMLLQFLYALFGVLTAVVLVQAQDQSGFTSIDCGLPEASSYNEKTTGIFYISDAKFIDAGVSKSISPAQKSTHLQQLAYVRSFPSGERNCYRINVTSGTKYLIRATFFYGNYDGLNQPPQFDLHLGANIWDTVNFPNASLSEISEIIHTPSLDYIQPCLVNTGKGTPFISAIELRTLNNAFYVTASAESLAYYQRYDLGSITNLGYRYNYDVYDRIWVPHGLNQWTQLSSTLHLLDIFQNDYKLPEVVMSTAATPINASAPFQFYWGPDNVDDKFYIYMHFSEVEILAENETRTFNIFMNGKLFYGPLTPGYLTTNTIYAKSALTGATRYLFSLAKTGTSTLPPIINAMEIYKVIDFPQSETEQDDVDAITNIKNAYGVDRNWQGDPCGPVAYIWEGLNCSYDNTPRITSLNLSSSGLTGQISSFISELTMLQYLDLSNNSLSGSLPDFLTQLQSLKVLNLVNNNLTGPVPGGLVERSKEGSLSLSLGQNPNLCESDPCIQQSNNKQPDAANQNKNKNNIVIPAATSVAGILVLVIIVVTAIICGLKKRKPQASVNIDVQTNTPSGSQFASKQRQYSFNELVKITDDFTRILGRGAFGKVYHGIIDDTQVAVKMLSPSAVRGYEQFLAEASGHYLHQSFFVNSTQSAVVTT

SEQ ID NO: 229748 - protein, 171 aa, Glycine max
  Coding DNA Sequence Number=SeqID_112970
  Gene Ontology: Mol. function=transferase activity; Cellular component= mitochondrion; Biological process=metabolic process
  Homolog annotation: Hit_ID=Q1T1H0; Match level="QueryCoverage=77%, HitCoverage=31%, E-value=2e-40, Identity=59%"; Hit description =Protein prenyltransferase
  Pfam annotation: Domain name=PPR; Domain location=11-45; Score=41.3; E_value=3.4e-09; Accession=PF01535.11; Description=PPR repeat
  Pfam annotation: Domain name=PPR; Domain location=46-80; Score=30.0; E_value=8.6e-06; Accession=PF01535.11; Description=PPR repeat
  Pfam annotation: Domain name=PPR; Domain location=88-122; Score=17.3; E_value=0.056; Accession=PF01535.11; Description=PPR repeat
  Pfam module annotation: Pfam domain module=PPR::PPR::PPR; Domain location=11-45::46-80::88-122
  Subcellular localization annotation: CTP_CleavageSite=33; ConfidenceScore=5.09e-01
MMGMVLSPNVVSFNTLISGYCNKGLFGLALKVKSLMGENGVQPNVVTFNTLINGFCKERKRHEANRVFNEMKVGDREMVRNGVKADILTINALILGLCKDGKTKKAAGFVRELDKENLVSNGVPFLHLLLGCVGKISWHWRCVVWWKRRLLPEGFDKEKIAITHPENETSN

SEQ ID NO: 229749 - protein, 70 aa, Glycine max
  Coding DNA Sequence Number=SeqID_112971
MLKLCRLCEGFDGGGKAVFFHEGISEGGVAELVGVGEGVEEGVKDERGGRAAETVGEQRRFEEGVKRGFA

SEQ ID NO: 229750 - protein, 490 aa, Glycine max
  Coding DNA Sequence Number=SeqID_112972
  Gene Ontology: Mol. function=glucose-6-phosphate 1-dehydrogenase activity; Cellular component=chloroplast; Biological process =carbohydrate metabolic process
  Homolog annotation: Hit_ID=Q43839; Match level="QueryCoverage=93%, HitCoverage=84%, E-value=0.0, Identity=80%"; Hit description=Glucose- 6-phosphate 1-dehydrogenase, chloroplast precursor
  Pfam annotation: Domain name=G6PD_C; Domain location=221-487; Score =432.2; E_value=7.1e-127; Accession=PF02781.6; Description=Glucose-6 -phosphate dehydrogenase, C-terminal domain
  Pfam annotation: Domain name=G6PD_N; Domain location=39-218; Score =318.2; E_value=1.4e-92; Accession=PF00479.12; Description=Glucose-6 -phosphate dehydrogenase, NAD bin
  Pfam module annotation: Pfam domain module=G6PD_C::G6PD_N; Domain location=221-487::39-218
MTSGLAGSSLAKEDGKPQPLEGPFPFPDSEYTGSNLSITVVGASGDLAKKKIFPALFALFYEDWLPENFLVFGFARTKMTDEELRNMISKTLTCRIDKRENCEDKMDQFLKRCFYHSGQYNSEDHFSELDSKLREKEGGKLSNRLFYLSIPPNIFVDVVRCASLKASSKDGWTRVIVEKPFGRDSESSSELTKSLKQYLTEDQIFRIDHYLGKELVENLSVLRFSNLVFEPLWSRNYIRNVQIIFSEDFGTEGRGGYFDHYGIIRDIMQNHLLQILALFAMETPVSLAAEDIRNEKVKVLRSMRPLELENVVVGQYKGHSKGGKSHPAYTDDPTVPKGSLTPTFAAAALFIDNARWDGRNFGTDLDKATNELVLRVQPDEAIYLKINNKVPGLGMRLDRSDLNLLFRARYPREIPDAYERLLLDAIEGERRLFIRSDELDAAWALFTPLLKEIENKKIAPELYPYGSRGPVGAHYLSAKHNVRWGDLGED

SEQ ID NO: 229751 - protein, 69 aa, Glycine max
  Coding DNA Sequence Number=SeqID_112973
MMVRVHGGTRVMVVVWRRGGEGGWVHGDNEVMVVWIRGKGELVVEPWGCGGSRGQGGGDVVIEVLGLWR

SEQ ID NO: 229752 - protein, 251 aa, Glycine max
  Coding DNA Sequence Number=SeqID_112974
  Gene Ontology: Mol. function=methyltransferase activity; Cellular component=nucleus; Biological process=fatty acid biosynthetic process
  Homolog annotation: Hit_ID=Q1T1A3; Match level="QueryCoverage=99%, HitCoverage=68%, E-value=9e-98, Identity=68%"; Hit description=SAM dependent carboxyl methyltransferase
  Pfam annotation: Domain name=Methyltransf_7; Domain location=36-251; Score=217.3; E_value=3.4e-62; Accession=PF03492.6; Description=SAM dependent carboxyl methyltransferase
MEVAKVLHMNGGVGDASYANNSFVQQKLICLTKPLREEAIKSLYCGTLPRRLAMADLGCSSGQHALIVVSDFIKTVEKLCLELNHKSPEYKVFFNDLPGNDFNNIFKSLDSFKQKLCEEMESGIGPCYFFGAPGSFYGRIFSNQSVHFIHSSYSLQWLSKRYIKVPECIDNNKSNIYLGRTSPSNVVRAYYEQYQRDFSLFLKCRAEELVEGGRMILTIMGRRSDDPSSKDGCYIWEIMATALNDMVLQKI

SEQ ID NO: 229753 - protein, 120 aa, Glycine max
  Coding DNA Sequence Number=SeqID_112975
  Homolog annotation: Hit_ID=Q1SAZ0; Match level="QueryCoverage=42%, HitCoverage=3%, E-value=3e-10, Identity=63%"; Hit description =Integrase, catalytic region
MKHIEIDRHFIKKKLDARVICLSFVPSNQKTSDILTKSLTRLILEPLASKLGMKVFVEAMFSKFILMMPKTQVKNQESGKFQESQSCSIKASFKNQRVVQSNQVSRIKIKVKIQEKTQLG

SEQ ID NO: 229754 - protein, 165 aa, Glycine max
  Coding DNA Sequence Number=SeqID_112976
  Gene Ontology: Mol. function=transcription regulator activity; Cellular component=nucleus; Biological process=regulation of transcription
  Homolog annotation: Hit_ID=Q69TG3; Match level="QueryCoverage=55%, HitCoverage=36%, E-value=3e-11, Identity=46%"; Hit description =Putative RNA polymerase transcriptional regulation mediator
MAVCHGDQVQILTSRFGIVFVFVPNRVKEKAVFVSYLGVEDGNGAGKSNVFINSQGLHKHLHLNDNLYTAYGAGSVDSENGTALLESKTAKETIDIKEAKRVDHILTSLQRRLPPAPPPPPFPEGYVSPLTAETEKGTETQEAAETQAPTADPIIDQGPAKRMKF

SEQ ID NO: 229755 - protein, 506 aa, Glycine max
  Coding DNA Sequence Number=SeqID_112977
  Gene Ontology: Mol. function=nucleoside-triphosphatase activity; Cellular component=intracellular; Biological process=two-component signal transduction system (phosphorelay)
  Homolog annotation: Hit_ID=Q9FJZ7; Match level="QueryCoverage=80%, HitCoverage=67%, E-value=1e-116, Identity=65%"; Hit description =Arabidopsis thaliana genomic DNA, chromosome 5, TAC clone:K1F13
  Pfam annotation: Domain name=UPF0261; Domain location=7-184; Score= -226.4; E_value=0.0013; Accession=PF06792.2; Description =Uncharacterised protein family (UPF026
CTGALGMNGVFLTLYLKSGYNLTQSMRAVAESMLVSHFGEAIIDELFSRYQEILADRMSKEKTKFINKSSECLGGVIGVGGSGGTSLLSSPFASLPIGVGGRAMENLVREGFIQGVFDISTTEVADYIVGGVMACESSRFDAVIENKVPLVLSVGALDMPYPHHINDLEFANALVDAFLEINEKTSKDSTQQQVASPESVEQFHEDNVSNASSIATIVYTPSEFPEARRGAGAWTGISAKFEEAGGVDLIVLYNSGRFRMAGRGSLAGLLPFSDANAVVLDMANEVLPDVQGKGPMAKAESNLGLGHHHNLLVVKKVPVLAGVCATGLFRRMDYFLKQVESTGFSGLQNFPTVGLFDGNFRLNLEETGMGYSLEVEMIQKAHKMGLFTTPYAFNQYEAIEMAKVGADIIVAHMGLTTTGSIGAKTSVSLKESVVHVQAIADAAHRINPGVIVLCHGGPISGPKEAAFVLKRTKGVHGFYGASSMERLPVEQAITNTVKQYKSISIH

SEQ ID NO: 229756 - protein, 379 aa, Glycine max
  Coding DNA Sequence Number=SeqID_112978
  Gene Ontology: Mol. function=oxidoreductase activity; Cellular component=membrane; Biological process=electron transport
  Homolog annotation: Hit_ID=Q75LK7; Match level="QueryCoverage=86%, HitCoverage=59%, E-value=6e-47, Identity=33%"; Hit description =Putative cytochrome P450
  Pfam annotation: Domain name=p450; Domain location=1-356; Score=33.7; E_value=1.6e-12; Accession=PF00067.12; Description=Cytochrome P450
MADAVGQKSLLCVPVESHKRIRGLLSEPFSMTSLSAFVTKFDKMLCGRLQKLEESGKSFKVLDLCMKMTFDAMCDMLMSITEDSLLRQIEEDCTAVSDAMLSIPIMIPRTRYYKGITARKRVMETFGEIIARRRRGEETPEDFLQSMLQRDSLPASEKLDDSEIMDNLLTLIIAGQTTTAAAMMWSVKFLHDNRETQDILREEQLSITKMKPEGASINHEDLNSMRYGLKVVKETLRMSNVLLWFPRVALEDCTIEGYDIKKGWHVNIDATHIHHDSDLYKDPLKFNPQRFDEMQKPYSFIPFGSGPRTCLGINMAKVTMLVFLHRLTGGYTYLLRKEGTHTQAKEWLPNNFEVLKQKHARGIKEGRGDLQDKYFIFTA

SEQ ID NO: 229757 - protein, 250 aa, Glycine max
  Coding DNA Sequence Number=SeqID_112979
  Homolog annotation: Hit_ID=Q3SPW4; Match level="QueryCoverage=52%, HitCoverage=37%, E-value=2e-27, Identity=49%"; Hit description =Hypothetical protein precursor
VDSRGSHRLDLGQRRGTALAKILPGQVAVPVAPRGLGETRRAQLAHQGEIGHREQVHAVLPVLAVAVAEGVELLDIAEALVGLLLDPGPQAALQGGVLGHQRSGGQGALAALGLALDLHGQRARLTVRRRDDHGHEPHGGGIGGGAVRARPLVRRGGNHTRLGRAHAFVGLASLVPGHLPPLHRSCRIGPGTVNGTSGLIRRSHSQSFRRRLRSRSPRRADPARPDGSAKGPPWRPDRTEDRHEHRNGVS

SEQ ID NO: 229758 - protein, 159 aa, Glycine max
  Coding DNA Sequence Number=SeqID_112980
  Subcellular localization annotation: CTP_CleavageSite=89; ConfidenceScore=5.06e-01
MSLPMGIILYMSFWASLSKVSDGGLPKHHGFLNLSHKDPMFFSIIVVSIMVPSTTSISFNTVEARTRPLQLTSSTFHHMGASNDLFGIKAQPLRVKHLTMFRGKDLNGTNDVKLRKPETLTLHCERFSMKEEEFIDNMFGRLQVLMNNLKALGQTYPKA

SEQ ID NO: 229759 - protein, 126 aa, Glycine max
  Coding DNA Sequence Number=SeqID_112981
  Gene Ontology: Mol. function=DNA binding; Biological process=DNA integration
  Homolog annotation: Hit_ID=Q1RZ71; Match level="QueryCoverage=99%, HitCoverage=14%, E-value=1e-14, Identity=34%"; Hit description =Peptidase aspartic, catalytic; Polynucleotidyl transferase, Ribonuclease H fold
MARTMLYEDSLLKHLWAEMDKGIFLEYLDTSKAYKIFNTGTLVVEESIHVKFNDGLTPNRKLLDLEDYVANMQIGPFVTPKQDETEAIKTKSSSKDLMTCAHVIEIKPKSVDEALTDDGWIIAMEE

SEQ ID NO: 229760 - protein, 140 aa, Glycine max
  Coding DNA Sequence Number=SeqID_112982
MWIEEEGWIEEEGIMKIEKGFLLLEILRLRMYSLDNSESRPSGLSRYGGDHALSVGFTLSTPLGFFMGLLRAKREMTAKRGDALSLSCALSELSQSPTFLQCSLSFALLNTHAPEISARNVKQTILWLSKFFGTARDPST

SEQ ID NO: 229761 - protein, 196 aa, Glycine max
  Coding DNA Sequence Number=SeqID_112983
  Gene Ontology: Mol. function=electron carrier activity; Cellular component=intracellular; Biological process=electron transport
  Homolog annotation: Hit_ID=Q1YG88; Match level="QueryCoverage=96%, HitCoverage=83%, E-value=1e-69, Identity=79%"; Hit description =Electron transfer flavoprotein beta-subunit
MKVLVPVKRVVDYNVKIRVKADGSGVELANVKMSMNPFDEIAVEEAIPGAGDPAHRPGHGRRPGDPGQDRCELRAACRRQGAEGGGRELEPEPRHPRQAGDRRRLEPDRPDAGGAPRLAAGHLRLQARIRRGRDRRDPRGRWRPPDGLAEAAGDRHDRPAPQRAALREPAQHHEGEEEAAGGAVSGGARGSTSRPN

SEQ ID NO: 229762 - protein, 105 aa, Glycine max
  Coding DNA Sequence Number=SeqID_112984
  Homolog annotation: Hit_ID=Q1YIV9; Match level="QueryCoverage=37%, HitCoverage=16%, E-value=1e-10, Identity=80%"; Hit description =Putative ErfK/YbiS/YcfS/YnhG
VDSRGSHHGALEHRRGGLLGMHPHAEPGRDRPAPARAHRNEGRGARVTRYQPRRTARRAGDDRQPRKRRVDRTGARRRPRPCAARQPVRPRLGGAGAIHRRRRAG

SEQ ID NO: 229763 - protein, 136 aa, Glycine max
  Coding DNA Sequence Number=SeqID_112985
  Homolog annotation: Hit_ID=UPI00003827FA; Match level="QueryCoverage =88%, HitCoverage=87%, E-value=6e-37, Identity=65%"; Hit description =COG1416: Uncharacterized conserved protein
  Pfam annotation: Domain name=DUF1791; Domain location=19-136; Score =135.0; E_value=2.1e-37; Accession=PF08754.1; Description=Domain of unknown function (DUF1791)
MGAAHAGSEAPAGHYANQKVVYHNGGGPDGAAYFKRLLGNLRNHVDAVGKDHVEIRVVSLGDGLALFQAAAEDGELAGRIDALKAAGVRFLVCANTLRERKIDRGALYAVGEDDIVPSGVAELARLQGMGFAYIHP

SEQ ID NO: 229764 - protein, 341 aa, Glycine max
  Coding DNA Sequence Number=SeqID_112986
  Gene Ontology: Mol. function=catalytic activity; Biological process =nucleoside metabolic process
  Homolog annotation: Hit_ID=Q9LWK9; Match level="QueryCoverage=94%, HitCoverage=90%, E-value=9e-82, Identity=49%"; Hit description =Putative bark storage protein
  Pfam annotation: Domain name=PNP_UDP_1; Domain location=38-336; Score= -44.9; E_value=9.6e-06; Accession=PF01048.10; Description =Phosphorylase family
MKLLGLLVLVLGSTISANGAVSEVSWREISKINREGPYVGIVVPNAFELNPLLRSPSFVPHNKFPYFDFAGKHFRIGVLEKKRVIVVMTGLSMLNAGISTQLLLTLFDIEGVVHYGIAGNANPKLQIGDVTIPQYWAHTGLWNWQRFGDGPKDALALEASGDYSRRFGYLKFADYNNNTKHSKSATNLLNNVWFQAEEIFPVNGTAEVRQHAFWVSVDKTYFEIARELKNVKLSNCVNTTCLPRRPIVVRVEKGVSANVFVDNKAYREFLHSKFDVTAIDMESAAVALICLQQKKPFIAIRSLSDLAGDSSTLSNEVDVFASLASQNALDVVVRFISLLNQ

SEQ ID NO: 229765 - protein, 293 aa, Glycine max
  Coding DNA Sequence Number=SeqID_112987
  Gene Ontology: Mol. function=DNA-directed RNA polymerase activity; Cellular component=nucleus; Biological process=transcription
  Homolog annotation: Hit_ID=Q1T3I9; Match level="QueryCoverage=72%, HitCoverage=58%, E-value=1e-101, Identity=85%"; Hit description=RNA polymerase subunit, RPB5; RNA polymerase Rpb5, N-terminal
  Pfam annotation: Domain name=RNA_pol_Rpb5_C; Domain location=220-293; Score=146.3; E_value=8e-41; Accession=PF01191.9; Description=RNA polymerase Rpb5, C-terminal domain
  Pfam annotation: Domain name=RNA_pol_Rpb5_N; Domain location=89-178; Score=148.1; E_value=2.4e-41; Accession=PF03871.5; Description=RNA polymerase Rpb5, N-terminal domain
  Pfam module annotation: Pfam domain module=RNA_pol_Rpb5_C::RNA_pol _Rpb5_N; Domain location=220-293::89-178
MVTFILRTTIAIDVSKFVKGLRQWRCPRPIGAEVIHDGDLSYLLINRGLSHEVELVDNRDNFGKKGLISLKGSVCVPIPCGERLRRKMVLSEEEMGRLYRIRKTVMQMLRDRGFLVGDFEINMSKHEFKSKYGEHMKREDLVINKSKKDNSGDQIYVFFPDEPKVGVKTMKTYTNRMNSENVYRAILVTQTNLTPFARTCISEISSKFHLEVFQEAELLVNIKEHELVPEHQVLTDAEKKTLLERYTVKETQLPRIQVTDPVARYYGLKRGQVVKIIRPSETAGRYVTYRFVV

SEQ ID NO: 229766 - protein, 151 aa, Glycine max
  Coding DNA Sequence Number=SeqID_112988
  Gene Ontology: Mol. function=protein serine/threonine kinase activity; Cellular component=integral to membrane; Biological process=protein amino acid phosphorylation
  Homolog annotation: Hit_ID=Q1S8T0; Match level="QueryCoverage=98%, HitCoverage=22%, E-value=3e-40, Identity=52%"; Hit description =Protein kinase
MLAARGTLGYIAPEVFSKNLGNVSYKYDIYSYGMLLLEMVGGRKNVDISPTQNFHVLYPDWIHDLVDGDIHIHVEDEGDVKISKQLAIAGLWCIQWQPVNRPSIKLVIEMLETREKDQLTVPPNPFQSTTATNISGLTLARRPLKLEAIQE

SEQ ID NO: 229767 - protein, 290 aa, Glycine max
  Coding DNA Sequence Number=SeqID_112989
  Gene Ontology: Mol. function=nucleic acid binding; Biological process= DNA integration
  Homolog annotation: Hit_ID=Q1T010; Match level="QueryCoverage=73%, HitCoverage=15%, E-value=3e-52, Identity=45%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MASNGHFPSNLPILAGKNFNIWSVQMKALLGFQDLTDVIENGIEIPKEGASDSQKTEFKDLKKKGCKALVILHQCVNDSHFEKIANAKSANKAWDILNKAYAGADKIKKVRLQTLRRQFELLQMEETENIEDYFGRLQVLANSITSCGDTITNLTLVEKVLRTLNPRFDHIVVAIEESKDLESLFVDELQGSLEAHEQRLQERANDKATEQALQAHHQSRNGGSNNHKGKKGRGRFQNTRGRGGYSKDKGKPQPDQRSGDSCSKRSGSSSTRGRGGKKKWDKRNAECFNC

SEQ ID NO: 229768 - protein, 189 aa, Glycine max
  Coding DNA Sequence Number=SeqID_112990
MCKMLVLVFAELLSLPTASKQPCPQVSECVTRATKLNGQGEEWVCDPRRGAIKGGVKDGGGDDGGGGGDGCGGERNLAVTAGVGAERQRPRLDGLEVAVDVGTVEARESKAEELAMSVVVTLKEGTVVAAVAVVMVVVVALKDETMVTVAVVIAPEKVRCMEIETHCDEVGHGCLEPVQASVERVGICH

SEQ ID NO: 229769 - protein, 245 aa, Glycine max
  Coding DNA Sequence Number=SeqID_112991
MGNSIRDAFNNSRIPCDIELGRSATMELSTKTRKKFGDDGGFWEDWYVTYTVHGQTCSLCLVRDYDKHDNLNKVSFILLDLGLGFRTLCLHIETTSETGFLRINSTQSIPWTKTNRTVDARDDVVDTKVYLDGNANQRNDLIVLECKKNSTDHDEETNVVTVAHYFADSRGRAFNIDDELGIGLSVVAKVRVSNGQLDITVEGPEQHPASALFCMFDQVNRTGIWKPTMCPHCAQPRSSASAPAA

SEQ ID NO: 229770 - protein, 334 aa, Glycine max
  Coding DNA Sequence Number=SeqID_112992
  Gene Ontology: Mol. function=catalytic activity; Biological process =nucleoside metabolic process
  Homolog annotation: Hit_ID=Q9LWK9; Match level="QueryCoverage=71%, HitCoverage=73%, E-value=7e-76, Identity=56%"; Hit description =Putative bark storage protein
  Pfam annotation: Domain name=PNP_UDP_1; Domain location=38-329; Score= -40.1; E_value=4.3e-06; Accession=PF01048.10; Description =Phosphorylase family
MELLGLLVLLLGSSIMANGAVSEVSWREISNINSEGPYLGIVVPNSFELGPLLRSSSFVPHNKFPYFDFAGKHFRIGVLEKKRVIVVMCGLGMLNAGLSTQLLLTLFNVNGVLHYGIAGNANPKLQIGDVTIPQYWAHTGLWHWQRLGEVNVSGDFSRDFGYLEFANYNNCSKDFKSNTNLLNKVWYQPEEIYPVNGIPEARHEIFWVPVDKTYFKIASKLKNVKLESCVNTTCLPRKPIVTRVEKGVTANVFVDNKAYREFLYSKFDATPVEMETAAVALVCLQQKKPFIAIRSLSDLAGGGSALSNEVDVFSSLASQNAFEVLVKFISLLTQ

SEQ ID NO: 229771 - protein, 246 aa, Glycine max
  Coding DNA Sequence Number=SeqID_112993
  Homolog annotation: Hit_ID=Q39PK1; Match level="QueryCoverage=45%, HitCoverage=46%, E-value=3e-35, Identity=62%"; Hit description=NADPH- dependent FMN reductase
MEGVPGGAVAGGERGDGRGAHLGVALAAVTHEELDEVGQAGVGGAVDDRLALAPGGDQPGVRELLQVEGQVVAGDVHRLGEDARGEAARTGGDQGAHDPEPMLLAEGGEGGEGLPGVKRLGQAPAAVRRRGAEPLRGAFRGADRGTDGAADAARPCASIPRPLRVAPGSVLQPVPGLRGGTAAGGDGRGGPHIPRGRATAARRRARRTSEGAGTPAALDLVGGAGLGQPGAARQHDRGDEGPGGIL

SEQ ID NO: 229772 - protein, 205 aa, Glycine max
  Coding DNA Sequence Number=SeqID_112994
  Gene Ontology: Mol. function=protein tyrosine phosphatase activity; Cellular component=intracellular; Biological process=protein amino acid dephosphorylation
  Homolog annotation: Hit_ID=Q6N3Y7; Match level="QueryCoverage=73%, HitCoverage=86%, E-value=2e-48, Identity=66%"; Hit description =Arsenate reductase
  Pfam annotation: Domain name=ArsC; Domain location=158-205; Score= -29.9; E_value=0.027; Accession=PF03960.6; Description=ArsC family
  Pfam annotation: Domain name=LMWPc; Domain location=1-115; Score= -20.0; E_value=0.0022; Accession=PF01451.11; Description=Low molecular weight phosphotyrosine protein phosphatase
  Pfam module annotation: Pfam domain module=ArsC::LMWPc; Domain location=158-205::1-115
MLKKEGGGRFRAFSAGSRPKGEPHSLALQVLRESDYPTEGLRSKSWDEFAGPEVPVMDFVFTVCDNAVFFYVPVLAGPAGDGPLGHRGPRRGGGLGDGAQARLRHRPALPQESDRGLRRPAARQPRPGRPVVEGPRDRPDGRRDLGPPGGRVMDVVIYHNPACGTSRNTLAMIRNAGIEPHVVEYLKTPPNRALLKQMLARAGLS

SEQ ID NO: 229773 - protein, 116 aa, Glycine max
  Coding DNA Sequence Number=SeqID_112995
MGNGSKMKEWGSPIKMKENTCKGSEKKEGEHEDGGKGFLSTSTKENTGYPWIPMNISYNIKKLKEYHFQIVRHFLKMDPTKWNLEVKFGMLEQWLFNKASANITTMETSSFITYHH

SEQ ID NO: 229774 - protein, 130 aa, Glycine max
  Coding DNA Sequence Number=SeqID_112996
  Gene Ontology: Mol. function=transcription regulator activity; Cellular component=nucleus; Biological process=regulation of transcription
  Homolog annotation: Hit_ID=Q8S3D1; Match level="QueryCoverage=85%, HitCoverage=28%, E-value=2e-40, Identity=70%"; Hit description =Putative bHLH transcription factor
MSGNNVVVWHISLLQTDTASVLLEAIGYIRFLQSQIEALSLPYLSGGSGNTRQQHSVQGEKTCIFPEDPGQLLDENCLKRKAAGEPDTQEEPKKGLRSRGLCLVPVSCTLQVGSDNGADYWAPALGGGFR

SEQ ID NO: 229775 - protein, 107 aa, Glycine max
  Coding DNA Sequence Number=SeqID_112997
MVEEVKEKKEEKAQKVRAQVDHVVDSLLKVQLLNEDAIGESSTKTNDKGSMKVVNSKGVKKGMREIIKEGLDLKEVKERALSNHKEPIKKAKKGRKTKAEDTIVQRK

SEQ ID NO: 229776 - protein, 312 aa, Glycine max
  Coding DNA Sequence Number=SeqID_112998
MLSHGGCEYLENKLIDEKRKKKLEEAAQSGNTDTVIDPPSPIRRHVKWKMTRTKKIGQMMSKASKEIAEKNDVLTVAIGRPEHPGLVRAARAGVTIKQYFRPTPRTSHTSSFIAPEELEQLTQKIRDQLEESITEKMQSQGLALPPEPEVGPSSARVSTKESYVDPSGNDPETGDSEKYGLLYEGSTIVHKIHLLHDQVKVGVEEVRDADFPIPVPTEEVKLVGQALNTFLAWPTHLIKRLSEHGAVGPVKPADRPDHDVDDPLYLMTLIIPQLFLKSLQAMTETNMRVGNSNVYGFLEPQSIQRYGQSQFE

SEQ ID NO: 229777 - protein, 140 aa, Glycine max
  Coding DNA Sequence Number=SeqID_112999
  Homolog annotation: Hit_ID=Q9FJK6; Match level="QueryCoverage=32%, HitCoverage=17%, E-value=3e-13, Identity=71%"; Hit description =Cyclin C-like protein
MAANFWTSSHYKHLLDQEDVDMVNPLDKEKGITLEDFKLIKMHMANCKIFVMSSFNLYHTCIYAPYATALFSNLALFWLLLVTIICMLVDVVSGSEFVVATDILRYFEIGSTSKSEAESAMHEGKRKELPHFLRPKAPGG

SEQ ID NO: 229778 - protein, 70 aa, Glycine max
  Coding DNA Sequence Number=SeqID_113000
MEKRILRRIRLARRIHQWRRTYLWMRGPSDGAGADGGRLYIGFFLWILLEGRVHLTILILSTVDLSLGIG

SEQ ID NO: 229779 - protein, 217 aa, Glycine max
  Coding DNA Sequence Number=SeqID_113001
MANPSPKISSNLELPKTPKNSDLPKIPTISGGLALFWKDPFNCHLLNFSSNFINVQVHHIGHPSWRRAGDFNDLLSNDEKIGLLDHPNWLLKGFKETLLDCNLHDLPMEGYQFTWAKRKGTPSDEDMTKSKGKDPLKGLGGPMTRARARKAKEALQQVLSILFEYKPKFQGEKSKEKWARLVKCRIYELAKPRHVLGEPSAKRTILQLSAQKNLEEG

SEQ ID NO: 229780 - protein, 80 aa, Glycine max
  Coding DNA Sequence Number=SeqID_113002
MGLSLIEIATLIGKFKNMQGYPTNLHTLFSTFGHIAHVTITEPRAEPRGSQSSGGRMELGTKACSGREGGAEVDDIEEAG

SEQ ID NO: 229781 - protein, 147 aa, Glycine max
  Coding DNA Sequence Number=SeqID_113003
  Pfam annotation: Domain name=zf-CCHC; Domain location=117-134; Score =12.3; E_value=0.0092; Accession=PF00098.13; Description=Zinc knuckle
MEQQKLRFLLNFKARNVMLCALSEKGIHQGTLFQRCQTYVGHSGCNIQREQILRSSSKALKVDDSSNDEFEEELDEYELAFISRKIHKMWRKRVGPSGETSQEECPVKKKDRDKSSIVFYECKKPRHFKFECPNLEKSQDKKKYFKT

SEQ ID NO: 229782 - protein, 74 aa, Glycine max
  Coding DNA Sequence Number=SeqID_113004
  Subcellular localization annotation: CTP_CleavageSite=45; ConfidenceScore=5.13e-01
MAIPSCVNLDSFFSVQIRLKKGIMTLKACLAPFSRLARKRQPPCLASYIRAKRMLAWTNSLQAYPYALSHCCLT

SEQ ID NO: 229783 - protein, 220 aa, Glycine max
  Coding DNA Sequence Number=SeqID_113005
MAPCKRKATASLSQASYESFVSRDAWDRYADNILGRNILSERNDKEPKHVRVRGHLIKFDADSLNTFLKTPVVLEQGESLPSYSRFYRLRPDPQELAARLCILGRGFVLNIEGLPWKLLSKDLTTLAQTWSVLSYSNLALTSHTSDLNLDRASSNSPSSSRSLHSELRAFHVYAAEPAPGPAPDYAELARCGPAVTSYECGGVSAEGCLARSPAFSFGRG

SEQ ID NO: 229784 - protein, 302 aa, Glycine max
  Coding DNA Sequence Number=SeqID_113006
  Gene Ontology: Mol. function=metalloendopeptidase activity; Cellular component=chloroplast thylakoid membrane; Biological process =proteolysis
  Homolog annotation: Hit_ID=Q9FHN0; Match level="QueryCoverage=90%, HitCoverage=30%, E-value=2e-93, Identity=62%"; Hit description =Similarity to endopeptidase
  Pfam annotation: Domain name=Peptidase_M3; Domain location=1-300; Score=21.0; E_value=5.1e-11; Accession=PF01432.10; Description =Peptidase family M3
MKRKNFPVGFNVYLSFKKKLPVILSHDLAPLKCVEGTEIIVALVCNFSGSRNPSAVRLNHWEVETLFHEFGHALHSLLSRTNWTGHRTGGSRVNGSTEDYQHFSGTRTVLDFAEIPSNLFEYYAWDYRVLKKFARHHSTGEEIPQKLVESMQGARDMFAATDLQRQIFYALVDQTLFGEQPFPHGDISSVVAKLKREHTSCEHVEGTHWEARFSHLLNYGAGYYSYLYAKCFAATIWKKLCQEDPLSPTTGFALRTKFLQHGGAREPAALLNDLAGDGIYRYCDGGIMPDISCLCDEMKLFE

SEQ ID NO: 229785 - protein, 66 aa, Glycine max
  Coding DNA Sequence Number=SeqID_113007
MVMTTVTIIVVNGGDSNNNNVMVTIKKIHHHPIQNVSENLFSPKPAFKKDKTFLIGFLLSHGLAYC

SEQ ID NO: 229786 - protein, 142 aa, Glycine max
  Coding DNA Sequence Number=SeqID_113008
MVGIVILAKHSRCLPGIIERKLPSTLLLQSQWYQTIMKANLMDFFDLMMWYHRNRVVFSNESFNASLATSLACSLRWSTSCLTSVEEVACSPICVASTSYCNSGILGGVCARQSHHIAHPRYSAGKIKLKTSMTCCPCPDPA

SEQ ID NO: 229787 - protein, 138 aa, Glycine max
  Coding DNA Sequence Number=SeqID_113009
  Subcellular localization annotation: CTP_CleavageSite=70; ConfidenceScore=5.66e-01
SWGRPDPTLPGYSLNKKTPSLPASTQPYLRPSKRAYPAARTNEPSRRAPTPPNSLPAFSLPSRRRDTTPGSTHEWRRRAPTTSPDNARRRRPAKEEDEVTKKKKTRTSFKWLNHHPMLLLQVQRGKIRQTQAGNIVIH

SEQ ID NO: 229788 - protein, 113 aa, Glycine max
  Coding DNA Sequence Number=SeqID_113010
MANCCSNNLRTTRKNARYAEVFRYKGDEIKSIYGCIMCFQQIPKNILLEVLGPSKVFNEVIKKIINSTVAEYVEKECLIVSKDLRVEQSFEDLETTFEEGEKFSFDVVLELQK

SEQ ID NO: 229789 - protein, 179 aa, Glycine max
  Coding DNA Sequence Number=SeqID_113011
MASHKRKATTLVSQDDYDRSRFISQEAWDRYSDNVLAKNIMPERNGSIDVAIVKEFYTNLYVLEDKSPKQVRVQGHLIKFDANSLNTFLETPMVVEKGESLPSYSRFARLRPDPQELATQLCIPRRGFVLDAEVLLWKLLRKDLTTLAQTWSVLSYSNLAPTSHTSYLNLDRAKLVYGL

SEQ ID NO: 229790 - protein, 112 aa, Glycine max
  Coding DNA Sequence Number=SeqID_113012
MDGLSLCGSDFVKGFYKENGKSQITEAICLTSEPIPPEPFIFEDLVIAQEDVAAATPQVTPQPLPEPSISVLDMSFAQTEPSAPVLDLPFPQDSSAGTPTLDLNEHAMDQDH

SEQ ID NO: 229791 - protein, 307 aa, Glycine max
  Coding DNA Sequence Number=SeqID_113013
  Subcellular localization annotation: CTP_CleavageSite=19; ConfidenceScore=5.30e-01
MASVPGSRSAGKIVRTRRSAAARSRTPYDRPAPPPPPPEPPSPNWISRFVISPSRFIASGAGKIFSSVLDLDNSPSDSSSATSSHSSSANDSDAEEVGTFDDENDNPSEGDVALSKGLQPCVGNSKSKHMIEQLLMKESFSREECDRLIKIIRSRVVDPANDDDGDKRPTDIPNKIFGSGTLYRLNSVLTYYCFLTMESNYFLDTDSPELHSAAIMEAKKWLREKKSGLDTNSDIGYGSPSLNLVALPQDPKDEGSPVDVAKLYMRTRPPWASPSIDHTKPQTPSGIQLFKEETPYLFGNNSTPPSK

SEQ ID NO: 229792 - protein, 212 aa, Glycine max
  Coding DNA Sequence Number=SeqID_113014
  Gene Ontology: Mol. function=nucleic acid binding; Cellular component= intracellular
  Homolog annotation: Hit_ID=Q2Z1Y7; Match level="QueryCoverage=62%, HitCoverage=38%, E-value=4e-26, Identity=43%"; Hit description=Pm27 protein
  Pfam annotation: Domain name=DUF1644; Domain location=1-96; Score =108.1; E_value=2.6e-29; Accession=PF07800.3; Description=Protein of unknown function (DUF1644)
MANSESVVSDCQYKLSCPLCRGDVFGWIIVDKARVHLDEKKRCCEEEQCAFIGSYSELQKHAQLEHPHACPSKIDPVRQLDWKNFQQSSEIIDVLSTIHSEIPRGVVLGDYVIEYGDDDSADEFEDFPGDEGNWVNRHLSSDTSNSDEGSVASVEYGEYRLDEIDDDFVSTIGHLRGGSGFRRKQNERKRYTQHRNQCDLDAAGVTTRKGYI

SEQ ID NO: 229793 - protein, 171 aa, Glycine max
  Coding DNA Sequence Number=SeqID_113015
  Gene Ontology: Mol. function=ribonuclease H activity; Biological process=DNA integration
MNGVVEAANKKIKKIIQKMTVTYRDWHEMLLFALHDYRTYVCTSTGETMFSLVYRMEAVITFEVKIPSLRVLSEAELEEVEWAHACFDQLNLIEGKRLDAINHGKVCSNKFNKGNLVLKKVSHVQKDLRGKYEGPFMVKKAFSDGTLILTKMNCEKLPPLVNSDDVKRYYA

SEQ ID NO: 229794 - protein, 222 aa, Glycine max
  Coding DNA Sequence Number=SeqID_113016
  Gene Ontology: Mol. function=protein serine/threonine kinase activity; Cellular component=integral to membrane; Biological process=protein amino acid phosphorylation
  Homolog annotation: Hit_ID=Q1SB06; Match level="QueryCoverage=88%, HitCoverage=28%, E-value=1e-61, Identity=55%"; Hit description =Protein kinase
  Pfam annotation: Domain name=Pkinase; Domain location=8-216; Score= -71.6; E_value=0.00027; Accession=PF00069.15; Description=Protein kinase domain
  Pfam annotation: Domain name=Pkinase_Tyr; Domain location=7-177; Score=-113.5; E_value=1.7e-05; Accession=PF07714.7; Description =Protein tyrosine kinase
  Pfam module annotation: Pfam domain module=Pkinase::Pkinase_Tyr; Domain location=8-216::7-177
MADNPDLCVSDSCKKNFVTPLVASLSSAQGYKEFRSEAQLLVIVHHRNLVSLIGYCGEGESKALIYEYMANGNLHQHLSDLKPSNILLDQSMHAKIADFGLYRAFGSHIDSHISTLTAGPLGYVDPDFGIILFELITGQHAISRTPEKNIHILEWVIPIVERGDIHNIVDPKLKEAFNVNSAWKAVEIALSCILPTAAEKTRHKPNIARAKGMPIFINGSDT

SEQ ID NO: 229795 - protein, 105 aa, Glycine max
  Coding DNA Sequence Number=SeqID_113017
MAIHHQILKKDFIVFPLSGGMNVCVACTVDGVGVGEEIKIKSLEEGAANETIPCILLWNTWVSLPIQSRDLACGTDDVKLNRAWTCLLRSNGDWFEVLKNQRVHS

SEQ ID NO: 229796 - protein, 140 aa, Glycine max
  Coding DNA Sequence Number=SeqID_113018
MYGIVVLGIYRGSVGSIEDQACRYLDQFSPSHASSNVSSKRKEEGPSLRWSSDKSAITDESALAVNFEERDKDGGEEGGGDKGPVPLLAIVNPDQFHNSPEDCHDLQWCVVTDFVNGGNTERDGASRSSDRNQTKKMLTC

SEQ ID NO: 229797 - protein, 389 aa, Glycine max
  Coding DNA Sequence Number=SeqID_113019
  Gene Ontology: Mol. function=6-phosphofructokinase activity; Cellular component=6-phosphofructokinase complex; Biological process=glycolysis
  Homolog annotation: Hit_ID=Q1S171; Match level="QueryCoverage=97%, HitCoverage=89%, E-value=1e-164, Identity=67%"; Hit description =Phosphofructokinase
  Pfam annotation: Domain name=PFK; Domain location=46-269; Score= -49.1; E_value=6.6e-10; Accession=PF00365.10; Description =Phosphofructokinase
MSNSEHNIITGHAGYVLEDVPHLSDYIPHLTVVVHKNSPRETHFRRAGPRQKGGYRGFYSCNTIPLTPKVVNDIHKRGGTILGTSQGEGGNDTLKIVDSIQDRGINQVYILGGDGTQRGASVIFEEIRRRGLKVSVVGIPESVDNDIPVIDKSFGFDTAVEEAQRAINAAHVEAESTENGIGVVKLMGRHSGFISMYATLASRDVDCCLIPESPFYLEGPGGLFEFIRKRLAENGHMVIVISEGAGHELISESLSATNKQEASGNKLLQDVGLWLSQKIKDHFTKSQKMDITLKYIDPTYMIRAVPSIASDNVHCTLLAQSAVHGAMAGYTGFAVGTVNGKHAYIPFYRINEIEKKVVITDRMWARLLSSTNQPSFLNPKDITTHQTGN

SEQ ID NO: 229798 - protein, 164 aa, Glycine max
  Coding DNA Sequence Number=SeqID_113020
  Gene Ontology: Mol. function=nucleoside-triphosphatase activity; Cellular component=membrane; Biological process=proteolysis
  Homolog annotation: Hit_ID=Q0WVW9; Match level="QueryCoverage=94%, HitCoverage=26%, E-value=7e-48, Identity=59%"; Hit description=DNA repair protein-like
MDGSQTFLIEIQALCLSGSTGSRQVHGIQLKRADMIISVLIKQAGLPLQEHAVFFNFVSGLALAETAGDLAIAAAICSCCLEIPILNDIAFIGEIDLGGELRMVPRMEKRVYTVTKLGFRMCIVPKVAEKALGTEGFEKMEVVGCRNLKDIINTVFPNLMRRSQ

SEQ ID NO: 229799 - protein, 315 aa, Glycine max
  Coding DNA Sequence Number=SeqID_113021
  Homolog annotation: Hit_ID=Q1SAY7; Match level="QueryCoverage=99%, HitCoverage=58%, E-value=3e-79, Identity=51%"; Hit description=Actin- binding, actinin-type
MNLKQKVAKLQDHEYKASANDQEIQIRLKRLKDLECESEQLRKSNLRLQMDNSDLARRLDSTQILANAVLEDPESLDPEELVYLRWINACLRHELRSYQPPPGKTVARDLSKSLSPTSEKKAKQLIPEYASNEGRGSVSDMDSDQWSSSQASFLTDPGEREDYSPLDNASEVKANNTRKSRIFSKLMRLIRGKDSNSNSSHFSLSISTGNDAGTEGPRSEYATPSATSRTSFDFNRTMSLKEESGRNSDSHTPGSSKNFSARRRRSVDFKNCLDSFSESSGTEKSNLVKYAEAIKDSSGTLKHRTHRRSASYSSF

SEQ ID NO: 229800 - protein, 101 aa, Glycine max
  Coding DNA Sequence Number=SeqID_113022
MVRKTSSPYKLNSNDLRIGQGKSMSLAFCSGTCWYVVDDDDEEVEEDTDSNLANVFNARNNRILVVGGFVSVEVNVVLRERNGSGVQGRMAMYNVGVVGFC

SEQ ID NO: 229801 - protein, 431 aa, Glycine max
  Coding DNA Sequence Number=SeqID_113023
  Gene Ontology: Mol. function=metalloendopeptidase activity; Cellular component=mitochondrial respiratory chain; Biological process =proteolysis
  Homolog annotation: Hit_ID=Q41440; Match level="QueryCoverage=99%, HitCoverage=75%, E-value=1e-104, Identity=67%"; Hit description =Mitochondrial processing peptidase
  Pfam annotation: Domain name=Peptidase_M16; Domain location=1-109; Score=64.8; E_value=2.8e-16; Accession=PF00675.10; Description =Insulinase (Peptidase family M16)
  Pfam annotation: Domain name=Peptidase_M16_C; Domain location=114 -296; Score=142.4; E_value=1.2e-39; Accession=PF05193.11; Description= Peptidase M16 inactive domain
  Pfam module annotation: Pfam domain module=Peptidase_M16::Peptidase _M16_C; Domain location=1-109::114-296
MAFKSTTNRSHFRIVREVEAIGGNIGASASREQMGYTFDALKTYAPQMVELLVDCVRNPAFLDWEVNEELRKVKAELGELSNNPQGLLLEAIHSAGYSGALAFPLLAPEAALNRLDGPNLEEFVVENYTAPRMVLAASGVEHEELLSIAEPLLSDLPKVPRPEEPKSIYVGGDFRRHGEGGTHVAIAFEVPGGWQKEKDAIALTVLQMLMGGGGSFSAGGPGKGMHSRLYLNVLNEYQQIQSFSAFNSIFNNTGLFGIYASTSPDFVPKTVDIAAKELIAIASPGQAFLSMTVTQELMLLDSVLSEKLTFTSSQRDVWGLKPTACETPLDQPLGFTVPFIHILIVLGGVCCQHFSAELCLMIASEDIGRQILTYGERKPVEQFLKAVDEITLNDITKIAQKIISSPLTMASYGDVMNVPSYESVNSKFHAK

SEQ ID NO: 229802 - protein, 334 aa, Glycine max
  Coding DNA Sequence Number=SeqID_113024
  Gene Ontology: Cellular component=integral to membrane
  Homolog annotation: Hit_ID=Q1SM52; Match level="QueryCoverage=48%, HitCoverage=64%, E-value=2e-67, Identity=76%"; Hit description =Thioredoxin-related
MRAIRVSPMFLLPALAAAAYTTFVSFTRMSCKCGYQCWISDRRDKKILERLRAERQEKIDELKERTNYYTTQQLIQLYPCIYFIKCITERAALDGNCLRLRYDPDPAAKAAAASVLASKLGADSGLKVYLGDESSPSAPLGRSNDIEIVQSSGLRNRRQLQSRSTSPGTTTPNFADQQLVGPGGIDQTQTFELNKPVVVEHHLPQSSTTQDGGWIARIAALLVGEDPTQSYALICGNCYMHNGLARKEDFPVITYYCPHCHALNKPKQSDEHISGLTSPNTGGTPNTDDGVTDAVKNARASAAESVITSSSPGSASSSEIEEVSERASVDEKID

SEQ ID NO: 229803 - protein, 203 aa, Glycine max
  Coding DNA Sequence Number=SeqID_113025
  Gene Ontology: Mol. function=methyltransferase activity; Cellular component=cytoplasm; Biological process=regulation of transcription, DNA-dependent
  Homolog annotation: Hit_ID=Q1SM58; Match level="QueryCoverage=99%, HitCoverage=33%, E-value=7e-99, Identity=84%"; Hit description=SAM (And some other nucleotide) binding motif; Skb1 methyltransferase
  Pfam annotation: Domain name=PRMT5; Domain location=1-203; Score =75.1; E_value=1.5e-26; Accession=PF05185.6; Description=PRMT5 arginine-N-methyltransferase
MVVGAGRGPLVRASLQAAEETGRKLKVYAVEKNPNAVVTLHALVKLEGWEYTVTIVSSDMRHWNAPEKADILVSELLGSFGDNELSPECLDGAQRFLKQDGISIPSSYVKAHKDLVHFETAYVVKMHNVARLAPTQPVFTFTHPKHPDKESNQRHKKLNFVIPNDTGSAMVHGFAGYFDATLYKDVHLGIEPSTATPNMFSWY

SEQ ID NO: 229804 - protein, 1122 aa, Glycine max
  Coding DNA Sequence Number=SeqID_113026
  Gene Ontology: Mol. function=ubiquitin thiolesterase activity; Cellular component=nucleus; Biological process=ubiquitin-dependent protein catabolic process
  Homolog annotation: Hit_ID=Q1SM56; Match level="QueryCoverage=95%, HitCoverage=94%, E-value=0.0, Identity=78%"; Hit description =Peptidase C19, ubiquitin carboxyl-terminal hydrolase 2; Ubiquitin carboxyl-terminal ...
  Homolog annotation: Hit description=hydrolase, N-terminal region 1
  Pfam annotation: Domain name=UCH; Domain location=51-436; Score =185.2; E_value=1.6e-52; Accession=PF00443.19; Description=Ubiquitin carboxyl-terminal hydrolase
  Pfam annotation: Domain name=ubiquitin; Domain location=963-1034; Score=13.1; E_value=0.012; Accession=PF00240.13; Description =Ubiquitin family
  Pfam module annotation: Pfam domain module=UCH::ubiquitin; Domain location=51-436::963-1034
CRVNNKDNPNCLCALVPPPNGARKSGLWQKMSDIVESLGHDPTKDLRASADSPAGLTNLGATCYANSILQCLYMNKSFREGMFSVERDVLHQQPVLDQLARLFVQLHISKMAFIDSSPFVKTLELDNGVQQDSHEFLTLLLSLLERCLSHSKVPKARTIVQDLFRGSVSHVTTCSKCGRDSEASSKMEDFYELELNVKGLKSLDGSLDEYLTVEELNGDNQYFCESCKTRVDATRSIKLCTLPKVLNFQLKRYVFLPKDKAVYSNPFPYLLTARSQGAFGIGGGVTVGNIPNPVALQKGETTTKKKITSAFSFPAELDMRHRMSELSQFNLVYDLSAVLIHKGTGANSGHYIAHIKDVNTGQWWEFDDEHVTNLGFHPFGEESSSSTTKSIKTDAIHFDNSEAMVADSNGNGLSATHSQSSKVETFLSSDAYMLMYHLKHTKSVGKSGGVICGVNHKEREGVVVAVQNGVPLPSHIYDEIQSFNTSYDDACQQYNNRKELQLSRISERRQEVRSVLAEAPVQSLEQPFYWISSEWLRQWADNIIPIPLDNTSVQCSHGKVPVSNVTSMKRLSAKAWDMLFSKYGGGPALSHDNHCRDCLIHGAMTVVSADTYRDRRESMKSLARDILDGNCLDGKYYISRPWLQQWWKRKVLDAPSEADAGPTAAISCPHGQLMPEQAPGAKRVLIPESFWLFLYEDAVSVTPDDPLGGPTFSSDSEECSQCSNELSEVACLEDSLRLVKQKQRQNHEKLFQAKSMPLSMHSKYFLVPSSWISKWRNYISPTLKNSDKPETLDGVIDSMLCEKHSQLIERPPELVFRRGAIIQRESSEGCLTIVSENDWKCFCEEWGSIETKGISATIDHVNDSENVLTGSSEEMLVCKDQLSTADKMNFENGTGQILIKTCPEVCESCIGERKSCELMQKLNYCNEDICVILVRGKEVPRSILEASKGFVETDRRVSKRSRKTKNGSSISLKVSASTSLYQLKMMIWESFGVVKENQILHKGDRIIDSDNEFATLADVNIFAGDQVIVRDSEIHENRDIADELCDDKMDLQHTEEGFRGTLLTANVSSQKNQLDEVVRYNTTTGIELLKVSKSNVYDFMNYRSLHRTIDSSLYWILTPAST

SEQ ID NO: 229805 - protein, 231 aa, Glycine max
  Coding DNA Sequence Number=SeqID_113027
  Gene Ontology: Mol. function=signal transducer activity; Cellular component=membrane; Biological process=signal transduction
  Homolog annotation: Hit_ID=Q8KL21; Match level="QueryCoverage=50%, HitCoverage=17%, E-value=9e-17, Identity=41%"; Hit description =Methyl-accepting chemotaxis protein
RPLRAGADLARDARAPVAALRQPVEGLPRRVLEAAGGGHGAGEAAGSGRTAAGPVASAPPAPRAAEVRVQARAGTMHFLAEIEKTLSIPVEIGDPERPHDRTGSIMRISLKAALAGSFSLLAVVAAVQGGLSVVKLSTIDRNVREIADNWLPSVGLLGDISTATRDERVKTYRFVAASPTDQLLAENEKSVRTSQAALDALRRAYEPLIASPEERALYQRFSETWGGLYGA

SEQ ID NO: 229806 - protein, 306 aa, Glycine max
  Coding DNA Sequence Number=SeqID_113028
  Gene Ontology: Mol. function=transferase activity, transferring phosphorus-containing groups; Cellular component=membrane; Biological process=two-component signal transduction system (phosphorelay)
  Homolog annotation: Hit_ID=UPI0000383784; Match level="QueryCoverage =24%, HitCoverage=21%, E-value=5e-27, Identity=81%"; Hit description =COG2202: FOG: PAS/PAC domain
MASSFCDCAQRLLRLVQGDRALLLGGDSASVGVDDVALGGGVPRDPARRPVLVPVAVLEGGEVVVRGGVGQRRARHDVVFGPDEFLEAAAHHLRWVVAQDRPPGRVDRAEDAVDADHDEQVARVAPDPVALGRALGDAPLQRLLAGVLLGDVLRDAAQMPEAALRVADREAGVADVAHGPVLGPHDAVLDRVCLAGKQARHGREGARTVVRVHQRGPASEVAHHQLAPVAPDPLVGRAQPLQPAARLERKHSSPSINPAAARTRAVVSCATLRMPVFAPVRTQDRVEAVCEEDLVGRAVSVEHHPL

SEQ ID NO: 229807 - protein, 338 aa, Glycine max
  Coding DNA Sequence Number=SeqID_113029
  Gene Ontology: Mol. function=ATPase activity, coupled to transmembrane movement of substances; Cellular component=integral to membrane; Biological process=transport
  Homolog annotation: Hit_ID=Q1QKC7; Match level="QueryCoverage=63%, HitCoverage=35%, E-value=1e-32, Identity=38%"; Hit description=ABC transporter related
DNDADGEGLADSPCREGRGADGAQPRGAAVLERRLVRARWVIEDLQKRRRPPEWGPSGRYGSEGGTAGYGESYARAAGSAVVVVADALDLSSSLLRPFRPDRLRSSLAGRVGPLRHLSTLLRFAWSTSPALTLFSLGLRIVQEDVPAWMLYVAKLFVDAVVAGRSDPASGLAVMDWLADPCLRYIGLLVGLEFILALASDLIGRAANPVDCILGERTGNATSLRLMAQPAALDLTRFEEPAVRDGLERARRHIAWHANPLGQLLVQAQDRLAAISLAAGVAVFQQWLVVLLVLALIPTFLNELRFNHKAYRRSPNQRASDYSTILSHRFAALAGRVMR

SEQ ID NO: 229808 - protein, 183 aa, Glycine max
  Coding DNA Sequence Number=SeqID_113030
  Gene Ontology: Mol. function=urea carboxylase activity; Cellular component=cytoplasm; Biological process=metabolic process
  Homolog annotation: Hit_ID=Q1M8E9; Match level="QueryCoverage=98%, HitCoverage=15%, E-value=4e-83, Identity=83%"; Hit description =Putative urea amidolyase
  Pfam annotation: Domain name=CPSase_L_D2; Domain location=50-182; Score=46.3; E_value=1.5e-14; Accession=PF02786.7; Description =Carbamoyl-phosphate synthase L chain, ATP binding domain
IAACRATGAQAVHPGYGFLSENVGFAERLAAEGIRFIGPRPEHLRAFGLKHTARELAKVSGVPLLPGTDLLPDVETALRAAEAIGYPVMLKSTAGGGGIGMQLCHSAEELAEGFAAVERTARASFGDARVYLERFVAQARHVEVHIFGDGRGRVVALGERDCSLQRRNQKVIEETPVPGLSES

SEQ ID NO: 229809 - protein, 449 aa, Glycine max
  Coding DNA Sequence Number=SeqID_113031
  Gene Ontology: Mol. function=DNA binding; Cellular component =chromatin; Biological process=DNA integration
  Homolog annotation: Hit_ID=Q1SDN3; Match level="QueryCoverage=89%, HitCoverage=41%, E-value=1e-91, Identity=40%"; Hit description =Polynucleotidyl transferase, Ribonuclease H fold
MASKFETQTHLQAFVSYVKRQFNTKVKAIRSDNGAEFIMKQFYHSTVFGCLCYTNTLTNNRKKLDPRAFASVFLGFKPHTKGYITFDLSSIVIMVSRHVIFHEDCFPYAYPNTSSDPSNSPIIVAPRRSNKERTRPKKFQDFHTTFTSTVADQSSDKWIKAMNAEIEALEANHTWILTDLPPNKSVIGCKWVYKVKHKAYDGLVERYKARLVAKGYTQIEGQDYLDTFSPVGKITTMRLLRAIAAVNNWHLKQLDVNNVFLPGDLNEEVYMTLPSDDIVLLGNDLLEIKSITQLLDEVFNIKDLGDLNFFLGFEVARSKQGINICQRKDVLDILHDACMLRSKPVSTPIDYVVRQHQQSSSPLDDTKASSYCRLIGRLIYLTNTRLDVTYAVQHLSQFVAHPSSTHQQAAYRILRYLKAALGSGVFFFASSIFQLKAFSDSDWAGCIYT

SEQ ID NO: 229810 - protein, 253 aa, Glycine max
  Coding DNA Sequence Number=SeqID_113032
  Gene Ontology: Mol. function=DNA binding; Biological process=DNA integration
  Homolog annotation: Hit_ID=Q1SS72; Match level="QueryCoverage=62%, HitCoverage=10%, E-value=3e-39, Identity=44%"; Hit description =Integrase, catalytic region
  Pfam annotation: Domain name=zf-CCHC; Domain location=205-222; Score =8.6; E_value=0.037; Accession=PF00098.13; Description=Zinc knuckle
MSEKQDESLSVHSPYYLHPSENPAIALVSPLLDPTNYNSWSRSSFTTLSAKNKVEFADGCLPRSTSNHRLYAAWKKANNMVVSWLVHLVATSIHQSILWMDNAIDIWKDLKARYSQGDLLRISNLQHKLASIKQGDMNITDYFTKLGTIWDELESYQPNPMCRDNHTVETCYKKNGFPPNFFSNRGGGGRGFGRGGTRGKNTNGKVCTHCGIINHTVDECYKKHGYPPGHKFYKPQGASVNNTIKEEENVSSS

SEQ ID NO: 229811 - protein, 402 aa, Glycine max
  Coding DNA Sequence Number=SeqID_113033
  Gene Ontology: Mol. function=RNA-directed DNA polymerase activity; Cellular component=chromatin; Biological process=RNA-dependent DNA replication
  Subcellular localization annotation: CTP_CleavageSite=42; ConfidenceScore=5.45e-01
MSSGGEAHRLSPCRSGSRTSFSFQDNRYNPTPISLPPPPLLSSSTKPSSSVPLKHLTSEELASRPERDLCFNCEERYHRGHHCSSRVFLLIADEDDRCAEDYIPLGFEPEPPDPVDLNAAQLNLHSLTGLIAAQKVLILVDGGSTHNFIQDTLVSRLGLSPCDTTPLKVMVGNGQYLHCQQLCPTVPGCTIEFKGKDTSTLQPLSPTQALPSSRPTDHHIHLAPNSDPINVRPYCYPYYPKVEIESQVDSMLQRGIIRPSTSPFSSLVLLVRKHDGTWRFCVHYRALNALTIKDHFPIPIIDELLDELVGASWFSKLDLLQGYHQILMSEDDICKTTFLTHHGHFEFRVMSFGLCSAPSSFQATMNTIFRPFLRQFIIVFFDDILIYSSTLEDHIIHLEKTF

SEQ ID NO: 229812 - protein, 47 aa, Glycine max
  Coding DNA Sequence Number=SeqID_113034
MVQSHQSEARQASYGEAGQKGKMVGWWWTRTYTLMSHPIRALCSHVL

SEQ ID NO: 229813 - protein, 171 aa, Glycine max
  Coding DNA Sequence Number=SeqID_113035
  Gene Ontology: Mol. function=chromatin binding; Cellular component =chromatin; Biological process=chromatin assembly or disassembly
  Homolog annotation: Hit_ID=Q1SAV4; Match level="QueryCoverage=78%, HitCoverage=92%, E-value=3e-10, Identity=41%"; Hit description =Integrase, catalytic region
  Pfam annotation: Domain name=Chromo; Domain location=87-133; Score =13.8; E_value=0.023; Accession=PF00385.14; Description='chromo' (CHRromatin Organisation MOdifier
MSIMLGTSSLSAMGGLVSRLHNWITRISWLYHHSCGHRPLFKRDSSGPHWQTSVSGQPIGYSKLAKRFYGSFRVIKKIGLSAYKLQLLVEAFILNTHQTADSKLEVLVQWQGLSSDDTSWKDWTQLQTDYHLEDKVLLEGIGNDSNTEKPEATKARPQRMSRAPTYLKDFL

SEQ ID NO: 229814 - protein, 143 aa, Glycine max
  Coding DNA Sequence Number=SeqID_113036
MEILTVAHHNLERGGVARRKAQTRDQGVLDKVVDQPGRAVRVQSPRGYNLQHNDHPRREASSSDVKCLRGTEEEGFVEEDNSGGGGKEMGGLYIVMNVGTQTRDTATEKEGIEENRPGGELTVAGHPLELGQSTTIHIKRGDG

SEQ ID NO: 229815 - protein, 77 aa, Glycine max
  Coding DNA Sequence Number=SeqID_113037
MVMKPLCPNYWWLILLEGRRRRIRKAKVARRAKDDPKDICNYYKEPSHWKKDFVLVVVQKDSSSENDLVLAVGEQPQ

SEQ ID NO: 229816 - protein, 63 aa, Glycine max
  Coding DNA Sequence Number=SeqID_113038
MEKSSGNVLMGNSTSCKSIADVHHVPELKKNLVSVGVMDSKGFSSWVDGGVMQIRGKEKYVVM

SEQ ID NO: 229817 - protein, 48 aa, Glycine max
  Coding DNA Sequence Number=SeqID_113039
MDGKVDDEDIQEVLSDDPKQLAIVKAFPIYEKTDCFNTSCKMILGYCE

SEQ ID NO: 229818 - protein, 33 aa, Glycine max
  Coding DNA Sequence Number=SeqID_113040
MVKINYHTYMVLSPVQYSVTFSVMHSNRIACIN

SEQ ID NO: 229819 - protein, 112 aa, Glycine max
  Coding DNA Sequence Number=SeqID_113041
MAWNSVLQNSMNFIKRKALQDNILVSFWAKAINTTCYLVNYSPSTAIDFRTTIEKIQTNAKDVTKHVEFKSLIIINFSDLKHLMRLIKIFKCNLNLIIQHQLRSLSGPIRII

SEQ ID NO: 229820 - protein, 132 aa, Glycine max
  Coding DNA Sequence Number=SeqID_113042
  Homolog annotation: Hit_ID=Q1RZK3; Match level="QueryCoverage=83%, HitCoverage=8%, E-value=3e-42, Identity=71%"; Hit description=WD40 -like
MFFGVFHRIWNHEEATLLNTFGNHDFPDRGISKLCLVNELDDSLLLDASFDGNIQIWKDYLLKGKQKLVIAFSSIHAHKPGVRSLSAVVDWQQQCDYPYASGEISSIMLWDVDKEQLVNSKSSSSDCSVSVL

SEQ ID NO: 229821 - protein, 363 aa, Glycine max
  Coding DNA Sequence Number=SeqID_113043
  Gene Ontology: Mol. function=methyltransferase activity; Cellular component=cytoplasm; Biological process=regulation of transcription, DNA-dependent
  Homolog annotation: Hit_ID=Q1SM58; Match level="QueryCoverage=92%, HitCoverage=46%, E-value=1e-125, Identity=67%"; Hit description=SAM (And some other nucleotide) binding motif; Skb1 methyltransferase
  Pfam annotation: Domain name=PRMT5; Domain location=180-363; Score= -222.9; E_value=9.9e-09; Accession=PF05185.6; Description=PRMT5 arginine-N-methyltransferase
MDPSYRPSLVQNDALGSGLLPFAGSDLVLSPSQWSSHVVGKISSWIDLDSEDETLRVDSETTLRQEIAWASHLSLQVCFGCMDMVMVPALYQYEYGCQNTAFDEFSCLRCTGLESQIVLAGMQTIKGIKACLLPAPKGTSCANYARCVNQILQGSNNMQLWLRLPLVKPDDDSMDAKSVALVDYWETWNSFRLLCEHHSQLSVALDILSTLPSPNSLGRWFGEPLRAAILHTDCFLTNSHGSPCLSKRHQSLITGVFNHSIQIIISGNSVHTKASMDANDNSGTNSQRHPLRPYLDYVGYLYQRMDPLPEQERFEPLMDNLEAQTYETFERDAMKYIQLIVGRVPMACDSSTIELPRVLIEVD

SEQ ID NO: 229822 - protein, 766 aa, Glycine max
  Coding DNA Sequence Number=SeqID_113044
  Homolog annotation: Hit_ID=Q5ZD36; Match level="QueryCoverage=87%, HitCoverage=26%, E-value=0.0, Identity=54%"; Hit description=Zinc finger-like
MGRHQTGAKKLWSYSIADLRARRHPHACCAPTSCTNSAKTFIINQQKLLIRSDHNNHKEIVQNCKLDRQDTPFPNHWSVDDVVSLVQDLDFSSLCSQLGLLATILLCIDVAATSAKSAKMSLQLLKQAENMLSDIYPGGSPKVGSTYWDQILEVGVISVSGRLLKRLQKFLEQENPPTLQEILSGEIVITSSKESHRQEQRERALALLHLMIEDAHMGKRQFLSGKLHNLARAVADEETEPSTTRGEGLYADQGVISNSDKDIVLGLGLRVVKQIPLSSTGGESTLQSTGYDIKDSGKRIFAPLSGKPMTYLSQFILHVAAIGDIVDGTDTTHDFNFFSIVYEWPKDLLTRLVFERGSTDAAGKVAEIMYADFVHEVISACVPPVYPPRSGHGWACIPVVPTFPKSSSDNKVLSPSSKDAKPNCYCRSSATPGVALYPLQLDVVKHLAKISPVRAVLACVFGSSILYNSSSSSISSSLSDGLLQAPDADRLFYEFALDQSERFPTLNRWIQMQTNLHRVSEFAVTANQTVDDGNVEARTSVKRVREHDTETESDADDIVSSSTIPVALTDLNSHGIEATDFWLDSSKSETAQIDTTVFLSFDWDNEQPYEKAVERLIDEGKLMDALALSDRFLRNGASDQLLQLVIERTEEIHSNSAQRQGFGGRNIWSNSWQYCLRLKDKQLAARLALRYVHSWELDAALDVLTMCSCHLPENDSTRKEVLQMKQALQRYSHILSADDHYASWQELKLELPVEADCKEDPEGLAL

SEQ ID NO: 229823 - protein, 191 aa, Glycine max
  Coding DNA Sequence Number=SeqID_113045
MVIVVINSSGDDKDVSGGRGDSGGDIGGANGGDIGVGGGGGGGISDDSGGDIGGGISGGGSSVGGVSGDGGGNEGGGVAVAAMLVVVVVAVIEMVLLVVLVVMKVVCWVVVVAMLMMMVMSMATMVAVTVVLVVTPSGGGDKGRRGGVYRNAGDYGSGGNNEGSIAGGSVDSGNGGDNDSGGNNTKCHCQM

SEQ ID NO: 229824 - protein, 711 aa, Glycine max
  Coding DNA Sequence Number=SeqID_113046
  Homolog annotation: Hit_ID=Q5ZD36; Match level="QueryCoverage=99%, HitCoverage=28%, E-value=1e-133, Identity=39%"; Hit description=Zinc finger-like
MGRETEILSRLVANHLHLAQFEPLRGVLLALRARNRDLARDILQTIVARSGRVPNVAWSSSCPSPALLTFLSTLELLQMDNASSAWNFDEETLRLRAEFLLLVQDLIDLVSECDGEWGNCRSVLDRVLELGVKRLRVDADGENEIDGIGSGNGNAATVVEEAEFTSLRKLILEHARVFDALCVNVHRQIRHWESEDSGEGSEELEEEDVKVLRGIQRTVQVVHLDAMRESLESGDAEGAVSHIRFLHFDYGIEEQSEYRIHDELLSEEIEMDRVQTENFIPHPLVRLQRYLEEVKSGKNSDDKALFLNEVIRYCKTDMYHYARVSGLHVLECIMDTALSAVKREQLDVAGNVLQLFPLLQPLVATMGWDFLAGKIAARRKLMQLLWTSKSQVIRLEESSPYGNKTDEMTCVEHLCDTLCYQLDLASFVACVNSGQPWNSKFSLMLSGKEQLEFRDEDTYSDPFVENFVLERLSVQSPLRVLFDVVPGIKFQEAIDLISMQPIASTVEARKRKQDIELMHMRYALESTVLALGAMERSVSGEVETHQDLPLFHLKDLQNHLDAISNLPRKILMVNVIISMLHMDNISVNLMHCGLPGSNFKLSNAWSSEDSCSTGSERGNKMVISFTGLLLDILRHNIPSSMIELENTLDDGVSTTSRQALEWRISISKRFIEEWEWRLSILQHLLPLSERQWRWKEALTVLRAAPSKLLNL

SEQ ID NO: 229825 - protein, 419 aa, Glycine max
  Coding DNA Sequence Number=SeqID_113047
  Gene Ontology: Mol. function=aminoacyl-tRNA ligase activity
  Homolog annotation: Hit_ID=Q2PF39; Match level="QueryCoverage=57%, HitCoverage=40%, E-value=2e-19, Identity=41%"; Hit description =Aminoacyl-tRNA synthetase
MQAVEEGGGEERNARFEESDLDSEISKLRGRWELASVLNFLDVFGPILGKDLKLSAEDIEIGLVKPDTSLSRLHIQLLKGIPPVSKTLEDSDKWVTAPCKNLTAWWLCVAEGEIPLVPSKGYDATSKGQSHRLYREIITSDSIPNDKDEGCLSLPTIQWETLASNLEDFSKVAEKFAFSKCAAEVAVSLKLQDDAIPALEKLRKKKERAIKQKQRQDMLLKKDFQNPHYSGNTRSCHARRPISYTFVRVGLVNVAEAYDRTMKEAIQLTKYVLHDIVPLKGQSFLLLNKINPEDLKINPTQDISTDSDSERVMSPIYDSDDTGYKVENHGSSEEDAAVDGELGNLETPSSHAVFYPKGFRCCKQLAGVPSHTILESQGKDPPAILLWNLSSYLIQRTKHVKGREICPSLLRPGINLYFG

SEQ ID NO: 229826 - protein, 118 aa, Glycine max
  Coding DNA Sequence Number=SeqID_113048
  Gene Ontology: Mol. function=voltage-gated potassium channel activity; Cellular component=membrane; Biological process=potassium ion transport
  Homolog annotation: Hit_ID=Q1SYJ7; Match level="QueryCoverage=66%, HitCoverage=12%, E-value=5e-24, Identity=67%"; Hit description =Cyclic nucleotide-binding; Cation channel, non-ligand gated
MAGEIGVMFNIPQPFTVRSRGLSQVKRINHRHFKHMVQPFSDDVKAINYNFIKYFKGLKGKVLEEISYITELMGDLHDELAYERVMAASLPQCRILSESPKYLQSPALDHVSEKGDGG

SEQ ID NO: 229827 - protein, 103 aa, Glycine max
  Coding DNA Sequence Number=SeqID_113049
  Gene Ontology: Mol. function=voltage-gated potassium channel activity; Cellular component=membrane; Biological process=potassium ion transport
  Homolog annotation: Hit_ID=Q1SYJ7; Match level="QueryCoverage=65%, HitCoverage=10%, E-value=1e-19, Identity=75%"; Hit description =Cyclic nucleotide-binding; Cation channel, non-ligand gated
MVALRMSMSLSSLVRRRSSDEITNSASVSSSLFPAFGTTIFDVEGYSKSNLRKYVIAPYDRRYQLWQTFLAALVVYSAWASPFELAFRELLVGSLLPVELLCG

SEQ ID NO: 229828 - protein, 992 aa, Glycine max
  Coding DNA Sequence Number=SeqID_113050
  Gene Ontology: Mol. function=zinc ion binding
  Homolog annotation: Hit_ID=Q5ZD36; Match level="QueryCoverage=92%, HitCoverage=38%, E-value=0.0, Identity=62%"; Hit description=Zinc finger-like
  Pfam annotation: Domain name=TPR_1; Domain location=475-508; Score =14.5; E_value=0.1; Accession=PF00515.18; Description=Tetratricopeptid e repeat
  Pfam annotation: Domain name=TPR_2; Domain location=475-508; Score =22.8; E_value=0.0012; Accession=PF07719.7; Description =Tetratricopeptide repeat
  Pfam module annotation: Pfam domain module=TPR_1::TPR_2; Domain location=475-508::475-508
GRSAGLSVDLRRELQGRQLVKLLTADPLNGGGPAEASRFLSSLRDTDDALPVAMGAMQLLPNLRSKQLLVHFFLKRREGNLSDVEISRLNSWALGLRVLAILPLPWQQRCSSLHEHPHLILEVLLMRKQLQSATLVTSKEATTKILKEFPSLRDNHVITTYATKAIAVSISSPPREHRISVSGSRPKQKTRSGAPQRSSFTSSLSNLQKEARRAFSWAPKNTVDKNAPKDVYRKRKSSGLSPSDRVAWEAMTGIQEDHISSFSTDGQERLPSVSIAEEWMLTGDPLKDESIRSSHRYESAPDITLFKALLGLCSDESVSAKIALDLCINQMKNVLSSQQLPENASMETIGRAYHATETFVQGLVYAKSLLRKLTGGSELPSNWDRNRDTDDASSDAGSSSVGSQSTDELSEILSQADVWLGRAELLQSLLGSGIAASLDDIADGQSSARLRDRLVADERYSMAVYTCKKCKIDVFPVWNAWGHALIRMERYGHARVKFKQALQLHKGDPGPVILEIINTIEGGPPVDVSAVRSMYEHLAKSAPTILDDSLSADSYLNILYMPSTFPRSERSRRSQVSANNNSVYSRDFEDGPRSNLDNVRYTECVTYLKEYARQQLLAFMFRHGHYHDACSLFFPPDEVPPPPQPSITSGVSSSSPQRLDSLATDYGTIDDLCELCIVYGAMPILEEVLSTRMSSTQSQDAVNQYTVTALARICLYCETHKHFNYLYRFQVIKNDHVAAGLCCIQLFVNSSSQEEAIRHLEHAKMHFDEGLSARHKGGESTKVVTKGLRGKSASEKLTEEGLVKFSARVSIQVEVVKSFNDSEGPQWKHSLFGNPNDPETFRRRCKIAEVLVEKNFDLAFQLIYEFNLPAVDIYAGVAASLAERKRGSQLTEFFRNIKGTIDDDDWDQFLTLEVFSNKTLKDTARHTGENRSKKEHGKQESTLDTVPLLLLKGFVFPKFFDDSLIFQLLPYIILLIVLPMILQFPLASLPYY

SEQ ID NO: 229829 - protein, 91 aa, Glycine max
  Coding DNA Sequence Number=SeqID_113051
MSVIIKKGENVDHSCFDDVEKKSLDCHHQKGENVNIASTNKALIQDLFKTKPCLKTKGFKVMQGSGNRLPGSVIDYQKGSSRIAVEKGFEF

SEQ ID NO: 229830 - protein, 185 aa, Glycine max
  Coding DNA Sequence Number=SeqID_113052
  Gene Ontology: Mol. function=pectinesterase activity; Cellular component=cell wall; Biological process=cell wall modification
  Homolog annotation: Hit_ID=Q8GUY1; Match level="QueryCoverage=59%, HitCoverage=59%, E-value=2e-25, Identity=43%"; Hit description =Methyl pectinesterase
  Pfam annotation: Domain name=Pectinesterase; Domain location=5-185; Score=-66.8; E_value=1.3e-16; Accession=PF01095.10; Description =Pectinesterase
MVLKIAILSSNGIIVITGLYIVLVGKAKELAENKPKAAPQSSNLQDDHDISSRIDLEQPLLSEKLSEHVTQADSKTCDIFVRKPMSHQSNFITTQGRDDPNNNTGISIQSYRVRPDSEFLTLKESFKTCLGWGEWSGKFAPSTLYYGEYLNTGYGAFTQNRVNWPGFHVLRSAFEATPFTVNQFL

SEQ ID NO: 229831 - protein, 116 aa, Glycine max
  Coding DNA Sequence Number=SeqID_113053
METISYNKSTSPQGSLGYLDPQYFQLYMLKDKSDVYRFGHFPPYELTNPATKRTQEHDFNILKGERFEQDEGLRQSHELEVLGYGEEETTSRGVMSDEEEREKGFGVLPAMVVTMA

SEQ ID NO: 229832 - protein, 553 aa, Glycine max
  Coding DNA Sequence Number=SeqID_113054
  Gene Ontology: Mol. function=thiamin-phosphate diphosphorylase activity; Cellular component=intracellular; Biological process =thiamin biosynthetic process
  Homolog annotation: Hit_ID=Q8ZAQ2; Match level="QueryCoverage=74%, HitCoverage=63%, E-value=0.0, Identity=93%"; Hit description =Thiamine biosynthesis protein thiC
MAFQLRQPLRRRRHVFGLGREDVPQRDVGRFHRQRACQLGVVMGGHAQPQPGAVNGRQIGSIEILLAQMHAVSAVLDRQPPVVVDEQPRLITLAQRDGGGDIRFDLLVRQVLDAQLDGGDAGLQQASDPFHAVDDRGAGAVIQLAAAGAELGGHFLHAGQLHFDRLGGFLGRGVVAHLLRNFHRAEFRPAHRAEVGDLAGLLRQGFVVIGAGGGRIERQIELIFPAEFETRLGHGVIADLRTRMAFGQIGGVSGDLVGDQALLDVLFVRQAEVFFRRDITQHGAAEPADHCRADAGGEMVIARGDIGGQRAEGVERRFVAVFQLFGHVAADHLHRHVARAFDHHLHVVFPSDFGQLAQRMQLGELGFVVGVLNRAGAQAVAERQRNVVGGADLTDFTEMLIEKVFLMVRQTPFGHDRAAARHDAGQAFGGHWHVAQQHAGVDGEVVDSLLRLFQQRIAEHLPGEVFRHAVDLLQRLVDRHGADGHRAVAQDPLAGFVNIAAGREIHHGVRAPAGGPHQLLHLFFDRRRDRRVADIGVHLHQEIAADDHRLRLR

SEQ ID NO: 229833 - protein, 48 aa, Glycine max
  Coding DNA Sequence Number=SeqID_113055
MAILIANTSTTFHRDERLGNTHAMENMWVYDPNMVGSWYLTHATKNAS

SEQ ID NO: 229834 - protein, 87 aa, Glycine max
  Coding DNA Sequence Number=SeqID_113056
MAFSGGALVLANMDDEELPSPVNSNVVKRYYAYDLGQLRKSLHGQDRFKQMVKYRAKSKTEMSRGTWGRARMDARPMINRSLSCVQL

SEQ ID NO: 229835 - protein, 182 aa, Glycine max
  Coding DNA Sequence Number=SeqID_113057
PGREAGGLAPHEEARTASAERGVAAALPALAEHDRAELLRDRNDGAVLAQQHAGETAGGRDVAPQRHDLLLGERPELHRHLALAVDEEQGETVFAAGIGRIVGEGQGHADGRTAAESRTEGRQRGGRVGEAGRARRVVAAGPTVLIRDLESHHRFDALSRVAVSVGRADLTSSVPVVSPKAP

SEQ ID NO: 229836 - protein, 197 aa, Glycine max
  Coding DNA Sequence Number=SeqID_113058
  Gene Ontology: Mol. function=transcription factor activity; Cellular component=chloroplast; Biological process=regulation of transcription, DNA-dependent
  Homolog annotation: Hit_ID=Q26M24; Match level="QueryCoverage=94%, HitCoverage=62%, E-value=4e-58, Identity=67%"; Hit description =Probable transcription regulator PA3711
  Pfam annotation: Domain name=HTH_1; Domain location=2-45; Score=42.8; E_value=1.2e-09; Accession=PF00126.17; Description=Bacterial regulatory helix-turn-helix protein, lysR family
MLEAGRRLGLNHATVARRLDALEAALGTPLFHRRPNGSALTEAGEQLVPVAERIEAEVLAVAARMRAQEAEPSGTVRIGAPDGLGTLFLARELGLFASRYANLVIELVPLPRSFSLSRREADLAIGLDRPAHGRLILSKLSDYSLGFYAVKAYLDRAGMFVERGGSRKPCRGDRRRRLRLRLGVGLYRLFCRIAWPG

SEQ ID NO: 229837 - protein, 134 aa, Glycine max
  Coding DNA Sequence Number=SeqID_113059
  Gene Ontology: Mol. function=transferase activity, transferring phosphorus-containing groups; Cellular component=membrane; Biological process=peptidyl-histidine phosphorylation
  Homolog annotation: Hit_ID=UPI00003834C6; Match level="QueryCoverage =94%, HitCoverage=27%, E-value=5e-49, Identity=77%"; Hit description =COG4191: Signal transduction histidine kinase regulating C4 -dicarboxylate transport system
  Pfam annotation: Domain name=HATPase_c; Domain location=5-114; Score =95.8; E_value=1.3e-25; Accession=PF02518.16; Description=Histidine kinase-, DNA gyrase B-, and HSP90-like ATPase
VDSRGSHIRLSYGVVNLVGNALDAVKGRPGAEVAVRAWAGEGRVVLSVEDNGPGLDRAALARLFEPFFTTKPAGEGLGLGLPISLAIAREFGASLQPRPMPGGGLAFDLVMDEAGKAAKETADTPRPERMRHVS

SEQ ID NO: 229838 - protein, 135 aa, Glycine max
  Coding DNA Sequence Number=SeqID_113060
  Gene Ontology: Mol. function=protein binding; Cellular component =protein complex
  Homolog annotation: Hit_ID=Q9FJM1; Match level="QueryCoverage=61%, HitCoverage=30%, E-value=1e-25, Identity=69%"; Hit description =Arabidopsis thaliana genomic DNA, chromosome 5, P1 clone:MTI20
MDTVASTPSQNVLLIRSPNSMDVNVLISRPFAMVDEIADASPAVEDGLQLGDQILKFGNVEAGDNLLQRLSSEAQSNLGCAVPVVIMRQGTVINLTITPRPWQGRGLLGKLNAKKLKMEECKGSIWRIARLGFLD

SEQ ID NO: 229839 - protein, 188 aa, Glycine max
  Coding DNA Sequence Number=SeqID_113061
  Gene Ontology: Mol. function=hydrolase activity; Biological process =RNA processing
  Homolog annotation: Hit_ID=Q89WK5; Match level="QueryCoverage=97%, HitCoverage=88%, E-value=1e-58, Identity=64%"; Hit description=HAM1 protein homolog
  Pfam annotation: Domain name=Ham1p_like; Domain location=1-183; Score= 152.6; E_value=1e-42; Accession=PF01725.7; Description=Ham1 family
MRELLAPFGVEAVSAGELGLPEPDETGTMFSENAAIKAHAAAKASGLPAFADDSGLCVDALDGAPGLFSARWAGPAKDFSGAMARIADELDRRGATNRRAHFVSALVLAWPDGHTELFEGRVFGDLVAPRGQLGFGYDPMFRPEGMDRTFGEISSEEKHGVDWQSGNALSHRARAFVELARACLRRSV

SEQ ID NO: 229840 - protein, 195 aa, Glycine max
  Coding DNA Sequence Number=SeqID_113062
  Gene Ontology: Mol. function=hydrolase activity, acting on acid anhydrides, catalyzing transmembrane movement of substances; Cellular component=integral to membrane; Biological process=copper ion transport
  Homolog annotation: Hit_ID=P58341; Match level="QueryCoverage=99%, HitCoverage=23%, E-value=4e-52, Identity=65%"; Hit description =Copper-transporting ATPase 1
  Subcellular localization annotation: CTP_CleavageSite=29; ConfidenceScore=5.70e-01
MARAPNPGIASNPTASASRTPRRCAAATMAAATGCSERASIEARSRSTVSSSKPGRTAMSVSSGVPLVSVPVLSSAITRASRSAWSASPRRNRMPNSAALPVPTMIEVGVARPIAQGQAMISTATALASAKARAGDGPKASQIPSVTAAAPSTAGTPPSRHPVDEGLDRQLQTLRRLDGAHDLRQQRVGPDLGGP

SEQ ID NO: 229841 - protein, 67 aa, Glycine max
  Coding DNA Sequence Number=SeqID_113063
MAADILESNKLFLYLKNRQEEQESKAAEGVKIGMAGMFGCSCCWQWAEAKSMGMGCWFYTHPCSEAF

SEQ ID NO: 229842 - protein, 275 aa, Glycine max
  Coding DNA Sequence Number=SeqID_113064
  Gene Ontology: Mol. function=ribonuclease P activity; Biological process=tRNA 5'-leader removal
  Homolog annotation: Hit_ID=Q2QZQ0; Match level="QueryCoverage=74%, HitCoverage=28%, E-value=4e-22, Identity=32%"; Hit description =Ribonucleases P/MRP protein subunit POP1 containing protein, expressed
MEKRVISINCFSLEGQLAKLELIGLGTFQLLQKVLHAVGRELLAIEETCARNSSILRNEDYFSSCAMLSLNVKDPRELPWKKTVVPVESISTKTPTDAQEKKYKELAELGGILEENRDLSSLSRGLRPPVEDSFLSKEIHHERMVNFCLDDIHSGEANSSTKVQCSRSCPILLLKNDMKELTIGWSVILPLSWVKAFWIPLISNGGLGDGGFRIWGAFLSSLMGVGGAFLSSLMGVGGLGLGVAGWGWGDGDWGLGYRDWGLGIRVWGLGFVGVY

SEQ ID NO: 229843 - protein, 222 aa, Glycine max
  Coding DNA Sequence Number=SeqID_113065
  Gene Ontology: Mol. function=ribonuclease P activity; Biological process=tRNA 5'-leader removal
  Pfam annotation: Domain name=POP1; Domain location=27-156; Score= -44.0; E_value=0.059; Accession=PF06978.2; Description=Ribonucleases PMRP protein subunit PO
MVTDGTKKPQVSVPTPPPPWKINLQKYAESCALKLHSLQSIIENRVNSDYRSQKNKRRTTVFDNQIARKGCRRKRQKLGIIDKALAKSGLEENHQKKLPRCVHRRYELKKNPENGFCYDQALGLPPSFVSTRKGALEKGSNKRCLYMMQAIILPSNWRVQRLSCIQDSLMSVLRMVLEPYPATTPHPGNHDDSVLYSVTYGRAMLHQCGAPVSQPIAPVTYM

SEQ ID NO: 229844 - protein, 130 aa, Glycine max
  Coding DNA Sequence Number=SeqID_113066
MEITKSLVSNNNNKKNKCTPSRLVGPDGVGLLVLPRKVELKDDSSLLVATYQPLPAAFTKQSSYYTKSNSFYITCSKLKYSNQNWRNNVGLGWKRMKERLRDRKMQRVQRPTKHEQVFGYWKLERAKCRE

SEQ ID NO: 229845 - protein, 186 aa, Glycine max
  Coding DNA Sequence Number=SeqID_113067
  Homolog annotation: Hit_ID=Q1T013; Match level="QueryCoverage=44%, HitCoverage=20%, E-value=4e-11, Identity=63%"; Hit description =Ionotropic glutamate receptor; Extracellular ligand-binding receptor
MIEAESPSFYQVAMRSKALNLVHVLDSAAAATTTAPEIQQKSLMDGFSQITGVQYKFILFGDGHKNPSYCDLVNMITSDVFDAAVVVWILEHRTNDEFRGSPREHIVTVLWFSLSTMLFAHKKTHLVHLVELCPSMSCIYILTSLTCISPPKVTDMLNWATFVVDPPLRRSTDTTLTLDVFNMQFP

SEQ ID NO: 229846 - protein, 268 aa, Glycine max
  Coding DNA Sequence Number=SeqID_113068
  Gene Ontology: Mol. function=glutamate-tRNA ligase activity; Cellular component=aminoacyl-tRNA synthetase multienzyme complex; Biological process=tRNA aminoacylation for protein translation
  Homolog annotation: Hit_ID=Q26R65; Match level="QueryCoverage=81%, HitCoverage=35%, E-value=2e-68, Identity=62%"; Hit description =Glutamyl-tRNA synthetase bacterial/mitochondrial
MAFIFFEAPRRARRRGVPRPRLPAGGPTQLPRAARLEPRRPGGLLHRGDDRRLRSEGDRPLGGAVRLHQAGEPQRALYPQQRRFGPGRCDRGDPAGPRTRARPADVADARPARKAPVGDARPEGARQDARRAPRQRLLPLRPAPAGPRREGRRPARRRGAGAATRPSPRLGSPARVECRIDGGGGARFRGKPGRQARPGRPASAGGPHRPCHLTAGLRRDGGARPRRGARPPAGSTGGLNHRPRGGSTHPGRAGTIRAGSRPVRDRST

SEQ ID NO: 229847 - protein, 149 aa, Glycine max
  Coding DNA Sequence Number=SeqID_113069
  Subcellular localization annotation: CTP_CleavageSite=66; ConfidenceScore=5.69e-01
MCPPPSSLEPSVVIALCNSPFITPFRSPVNCVFVHVSSTFEFGAMRSDCLVQFSILNLFRSPMNCVFVHVSSTFEFGAMRSDCLVKFSILNPFSEPYELRFSFMCPPTFEFGAMRSDCLSAILHSQPFSEPHELRFRSCVLHLRVWSHA

SEQ ID NO: 229848 - protein, 101 aa, Glycine max
  Coding DNA Sequence Number=SeqID_113070
MLIAILTRAENSHSEISPLSTILASREIALSVKCYAQCEMSWSTPKFELHLARFAYYKYVLHREKLDFLLFFSPNIHSNPNTFFSTTQGHQWQPQVVVACH

SEQ ID NO: 229849 - protein, 139 aa, Glycine max
  Coding DNA Sequence Number=SeqID_113071
MTLRQHGLNEEQGINENSPNKKIEEAKEHHLDEDALIPHDVSSVGACRPRIFFINGFLCFLEDKWQRNGERKRERRRHFKEKMSLEEAHHHRKPWIRAWRKKEMNEGRGREEHEILCSKRALKSEVNIQMIKVLKNAHT

SEQ ID NO: 229850 - protein, 424 aa, Glycine max
  Coding DNA Sequence Number=SeqID_113072
  Gene Ontology: Mol. function=oxidoreductase activity; Cellular component=mitochondrial outer membrane translocase complex; Biological process=aromatic compound metabolic process
  Homolog annotation: Hit_ID=Q1SA66; Match level="QueryCoverage=99%, HitCoverage=100%, E-value=0.0, Identity=86%"; Hit description =Pyridine nucleotide-disulphide oxidoreductase, class I; FAD -dependent pyridine ...
  Homolog annotation: Hit description=nucleotide-disulphide oxidoreductase
  Pfam annotation: Domain name=FMO-like; Domain location=26-424; Score=- 368.4; E_value=8.1e-07; Accession=PF00743.9; Description=Flavin -binding monooxygenase-like
  Pfam annotation: Domain name=Pyr_redox_2; Domain location=25-383; Score=-22.7; E_value=0.0069; Accession=PF07992.4; Description =Pyridine nucleotide-disulphide oxidor
  Pfam module annotation: Pfam domain module=FMO-like::Pyr_redox_2; Domain location=26-424::25-383
MENLLRLVDHEDFFSRRCIWVNGPIIIGAGPSGLATAACLREQGVPFMVLERADCIASLWQKRTYDRLKLHLPKQFCQLPKLPFPEDFPEYPTKKQFIEYLESYAKHFEINPQFNECVQSARYDETSGLWRVKTVSSSGAAARGEIEYICRWLVVATGENAECVMPDIEGLSEFKGDVIHACDYKSGESFRGKKVLVVGCGNSGMELSLDLCNHHASPSMVVRSSVHVLPREVFGISTFELAVMLLQWLPLWLVDKILLILAWFVLGNIEKLGLKRPSMGPLELKNTKGKTPVLDIGALEKIRSGDIEVVPGIKRFNNGEVEFVNGEKLDIDAIVLATGYRSNVPSWLQEGEFFSKNGYPKMPFPHSWKGNAGLYAVGFTKRGLSGASSDAVKIAQDIGQVWKNETKQKKQRTTACHRRCISQF

SEQ ID NO: 229851 - protein, 53 aa, Glycine max
  Coding DNA Sequence Number=SeqID_113073
MWGTHSPMQGDKIFKMQVQVLQQCYSDLTTVIGDDVMVVHVAKDKDRTTVKPV

SEQ ID NO: 229852 - protein, 70 aa, Glycine max
  Coding DNA Sequence Number=SeqID_113074
MQSSSRPPGCARNCPPPIGDQPGSPKEFPKVTSPLSTKYTLPQLLYFLCRISYEHGQKSRNSGGKIRGFD

SEQ ID NO: 229853 - protein, 217 aa, Glycine max
  Coding DNA Sequence Number=SeqID_113075
  Homolog annotation: Hit_ID=UPI00003831E4; Match level="QueryCoverage =22%, HitCoverage=77%, E-value=4e-18, Identity=95%"; Hit description =COG0766: UDP-N-acetylglucosamine enolpyruvyl transferase
  Subcellular localization annotation: CTP_CleavageSite=83; ConfidenceScore=5.05e-01
MSASRGTLMSSSVSPVRRLAIISGRAAFLAPEIGIVPLSGVPPVMWMRSIGILGAPPFRSRRSPCVPGAWAPLVQGGGIGGIRQKEEAWPFGSTPRAAHRSDDGGEEGRIGREEAAVQSASPVLGRGLGRAFLRRGLESGVRCEVGCGVRRVVGPAPGLRLAAAQVVAQGRLEPGGALVVLGSHRARSDNDPRHDPTDPACPVRRCGHWPSGEGPIP

SEQ ID NO: 229854 - protein, 211 aa, Glycine max
  Coding DNA Sequence Number=SeqID_113076
  Gene Ontology: Mol. function=UDP-N-acetylglucosamine 1-carboxyvinyltra nsferase activity; Biological process=UDP-N-acetylgalactosamine biosynthetic process
  Homolog annotation: Hit_ID=Q3SW27; Match level="QueryCoverage=99%, HitCoverage=48%, E-value=3e-83, Identity=75%"; Hit description=UDP-N- acetylglucosamine 1-carboxyvinyltransferase
  Pfam annotation: Domain name=EPSP_synthase; Domain location=3-210; Score=-94.3; E_value=2e-07; Accession=PF00275.10; Description=EPSP synthase (3-phosphoshikimate 1-carboxyvinyltransferase)
MVVGKRPGQTAETGQTVRLTASNVIDTTAPYELVSTMRASFWVIAPLLARFGEAKVSLPGGCAIGTRPVDLLIMALEKLGAEIEIDGGYVVAKTKNGLRGAEITFPTVTVGGTHVALMAAALAYGTTVIDNAAREPEVVDLAECLSKMGARIEGAGTSRIVVEGVARLGGARHEVLPDRIETGTYAMAVAMTGGDVSLVNTRTELLASVLR

SEQ ID NO: 229855 - protein, 307 aa, Glycine max
  Coding DNA Sequence Number=SeqID_113077
  Gene Ontology: Mol. function=glucose-fructose oxidoreductase activity; Cellular component=periplasmic space; Biological process =electron transport
  Homolog annotation: Hit_ID=Q07982; Match level="QueryCoverage=91%, HitCoverage=65%, E-value=2e-62, Identity=43%"; Hit description =Glucose--fructose oxidoreductase precursor
  Pfam annotation: Domain name=GFO_IDH_MocA; Domain location=1-112; Score=95.6; E_value=1.5e-25; Accession=PF01408.12; Description =Oxidoreductase family, NAD-binding Rossmann fold
  Pfam annotation: Domain name=GFO_IDH_MocA_C; Domain location=124-239; Score=42.7; E_value=1.3e-09; Accession=PF02894.8; Description =Oxidoreductase family, C-terminal alphabeta domain
  Pfam module annotation: Pfam domain module=GFO_IDH_MocA::GFO_IDH_MocA_ C; Domain location=1-112::124-239
GYVLPALARARRSRAVALVSGNPEKAKRVAARYGVGENALYGYDTMGRLAGNDAVGVVYIVTANATHAELTVKAFEAGKHVFCEKPMANSPAECQRMIDAAKAAGRKLMIAYRAHWEPHNLRAKAILDSGALGQVWFASSDHHRPLDPSLPRDQWRMKRDVAGGGSLVDIGIYSLNGLQWFLGESPNAVAATMQAPPGDPRFAEVENVFSAELAFPSGRRATISSGYTASKKRIDLWGDRLVATLDPATAYQGNRLVVSNAKKAEEILTEETSAAQFTGEIDHFSQAVTEGTEVRTPGEMGSAPTCA

SEQ ID NO: 229856 - protein, 270 aa, Glycine max
  Coding DNA Sequence Number=SeqID_113078
  Gene Ontology: Mol. function=protein histidine kinase activity; Cellular component=membrane; Biological process=peptidyl-histidine phosphorylation
  Homolog annotation: Hit_ID=UPI0000382B4C; Match level="QueryCoverage =67%, HitCoverage=85%, E-value=3e-64, Identity=71%"; Hit description =COG0642: Signal transduction histidine kinase
  Pfam annotation: Domain name=HisKA; Domain location=48-113; Score =57.3; E_value=5e-14; Accession=PF00512.15; Description=His Kinase A (phosphoacceptor) domain
STLEDPTLAARDANDMSAIDAGQAPTEVRPLADALNGLFLKVEAARRHEREVTAFAAHELRTPLAGLKTQAQVAMAATDPDITRAALRQILAAVDRTTRLVRQLLDAARLDAAEETRPLTEIDVGALVAETVAGMRVPAEIRTVVDPELHGYTMRADPESLRLAVRNLHENAVQHMQAGLVEWAARPGGHEALLPRTPQERDGKRARTGHRGDGLSSERIEPAPPQSIGPARARGGDPARLTPPRLSDRQRAIADPVLGVEQPAAGIALQ

SEQ ID NO: 229857 - protein, 55 aa, Glycine max
  Coding DNA Sequence Number=SeqID_113079
MGGGRRAGSLGVGCGFEYDNSSDGPPIYLPGVWPTKSLEVRKEVAVPVPPIKVLV

SEQ ID NO: 229858 - protein, 162 aa, Glycine max
  Coding DNA Sequence Number=SeqID_113080
MDDGGRPCGIRVVEYRPHGHRRARPESLRPARRPPSARAAARGPRAHRPRRARARRDAATGGEPRPCPGAVRTDLERGRGAGDRAGRPERAGLDARSGSRPRHRVPRLRPAGPPGLRLPGAARAGAGRTDSSRAEAGHARGRPDPRRLARAGGRRGALRGIL

SEQ ID NO: 229859 - protein, 269 aa, Glycine max
  Coding DNA Sequence Number=SeqID_113081
  Gene Ontology: Mol. function=serine-type endopeptidase activity; Biological process=proteolysis
  Homolog annotation: Hit_ID=Q26NV4; Match level="QueryCoverage=70%, HitCoverage=25%, E-value=9e-49, Identity=51%"; Hit description =Putative aminopeptidase
GNVEEGGADGVPHRVARGRFDPLRAVLAGVEVAYADGVKFRTLGVDAPGQQAVVVGMSRAGDLEEGEALALLIAVEQDLLADLAVLGLLGDAVNGARPAADQRMLATLAMAGVVGERPVGLGHRGVVLADASAHLGDQGLAQGGGAAQRRLGIGVLGVEIGADVGGERRGVLQHGPPVLGLEPRERILDAPAEEFEGGARRSSPNSGWNALERLEQAGVMAAGVPRRDAGRKAGRCPISAANAARQLLGGKPCGAFMTDCARPGSPPRR

SEQ ID NO: 229860 - protein, 195 aa, Glycine max
  Coding DNA Sequence Number=SeqID_113082
MGDWWRPFKSDLTSKWAHAADKDGVDDTVCEKYDISKEPNFVRAAETLPGRKKLMKKKKKKQLEEDAKSGSTDTVIDSPSPIRQHVKWKMARTKKIGQMTSEAVKEIADKMASQGSFVTHGRHDVLTATIGRPKHPGRVRVAGAGVTIKQYFGPAPRTSYTSLSMALEDLEQLTQKIKDKLEESITEKVTFGACT

SEQ ID NO: 229861 - protein, 183 aa, Glycine max
  Coding DNA Sequence Number=SeqID_113083
MAASPSSVGKLRLGSTRSYKNQHEQRAGEIEQVHQGAQQADAEERAPDAGTHLGRRERRFVILSRRGVVRERGWLHVVLPHATGLAREGAAAFRCRPGSAKRPAARPRGLARGRTRSGEHVVVLRAGGGLCGLLEDQPGAVPPDRRVVNEGAPRRVVGVPHEVVLGHLAPRQALEEDRAVSLA

SEQ ID NO: 229862 - protein, 103 aa, Glycine max
  Coding DNA Sequence Number=SeqID_113084
  Subcellular localization annotation: CTP_CleavageSite=43; ConfidenceScore=5.15e-01
MVNFRRRILQPEQVADALTRINPMPDSASQRPSGSGRRGCRVCGLMRSSPGRAPSPRDRVGNLQRAGAPQQPRGAEAVHGAAIDGVDLVEQVEHAQRQARAGP

SEQ ID NO: 229863 - protein, 107 aa, Glycine max
  Coding DNA Sequence Number=SeqID_113085
  Gene Ontology: Mol. function=nitrile hydratase activity; Cellular component=phycobilisome; Biological process=nitrogen compound metabolic process
  Homolog annotation: Hit_ID=Q08G29; Match level="QueryCoverage=99%, HitCoverage=37%, E-value=3e-53, Identity=89%"; Hit description=ScnA
MPSPTETRQIFETGTHLMPAIHKEQDWPYEVPHIRYEAYIWPTHDVGGQPCAPQIFEEKEDEEWENNVYITCEVLGFRGLWNAEERRRRYANDIGMTLYYGFYDNAR

SEQ ID NO: 229864 - protein, 261 aa, Glycine max
  Coding DNA Sequence Number=SeqID_113086
  Gene Ontology: Mol. function=acyltransferase activity; Cellular component=membrane; Biological process=response to antibiotic
  Homolog annotation: Hit_ID=Q8RJL6; Match level="QueryCoverage=71%, HitCoverage=77%, E-value=3e-32, Identity=42%"; Hit description =Putative O-acetyltransferase WavO
  Pfam annotation: Domain name=Hexapep; Domain location=136-153; Score =13.3; E_value=0.88; Accession=PF00132.14; Description=Bacterial transferase hexapeptide (three rep
  Pfam annotation: Domain name=Hexapep; Domain location=154-171; Score =7.6; E_value=17; Accession=PF00132.14; Description=Bacterial transferase hexapeptide (three rep
  Pfam module annotation: Pfam domain module=Hexapep::Hexapep; Domain location=136-153::154-171
MKIAFGEIRSLLQSQRIFLGGQRLVCDHPFYRDEQPIEVPENLCTEPYTTYWGRCGERLASLGAFSYTRTLLPAFIQVGRYTSIADRLQVLGDRHPLEWASSSPVFYARHSALMETLAADNGRENHFYAFEKQTRPIVIGNDVWIGQNVTLAQGITIGDGAVIAANALVVKDVAPYTMVGGNPAKLIKYRFAEPIVEQLLALRWWQYSAQDIAMFPVNEVARFCELLRHAQEQGELTPLALPKLTATVVKTVVAGGMKMKS

SEQ ID NO: 229865 - protein, 460 aa, Glycine max
  Coding DNA Sequence Number=SeqID_113087
  Gene Ontology: Mol. function=transcription factor activity; Cellular component=nucleus; Biological process=regulation of transcription
  Homolog annotation: Hit_ID=Q1SRF6; Match level="QueryCoverage=93%, HitCoverage=98%, E-value=2e-97, Identity=43%"; Hit description=GRAS transcription factor
  Pfam annotation: Domain name=GRAS; Domain location=24-356; Score =273.1; E_value=5.4e-79; Accession=PF03514.5; Description=GRAS family transcription factor
  Subcellular localization annotation: CTP_CleavageSite=35; ConfidenceScore=5.04e-01
MHVTSSQSHMKAELKGTTSISFQNPTTTLFNNPLSGALKGCLGSLDGACIEKLLLHCASALESNDVTLAQQVMWVLNNVASPVGDTNQRLTSWFLRALISRASRICPTAMSFKGSNTIQRRLMSVTELAGYVDLIPWHRFGYCASNNEIYKAITGFQRVHIVDFSITHCMQWPTFIDALAKRPEGPPSLRITVPSCRPHVPPLVNISIHEVGLRLGNFAKFRDVPFEFNVIGNTGPLTTAELSDESTNFHFEAMLSLLNPTMLNLREDEALVINCQNWLRYLSDDRKGISRQSLSLRDAFLNIIKGLNPRIVLLVDEDCDLSASSLTSRITTCFNHMWIPFDALETFLPKDSCQRSEFESDIGQKIENIISYEGHQRIERSESGVQMSQRMKNVGYLSVPFCDETVREIKGLLDEHASGWGMKREEGMLVLTWKGNSCVFATAWVPCEMRDHIGIDAGLS

SEQ ID NO: 229866 - protein, 55 aa, Glycine max
  Coding DNA Sequence Number=SeqID_113088
CEKGRYYKQKGAKIKKKEVNQKKPKSSKALSARHALSERFRAQRDYEGPSPSLHL

SEQ ID NO: 229867 - protein, 210 aa, Glycine max
  Coding DNA Sequence Number=SeqID_113089
  Gene Ontology: Mol. function=nucleic acid binding
MSMSSRFLRMNDNITLVLHHGGRFTPRASDGKVEYIGGEFDVWEDISADCLNAFILYDLVKACKKYSNIGECFWLIDKDLDFNHGLRSCTTDGDILHLVRDAFENENEINVYFHHEVDPILEEVPQMLYLECYPIRKAVENVDDLDDVPVAGHEEDVGAGEQTDAGEQMDADGSEQRDTDAGEQRDGSEQRDAEAGEERDADGEERDVAD

SEQ ID NO: 229868 - protein, 275 aa, Glycine max
  Coding DNA Sequence Number=SeqID_113090
  Gene Ontology: Mol. function=ATPase activity, coupled to transmembrane movement of substances; Cellular component=integral to membrane; Biological process=transport
  Homolog annotation: Hit_ID=Q26M10; Match level="QueryCoverage=90%, HitCoverage=41%, E-value=1e-62, Identity=50%"; Hit description=ATPas precursor
GDLAGTRPAVPPQPERRGDDGGAEGQQQSELRRAAPRHDHPGAPGAPPPLRQDARQAGVLPRLGAEGLHHGVVADRVAERPAEPRVEGVRERRRGRDHPRRQDDRGADIGERPEPDHRPHRRPVQAEHHRRAREHDDGGQDREQQHVVESVERPHAAGDLAHGRAREGVGMPLRREALHAGEAAARDVGHRAERQRDNEAPGDVAQNHRRETQQGHREEGRHRRLKRRLPLRARQRVDEAAGIERQHDVGQGGERDRGHEGPTRDRGVGASRGRR

SEQ ID NO: 229869 - protein, 190 aa, Glycine max
  Coding DNA Sequence Number=SeqID_113091
  Gene Ontology: Mol. function=isomerase activity; Cellular component =integral to membrane; Biological process=peptidoglycan metabolic process
  Homolog annotation: Hit_ID=Q2L342; Match level="QueryCoverage=92%, HitCoverage=43%, E-value=2e-54, Identity=58%"; Hit description =Putative lytic murein transglycosylase precursor
RLQLLAFRPARGRHAELALDVLDRLAGLGADLAVRLADIVAAGDQAALEVAALGARQRRVVGRPVGLDAGAPAQAVGQDGDGQPVGFGGVVGVDRVEVLGDEEGGAVDAGRHEDAGGSLSRQRLAVDAGDAERGPVADGVLVLAAGGPGVEAARQPHLVAPGMPVRPLGDAQEVGGGGDRVGHRIDHVAP

SEQ ID NO: 229870 - protein, 90 aa, Glycine max
  Coding DNA Sequence Number=SeqID_113092
  Gene Ontology: Mol. function=RNA-directed DNA polymerase activity; Cellular component=chromatin; Biological process=DNA integration
MDVKTTFLNCDLEEQVYIKQPEGFFSSSGEHLVCKLKKSIYGLKQASRQWYLKLHGTISSFDFDENPMDQCIYHKMIFYLQPMVRVCYMR

SEQ ID NO: 229871 - protein, 146 aa, Glycine max
  Coding DNA Sequence Number=SeqID_113093
MLARPPHAMTGSPTSRIEAADVAAGLKLARAKDHAAVRALARASEVGSWQSLLALSVGTLAWGTITHDRRLAEAGRHMLRAGLLASLVKTSLKRTVHRTRPNVLMDEGIYARGRPGTNVGPWQSFPSGHSALSAAVACATARAYPE

SEQ ID NO: 229872 - protein, 191 aa, Glycine max
  Coding DNA Sequence Number=SeqID_113094
  Subcellular localization annotation: CTP_CleavageSite=35; ConfidenceScore=5.57e-01
DPTGRLRGARPSPDAQRPPAARRIRPFGPMSCRVSCGSRRGGCGAPVPAVAGFRAGQDRPASRSPENGHKSRNESRHESRNAKKPGTRPGFSFGKSGGPAGADDGELGVADLLATADEHGAGAADGDRAALVVDGEGATAAGAAIEVHVQAFDLQRHGRRLEEVQERVGRESVLDTTTRGPAGLEVVARHA

SEQ ID NO: 229873 - protein, 302 aa, Glycine max
  Coding DNA Sequence Number=SeqID_113095
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=4e-34, Identity=26%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MPSPLEGLHVLTVRGLYVLAFKGLHVLAFRGLHALAIGGLHVLAIRGLHALTFRGLHILAIRGLHALTFRGLHVLANKGLDVLAFRGLHVLAFRGLDVLTFRELHVLAIIGLDVVAFRGLHVLTIRGLHALTFRGLHVLVFRGLHALAFKGLHVLDIRGLNTLTFRGLHILAIRELHALTFRGLHVLAIRGLHALTFRGLHILAIRWLDAFSFRGLHVLLFRGLDVLTFRGLHTLPLRELHVLAFRGLHAVAFSDLHAVIFKGRHVLEFEGLHAPSPLGGYTPSPSEDYKSSPSEDYTPLPS

SEQ ID NO: 229874 - protein, 74 aa, Glycine max
  Coding DNA Sequence Number=SeqID_113096
MPKIITHKWKFGNLLEAPNTLPMKGLFVTKLESNEALKVVGPFLLDSNFSRDGTNPPSNSLYGNPQTRKQRDKQ

SEQ ID NO: 229875 - protein, 279 aa, Glycine max
  Coding DNA Sequence Number=SeqID_113097
  Homolog annotation: Hit_ID=Q9AVH2; Match level="QueryCoverage=71%, HitCoverage=100%, E-value=4e-63, Identity=50%"; Hit description =Putative senescence-associated protein
EGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNSHVPYWWVNNPTLGEFCFTMIGRADIEGSKSNVAMNAWLPQASYPCESTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 229876 - protein, 237 aa, Glycine max
  Coding DNA Sequence Number=SeqID_113098
LPSDHREIEAALCIPGMGFILNVEGHPRRILKKDLTTLAQVWSVLSYSNLTPTSHTSDLIVDRVRLGFPTLLTTLCRARGVVSNNLTFERLSPAINLAYIRKNCWNIDDLTVAFPGARRARVRPVDIPSTFATPSPTPTSTFAAPSVPAHMVSSPESILSVDQFLEKVAWLGAHPSLDREGGGPTAQVAQQVQDASFETTIPEPFTLHHEVGEEQVRPKIDVTSERSLEGTSEPPTP

SEQ ID NO: 229877 - protein, 138 aa, Glycine max
  Coding DNA Sequence Number=SeqID_113099
  Homolog annotation: Hit_ID=Q93X02; Match level="QueryCoverage=25%, HitCoverage=7%, E-value=3e-09, Identity=83%"; Hit description =Putative ammonium transporter AMT2
MPSSTQWLMQSWDAIVMGILSGSIPWVTMMILPKKSTLLQKMDWVQMDRCRVAALLPSIKEKQLESHSNCVRHDRENQGLDKGNMAEIDGYQNLFGLMKQRFLSFKNQKYIKELEHFQALAEAQFPKVIIDLPSPFSI

SEQ ID NO: 229878 - protein, 54 aa, Glycine max
  Coding DNA Sequence Number=SeqID_113100
MLALPHEHGRSTLSRRVPKLTGPPTCPFNKGYSQSDVRDLRAYLGHVHPDEGQL

SEQ ID NO: 229879 - protein, 96 aa, Glycine max
  Coding DNA Sequence Number=SeqID_113101
  Gene Ontology: Mol. function=structural constituent of ribosome; Cellular component=ribonucleoprotein complex; Biological process =translation
  Homolog annotation: Hit_ID=Q2PMP7; Match level="QueryCoverage=87%, HitCoverage=39%, E-value=2e-40, Identity=97%"; Hit description =Chloroplast 30S ribosomal protein S3
  Pfam annotation: Domain name=Ribosomal_S3_C; Domain location=11-95; Score=147.3; E_value=4.1e-41; Accession=PF00189.10; Description =Ribosomal protein S3, C-terminal domain
MGFPKFLIEEFIAGQLKNRVSFRKAMKKAIELTEQAGTKGVQVQIAGRIDGKEIARVEWIREGRVPLQTIRAKIDYCCYTVRTIYGVLGIKSLDIF

SEQ ID NO: 229880 - protein, 127 aa, Glycine max
  Coding DNA Sequence Number=SeqID_113102
MKAQVEKDEGPEAETLSRLLIVAEGPSNPCGVYPDLSSFTGSGVYPDLSSLTGSGVYTDLSSFIGSGVYPDLSSFTGSGVIQIFVTCIKRSAPKTSAHLGKKTLFTDTDKKHDSRCRPGKMTDPGQK

SEQ ID NO: 229881 - protein, 102 aa, Glycine max
  Coding DNA Sequence Number=SeqID_113103
  Subcellular localization annotation: CTP_CleavageSite=40; ConfidenceScore=5.71e-01
MVRNAHRSKCPNSLKTVPSGVANSRNLPFGRRATGGTRVRLPRKEGARSRHQRLFEENVRKSKTCDLRTLIVKGSGVVFTHGEGYFLCSYVFLNCDEEIRPT

SEQ ID NO: 229882 - protein, 506 aa, Glycine max
  Coding DNA Sequence Number=SeqID_113104
  Gene Ontology: Mol. function=chitin binding; Cellular component =extracellular region; Biological process=chitin metabolic process
  Homolog annotation: Hit_ID=UPI00006A17C9; Match level="QueryCoverage =61%, HitCoverage=100%, E-value=7e-48, Identity=30%"; Hit description= UPI00006A17C9 related cluster
MMSMKKIMEVNAAARLHALDFRGLHVLTFRGLHALAFRGLHALAFRGLHVLAFRGLHVLAFRGLHVLTYRGLHALAFRRLRALDFKGLHVLAFRGLHALSFKGIHVLTFRGLHVLAFRGLQVLTFRGLQVLAFRGLHVLAFRGLHVLAFRGLHVLALGGLHVLTLGGLHVLTFRGLHVLAFSGLHVLAFRGLHVLAFRGLHVLTLGGLHVLTFRGLHVLTFRGLHVLAFSGLHVLAFRGMHVLAFRGLHVLAFIGLHVLAFRGGLHVLAFSGLDALTFRWLHALTFIGLHALIFRAVHVHAFRVLHVLAFRGLHVLTFRGLHICAFREFKAAAKRRVRIMLTNMTILTQIWMTLLLSNILPNDHNVDLPLWKYQGPLDSEKSNRALGFLALITRPSLTGLSSRSFVPPGRHRVRHHSSLGTTSRGQQTHRHHLQGPPQLIYKGWSVAYDTWPTSRRPTTQANVKEALLGGNLELATKKLPATRSRKGTIEEGYNAAPQSDTGFDKH

SEQ ID NO: 229883 - protein, 162 aa, Glycine max
  Coding DNA Sequence Number=SeqID_113105
LLLQSLRVNGLTCLWLTKGADNHKVCPHATGPLGHDSRNETFLRSRSVVADIFGKGADDHIGLYVSTGSLASDTDISEKVQMTSLVYVCQRARLPLVDKRLACLWLTKGANNHKVCPRATEPLGHDSRIETFLHSWPEDAHIFGKGANDHIGLYVSTGSLAS

SEQ ID NO: 229884 - protein, 91 aa, Glycine max
  Coding DNA Sequence Number=SeqID_113106
MARKDKLWSFCALLSSRGGEPDDMRRQIMAANPAVCGDVGRSVLIIFKNFAGTAGGEIDRPNDPCLTTSRYLTPIVRQSAKFRDMSGVERT

SEQ ID NO: 229885 - protein, 240 aa, Glycine max
  Coding DNA Sequence Number=SeqID_113107
  Homolog annotation: Hit_ID=Q8TGM6; Match level="QueryCoverage=31%, HitCoverage=61%, E-value=8e-07, Identity=64%"; Hit description =Protein TAR1
  Subcellular localization annotation: CTP_CleavageSite=35; ConfidenceScore=5.45e-01
SLSVSRQYLALDGIYRPIGAAFPNNPTRRQRLVVRQGPGTTGLSPSLAPPSRGLGPGPPLRTLLQTTIRTPRATDFHGGLFPRVAPPDLRSRWERACTQRVVDGSRTDRLARDWSRAWLIHHFITAKSAMNPDFNQPRGGCSREVSIHPAQQHCYMFALGKRCVTPRAGVPSGLMASGATCVQKTRWFTGILAIHTKYRISLRSSSMQEPRYPLPRVIVCKCCVVTTPAGHRLRAPGSRT

SEQ ID NO: 229886 - protein, 78 aa, Glycine max
  Coding DNA Sequence Number=SeqID_113108
MVLQNPVEGKKRKDYRVNDQGRLTVDGKPVATTISVKPLDKASSDKAAVLALNTGASTKMLMAECPPCFIGGASRPRV

SEQ ID NO: 229887 - protein, 210 aa, Glycine max
  Coding DNA Sequence Number=SeqID_113109
  Gene Ontology: Mol. function=sequence-specific DNA binding; Cellular component=intracellular; Biological process=regulation of transcription, DNA-dependent
  Homolog annotation: Hit_ID=Q35AK4; Match level="QueryCoverage=98%, HitCoverage=78%, E-value=4e-27, Identity=31%"; Hit description=Helix- turn-helix, AraC type
  Pfam annotation: Domain name=HTH_AraC; Domain location=116-161; Score= 16.7; E_value=0.03; Accession=PF00165.13; Description=Bacterial regulatory helix-turn-helix proteins, araC family
  Pfam annotation: Domain name=HTH_AraC; Domain location=167-210; Score= 14.2; E_value=0.062; Accession=PF00165.13; Description=Bacterial regulatory helix-turn-helix proteins, araC family
  Pfam module annotation: Pfam domain module=HTH_AraC::HTH_AraC; Domain location=116-161::167-210
MLVETENNRWVIPPQRALWLPPLQIHSYNLLSHTDLRAVYFSGSLIAECTNFAKSDQVHVITATPLVKELITGLFSDNYNRPSQRKMALLLLEILSEAPSLTAELPMPRDERLFSAARELVVNHRWEIPLSDLAFIASMSERTFSRLFIKDTGFSFRTWKQRARIYASLDLLANNIPIKQVAYKLGFSCPAAYTAAFRSILNATPRDYLP

SEQ ID NO: 229888 - protein, 220 aa, Glycine max
  Coding DNA Sequence Number=SeqID_113110
  Gene Ontology: Mol. function=isochorismate synthase activity; Biological process=biosynthetic process
  Homolog annotation: Hit_ID=Q8ZR33; Match level="QueryCoverage=89%, HitCoverage=50%, E-value=6e-46, Identity=54%"; Hit description =Isochorismate synthetase, enterochelin biosynthesis
MVESSTFENAWLKDFSALCRGFLFTSPWRSLATQGCYTTINTPVGDAALLQGDFQQQLRQHFAAAKKQGIANPLLVGAIPFDVSQPASLFIPESWQSFNRADLQQALPAQQSDLPAVRRRTAVPDHAVFTRMVADAVATIQRGDPDKVVLSRLMDIVTEQPVDTAALMQRVIAQNPNSYHFHLPLAEGGALVGASLGTNAAQTGARFLLLPAGRLGAPPS

SEQ ID NO: 229889 - protein, 180 aa, Glycine max
  Coding DNA Sequence Number=SeqID_113111
  Gene Ontology: Mol. function=iron ion transporter activity; Cellular component=periplasmic space; Biological process=high affinity iron ion transport
  Homolog annotation: Hit_ID=Q8ZR34; Match level="QueryCoverage=97%, HitCoverage=55%, E-value=4e-58, Identity=64%"; Hit description =Ferric enterobactin (Enterochelin) tranporter
  Subcellular localization annotation: CTP_CleavageSite=60; ConfidenceScore=5.44e-01
MAVLLFIFQSLSGTARADQGWPRSVQGATGTVTLHQAPQRIVSTSVTLTGSLLAIGAPVIASGATAPKSRLADDQGFFRQWGEVAKQRHVKRLYIGEPSAEAIAAQAPDLIIVSATGNDSALKLVSQLSAIAPTLVVNYDDKSWQDVVTLLGQATGHEAQAAQRVKEFDDREAALKQAIT

SEQ ID NO: 229890 - protein, 229 aa, Glycine max
  Coding DNA Sequence Number=SeqID_113112
MAQEEQGSSASTGSWAIEASSPPEGEAGLLAKPAVQGTPPHSYIANNVSEMNEEGPVGGARTDGAVKGAAVEEDGTVVEGVVEGSGKVDEEGAEVSGAAEVGGASDLLPLAFLGPLNVTVGSSRFQQFFFIYVKLMAGLRLSKDMEFDVTPLALHKVVIKAGMLGNDRNLVGDERLTISIKLKSPPWDAELSSQLLRIRPQECKSRGSSRRYSTCPHQTSPNGLSPSPI

SEQ ID NO: 229891 - protein, 96 aa, Glycine max
  Coding DNA Sequence Number=SeqID_113113
  Homolog annotation: Hit_ID=Q9SK50; Match level="QueryCoverage=40%, HitCoverage=7%, E-value=3e-10, Identity=76%"; Hit description =Putative Rieske iron-sulfur protein
MNLKVIDKIGCDIRTSLISYQKIHTFHVNITHNKKLLVQHWLRLLAKLSEGQLIDGRFKCLNHGWQFEGEGKCVKIAHVGYSSSFTSKSMQYNNFF

SEQ ID NO: 229892 - protein, 67 aa, Glycine max
  Coding DNA Sequence Number=SeqID_113114
MIKGGLHVRLWVWVEPWRWLRCGVMVLDADLIDLMMMVERWCGDGVGRSRGGPRHDGDGVGRKMATQ

SEQ ID NO: 229893 - protein, 98 aa, Glycine max
  Coding DNA Sequence Number=SeqID_113115
MHASEKGFYLHGVSPARMAKCMHVKMAKPISPVRMATFSEDGAMHVKPVATLTHLLMATCMHCFTDRNGEMCFAMLLDEMLTQNRPPTHNGPLLGISF

SEQ ID NO: 229894 - protein, 393 aa, Glycine max
  Coding DNA Sequence Number=SeqID_113116
  Gene Ontology: Mol. function=oxidoreductase activity; Cellular component=vacuole; Biological process=hydrogen peroxide catabolic process
  Homolog annotation: Hit_ID=O81772; Match level="QueryCoverage=92%, HitCoverage=92%, E-value=1e-106, Identity=55%"; Hit description =Peroxidase 46 precursor
  Pfam annotation: Domain name=peroxidase; Domain location=48-356; Score=294.9; E_value=1.5e-85; Accession=PF00141.13; Description =Peroxidase
  Subcellular localization annotation: CTP_CleavageSite=53; ConfidenceScore=5.22e-01
MEKGAMVFPFPIAVSCLFIIVHIFANSVSGSLVFNFYAASCPTAELIVRNTVSSSSSSDPSIPGKLLRLVFHDCFVEDIYLSYFRSFPLVLGLNSFKESDHLLALKAFPKWASRFCGVQLGPKFKFYKNLTGNVGCDASLMLLGNNTEKSDPANRSVGGFSVIESAKRVLEFLCPGTVSCADIIALAARDAVEIVGGPMIEIPTGRRDGMVSVASNVRPNILDTSFTMDEMINRFSSKGLSLFDLVILSGGRGSKRAHTIGAAHCSSFRDRFQEDSKGKLTLIDKTLDNTYADELMKECPLSASPSVTVNNDPETSMVFDNQYYRNLLTNKGLFQSDSALLSDNRTRKFVEDLANDQEFFFESWGQSFLKLTSIGVKTGDEGEIRSSCASINA

SEQ ID NO: 229895 - protein, 90 aa, Glycine max
  Coding DNA Sequence Number=SeqID_113117
  Pfam annotation: Domain name=PPR; Domain location=17-51; Score=32.2; E_value=1.8e-06; Accession=PF01535.11; Description=PPR repeat
MVVAHKLFDTTAIPNLVSWNTMISGFDHNQMFEKSLEMFNRMHLLGVEPMSLVMGVFFWPVTRMVDLLREMATLGLGSDEELGDGGRGRG

SEQ ID NO: 229896 - protein, 224 aa, Glycine max
  Coding DNA Sequence Number=SeqID_113118
  Gene Ontology: Mol. function=protein serine/threonine kinase activity
  Homolog annotation: Hit_ID=Q337P5; Match level="QueryCoverage=50%, HitCoverage=16%, E-value=4e-20, Identity=45%"; Hit description =Pleckstriny domain-containing protein, putative, expressed
  Pfam annotation: Domain name=DUF1336; Domain location=11-190; Score =62.6; E_value=2.3e-16; Accession=PF07059.3; Description=Protein of unknown function (DUF1336)
MGVTAGLRLLPQCQKFLLESPKMPRRRLPPPAGEHGLAQIHHKTRPRALTRSQQRDARATKISISNPRSIAKELCLHDPLRTSSLLNRFVHGNDVFRNQRFKLVNWIEKGPWIVKKAMGSHSACLLGKVLNCIYYKGSNYLKIDVDIEILHLVLGYVTTVMIDMGFVVEAQAEEELLEWLIDAIRVCHMEMALATVIESPHVPRGIGLAKVNHHKSTDELALND

SEQ ID NO: 229897 - protein, 172 aa, Glycine max
  Coding DNA Sequence Number=SeqID_113119
  Gene Ontology: Mol. function=DNA binding; Biological process=DNA integration
  Homolog annotation: Hit_ID=Q1SS72; Match level="QueryCoverage=96%, HitCoverage=14%, E-value=3e-25, Identity=48%"; Hit description =Integrase, catalytic region
MDSYLYLHPSENPAVSLVSPVLDSTNYHSWSRSMITTLSAKNKLEFVDGGAPKPAKTDRVYGSWRRCNNMVVSWIVHSVSISIRQSILWMDRAEEIWRDLKSRYSQGDLLRISDLHSCYHRSKKTRRSSHIVSTWLERTIQQCSITCTAFGSDACDIEDIFICSTTRTSIIW

SEQ ID NO: 229898 - protein, 156 aa, Glycine max
  Coding DNA Sequence Number=SeqID_113120
  Gene Ontology: Mol. function=oxidoreductase activity; Biological process=electron transport
  Homolog annotation: Hit_ID=O49931; Match level="QueryCoverage=62%, HitCoverage=17%, E-value=7e-37, Identity=78%"; Hit description =Rieske iron-sulfur protein Tic55 precursor
  Pfam annotation: Domain name=PaO; Domain location=55-152; Score=5.9; E_value=0.0024; Accession=PF08417.2; Description=Pheophorbide a oxygenase
MDPAHVSISHDRTDWTAKREDAQPLCFEVTERLIGFAGWWGREKEGKNIPNFLSFRAPCVLQNNREIVDKNGETRYFSGVFLCTPTGQGQGKSMLITRKWMDKVGNGIAVALVGISNFGIWDKVESTSLSMCMHVLSIGVYTHAQPPLQWLYQILL

SEQ ID NO: 229899 - protein, 108 aa, Glycine max
  Coding DNA Sequence Number=SeqID_113121
MAEAESNLLTSCKGRITEAIKDKIVSNGEKGLWQKEMKQSLWKFKETWFIQYSVFPYCWIFLTPTIKLEDKVVFYDRGLIDINATAIQGKLMGGASLWKALKQVYQNE

SEQ ID NO: 229900 - protein, 197 aa, Glycine max
  Coding DNA Sequence Number=SeqID_113122
  Homolog annotation: Hit_ID=Q9ZPJ0; Match level="QueryCoverage=72%, HitCoverage=74%, E-value=2e-32, Identity=61%"; Hit description=Tsi1 -interacting protein TSIP1
MKPKTTTRYFIIQVKKHETFLVLLLSISVKKKKKKSCGKGFVHILNAMHSVRFMSSPIGVTVTVPNNARPCNRISCIRVKASMVDSSSDFVKRMELACDHIIVMSLVVLFSTKNMSVLYRLHQSATKEISNQCQLRVHLATLKGILNVNGVEALVSSLLVTMCFVKFHPETLAVLFAEERDQGAVLIVKEQAFVQSG

SEQ ID NO: 229901 - protein, 125 aa, Glycine max
  Coding DNA Sequence Number=SeqID_113123
  Homolog annotation: Hit_ID=Q9SK36; Match level="QueryCoverage=88%, HitCoverage=73%, E-value=2e-34, Identity=61%"; Hit description =Expressed protein
MGHQYHQATDGLLNLFTKANHDLSMVHHRLEKEFQQVYPDNANPMKLVSRIKKIQEDITILKGQCHELLAAKQDLIDKAQRILVENRNLVQRMQPSLGISRTGEDDAAFTNFKQPHKRSFSCSKD

SEQ ID NO: 229902 - protein, 230 aa, Glycine max
  Coding DNA Sequence Number=SeqID_113124
  Gene Ontology: Cellular component=membrane
  Homolog annotation: Hit_ID=Q4WVH7; Match level="QueryCoverage=92%, HitCoverage=55%, E-value=8e-34, Identity=37%"; Hit description =Integral membrane protein, putative
  Pfam annotation: Domain name=TPT; Domain location=74-217; Score= -31.0; E_value=0.036; Accession=PF03151.7; Description=Triose -phosphate Transporter family
  Subcellular localization annotation: CTP_CleavageSite=3; ConfidenceScore=5.34e-01
MALANTSVASTTVLSSMSGLFTLFFGAILGQDSVNITKIAAVLISMAGVAMTTVGKTSAADENISMTQKHSIMGDIFALLSAICYGLFTVLLKNSVGSGEKVDMQKLFGCFGLYSFLGFWWLAWPLNVVGIEPHFKFPSSMSTWEIVIANSICSSVISDYLWALSIVWTAPLVSTLGMSLTIPVAMIADMVIHGRKYSAMYILGCIQVFAGFTLANLSGKISRSDTELST

SEQ ID NO: 229903 - protein, 185 aa, Glycine max
  Coding DNA Sequence Number=SeqID_113125
  Gene Ontology: Mol. function=phosphatidylserine decarboxylase activity; Cellular component=integral to membrane; Biological process=phospholipid biosynthetic process
  Homolog annotation: Hit_ID=Q10L35; Match level="QueryCoverage=96%, HitCoverage=93%, E-value=1e-60, Identity=64%"; Hit description =Expressed protein
  Pfam annotation: Domain name=DUF1077; Domain location=20-184; Score =215.2; E_value=1.5e-61; Accession=PF06417.2; Description=Protein of unknown function (DUF1077)
MEKGKGVMGSGGRRWGVDFSDNSTSRDIPDPPGFSRASLDQAQALYNPFFSFNFDDSTLSRQKKDAESNWKAQKAWEVAQAPMKNLLMMGFMMWMAGSTVHLFSIGITFSALWQPISALQSVGKMFEPYKDNKVELLGPKLLFIALNLGGLALGVWKLNALGLLPTHTSDWVSSLAPAQQKSILY

SEQ ID NO: 229904 - protein, 423 aa, Glycine max
  Coding DNA Sequence Number=SeqID_113126
  Gene Ontology: Mol. function=transferase activity, transferring hexosyl groups; Biological process=carbohydrate metabolic process
  Homolog annotation: Hit_ID=Q9FZL4; Match level="QueryCoverage=95%, HitCoverage=76%, E-value=0.0, Identity=91%"; Hit description=MGDG synthase type A
  Pfam annotation: Domain name=MGDG_synth; Domain location=152-320; Score=300.3; E_value=3.5e-87; Accession=PF06925.2; Description =Monogalactosyldiacylglycerol (MGDG) syntha
  Subcellular localization annotation: CTP_CleavageSite=59; ConfidenceScore=5.43e-01
MNNGVSQESGVLLDLASHVNRFAFDSFRSDYNNSNTLLSNFSQFNNTRTGEAAVKRSVSLGLKVGGASVRFRNILNDFNRAVRFHCEKIPIGFASLRVGDGDGDGNGADGNGNGVRVDECSGVENEGFRGNGVEGEKPKKVLILMSDTGGGHRASAEAIKAAFYQEFGDDYQVFVTDLWADHTPWPFNQLPRSYSFLVKHGPLWKMTYYGTAPRVVHQSNFAATGTFIAREVAKGLMKYQPDIIISVHPLMQHVPLRILRSKGLLKKIVFTTVITDLSTCHPTWFHKLVTRCYCPTTDVAQRALKAGLQQSQIKIFGLPVRPSFVKPVRPKDELRRELGMDEDLPAVLLMGGGEGMGPIEATARALGDSLYDENIGAPVGQILVICGRNKKLANKLSSISWKVPVQPSMCMDVLLHDELGVYP

SEQ ID NO: 229905 - protein, 555 aa, Glycine max
  Coding DNA Sequence Number=SeqID_113127
  Gene Ontology: Mol. function=transferase activity, transferring phosphorus-containing groups; Cellular component=membrane; Biological process=two-component signal transduction system (phosphorelay)
  Homolog annotation: Hit_ID=Q3S4A7; Match level="QueryCoverage=99%, HitCoverage=57%, E-value=1e-167, Identity=56%"; Hit description =Cytokinin independent 2
  Pfam annotation: Domain name=HATPase_c; Domain location=422-546; Score=0.2; E_value=0.091; Accession=PF02518.16; Description =Histidine kinase-, DNA gyrase B-, and HSP90-like ATPase
  Pfam annotation: Domain name=HisKA; Domain location=311-376; Score =82.1; E_value=1.7e-21; Accession=PF00512.15; Description=His Kinase A (phosphoacceptor) domain
  Pfam module annotation: Pfam domain module=HATPase_c::HisKA; Domain location=422-546::311-376
IGTDVGKQFNIEKPGRDQDMLEEVTIIEEPTIADFQRLMELTNYTDKGSSQLAYLMQHWEYKQANAVRLLREELDNLSKQRKEVELRKLEILKDNRFEEENYGGDKRPVSILDEVYYTWQDVPVPLRKSDVVVQNKRIEIEAEYDTVVYWKQRALQLEKQLEASVQREQILMDKLQESVKNLERQSSPVEELSQILKRADNFLHFILQNAPVVIGHQDIIGKTDVEIFTGSGVKESQDFKREVMEKGLPAKKEITFETELFGSKTFLIYVEPVFSKAGETIGVNYMGMEITDQELIFSLPYPPFSTEETMRAKQMLATMSHEIRSPLSGVVSMAEILSTTKLDREQRQLLNVMISSGDLVLQLINDILDLSKVESGVMKLEATKFRPREVVKHVLQTAAASLQKILTLEGNVADDIPVEVIGDVLRIRQILTNLVSNAVKFTHEGKVGINLYVVTEPPFAKAEGHQKMITEQSTNSANGVKEEKRASTPRSNDDQNCLDGQKNNDHPSQNHAVNDECRSSVKSECSINGDTEEQTHSTETVWIRCDVYDTGIGIP

SEQ ID NO: 229906 - protein, 83 aa, Glycine max
  Coding DNA Sequence Number=SeqID_113128
  Gene Ontology: Mol. function=oxidoreductase activity; Cellular component=membrane; Biological process=electron transport
  Homolog annotation: Hit_ID=O22162; Match level="QueryCoverage=70%, HitCoverage=12%, E-value=4e-17, Identity=69%"; Hit description =Putative cytochrome P450
MKKKFEVLNNKDMVSADRNRNTQTAGPRICLWEDFAYRPMKIVAMALVGFFRFKLANGTPNVTYKVMFTLHMDKGLHLCAIPR

SEQ ID NO: 229907 - protein, 165 aa, Glycine max
  Coding DNA Sequence Number=SeqID_113129
  Pfam annotation: Domain name=zf-CCHC; Domain location=9-26; Score =21.6; E_value=0.00027; Accession=PF00098.13; Description=Zinc knuckle
MHTHDLYSMKCFKCLGRGHITSQCPTKKTMIMRGQDIYSSLDEATSSPSSSESEEAKGEESSEEIYPQEKEQPLMVKEECEVSVSSKRLAKKEMHFEIKTNIKVISPLRQPPHFLLCEKTLVTIATPLRLEFIPQVKELLDEGLVRKSLNPYALLVPKIVIKGFP

SEQ ID NO: 229908 - protein, 70 aa, Glycine max
  Coding DNA Sequence Number=SeqID_113130
FYAHILLNAPDYPPALALCTYASECVKTGLANGSGDNHLLCRQWQWREATRAWRFGLHARQKSRKNNIPS

SEQ ID NO: 229909 - protein, 138 aa, Glycine max
  Coding DNA Sequence Number=SeqID_113131
MCKKEHESFKEYAQRWRDMAAQVVPPMMEREMVTMIVDMLPFFYYEKMVGYTPSSFADLVFIGERIEVGLRRGKFDYPALMNGKPRANGENKNEGGTHAVTIVPIWPNFPPAQQYQYSANISPSHYPPPYQPRTLNHP

SEQ ID NO: 229910 - protein, 149 aa, Glycine max
  Coding DNA Sequence Number=SeqID_113132
MNCVFVHASSTHKFGAMRSDCLVQFSILIPFLEPMNCVFIHASSTHEFGAMRSDCLVQFSILNPFPEPMNCVFIHVSSTHEFGALRSDCLVQFSIFNPFLEPMNCVFVHAFSTHEFGAMRSDCLVQFSILNIFSEPHELHFRSCVLHLR

SEQ ID NO: 229911 - protein, 71 aa, Glycine max
  Coding DNA Sequence Number=SeqID_113133
MASGTACPAGGAGWPEWLAGRASTAECGVRSPYVVARGPQVYPLNLPNNWYQSRWFKLVTSLDEYASTAGG

SEQ ID NO: 229912 - protein, 134 aa, Glycine max
  Coding DNA Sequence Number=SeqID_113134
MKKLRKHIGLDFILFPLLSQPSKVKYAYLGLRGFYESITVATYPSTGGRRETRGMRVPRKEYARSRHQRLFEENVGKTGKDAIYELISERFGSCIYARGRRETLRHWTINDLLGRSTKAGLLLLRILNEELRPT

SEQ ID NO: 229913 - protein, 54 aa, Glycine max
  Coding DNA Sequence Number=SeqID_113135
MEKMDVHIITRGTPKGKWALRAKAARLGELKLSVEAISSPNRAGARPGKLVSSP

SEQ ID NO: 229914 - protein, 170 aa, Glycine max
  Coding DNA Sequence Number=SeqID_113136
ADPQGNPPFSPFSEPHECHCLALFMCPPLASAEPLKKKEGVETRVIITERAGRTKSVSYLCFPLISDESPKTCQKSKGSRLAQSEKFRDVRKSKRCVFARSKVVASGGSNLARLGELGGKLLPYFAINRGRSEEEKGSAFLALLSLSLEIAEENYFREENPSRGASVTFP

SEQ ID NO: 229915 - protein, 158 aa, Glycine max
  Coding DNA Sequence Number=SeqID_113137
RGSNEEKAYGGYLGTPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEP

SEQ ID NO: 229916 - protein, 246 aa, Glycine max
  Coding DNA Sequence Number=SeqID_113138
  Gene Ontology: Mol. function=isomerase activity; Cellular component =intracellular; Biological process=proteolysis
  Homolog annotation: Hit_ID=Q1RTJ9; Match level="QueryCoverage=97%, HitCoverage=74%, E-value=1e-20, Identity=33%"; Hit description =Cyclin-like F-box; F-box protein interaction domain
MSDPYFIKLHLSKFAAKDDLEHLQLMKNVCLGSIPEIHMESCDVSSLFHSLQIETFLFDFENMAGYHLVGSCNGLHCGVSEIPEGYRVCFWNKATRVISRESPTLSFSLGIGRRKMFGFGYDPSSDKYKVVAIALTMLSLDVFEKTEMKVYGAGDSSWRNLKGFPVLWTLPKVDGVYLSGTLNWVVIKGKETIHSEIVIIYVDLEKETCRSLFLPDDFCFFDTNIGVFRDSLCVWQDSNTHLACGR

SEQ ID NO: 229917 - protein, 54 aa, Glycine max
  Coding DNA Sequence Number=SeqID_113139
MHEYDAGMICPLQCHEEMHDAIKEYAKRYHPLKEYIVAIGTFSDNASLKEENSR

SEQ ID NO: 229918 - protein, 104 aa, Glycine max
  Coding DNA Sequence Number=SeqID_113140
  Gene Ontology: Mol. function=nucleic acid binding; Cellular component= mitochondrion; Biological process=DNA integration
MTTEIKGLESNNTWTLVPLLAGKQCIGCRWVYKVKFKPDGTVDRHKARLVAKGYIQQAGIEFSDTFSPIAKLTSVRVLLAVATAKNWSILQLDMDNAFLNGNLF

SEQ ID NO: 229919 - protein, 55 aa, Glycine max
  Coding DNA Sequence Number=SeqID_113141
RPVRVTLFFENAPTIWDQHRLKGAFKPGVFTPKAYTPRSPLRPLPLDSGPTQKNI

SEQ ID NO: 229920 - protein, 67 aa, Glycine max; identical to SEQ ID NO: 123961
  Coding DNA Sequence Number=SeqID_113142
  Subcellular localization annotation: CTP_CleavageSite=46; ConfidenceScore=5.02e-01

SEQ ID NO: 229921 - protein, 86 aa, Glycine max
  Coding DNA Sequence Number=SeqID_113143
MATIPTLTYLPSDENVILQLISRPLPADADLFDVADNCAALVSVLVETDDVGSRTALCERLLQTLRRLRELCDVDLPPYLIEQLIV

SEQ ID NO: 229922 - protein, 193 aa, Glycine max
  Coding DNA Sequence Number=SeqID_113144
  Gene Ontology: Mol. function=glutathione transferase activity; Cellular component=eukaryotic translation elongation factor 1 complex; Biological process=translational elongation
  Homolog annotation: Hit_ID=UPI00005F8576; Match level="QueryCoverage =97%, HitCoverage=82%, E-value=1e-63, Identity=59%"; Hit description =COG0625: Glutathione S-transferase
  Pfam annotation: Domain name=GST_N; Domain location=1-75; Score=59.3; E_value=1.2e-14; Accession=PF02798.10; Description=Glutathione S -transferase, N-terminal domain
MINILGKTTSINVRKVLWTCEEAGLEYQQEDYGSGFASTETDTFRALNPNAMVPVLIDGDFVLWESNSICRYLARKAGRHDLLPAEPQACANVERWMDWQATEFNNAWRYVFPALGRKNPDFNDPERIAAGIQEWNHCITILENQLQRTGAFAAGETFTLADVVLGLSVNRWKMTPFDKPDVPAIEAWFGGIL

SEQ ID NO: 229923 - protein, 123 aa, Glycine max
  Coding DNA Sequence Number=SeqID_113145
  Subcellular localization annotation: CTP_CleavageSite=29; ConfidenceScore=5.32e-01
MGPVPIFSAGVSKNYANNQGLCGGKTLAPCQTKSSKSNLAVIAGAAAGGVTLAALGLCIGLFFFVRRVSFKKKEEDPEGNKWARSLKGTKQIKASYIGALHRTYMITQLFIFLVDPFVSCSNR

SEQ ID NO: 229924 - protein, 113 aa, Glycine max
  Coding DNA Sequence Number=SeqID_113146
MEANVVAVAATRAIAKENPTPPSDINQMNHRTSDMVGKDLGSTDDPMMCKFKTSTPFRHMTCLPTIHHPMWHTLPIRMSITPLLYPLRANNPKLIMHVSLKPWGRHMKFPTTI

SEQ ID NO: 229925 - protein, 897 aa, Glycine max
  Coding DNA Sequence Number=SeqID_113147
  Gene Ontology: Mol. function=serine-type endopeptidase activity; Cellular component=extracellular region; Biological process =proteolysis
  Homolog annotation: Hit_ID=Q54484; Match level="QueryCoverage=73%, HitCoverage=64%, E-value=0.0, Identity=93%"; Hit description=SSP-h2
  Pfam annotation: Domain name=Autotransporter; Domain location=393 -656; Score=138.7; E_value=1.5e-38; Accession=PF03797.9; Description =Autotransporter beta-domain
  Pfam annotation: Domain name=BetR; Domain location=729-873; Score =112.2; E_value=1.5e-30; Accession=PF08667.1; Description=BetR domain
  Pfam module annotation: Pfam domain module=Autotransporter::BetR; Domain location=393-656::729-873
MATPHVTGAVAVLLQRFPYMSSAQIADVLKTTATDMGAPGIDALYGWGMINLGKAINGPGMFYTVEDIPAEFRIPDPTGVAYGPTQFVANIPGLGAEVDAGTLHARKCDDISCELEVYSNNISGHGGLTKEGMGTLVLTGNNTYSGPTLVNQGRLAVNGSVTSAVSVQSGGIVGGSGTVGSLTARQGGTVAPGNSIGTLNVAGNVSFEPGSRYAVEVGPNGQSDRIQSSGSATIGGGEVAVTLENSPNLLTQSEVRSLLGQQYTILSAQQGVSGQFDAVAPNYLFLGTGLSYQPTGVTLSVGRNGTSFASVAQTPNERAVAAAADALAAGNPVYESLLGSGTAGEARQAFRQLSGQIHADIASALVNDSRYLREALNGRLRQAEGLASSSAIKADEGGAWAQLLGAWDHASGDANATGYQASTYGVLVGLDSAAADDWRLGVATGYTRTSLHGGYGSKADSDNYHLAAYGDKQFGALALRGGAGYTWHRIDTKRSVNYGMQSDRDTAKYSARTEQLFAEAGYSVQGEWLNLEPFVNLAYVNFENNGIAESGGAAALRGDKQHTDATVSTLGLRADTEWQVSAGTTVALRSELGWQHQYGGLERGTGLRFNGGNAPFVVDSVPVSRDGMVLKAGAEVAVNENATLSLGYGGLLSQNHQDNSVNAAGMPAPFLFAAAGLALKAQAPFDLRSPSDVLIVSVAATEQIFPGVTMVIIKKRAGVIFYSVLLYVSFDTMFDDATWELFLHYGIGKRQHARELSRILDLSFSHAHRKLKGQSPWTLEQINSVAAALGETPAAIADLSAEHETTEPNMARDAIFFVAGVAMPCVGHIGDELPAGRPAEFVALRVEGQWRIYRADEAPAGPRYGVDLIEIRPGFGDDERLSIAVLDDSHKAADELA

SEQ ID NO: 229926 - protein, 315 aa, Glycine max
  Coding DNA Sequence Number=SeqID_113148
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=99%, HitCoverage=24%, E-value=6e-92, Identity=49%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MKLGFLKCTTKHGVYIKGSNTTNLTVVCLYVDDLLVTGNNEIEIANFKGEMMREFEMTDLDLISYFLGIEFKRTDEGVIMHQGRYARDVLKKFRMVDCNSADTPTATGVNLVKDPNEEEVDVILYRQMVGSLRYMENPKLSHFCAAKRIMRYVKGTLDYGILFPSAAKKCNVLGYSDSDWCGDKSDRKSTTGYVFFYGDAPISWSSKKEQVVALSSCEAEYIAAAMAACQAQWLDNIFGELKMKEKGAITLMVDNKFAINLAKHPVAHGRSKHNETRFHFLREQVTKGKLSVKYCPTTVQVADIFTKPLKIDQFK

SEQ ID NO: 229927 - protein, 513 aa, Glycine max
  Coding DNA Sequence Number=SeqID_113149
  Homolog annotation: Hit_ID=Q9FH24; Match level="QueryCoverage=78%, HitCoverage=98%, E-value=1e-46, Identity=33%"; Hit description =Arabidopsis thaliana genomic DNA, chromosome 5, TAC clone:K20J1
MEKRFGRGRRRREWRRFWWVKVVAFVAGNNGGRQRGMETRLNSGMEDEENRSANSGGSGVVYRDTLCLGRNQVSVPRAPGESPLLNGTSTSYLTCSLRMEAMKGARVGVGEDHDMGDGMQCSDHPYRNNPGGICAFCLQDKLGKLVSSSFPLPLLPPSSPSSSSTLPSISSLPPSSAPAPSSSTAVSHFNHPYYPRRTRLPFLLPKKKSKKPTSAPTSDNILLKRSKSTATPRRNRSLVDDDDNDDDLVIGPFSPRKRNGFWSFLYLSSKSSKKLNSKSFRDNNINNTPRISSINLAPASTSSAKLKEKCCSGSSLKTDIVVEQDNNNSNSPNTASASSFERKVSRSKSVGCGSRSFSGDFFERISTGFGDCTLRRVESQREGKPKGTGGGASAAVSRAGEQHHHHCIKERVRCGGLFSGFMMTSSSSSSSSSSYWVSSSADDAAAVNGKSATVALSHNRGRSWGWAFASPMRAFSGKPSSKESNRRDIIRDANDKNATPNLSAIPSLLAVRG

SEQ ID NO: 229928 - protein, 84 aa, Glycine max
  Coding DNA Sequence Number=SeqID_113150
QNRGGACHPARPGEPGCFLEKQPPFGGRIWKAQVGLLSECYRNSQIVQQHFLLISGMSRNFTYCATKGAKYLEAVNQRLYAIKQ

SEQ ID NO: 229929 - protein, 1118 aa, Glycine max
  Coding DNA Sequence Number=SeqID_113151
  Gene Ontology: Mol. function=binding; Cellular component=nucleus; Biological process=lateral root development
  Homolog annotation: Hit_ID=O22161; Match level="QueryCoverage=98%, HitCoverage=97%, E-value=0.0, Identity=62%"; Hit description=F-box protein family, AtFBX5
  Pfam annotation: Domain name=Arm; Domain location=370-410; Score=3.7; E_value=4.3; Accession=PF00514.13; Description=Armadillobeta-catenin -like repeat
  Pfam annotation: Domain name=Arm; Domain location=419-459; Score =25.5; E_value=0.00018; Accession=PF00514.13; Description =Armadillobeta-catenin-like repeat
  Pfam annotation: Domain name=Arm; Domain location=460-500; Score =34.2; E_value=4.5e-07; Accession=PF00514.13; Description =Armadillobeta-catenin-like repeat
  Pfam annotation: Domain name=Arm; Domain location=501-551; Score =19.4; E_value=0.013; Accession=PF00514.13; Description=Armadillobeta- catenin-like repeat
  Pfam annotation: Domain name=Arm; Domain location=552-593; Score =32.8; E_value=1.2e-06; Accession=PF00514.13; Description =Armadillobeta-catenin-like repeat
  Pfam annotation: Domain name=Arm; Domain location=598-638; Score =44.8; E_value=3e-10; Accession=PF00514.13; Description=Armadillobeta- catenin-like repeat
  Pfam annotation: Domain name=Arm; Domain location=639-682; Score =34.1; E_value=4.8e-07; Accession=PF00514.13; Description =Armadillobeta-catenin-like repeat
  Pfam annotation: Domain name=Arm; Domain location=875-913; Score =29.7; E_value=1e-05; Accession=PF00514.13; Description=Armadillobeta- catenin-like repeat
  Pfam annotation: Domain name=Arm; Domain location=914-955; Score =22.6; E_value=0.0014; Accession=PF00514.13; Description =Armadillobeta-catenin-like repeat
  Pfam annotation: Domain name=F-box; Domain location=40-87; Score =39.5; E_value=1.1e-08; Accession=PF00646.23; Description=F-box domain
  Pfam module annotation: Pfam domain module=Arm::Arm::Arm::Arm::Arm::Ar m::Arm::Arm::Arm::F-box; Domain location=370-410::419-459::460 -500::501-551::552-593::598-638::639-682::875-913::914-955::40-87
MNRRVRRKVARKNKGNVVQSSFPEDQDEVLDLEPQRQGFVDWKCLPDDTVIQLLSCLSYQDRASLSSTCKTWRSLGSSLCLWSSLDLRSHRFDAGMASSLAPRCVHLQKLRFRGAESADAIIHLRARNLRELSGDYCRKITDATLSVIVARHELLESLQLGPDFCERISSDAIKAIAHCCPKLNKLRLSGIRDVNADAINALAKHCPKLTDIGFIDCLNVDEVALGNVLSVRFLSVAGTSSMKWGVVSHLWHKLPNLIGLDVSRTDIGPSALLRMLSLSQNLRVLIALNCPILEEDTSFSASKYKNKLLISLRTDIFKGLASLLFDNTRRGNNVFLDWRTSKNNDKDLNEIIPWLEWMLSHTLLRSAESPQQGLDSFWVEQGGALLLSLMQSSQEDVQERAATGLATFVVIDDENASIDCGRAEAVMRDGGIRLLLGLAKSWREGLQSEAAKAIANLSVNANVAKAVAEEGGIQILAGLARSMNKLVAEEAAGGLWNLSVGEEHKGAIAEAGGIQALVDLIFKWSSSGDGVLVSFSDFMERAAGALANLAADDKCSTEVALAGGVHALVMLARNCKFEGVQEQAARALANLAAHGDSNSNNAAVGQEAGALEALVQLTCSPHEGVRQEAAGALWNLSFDDRNREAIAAAGGVQALVALAQACANASPGLQERAAGALWGLSVSETNSGKAKFMSVARLLVVVDCCSVVAQQGTTLWGSVTVLPPTSALSMQNTGKVTHPPPLQRTCLWQFCAFLEIEVTTFDSYTICLIDRLQKCGIAVEWIVLGSASKFTELKTRDIVGCGCRLATSMAWRKTVVRCKFVVVVEAAVQKCSATSGKVEMFCNSDDAERAKEKMVADGRKRKKQGFLTLFYFLGQSGVAIGREGGVAPLIALARSEAEDVHETAAGALWNLAFNASNALRIVEEGGVSALVDLCSSSVSKMARFMSALALAYMFDGRMDEYALVVTSSESISKSVSLDGARRMALKHIEAFVLMFSDLQAFAAAAASSAPAALAQVTEGARIQEAGHLRCSGAEIGRFITMLRNPSSILKACAAFALLQFTIPGGRHAMHHASLMQSLGASRVLRGAAAAATAPLEAKIFARIVLRNLEYHQIEQALA

SEQ ID NO: 229930 - protein, 276 aa, Glycine max
  Coding DNA Sequence Number=SeqID_113152
  Homolog annotation: Hit_ID=Q1SXI6; Match level="QueryCoverage=67%, HitCoverage=80%, E-value=3e-27, Identity=41%"; Hit description=EGF -like
MGEANSPHHRKHPITANSPPPSHSPMCDHHILQQNQQVVEPTDLFSMMHINNRQPPCSAATNPMKRRSPPSSSSSGEPCAKKLFCDQEDPTHYGFSAVPIPLNINSLVNKGGSFPVLRRCVSDPYTSPAPAPEPEQSMPPERGSGLPPLPPRFRRSVSDLSVPSPDKALSCLSSEETATPDSVRLRRMKERLKEMRQWWDEVMKDEEEDRGGREEECAVVAQDDKALAQDDLVGGDSEESVSVDWIERCVSLGFRCPCGKGYEVLLSQNNCYYKLV

SEQ ID NO: 229931 - protein, 152 aa, Glycine max
  Coding DNA Sequence Number=SeqID_113153
  Homolog annotation: Hit_ID=Q1S206; Match level="QueryCoverage=41%, HitCoverage=14%, E-value=6e-13, Identity=54%"; Hit description=RNA -binding region RNP-1 (RNA recognition motif); Nuclear transport factor 2
  Pfam annotation: Domain name=RRM_1; Domain location=21-85; Score =16.1; E_value=0.0047; Accession=PF00076.12; Description=RNA recognition motif. (a.k.a. RRM, R
MLQVQPINLTFFLASYKIKSVYVRNLSPAVSPKIEDEFKNFGRIRLDGVVIRSHKDVGVCYAFVEFEDMTGVHNAVKFSNYPYHAFFFRGWFISSTATSCFPIRNTKRSLPPKAKNLVVVWGLRAFVFGVYFYTMNGYKIFSHQKEQVKERL

SEQ ID NO: 229932 - protein, 159 aa, Glycine max
  Coding DNA Sequence Number=SeqID_113154
  Gene Ontology: Mol. function=electron carrier activity; Cellular component=membrane; Biological process=electron transport
  Homolog annotation: Hit_ID=Q07488; Match level="QueryCoverage=76%, HitCoverage=60%, E-value=2e-13, Identity=38%"; Hit description=Blue copper protein precursor
  Pfam annotation: Domain name=Cu_bind_like; Domain location=37-125; Score=43.7; E_value=6.4e-10; Accession=PF02298.8; Description =Plastocyanin-like domain
MARNVGLNMIGYSTIAMVFIIGVTKATEYMVGDNFGWNVPSYESFYMDWARTKRFHVGDKLIFSWSGEHSLGIRKDDIYYENCSTSLEGGLTYIFNGATINYTIVSTPGPVYFICTVDDHCERGQKFRINVSAAPALSFGILSAFLSSLAVYFCFTVTS

SEQ ID NO: 229933 - protein, 96 aa, Glycine max
  Coding DNA Sequence Number=SeqID_113155
  Gene Ontology: Mol. function=hydrogen ion transporter activity; Biological process=ATP biosynthetic process
  Homolog annotation: Hit_ID=Q9SP55; Match level="QueryCoverage=93%, HitCoverage=95%, E-value=1e-18, Identity=47%"; Hit description =Vacuolar ATP synthase subunit G
  Pfam annotation: Domain name=V-ATPase_G; Domain location=2-95; Score =119.2; E_value=1.2e-32; Accession=PF03179.5; Description=Vacuolar (H+)-ATPase G subunit
MDPFKGQGGIQMLLIAEQEAQHIAKDEAEREATEYRSHIEEEYQKSISENTGSSGSNVKRLEEETNAKIKNLKKSTSKVSSEVVDMLLKYVTNIKT

SEQ ID NO: 229934 - protein, 92 aa, Glycine max
  Coding DNA Sequence Number=SeqID_113156
MDEDQWTYDNTMSQEVHMDYENEEECGVNPLHVDCSDAFNTSQHGTRRTTTDHLEEAIAALTEHSDLANKFEAICERLSHMTSSAPPPPSAP

SEQ ID NO: 229935 - protein, 87 aa, Glycine max
  Coding DNA Sequence Number=SeqID_113157
MNELVNKIVKGYRGDPRSLLSVVRIPREAKWKCGQMSHFLSVQPNARSWILLIWIKMLVERTDHTKLVYPKRKKGGKFSFLYNAKNY

SEQ ID NO: 229936 - protein, 152 aa, Glycine max
  Coding DNA Sequence Number=SeqID_113158
MFTEFINENVNLNKADESMLTTAIVAPPAAMMDKKAGQVVPQLALMNAIPDVVFVPSATLLALIAIKIIKLTFIGNTTSKDTKTHVQPTPEQKLPTTIAFEKEPQIATKQEPHTTTTIEEPQIATEQEPLNYNCTFTYTSIHPQGQHLLPLM

SEQ ID NO: 229937 - protein, 799 aa, Glycine max
  Coding DNA Sequence Number=SeqID_113159
  Gene Ontology: Mol. function=3-hydroxyacyl-CoA dehydrogenase activity; Cellular component=glyoxysome; Biological process=fatty acid metabolic process
  Homolog annotation: Hit_ID=O49809; Match level="QueryCoverage=99%, HitCoverage=99%, E-value=0.0, Identity=71%"; Hit description =Glyoxysomal fatty acid beta-oxidation multifunctional protein MFP-a [Includes: Enoyl-CoA ...
  Homolog annotation: Hit description=hydratase (EC 4.2.1.17); 3-2 -trans-enoyl-CoA isomerase (EC 5.3.3.8); 3-hydroxybutyryl-CoA epimerase (EC 5.1.2.3); 3-hydroxyacyl-CoA dehydrogenase (EC 1.1.1.35)]
  Pfam annotation: Domain name=3HCDH; Domain location=569-662; Score =107.0; E_value=5.4e-29; Accession=PF00725.12; Description=3 -hydroxyacyl-CoA dehydrogenase, C-terminal domain
  Pfam annotation: Domain name=3HCDH_N; Domain location=389-567; Score =280.5; E_value=3.3e-81; Accession=PF02737.8; Description=3 -hydroxyacyl-CoA dehydrogenase, NAD binding domain
  Pfam annotation: Domain name=ECH; Domain location=112-266; Score =85.0; E_value=2.4e-22; Accession=PF00378.10; Description=Enoyl-CoA hydrataseisomerase family
  Pfam module annotation: Pfam domain module=3HCDH::3HCDH_N::ECH; Domain location=569-662::389-567::112-266
MSRSRGHTIMEVGPDGVAIITIVNPPVNSLSYDVLRSFKENFDQALQRDDVKAIVVTESELGDYSNNWEGTALKFAQFIRKISSPVTGEESPVSNMQSHGICLLPDSPIIGEKPEQFKNIDLVQREDFLEVLIFLHLVLKSRKLLSFSFSNSFLSPLKERPKPGWLSVEIITDTIEAARKPLVAAIDGLALGGGLEFAMACNARLSTPTAKLGLPELQLGIIPGLGGTQRLPRLVGLTKALEMMLTSKPVKGKEAFSLGLVDGLMSPDDLVNTACQWALDIMGRRRPWIASLYKTDKLEPLGEAREILKFARAQVQKRAPNLQHPLVCIDVIEAGVVAGPRAGLWKEVEASEGLIKSDTSKSLIHVFFSQRGTSKVPGVTDCGLVPRHVKKVAIIGGGLMGSGIATALILSSYPIILKEVNEKFLEAGINRIKANLQSRVKKGKLTQENFENTVSLLKGTLDYESFKDVDMAVVENVSLKQQIFADLEKYCPPHCILASNTSTIDLNLIGERTKSQDRIVGAHFFSPAHVMPLLEIVRTKQTSAQVVVDVLDISKKIKKTPVVVGNCTGFAVNRMFFPYTQAGLFLVEHGADVYQIDRVITKFGMPMGPFRLVDLVGFGVAIATGMQFIQNFPERTYKSMLIPLLQEDKRAGETTRKGFYLYDDKCKPSPDPELKNYIEKARSFTGVSVDPKLVKLQEKDIIEMTFFPVVNEACRVLDEGIAVKGSDLDISAVMGMGFPPYRGGILFWADSLGSKYIYSKLEKWSELYGEFFKPCAYLAARAAKGIPLSASVEQANSRL

SEQ ID NO: 229938 - protein, 172 aa, Glycine max
  Coding DNA Sequence Number=SeqID_113160
MERRNCLQPGTLWCPKTIPNYNSNDLSFQNNKNFVPHCPEALRYAKPAPIISPYRNSHPFYHGGFGIPPPSYGIPSQFGSPIPHPGLQYDYGLYARARAPYSPLPMFPPASFGGINYGPRPRIDGYGYGFQSPPPPWAEGLVADNFASRKRRGELQFKKQSLFHKEKKQVSM

SEQ ID NO: 229939 - protein, 203 aa, Glycine max
  Coding DNA Sequence Number=SeqID_113161
  Gene Ontology: Mol. function=transcription factor activity; Cellular component=nucleus; Biological process=regulation of transcription, DNA-dependent
  Homolog annotation: Hit_ID=Q8LLR3; Match level="QueryCoverage=99%, HitCoverage=99%, E-value=4e-83, Identity=81%"; Hit description =Ethylene-responsive element binding protein 1
  Pfam annotation: Domain name=AP2; Domain location=75-140; Score =146.3; E_value=8.2e-41; Accession=PF00847.10; Description=AP2 domain
MASATVDSDFEFLESVQQYLLGHDSVNLMPETQQTASHDPFSDPKCDGDLENIIVFRSEDATAVVARDVHAPPTWKHYRGVRRRPWGKFAAEIRDPKKNGARVWLGTYDTEEKAALAYDKAAFKMRGRKAKLNFPHLIDSDMLSEEVMVTTSKRSLAENSPPSSPSWSCSDDSLESQGAKRRKSLADLLNKLAKNRSHVKVER

SEQ ID NO: 229940 - protein, 455 aa, Glycine max
  Coding DNA Sequence Number=SeqID_113162
  Gene Ontology: Mol. function=galactosyltransferase activity; Cellular component=Golgi stack; Biological process=metabolic process
  Homolog annotation: Hit_ID=Q2R1F4; Match level="QueryCoverage=89%, HitCoverage=81%, E-value=1e-145, Identity=36%"; Hit description =Pentatricopeptide, putative, expressed
  Pfam annotation: Domain name=PPR; Domain location=102-136; Score =47.3; E_value=5.2e-11; Accession=PF01535.11; Description=PPR repeat
  Pfam annotation: Domain name=PPR; Domain location=137-171; Score =31.1; E_value=3.8e-06; Accession=PF01535.11; Description=PPR repeat
  Pfam annotation: Domain name=PPR; Domain location=172-206; Score =40.7; E_value=5e-09; Accession=PF01535.11; Description=PPR repeat
  Pfam annotation: Domain name=PPR; Domain location=207-241; Score =35.7; E_value=1.6e-07; Accession=PF01535.11; Description=PPR repeat
  Pfam annotation: Domain name=PPR; Domain location=242-276; Score =41.6; E_value=2.7e-09; Accession=PF01535.11; Description=PPR repeat
  Pfam annotation: Domain name=PPR; Domain location=277-311; Score =41.4; E_value=3.1e-09; Accession=PF01535.11; Description=PPR repeat
  Pfam annotation: Domain name=PPR; Domain location=31-65; Score=28.4; E_value=2.5e-05; Accession=PF01535.11; Description=PPR repeat
  Pfam annotation: Domain name=PPR; Domain location=344-378; Score =12.2; E_value=0.27; Accession=PF01535.11; Description=PPR repeat
  Pfam annotation: Domain name=PPR; Domain location=67-101; Score=46.2; E_value=1.1e-10; Accession=PF01535.11; Description=PPR repeat
  Pfam module annotation: Pfam domain module=PPR::PPR::PPR::PPR::PPR::PP R::PPR::PPR::PPR; Domain location=102-136::137-171::172-206::207 -241::242-276::277-311::31-65::344-378::67-101
MIEGLCKRGSVKQAFEMLEEMVGRGWKPNVYTHTALIDGLCKKGWTEKAFRLFLKLVRSENHKPNVLTYTAMISGYCRDEKMNRAEMLLSRMKEQGLAPNTNTYTTLIDGHCKAGNFERAYELMNVMNEEGFSPNVCTYNAIVDGLCKKGRVQEAYKVLKSGFRNGLDADKVTYTILISEHCKQAEIKQALVLFNKMVKSGIQPDIHSYTTLIAVFCREKRMKESEMFFEEAVRFGLVPTNKTYTSMICGYCREGNLRLALKFFHRMSDHGCASDSITYGALISGLCKQSKLDEARCLYDAMIEKGLTPCEVTRVTLAYEYCKIDDGCSAMVVLERLEKKLWVRTVNTLVRKLCSERKVGMAALFFHKLLDKDPNVNRVTIAAFMTACYESNKYDLVSDLSARIYKENHLAIKVSGSLLELSNMLLLYQCQESQDKIPSSAGRCTACKFVEESAS

SEQ ID NO: 229941 - protein, 136 aa, Glycine max
  Coding DNA Sequence Number=SeqID_113163
MGENKHTGVSERERKERGCKQREKLNSKNHHHRSVPLYIIKSPTTMHHATLVKIHVVIVVVVSVVVVMPVAFSARFSCMRVKSTQEGARDGSDQSLCSGNLLCDVVEGSSSVLVLESRALHCCLDHHHLSMAITII

SEQ ID NO: 229942 - protein, 149 aa, Glycine max
  Coding DNA Sequence Number=SeqID_113164
  Subcellular localization annotation: CTP_CleavageSite=13; ConfidenceScore=5.07e-01
MEQLVKQASASPNANALTSVLVEATSHLNLFAFSQFLALPNLLQVLLSPIIIVGASVYRFYTFNEYYFIDFCFHSFSMTLQLQVTENSVYLDMLRLFAHGTWSDYKIATIVVVMTTVAITTIANDGHANSSSDNSDGDDDHANGGGDSH

SEQ ID NO: 229943 - protein, 61 aa, Glycine max
  Coding DNA Sequence Number=SeqID_113165
CEKGRYNKQKVVEIKKKRRKSEEAQVQQGAKRRTRAERNVALSARLRAQRDYEGPNPSLHL

SEQ ID NO: 229944 - protein, 124 aa, Glycine max
  Coding DNA Sequence Number=SeqID_113166
MEAYPDRFIVLHKPTADFSGWYKTVQEKYNLKPYMKIRKPESFITQVRYQTTDAELFLLTNSSSRHSASLDIQFDQEIIKRKQAWLWDATTGRRSIMTGPSTKKSWIVLLILKSCLLTVILPEL

SEQ ID NO: 229945 - protein, 107 aa, Glycine max
  Coding DNA Sequence Number=SeqID_113167
MVAVNNDDIGGGDRGDINGGGVLMATTVVVAINVNDVNDDNDDGGNSKVSDDDGTKWWRVVVTLIVIVMVAMLVIMVMSLTMVVVIAVLVVMVVATNYDGDNDDDSN

SEQ ID NO: 229946 - protein, 366 aa, Glycine max
  Coding DNA Sequence Number=SeqID_113168
  Gene Ontology: Mol. function=calpain activity; Cellular component =intracellular; Biological process=proteolysis
  Homolog annotation: Hit_ID=Q1T2S5; Match level="QueryCoverage=97%, HitCoverage=97%, E-value=4e-73, Identity=46%"; Hit description =Cyclin-like F-box; F-box protein interaction domain; Galactose oxidase, central
  Pfam annotation: Domain name=F-box; Domain location=1-46; Score=35.2; E_value=2.3e-07; Accession=PF00646.23; Description=F-box domain
MVDLPQELIHEILLRLPVKSLIRFKTVCKSWLSHISDPHFTASHFKLGAAPTERLLFLSPIAREFLSIDFNESLNDDSASAALNCDFVEHFDYLEIIGSCRGFLLLDFRYTLCVWNPSTGVHQFVKWSPFVSSNIMGLDVGDEFSLSIRGFGYDPSTDDYLAVLASCNDELVIIHMEYFSLRANTWKEIEASHLSFAEIAYNEVGSFLNTAIHWLAFSLEVSMDVIVAFDLTERSFSEILLPIDFDLDNFQLCVLAVLGELLNLCAVEEIRHSVEIWAMGEYKVRSSWTKTTVVSLDYFSSLSLFPICSTEDGDIVGTDGCNVLIKCNDEGQLQEYQIYSNGPYRSAVYTESLLSLPCDREPAENV

SEQ ID NO: 229947 - protein, 287 aa, Glycine max
  Coding DNA Sequence Number=SeqID_113169
  Homolog annotation: Hit_ID=Q67U54; Match level="QueryCoverage=60%, HitCoverage=62%, E-value=9e-33, Identity=44%"; Hit description=Plant viral-response family protein-like
  Pfam annotation: Domain name=DUF716; Domain location=52-199; Score =168.1; E_value=2.3e-47; Accession=PF04819.3; Description=Family of unknown function (DUF716)
  Subcellular localization annotation: CTP_CleavageSite=34; ConfidenceScore=5.46e-01
MGTLVGHVAPGFGFLSTPSPTRAHHGSQAPSSPTSGPRWNHSLHSLISITFFLYAACAIILDRAQVQAQFAQQLLLLHLHSADHMGPEGRYHLLLQILVFVSLFTTLIGIGHPHSLLVNFVRSVSIFFQGLWLIVMGFMLWTPSLIPKGCYMVVRCSSPEAPNRAVSLVKIEFNWFVIGVTVFAVSLYLVLVKLYGEKKVQYFSLGSEDKERSRGIIALCCGGIKFSDCYRVHHRRALYPCGGGLQLYDPRRDAIYLQRRKSSGVFGLCLELGVGFVDYPKNGLHWN

SEQ ID NO: 229948 - protein, 66 aa, Glycine max
  Coding DNA Sequence Number=SeqID_113170
MNPKLSRGKNERIKISAIQGGEEGVAELLSLTLVANMSCHGKICRHNFGLAMTLRKGGDEKIGWIP

SEQ ID NO: 229949 - protein, 239 aa, Glycine max
  Coding DNA Sequence Number=SeqID_113171
  Pfam annotation: Domain name=C2; Domain location=7-94; Score=31.3; E _value=3.4e-06; Accession=PF00168.20; Description=C2 domain
MGSRYEVEVKPLSARALKNVNWRHGPNLPYVVVWADRSYLLSTSVDENGNTDANWNETLTIPLPAKPLEDQNLFIHVVHAGSGEDTKSLIGKAWLRLVDIVNDFGIGERVRCTLSLKRPSGRPQGKAEVSVTIRESSYGAQGGYNAPPNGAPPQKANCYATPSGYPYNATAKGWATLAAVFGGISVEDAEYVDDKNQDDAEEKRVEDDLGAEDKIQDNVEARVEDDLGDHADDDDDFWR

SEQ ID NO: 229950 - protein, 213 aa, Glycine max
  Coding DNA Sequence Number=SeqID_113172
  Gene Ontology: Mol. function=hydrolase activity; Cellular component =cytoplasm
  Homolog annotation: Hit_ID=Q9LUG8; Match level="QueryCoverage=99%, HitCoverage=100%, E-value=2e-71, Identity=54%"; Hit description =Similarity to endo-1
  Pfam annotation: Domain name=Abhydrolase_2; Domain location=49-212; Score=-81.2; E_value=0.097; Accession=PF02230.7; Description =PhospholipaseCarboxylesterase
  Pfam annotation: Domain name=DLH; Domain location=29-212; Score=16.7; E_value=2e-08; Accession=PF01738.9; Description=Dienelactone hydrolase family
  Pfam module annotation: Pfam domain module=Abhydrolase_2::DLH; Domain location=49-212::29-212
MSGPQCCSNPPSLNPTGGGGHVDKVGGIDSYFTGSPHSKLAVLMLSDVFGYEAPNLRKLADKVGAAGYYVVVPDLLDGEPFNPQNSDRPFPAWIKDCGAEPTKPIIEALKSKGVSAIAAVGFCWGAKVVIELAKSKLIQTAVLLHPSFISLDDIKGVDTPIAILGAEIDQVSPPELVKQFEQVLAAKSGDAEAVKVAEEAHQDLLDWLAKHHK

SEQ ID NO: 229951 - protein, 338 aa, Glycine max
  Coding DNA Sequence Number=SeqID_113173
  Gene Ontology: Mol. function=adenylate dimethylallyltransferase activity; Cellular component=intracellular; Biological process=tRNA processing
  Homolog annotation: Hit_ID=Q2MHM8; Match level="QueryCoverage=90%, HitCoverage=91%, E-value=1e-118, Identity=70%"; Hit description =Adenylate isopentenyltransferase
  Pfam annotation: Domain name=IPPT; Domain location=73-272; Score= -2.8; E_value=1.1e-10; Accession=PF01715.8; Description=IPP transferase
  Pfam annotation: Domain name=IPT; Domain location=38-266; Score= -121.9; E_value=0.003; Accession=PF01745.7; Description=Isopentenyl transferase
  Pfam module annotation: Pfam domain module=IPPT::IPT; Domain location= 73-272::38-266
  Subcellular localization annotation: CTP_CleavageSite=44; ConfidenceScore=5.17e-01
MVSVSAAVCKPVVASFNPASLRNMDSLSLFRHHRNNKEKVVVIMGATGTGKSKLAIDLATQFPPAEIVNSDKMQVYEGLDITTNKVTEEERRGVLHHLLGTVNPNTNFTAQDFCDHATLAVGSILGRDGLPIIAGGSNSFLDALVNHHTEFRLRYECCFLWVDVSLPVLHSSLSARVDRMIHAGQVHEVRKSFQYHNDDYTVGLRKAIGVPEFHDFFRAEADGADERTKQRLLEAAIASLKTNNCSLANRQVQKIHRLYGMWKRNMHRLDATEVFLKNATRQEEAEEAWEDHVLSKSRRILNKFLYEDTHVAPAGIAASVVIASSPPAMAAAAAAATH

SEQ ID NO: 229952 - protein, 1038 aa, Glycine max
  Coding DNA Sequence Number=SeqID_113174
  Gene Ontology: Mol. function=drug transporter activity; Cellular component=membrane; Biological process=multidrug transport
  Homolog annotation: Hit_ID=UPI000034F09A; Match level="QueryCoverage =90%, HitCoverage=83%, E-value=1e-141, Identity=47%"; Hit description= antiporter/ drug transporter/ transporter
  Pfam annotation: Domain name=MatE; Domain location=261-424; Score =91.0; E_value=3.7e-24; Accession=PF01554.9; Description=MatE
  Pfam annotation: Domain name=MatE; Domain location=42-202; Score =107.3; E_value=4.5e-29; Accession=PF01554.9; Description=MatE
  Pfam annotation: Domain name=MatE; Domain location=778-941; Score =107.4; E_value=4.3e-29; Accession=PF01554.9; Description=MatE
  Pfam module annotation: Pfam domain module=MatE::MatE::MatE; Domain location=261-424::42-202::778-941
METPLVIQKHTSEPDYLPVESLKDVMFVLRTETVKIWRVALPMALLALFQLLMDSSTSIYAGHIGDIELSSIGVYQGVIGAIYFYLLFGMSSALATLCGQAFGAGKIQSTCIYVQRSWIILTATCIILLPIYVYATPILKLLGQDEGIAEVAGRYSIQVIPYMFSFAVAFPIQRFLQAQSKVKVIMCIAFVDLLIQNGLLYIFINVFGWGITGLAIVTNIVGWLYAVALVVYTIGWCKEEWSGFCWMAFRDLWAFAKLSLASSVMNCLEQWYITCIMLLAGLLDNPVIAVGSYSICFNVQGWDDMLRLGINTAISVRVSNTLGMSHPRAAIYSFCVTMFQSLLLGILFMTVIFFSKDEFAKIFTDSEDMILAAADLAYLLGVTIVLNSASQVMSGVAIGSGWQVMVGYINLACYYIVGLPIGIFLGFKLHLGVKGLWGGTMCGSILQTLVLFTIIWKTNWSKEVLMDSSTSIYAGHIGDIELSSIAVYQGVINSIYFYLLLQCSGLGLHAAPWNKYSHKTVKIRRITLPVALSQLFQFLTNSSTSIYVGRVGDIELSSISVYQASMLWVGTSCCLASWNKYSHKEVYSKHFSLKRSVKGRTPQMETPLVIQKFTSESDYLPVKSLKDLKFVLWTETVKIWRIAFPMALSALLQFLTISSTSIYAGHLGDIELSSISVYQGVISAIYFDLLTFLQAQIKVKVITCIALAVLVIQNVLLYIFINVFGWGTTGLAMVTNITGWVYAMALVVYTIGWCKEEWTGFSWMAFRDLWSFAKLSLASSVMSCLEQWYGTCIILLAGLLDNPVIDVGSYSICFNVQGWHTMLLLGISVAISIRVSNTLGMSHPRAAIYSFCVTMFQSLLLGIVFMIAIFLSKDEFAKIFTDSEDMIRAVADLAYLLGVSMVINSASQVMSGVAVGSGWQVMVGYINLACYYVVGLPIGIFLGFNQHLGVKDSSNVSPLNHYLEDQLVQGVRLTIFIAGQIASCSGETTGIVSESGVFVAGIVSESGVFTTYYTQEFLASGANSSSHENMEHQQPPLE

SEQ ID NO: 229953 - protein, 94 aa, Glycine max
  Coding DNA Sequence Number=SeqID_113175
MAVQLPIDKESGQSLGFAYIWFVKEESAQLAVLEMNGKFFYGSCCDYTQGSGYGTSVIGQWSCKGCHFLTMVKQQYISHQDRRESSGIIREVLS

SEQ ID NO: 229954 - protein, 239 aa, Glycine max
  Coding DNA Sequence Number=SeqID_113176
  Gene Ontology: Mol. function=hydrolase activity; Cellular component =cytoplasm
  Homolog annotation: Hit_ID=Q9LUG8; Match level="QueryCoverage=99%, HitCoverage=100%, E-value=7e-76, Identity=56%"; Hit description =Similarity to endo-1
  Pfam annotation: Domain name=DLH; Domain location=28-238; Score=40.9; E_value=4.5e-10; Accession=PF01738.9; Description=Dienelactone hydrolase family
  Subcellular localization annotation: CTP_CleavageSite=59; ConfidenceScore=5.05e-01
MSGPQCCSNPPSLNPSGGGGHVNKVGGVDSYFSGSSHSKLALLMLSDVFGYEAPNLRKLADKVAAAGYYVVVPDLLDGEPFNYQNSNRPLPVWLKDHGPDKGSEATKPIIEALKSKGVSVIAAVGFCWGAKVVVELVKSKLIQTAVLMHPSFVSLDDIKAVDIPIAILGAEIDQYSPPELVKQFEQVLAAKAGVASFVKIFPKISHGWAVRYNAEDAEAVKVAEEAHRDMLDWLAKHHK

SEQ ID NO: 229955 - protein, 173 aa, Glycine max
  Coding DNA Sequence Number=SeqID_113177
  Gene Ontology: Mol. function=hydrolase activity; Cellular component =cytoplasm
  Homolog annotation: Hit_ID=Q9LUG8; Match level="QueryCoverage=95%, HitCoverage=66%, E-value=2e-61, Identity=67%"; Hit description =Similarity to endo-1
  Pfam annotation: Domain name=DLH; Domain location=28-173; Score= -71.5; E_value=0.023; Accession=PF01738.9; Description=Dienelactone hydrolase family
MSGPECCSNPPVLNPNAGAGHVEKLAGLNSYLSGSPNSIAILLISDIYGYEAPNLRNIADKVAAAGYYVVVPDFFHGDPYNPENASRSIPVWLKDHGTDKGSEAAKSIIEALKSKGVMAIGAAGFCWGECALFFIPTAKVVVELAKSRLIQAAVLLHPSFVSVDDIKVHFAYC

SEQ ID NO: 229956 - protein, 484 aa, Glycine max
  Coding DNA Sequence Number=SeqID_113178
  Gene Ontology: Mol. function=DNA topoisomerase (ATP-hydrolyzing) activity; Cellular component=chromosome; Biological process=DNA topological change
  Homolog annotation: Hit_ID=Q0GPH0; Match level="QueryCoverage=83%, HitCoverage=90%, E-value=0.0, Identity=91%"; Hit description=BZIP transcription factor bZIP80
  Pfam annotation: Domain name=DUF632; Domain location=1-284; Score =328.0; E_value=1.6e-95; Accession=PF04782.3; Description=Protein of unknown function (DUF632)
NLSSSWTSKPPLAVKYRLDTGSLDEPGGPKSLCSTLERLLAWEKKLYEEIKSGGSVALILSQKPKTMWFGNEAREGVKIEHEKKLSALQTQEYKGEDEAKIFKTKASINRLQSLISVTSQAVSTTSTAIIGLRDSDLVPQLVDLIHGFMYMWRSMHHYHEIQSNIVQQVRGLVNRSSRGDSTSELHRQATRDLESAVSAWHNSFCRLIKFQREFILSLHGWFKLSLVPVHNDNINGRETSETYQFFDEWKLALDRVPDTVASEAIKSFINVVHVISSKQVEELKIKKRTETASKELEKKASSLRNLERKFYSSYSMVGISLPDSAPDNGQVLDARDPLAEKKIELATCQRRVEDEMLRHSKAVEVTRAMTLNNLQTGLPGVFQALTSFSSLFAEALESVCTRSYAIKFLLAPPNYWLRGTRPPEKKRLPSNIMIQKIFAITEFGGACPPKADSIKQGYSLWCQEHAEQFYVVYCVIAQAEECTY

SEQ ID NO: 229957 - protein, 243 aa, Glycine max
  Coding DNA Sequence Number=SeqID_113179
  Gene Ontology: Mol. function=RNA-directed DNA polymerase activity; Biological process=RNA-dependent DNA replication
  Pfam annotation: Domain name=AT_hook; Domain location=136-148; Score =14.9; E_value=0.061; Accession=PF02178.9; Description=AT hook motif
  Pfam annotation: Domain name=DLH; Domain location=71-242; Score= -78.9; E_value=0.075; Accession=PF01738.9; Description=Dienelactone hydrolase family
  Pfam module annotation: Pfam domain module=AT_hook::DLH; Domain location=136-148::71-242
DDGEIEGDVNHRTQAGWMKWRKASGVLCDAKVPIKLKGKFYRTAVRPAILYGTKCWAVKSQHENKVGVAEMRMLRWMCGKTRQDKIRNEAIRERVGVAPIVEKMVENRLRWFGHVERRPVDSVVRRVDQMERRQTIRGRGRPKKTIREVIKKDLEINGLDRSVDTPTAVLGAEIDKMSPPELVKQFEQVLTAKPGVVDCFVKIFPKVSHGWTVRFNPKDAETVKAAAEEAHQDMLNWFAKHLK

SEQ ID NO: 229958 - protein, 657 aa, Glycine max
  Coding DNA Sequence Number=SeqID_113180
  Gene Ontology: Cellular component=cytoplasm; Biological process =regulation of transcription
  Homolog annotation: Hit_ID=Q1S895; Match level="QueryCoverage=92%, HitCoverage=92%, E-value=1e-130, Identity=46%"; Hit description=GRAS transcription factor
  Pfam annotation: Domain name=GRAS; Domain location=262-560; Score =223.7; E_value=4.1e-64; Accession=PF03514.5; Description=GRAS family transcription factor
  Subcellular localization annotation: CTP_CleavageSite=36; ConfidenceScore=5.42e-01
MSSSGFPGGGGASEFFAGVGGFGGRSIPATSMNNPNAAASATNNNLHPLYRTQQQQQQQQQQNLPAMFLDPSSQIAQRQTPTLIGKRTLTEFQAYNQTNNNPNHVLSNLLLRTVKPRTTFSHNHMDFPVPELQSQNLYANQTQRFGVPLLHQLRPQPINLPNNGPVPMTGPNFGYRNSNLGFPPNQNRVRVSPPVSVPVQVQSSEPEKKIMDHRLLELEKQLLEDNDEEGEADAASVITTSEWSETYQNLISPGPVQKPVLTTTSPTSSTTSSTSSSSSVASPASGCSKQTLMEAASAIVEGKHDVAAEILNRLNGVNRSDRLTDCMVSALKSRMNPGEHPPPVAELFRKEHAESSQLLLDNSVCFKVGFMAANYAILEAAFEEKTENNRFCVVDFEIGKGKQYLHLLNALSARDQNAVVKIAAVAENGGEERVRAVGDMLSLLAEKLRIRFEFKIVATQKITELTRESLGCEVDEVLMVNFAFNLNKIPDESVSTENPRDELLRRVKRLAPRVVTIVEQEINANTAPFLARVAETLSYYSALLESIEATTAGRENNNNNLDRVRLEEGLSRKLHNSVACEGRDRVERCEVFGKWRARMSMAGFELKPLSQSMAESIKSRLTTANNRVNSGLTVKEENGGICFGWMGRTLTVASAWR

SEQ ID NO: 229959 - protein, 58 aa, Glycine max
  Coding DNA Sequence Number=SeqID_113181
MHLICTFGWAKILLHFRNKPITISKHGKLIAMKGTPYRFGFGLDVGTNIQEIGAILQE

SEQ ID NO: 229960 - protein, 561 aa, Glycine max
  Coding DNA Sequence Number=SeqID_113182
  Gene Ontology: Mol. function=protein serine/threonine kinase activity; Cellular component=membrane; Biological process=protein amino acid phosphorylation
  Homolog annotation: Hit_ID=Q1T642; Match level="QueryCoverage=95%, HitCoverage=77%, E-value=0.0, Identity=71%"; Hit description=Protein kinase
METQKLIIHFILLLLFISCSSSFTPIDNYLLSCGSQNNASLFNRIFVSDSTSHGSIFLSADKSISLTYQDPPPNLPTLYHTARVFPITGSYRFNMRINGTHLVRFHFSPFKAQGFDLKSANFSVLVDGNLVLRNFKPINGALLKEFILKIESNLLEILFRPEGNSGFGFVNAVEVFTAPADFVIDYGARLVGPSGVVEYKNLSSQVLETVHRINVGGVKVTPFNDTLWRTWIPDEEFLVLKDAAKRVGSTHTLNYQKGGATREIAPDNVYMTAQEMNKDHSIIASQFNITWDFPVAPGGVRHLVRLHFCDIVSPALNLLYFDVYINGYYAYKDLDLSSLTVHVLASPFYVDFVVDSNELGVIQISVGPSELSSSARMNAILNGVEIMKLVNVVDSHVVPRKKRLWVLVSSIVGGIVVLLFVIAALLLSLKCRKKKKTPRQRTMESVGWTPLRVYGGSSLSRMSEGTAFPSPGSYGYFGLTIPFADIQSATNNFDRSLIIGSGGFGMVYKGVLKDNVKVAVKRGMPGSRQGLPEFQTEITIFSKIRHRHLVSLVGYCEENSE

SEQ ID NO: 229961 - protein, 233 aa, Glycine max
  Coding DNA Sequence Number=SeqID_113183
  Homolog annotation: Hit_ID=Q1T2S6; Match level="QueryCoverage=65%, HitCoverage=41%, E-value=3e-25, Identity=43%"; Hit description =Cyclin-like F-box; F-box protein interaction domain
  Pfam annotation: Domain name=F-box; Domain location=15-62; Score =30.2; E_value=7.5e-06; Accession=PF00646.23; Description=F-box domain
MKRGRRKEERQAQKHEKVILPQEMVNQILLRLPVKSLLQFKTVCKSWLSHISDPHFAISHFDLAAARTERIALLVPFDREFLSIDFDASLASNALNLDPLLASKSFSLVILGSCRGFLLLICGHRLYVWNPSTGLYKILVWSPIITSDREFEITTFLRGFGYFFPICITASVDIVGKDLGTGLVECSGKGHLRVHRSYFNGQCGYEVALYTESLLSLPCDSKPSKQAEVDDKQ

SEQ ID NO: 229962 - protein, 162 aa, Glycine max
  Coding DNA Sequence Number=SeqID_113184
  Homolog annotation: Hit_ID=Q5I6E9; Match level="QueryCoverage=34%, HitCoverage=8%, E-value=5e-10, Identity=54%"; Hit description=AvrPto- dependent Pto-interacting protein 3
MERVAEPKVLPRSLPVLVEVSNAHTDAIREAGQRLNGQDVSSVRGIPGREGNQFLKARDGPMKRLASIREVAQLSNARIVLVREDMGFDTRCQEPPSPAPTRMWKGKGSLPEAVELVPDIEKLKGGNDSFVETGPSSFAGASHPPEPVDTDLMRTVLYQRSN

SEQ ID NO: 229963 - protein, 83 aa, Glycine max
  Coding DNA Sequence Number=SeqID_113185
MAACACNLGRCSVVQAELGLGDLSWDHIRLIKDKGIPGQRDQSSGRDRLDKHDGLEVAEGVLVVDSPPPLLADLAVVFFFPWF

SEQ ID NO: 229964 - protein, 69 aa, Glycine max
  Coding DNA Sequence Number=SeqID_113186
  Gene Ontology: Mol. function=hydrolase activity; Cellular component =cytoplasm
  Homolog annotation: Hit_ID=Q9LUH1; Match level="QueryCoverage=89%, HitCoverage=30%, E-value=6e-19, Identity=60%"; Hit description =Similarity to endo-1
MTESYTNIADKVAATGYYVVVPDFFNGEPYDPENVKRPKEKGIEVAKPVIEALKSKGVTAIGAAGFCWG

SEQ ID NO: 229965 - protein, 175 aa, Glycine max
  Coding DNA Sequence Number=SeqID_113187
  Gene Ontology: Mol. function=protein serine/threonine kinase activity; Cellular component=membrane; Biological process=protein amino acid phosphorylation
  Homolog annotation: Hit_ID=Q9FLW0; Match level="QueryCoverage=98%, HitCoverage=20%, E-value=8e-55, Identity=64%"; Hit description =Receptor-protein kinase-like protein
IFGYLDPEYFRRQQLTDKSDVYSFGVVLFEVLCARPAVDPQLDREQVNLAEWALEWQKKGMLEHIIDPYLVGKIKQSSLKKFSETAEKCLAEYGVDRPTMGSVLWNLEYALQLLESEQEGEPYDDSSAQEAVNVTTTTIPGSPSSNVRREGDNDNAYSDISATEVFSQLMNREGR

SEQ ID NO: 229966 - protein, 563 aa, Glycine max
  Coding DNA Sequence Number=SeqID_113188
  Gene Ontology: Mol. function=protein serine/threonine kinase activity; Cellular component=cytoplasm; Biological process=protein amino acid phosphorylation
  Homolog annotation: Hit_ID=Q5I6E9; Match level="QueryCoverage=99%, HitCoverage=79%, E-value=0.0, Identity=79%"; Hit description=AvrPto -dependent Pto-interacting protein 3
  Pfam annotation: Domain name=Pkinase; Domain location=162-494; Score =231.6; E_value=1.7e-66; Accession=PF00069.15; Description=Protein kinase domain
  Pfam annotation: Domain name=Pkinase_Tyr; Domain location=162-488; Score=-34.4; E_value=2.3e-10; Accession=PF07714.7; Description =Protein tyrosine kinase
  Pfam module annotation: Pfam domain module=Pkinase::Pkinase_Tyr; Domain location=162-494::162-488
MVEESNEMGNLSSPFLGARASQNTENSPLAPDSEEKECVWDASLPPSGNVSPHSSIDSTSVVRTMSIANSCASTYRSDAVTSDGMLSLDRNCDSTKGSVRGDSLESAKTSASRASDSSGLSDDSNWSNITGSANKPHKGNDPRWKAILAIRTRDGILGMSHFRLLKRLGCGDIGSVYLSELSATRCFFAMKVMDKASLASRNKLTRAQTEREILQLLDHPFLPTLYTHFETDRFCCLVMEYCPGGDLHTLRQRQPGKHFSEYAARFYAAEVLLALEYLHMLGVVYRDLKPENVLVRDDGHIMLSDFDLSLRCAVSPTLIRNFDSDPSKRGGGAFCVQPACIEPSSVCIQPSCFMPRLFAQKNKKSRTPKAEPGMPSSTLPELVAEPTTARSMSFVGTHEYLAPEIIKGEGHGSAVDWWTFGIFLHELLYGKTPFKGSGNRATLFNVVGQQLRFPESPATSYASRDLIRGLLVKEPQHRLGVKRGATEIKQHPFFEGVNWALIRCSTPPEVPRPVECDLPAKFEPVDTVGVGNINNSNNSSKRMVGNNNTDMKSGGKYLDFEFF

SEQ ID NO: 229967 - protein, 56 aa, Glycine max
  Coding DNA Sequence Number=SeqID_113189
MGGYGFGYDPSTDDYSLYFSLRANAWKEIEPIHLSYQGCSDRVVLDFGLVFNGVLH

SEQ ID NO: 229968 - protein, 80 aa, Glycine max
  Coding DNA Sequence Number=SeqID_113190
  Gene Ontology: Mol. function=hydrolase activity; Cellular component =cytoplasm
  Homolog annotation: Hit_ID=Q9LUG8; Match level="QueryCoverage=96%, HitCoverage=32%, E-value=4e-21, Identity=60%"; Hit description =Similarity to endo-1
VKIPIAILGAENDKVACPPTLVKQWEEILKAKPEIDSYVEIFPNVSHGWTVRYDPKDPSAVKAADKAHQIMIGWFDKHLK

SEQ ID NO: 229969 - protein, 269 aa, Glycine max
  Coding DNA Sequence Number=SeqID_113191
  Gene Ontology: Mol. function=nucleoside-triphosphatase activity; Cellular component=membrane; Biological process=transport
  Homolog annotation: Hit_ID=Q1S4Z8; Match level="QueryCoverage=69%, HitCoverage=88%, E-value=2e-63, Identity=53%"; Hit description=AAA ATPase
  Pfam annotation: Domain name=AAA; Domain location=74-207; Score=22.0; E_value=4.6e-06; Accession=PF00004.19; Description=ATPase family associated with various cellular activities (AAA)
MDDNEEITKTFQGAKVWWVSNKTITKSQSISFYPARFETLAMEKEMKQQIIYDLVNFKNGKEYYDKIGKAWKRGYLLYGPPGTGKSTMIAAMANFMYYDVYDLELTAVKDNTQLRTLLIETTKRIIVFTTNYVDKLDPALVRSGRMDKKIELPYCCFEALKVLAKIYLDVDHHGLFHAVEGLLEESNMTPADVAEDMMPKSKSDDVETCLKKLIESLEKAMKKDQEEAQKKRDEEEARLKEEKEQFAQEEAKKSDEKAGKDVKENGFVH

SEQ ID NO: 229970 - protein, 94 aa, Glycine max
  Coding DNA Sequence Number=SeqID_113192
MHLIPVIDMKTYEYLYSFLNLERVLDNLYSFCGAGAGKGKTRRRGFREVIDTRKEGACDGELREYPMIIRRLRVWLRRHKATRTGAIMGPGGAT

SEQ ID NO: 229971 - protein, 132 aa, Glycine max
  Coding DNA Sequence Number=SeqID_113193
  Gene Ontology: Mol. function=sequence-specific DNA binding; Cellular component=nucleus; Biological process=regulation of transcription, DNA-dependent
  Homolog annotation: Hit_ID=Q6I664; Match level="QueryCoverage=67%, HitCoverage=77%, E-value=9e-28, Identity=70%"; Hit description=HD -ZIP protein
  Pfam annotation: Domain name=HALZ; Domain location=27-71; Score=84.6; E_value=3.1e-22; Accession=PF02183.8; Description=Homeobox associated leucine zipper
MWQMVHWLLMACFCCYFGLFTLLTKLKQTEVDCEYLKRCYENLTEENRRLHKEVQELRALKLSPQMYMHMNPPTTLTICPSCERTHSFASSSTATIHSAVAATSSNRKLFGTNIRLPVSFNTRPFEGPIPRP

SEQ ID NO: 229972 - protein, 74 aa, Glycine max
  Coding DNA Sequence Number=SeqID_113194
MHAGLKQTAGGTGEFAVREEIATGNGDIAMHREPPVKLASSRQEGVGYVADWCRLVGNRHWHWRVAGGTRQHYW

SEQ ID NO: 229973 - protein, 134 aa, Glycine max
  Coding DNA Sequence Number=SeqID_113195
MYGRPLLCANSKQAPLHAIWLASQLTPPNVAYTPNENVNNSTSILIESQQPQSDHAHVSQPMGETHEMPHHNLADFEPCLGYATKGQAIGDIPLQNTLKGPQYHPQPHPLHSTAGKNPHAMAEMGEVGSSRGKA

SEQ ID NO: 229974 - protein, 75 aa, Glycine max
  Coding DNA Sequence Number=SeqID_113196
YTTTWPKKVGQQDTWENQQRKKWRGKKTKKSGKVPGVNISSMGGHRKTLHWPANCRSQIEAKATDRRSLKLVYFG

SEQ ID NO: 229975 - protein, 205 aa, Glycine max
  Coding DNA Sequence Number=SeqID_113197
  Gene Ontology: Mol. function=chitin binding; Cellular component =extracellular region; Biological process=chitin metabolic process
  Homolog annotation: Hit_ID=UPI000044A8F0; Match level="QueryCoverage =84%, HitCoverage=99%, E-value=6e-24, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MDTSEPYTGAMKGTMHKPQVNLGGKNVMNFGGLHALAFRGLHVLTLRGLHVLTFRGLHVLTFRGLHILAFRGRHVFIFRGPHILAFRGLHVLAFRGLHVLVLSGLHRVEHLRLHRVHALTFRGLRALTFRGLQVLAFRGLHVLAFRGLHVLTFRGLHVLIFRELDALAFVGVHAFIFRELHAFAFRGIHVLTFRGLHALASRGIH

SEQ ID NO: 229976 - protein, 449 aa, Glycine max
  Coding DNA Sequence Number=SeqID_113198
  Homolog annotation: Hit_ID=Q1SDS1; Match level="QueryCoverage=54%, HitCoverage=64%, E-value=5e-23, Identity=27%"; Hit description=IMP dehydrogenase/GMP reductase
MGSSQAPSFKKRFYQVKIKSLGVASLKELGQLMGQLQQQAFRKAYGKIWDRTMAEVSTEAIASLAQYYDQPLRCFTFGDFQLTPTEMFGSKGESLAKSRRMGPFMDILALLIFGVVLFPNVDGLVDRAAIDAFLAFYDRKESPVVAILADLYDTFDRRCHRSCTEKKEANWDRLLASKEEASVNWFPRWKEGRTGILISCGKFPNVPLMGMRGCINYNPVLAIRQLGYPIRGAPSKEGLIPFTIRGFNSTNAGVFQRVHKAWEMSQRKDKELRGSSNGPIGGYRRWLKAYAQDLDWLLSLRTIKGVEVETSEEDEENAKLRDVNIATIKTLKQETKRARREEYGWNKFRGAVWGSNSELKLRREEKDQSRVDGLILKDELRTETDMLAIINKYHEELNLAMAHEHKVADEYARVYAEKEARGRVINSLHQATMWMDWFALTLNGSQELP

SEQ ID NO: 229977 - protein, 181 aa, Glycine max
  Coding DNA Sequence Number=SeqID_113199
MGQLQRQAFRKAYGIRPPKASRKWGGRNTEKIFGAIDVFLAYHNHKESPVVAMLADLYDTFDRRCEESNARIVCCTPTLYVGLVSHLFLQVGRPVYPLQGHRSCVEKGKANWDQLLASMGGRLLIGSLARRKGRIKILSSCEGCPMRGVPSDESITPFIARGFSDHNARVLQGVHKAWDAA

SEQ ID NO: 229978 - protein, 189 aa, Glycine max
  Coding DNA Sequence Number=SeqID_113200
  Gene Ontology: Mol. function=protein transporter activity; Cellular component=type II protein secretion system complex; Biological process=protein secretion by the type II secretion system
  Homolog annotation: Hit_ID=Q2KZL9; Match level="QueryCoverage=64%, HitCoverage=75%, E-value=9e-29, Identity=54%"; Hit description =General secretion pathway protein H precursor
  Subcellular localization annotation: CTP_CleavageSite=61; ConfidenceScore=5.59e-01
MTPVARRAAPIATAMMASATSTSIRVKPRWRPRRRAGRGGNSADVIVSGGVARQRHMRIARAQPQAEWIGDPFGVEDQRAVGIQAPLHLAGAPGLRAQGRVVFQPVHGQGPVVLRGRRIGAAGAFERPAAAGRRPAQGAAVAAGLAFGHGECVEQPLGIVAQRIGALADGQADHAGGDGDDHQHHHDFD

SEQ ID NO: 229979 - protein, 80 aa, Glycine max
  Coding DNA Sequence Number=SeqID_113201
MDNEREWNRDHDGVGCYGCCYIYMNNEYFTRNDGGLGLIELVRKKRFMEKEEMASFYFLLGIIALVNFGSLMPLLPLRRA

SEQ ID NO: 229980 - protein, 146 aa, Glycine max
  Coding DNA Sequence Number=SeqID_113202
  Homolog annotation: Hit_ID=Q1RV98; Match level="QueryCoverage=29%, HitCoverage=3%, E-value=3e-10, Identity=74%"; Hit description =Phospholipase, patatin family, putative
MESNNAEYVALGGEGSAPKLENINKVSIIPLMFFIFYEVSEQPCKSNLDESEFSKFHSNVKHWDIVGITGHWVSSILLEHLRWLLLQHRTALGSMYLDGQLGKTIASPPMSPRGVRQLSFSVKSLLEKLQNSSQVGVIHWLFKRTA

SEQ ID NO: 229981 - protein, 94 aa, Glycine max
  Coding DNA Sequence Number=SeqID_113203
  Subcellular localization annotation: CTP_CleavageSite=38; ConfidenceScore=5.09e-01
VAAWPRKGVGSVLHYNNCGVAVTAVAEQRKMGRNPSVSAQYAAPSSSYPRRNPSCKSEKVEEGIEGANGLQTKPQYIARKVVAAAQGGPGGNWY

SEQ ID NO: 229982 - protein, 84 aa, Glycine max
  Coding DNA Sequence Number=SeqID_113204
MTDEQASIYNQIVEAVNKDEGGIFFLYGYGAPMAHKFCFVALDHSLRDIINHNSRDRKISGGPSNGQRWILTADPASHSKRQPL

SEQ ID NO: 229983 - protein, 795 aa, Glycine max
  Coding DNA Sequence Number=SeqID_113205
  Gene Ontology: Mol. function=binding; Cellular component=proton -transporting two-sector ATPase complex; Biological process=ATP synthesis coupled proton transport
  Homolog annotation: Hit_ID=Q2QPI5; Match level="QueryCoverage=92%, HitCoverage=88%, E-value=1e-176, Identity=48%"; Hit description =Expressed protein
  Pfam annotation: Domain name=Arm; Domain location=337-380; Score=5.2; E_value=2.7; Accession=PF00514.13; Description=Armadillobeta-catenin -like repeat
  Pfam annotation: Domain name=Arm; Domain location=597-635; Score =13.8; E_value=0.23; Accession=PF00514.13; Description=Armadillobeta -catenin-like repeat
  Pfam module annotation: Pfam domain module=Arm::Arm; Domain location =337-380::597-635
MEGEGSIHVQVDELQRMRLSETISIGTTMFEPRGLSSIDKLDSNNSTANSVSSTTSAPEKKLTLFALQLAVLEKAATGLGTLGFIWATVVLLGGFAITLEKTDFWFITIILVVEGTRIFSRSHELEWQHQATWSITEVLVTPSTKNHHHQYVSTDTTPTRTRTRMWVSSDVPLLPYAKWFFLSRHVSRLLYWLQLLSATACVVLSLIKLVKHDYGEVAKGDTDKRNRKSALSIFYALALSEALLFLMEKAYWEWQVSYCKLLEEVNKECELGPSGMVSTRRLFYDAYSRCVNGSIFDGLKMDMVGFSMDLLASNSPDEQLIGARILRQFSISERFCDDTLQKIGIDISMVERLVEMLNWTDFKDEEIRLSAAEILSKLAGKKQNSLRIAGIPGAMESISSLLQTNRSVIPAADEIGEKKLVFDHQNYGFWTFNHLGLLILKKLARDLDNCGKIGNTRGLLPKIIDFTHAEEWLLKSENVTPSQVLTLKRSLQLVKMLASTVGTTGKHLRREIAEIVFTISNIRDILRHGEKHPLLQKLCIEILTSLALEEDATERIGGTGGVLKELFNIFFKHNIPENQKHVKIVAGEALAMLALESKSNCHRILKLKVLEKLAEALKDPLLRVNAARILRNLCTYSGSEWFIQLKGVTTAAPIILRAIMSEDNKIQEVMIGLAANVFRYMTSHESSIVFEEAGITEAELANKLVQILKKYQYPPTKIPRIRRFVIELAIWMMKDKAENIETFKGLGMEEVLEGVLETTSELESFNVFSGTVGLNRHTLTTQSLVEMALKLMEDS

SEQ ID NO: 229984 - protein, 98 aa, Glycine max
  Coding DNA Sequence Number=SeqID_113206
WVASGSNPARLGELRSPGRAGRQPPPPFSYKKAEGGCSKDPSAPWLCISTVLGEKNCFREENPSRGASVTLPRCFRKQIREGFRPFFIVLHPFFVLQR

SEQ ID NO: 229985 - protein, 311 aa, Glycine max
  Coding DNA Sequence Number=SeqID_113207
  Homolog annotation: Hit_ID=Q8LCM1; Match level="QueryCoverage=41%, HitCoverage=26%, E-value=2e-09, Identity=32%"; Hit description =Glycoprotein homolog
  Subcellular localization annotation: CTP_CleavageSite=61; ConfidenceScore=5.50e-01
MADSSPYTKPHFPLSDHSSRIQPKPTNQGKSCSGFILKVLFLALFVAVLPLFPSQAPDFVSQTILNKFWELLHLLFIGIAVTYGLFSRRNSELDTTHTELETTHSSANDSTAAAPSYVSKVFPASSNIFYDNGCDNENGNSCEVDEKMVHCWNNQYFDGGPGGVCSNGGGTVGVFDEQYKTHLPISEDSFGYSVRCDGNGIGTGVVQAWNSEYYHSEPVVVVAQPNCNTGECGEVVDYKPLGLPIRSLRSVARDVDSSRYANESDSSSVSRGSSSGLGKSGDREFGDLGPSNLEKKFNDAAAAGGSASAIP

SEQ ID NO: 229986 - protein, 356 aa, Glycine max
  Coding DNA Sequence Number=SeqID_113208
  Gene Ontology: Mol. function=calcium ion binding
  Homolog annotation: Hit_ID=UPI00005DC23F; Match level="QueryCoverage =98%, HitCoverage=65%, E-value=1e-147, Identity=72%"; Hit description= catalytic
  Pfam annotation: Domain name=Abhydrolase_1; Domain location=74-323; Score=-2.2; E_value=0.012; Accession=PF00561.10; Description =alphabeta hydrolase fold
  Pfam annotation: Domain name=Peptidase_S15; Domain location=35-245; Score=-111.5; E_value=0.05; Accession=PF02129.9; Description=X-Pro dipeptidyl-peptidase (S15 family)
  Pfam annotation: Domain name=Peptidase_S9; Domain location=60-266; Score=-71.3; E_value=0.013; Accession=PF00326.11; Description=Prolyl oligopeptidase family
  Pfam module annotation: Pfam domain module=Abhydrolase_1::Peptidase _S15::Peptidase_S9; Domain location=74-323::35-245::60-266
MKGAEYDPKSDLLDQEFMLKGKWYQRKDVEIKNSRGDVLQCSHYLPIVSPEGKPLPGCRADASEAAIILLPSNITVFTLDFSGSGISGGEHVTLGWNEKDDLKAVVNYLRDDGNVSLIGLWGRSMGAVTSLMYGAEDPSIAGMVLDSPFSDLVDLMMELVDTYKVRLPKFTVKFAIQYMRRAIQKKAKFDITDLNTIKVAKSCFVPALLGHAIDDDFIQPHHSDRIFEAYMGDKNIIKFDGDHNSPRPQFYFDSINIFFHNVLQPPEDEVGESFFDPMNDYFGKDVWRSVHELGYSNESSSKNKGMTQDLHLVPSLFVNILHVSLLDAEPSTSSTINAIEQVRSRRPMSRMEVCIY

SEQ ID NO: 229987 - protein, 711 aa, Glycine max
  Coding DNA Sequence Number=SeqID_113209
  Gene Ontology: Mol. function=microtubule motor activity; Cellular component=microtubule associated complex; Biological process =microtubule-based movement
  Homolog annotation: Hit_ID=Q1RYB8; Match level="QueryCoverage=99%, HitCoverage=57%, E-value=0.0, Identity=71%"; Hit description=Kinesin- related protein tck1-common tobacco-related
  Pfam annotation: Domain name=Band_41; Domain location=138-320; Score=- 56.6; E_value=0.00091; Accession=PF00373.8; Description=FERM domain (Band 4.1 family)
  Pfam annotation: Domain name=MyTH4; Domain location=15-129; Score =172.0; E_value=1.4e-48; Accession=PF00784.8; Description=MyTH4 domain
  Pfam module annotation: Pfam domain module=Band_41::MyTH4; Domain location=138-320::15-129
MGIDPSDRVTPISLDERVELVGKLYKQSLKRPELRDELFVQISKQTRNNPERQYLIKAWELMYLCASSMSPSKDISSYLSEYIHNIANGVATDSEIQVLALNTLNALKHSVKAGPRHIIPGREEIEALLTGRKLTTIVFFLDETFEEITYDMSTTVANAVEEYIGLDANKYIGDLLAEFKAAKDRSKGEILHCKLIFKKKLFRESDEAVTEPMFVQLSYVQMQHDYILGNYPVGRDDAAQLSALQILAEIGFLSTPESCIDWNSLLERFLPRQISMTRAKREWEYDILSRYRSLENLTKDDARQQFLRILRALPYGNSVFFNVRKIDDPIGLLPGRIILGINKRGIHFFRPVPKEYLHSAELRDIMQFGSSNTAVFFKMRVAGVLHIFQFETKQGEEICVALQTHINDVMLRRYSKARSAAGGGSGSLNGDISNNSKTPNMELYEKRVQELSKHIEESKKNADQLLEELRVKQKQEEKMQEELDDLKESLKANKQNLDAVTSDRDSLVSLCNEKDKELQAAILDKRNMESRMAKLNNAVIENTAKKDLANAGNRQVTQKLEDELKVCKYELLSANETIESLKSEKLILEQKLSALEKRNAGEISSLKWKLEQERKVVKSEAYELERRLEGCRQELLTAKAIISVKDSEFDALQNNLKELEELREMKEDIDRKNEQTAAILKIQGAQLAEMESLYKEEQVLRKRYFNVIEGG

SEQ ID NO: 229988 - protein, 403 aa, Glycine max
  Coding DNA Sequence Number=SeqID_113210
MYSSLDSISSDMDFQEEDMGQKKTSHMHTSENMNFQEDMGHKKTSYVHDSENVNFQEEDMEQKKTSYVPASENRNFQEVDLGKSSQVSSSGNGMIESKGKYAGDSRPSYFRPMSVDETQLESLSSRSFQSMGSFSSQSSLCSSLDSALSENMNSPKEEHGSSSSSPSPLARRNGEASLQAFQARGYTNGSSPPDDIKSSLNGELRGLNEIEGEDPPGKKESRIHVLQSDSEKPARVAKAPSQGKSVRTRRASGLTSGTMRIGETSSKQTDEKGEKNGNNVESVMRKDRMKSREPDLPLKGVSKKTLDSYCPKPEIKFSNHHRRDKLESSKNLSKQDSDIELENTQVSSYENGVPECVNDSDLDSEVDKKASEFIAKFKAQIRLQKIGSIERSKEQKITQNKIR

SEQ ID NO: 229989 - protein, 513 aa, Glycine max
  Coding DNA Sequence Number=SeqID_113211
  Gene Ontology: Mol. function=amino acid transporter activity; Cellular component=membrane; Biological process=amino acid transport
  Homolog annotation: Hit_ID=Q6H6H8; Match level="QueryCoverage=79%, HitCoverage=65%, E-value=1e-152, Identity=67%"; Hit description =Amino acid permease-like
  Pfam annotation: Domain name=AA_permease; Domain location=50-505; Score=43.6; E_value=6.6e-10; Accession=PF00324.11; Description=Amino acid permease
  Pfam annotation: Domain name=Aa_trans; Domain location=44-474; Score=- 149.0; E_value=0.031; Accession=PF01490.8; Description=Transmembrane amino acid transporter protein
  Pfam module annotation: Pfam domain module=AA_permease::Aa_trans; Domain location=50-505::44-474
  Subcellular localization annotation: CTP_CleavageSite=28; ConfidenceScore=5.21e-01
MRIGSPSSSSSRCSRFWSSALRSKRLVSPAEKAARDSSDLGLSRRLGVLDLVLLGIGASIGAGIFVVTGTVARDAGPGVTISFILAGASCVINALCYAELATRFPAVVGGAYLYAYTAFNELTAFLVFGQLMLDYHIGAASIARSLASYLINILELFPVFKDNIPKWIGHGEDIGDVLSINVLAPILLVLLTFILCRGVQESSVVNSLMTVTKVPFHPTSYLNIVLNIALMVIIVIIVIFAGAFEVDVSNWSPFAPNGLKAIFTGATVVFFAYVGFDAVANSAEESKRPQRDLPIGIIGSLLICIALYIGVCLVITGMVPYNLLGEDAPLAEAFTSKGLKFVSILISVGAVAGLTTTLLVGLYVQSRLYLGLGRDGLLPLIFAKVHPKRHTPIHSQIWVGLVASVLAGLFNVHVLSHILSVGTLTGYSVVSACVVVLRWKDKTNSQVSSSAEREGVICLIAVALCGFASGLLYRYDASFIFLILALVIAAGASAALVFRQVRIILYFIKALFG

SEQ ID NO: 229990 - protein, 80 aa, Glycine max
  Coding DNA Sequence Number=SeqID_113212
  Gene Ontology: Mol. function=transferase activity, transferring glycosyl groups; Biological process=metabolic process
  Homolog annotation: Hit_ID=Q7XZD0; Match level="QueryCoverage=81%, HitCoverage=13%, E-value=5e-16, Identity=69%"; Hit description =Isoflavonoid glucosyltransferase
MQSDSRSKLVSGDSIEKAVRRLMDGGDEALEIRRRAEEFVRKAREAVGEGASSYNNLPNLIDDLLRLKDTKASASPLVNY

SEQ ID NO: 229991 - protein, 56 aa, Glycine max
  Coding DNA Sequence Number=SeqID_113213
MSYAIGMQDINTLFYPEIVGFPMNGRKMENLRYPENGKMMGQRGRKERGSESERRR

SEQ ID NO: 229992 - protein, 93 aa, Glycine max
  Coding DNA Sequence Number=SeqID_113214
  Homolog annotation: Hit_ID=Q9LLL8; Match level="QueryCoverage=37%, HitCoverage=4%, E-value=8e-10, Identity=71%"; Hit description=Xylem serine proteinase 1 precursor
MHFMKRCDSSQLNLNFNVHIHWKLVIDYQRVNTLDQPRAPAQSLIKPDEKRNKGSKAGFTPESKSFKDDGFGPPPARWKGSCGHYANFSGCNR

SEQ ID NO: 229993 - protein, 82 aa, Glycine max
  Coding DNA Sequence Number=SeqID_113215
MEVTILQKLGQKMDRVTSLLHLMPNTFRTVDVLVTSSFTLTKMSWTIKEHALRCPYQTRARARVMGEVEEVQEQIKADMEAM

SEQ ID NO: 229994 - protein, 202 aa, Glycine max
  Coding DNA Sequence Number=SeqID_113216
  Gene Ontology: Mol. function=electron carrier activity; Cellular component=membrane; Biological process=electron transport
  Homolog annotation: Hit_ID=Q1SM05; Match level="QueryCoverage=74%, HitCoverage=51%, E-value=4e-38, Identity=53%"; Hit description=Blue (Type 1) copper domain
  Pfam annotation: Domain name=Cu_bind_like; Domain location=41-124; Score=120.3; E_value=5.3e-33; Accession=PF02298.8; Description =Plastocyanin-like domain
MAMRYSNDGFLGLFALTIISIFILGSSTSSYTFRVGGKDGWVINPSEDYIHWPQRNRFHVNDSLYFKYKKGSDSVLVVNKDDYDSCNSNNPIQKMDEGDSLFTLDKPGPFFFISGNLENCQSGQKLIVVVLADTHEHSQSPSQPEAEAPIANWPSGPNSPVASPPKHSGSTSVRGLRVALVSLSVLVLRTWGGFALQQVGLV

SEQ ID NO: 229995 - protein, 140 aa, Glycine max
  Coding DNA Sequence Number=SeqID_113217
MQEVKLDKLSLLDVWKQGFLGINSFNYPYNYTRQEDCCSQPQCVEAKLHEESRLIQRCFDDNKDDDKGDDKKLKGQSKNELKMFKIESRTLQDSRGKLISRIKNKDSRIKLPRIKIKIQESREDSIKISIKKFFQKLSST

SEQ ID NO: 229996 - protein, 75 aa, Glycine max
  Coding DNA Sequence Number=SeqID_113218
MSIAEVQRQSTEKDTMMDINKMNRAEINELERVQYATEHATKILFLDVAQRQVEMEVAIVPNDMDPTKKKSFVKA

SEQ ID NO: 229997 - protein, 62 aa, Glycine max
  Coding DNA Sequence Number=SeqID_113219
MAPKRNNGWKTRVFLSKGSLIMLVGHPSWKSSAPSIMVTMPYSGELHIKTELVSEAPPRERK

SEQ ID NO: 229998 - protein, 177 aa, Glycine max
  Coding DNA Sequence Number=SeqID_113220
  Subcellular localization annotation: CTP_CleavageSite=18; ConfidenceScore=5.08e-01
MMKNDEESSRNRSRKRLESVTKAPRLGFFSRKKFSSLISRESLNTRRVEQFTLPFSPIYRRKEEGGCRPARPSEQGCFHKKARPSVGTFWKAQVGLNVVKLYGPCNHALFDSWNFAELHRLRNNACFFLLECCETLQIISRWVLNILSRSREGRMPTNNGPRTKLGYDKMYKKISLL

SEQ ID NO: 229999 - protein, 469 aa, Glycine max
  Coding DNA Sequence Number=SeqID_113221
  Gene Ontology: Mol. function=transferase activity, transferring glycosyl groups; Cellular component=integral to membrane; Biological process=metabolic process
  Homolog annotation: Hit_ID=Q7XZD0; Match level="QueryCoverage=99%, HitCoverage=99%, E-value=1e-179, Identity=65%"; Hit description =Isoflavonoid glucosyltransferase
  Pfam annotation: Domain name=UDPGT; Domain location=9-465; Score= -47.0; E_value=3e-08; Accession=PF00201.9; Description=UDP -glucoronosyl and UDP-glucosyl transferase
MDLKEQPLKLYFIPYLAAGHMIPLCDIAQFFASRGHHVTIITTPSNAQILHQSKNLRVHTFEFPSQEAGLPDGVENIFTVTDLEKFYRIYVAATILLREPIESFVERDPPDCIVADFMYYWVDDLANRLRIPRLVFNGFSLFAICAMESVKTHRIDGPFVIPDFPHHITINSAPPKDARDFLEPLLTVALKSNGFIINNFAELDGEEYLRHYEKTTGHRAWHLGPASLVRRTALEKAERGQKSVVSANECLSWLDSKRDNSVVYISFGTLCYFPDKQLYEIACGMEASGYEFIWVVPEKKGKEDESEEEKEKWLPEGFEERKKGMIIKGWAPQVLILEHPAVGAFLTHCGWNSTVEAVSAGVPMITWPVHSDQFYNEKLITQVRGIGVEVGVEEWTLSAYFQSQKLVGRDRIEKAVRRLMDGAAEAQQIRRQALNFQKTAANAVQEGGSSYNNLTSLIHYLKQFRDRKS

SEQ ID NO: 230000 - protein, 113 aa, Glycine max
  Coding DNA Sequence Number=SeqID_113222
MHYFQLISNAIYYLQGSCPQDTQLTQRHPTGPWGFQLWLRASINPTGCPYPPGKVMPSRHSFTECLSPPTRSLGPALTELSSRSTAPPSRRRARQHSSMGTAGSGQQTHRHHL

SEQ ID NO: 230001 - protein, 359 aa, Glycine max
  Coding DNA Sequence Number=SeqID_113223
  Homolog annotation: Hit_ID=Q5KS41; Match level="QueryCoverage=96%, HitCoverage=74%, E-value=1e-33, Identity=27%"; Hit description =FOLDED PETALS
  Pfam annotation: Domain name=DUF1298; Domain location=197-351; Score =31.4; E_value=5.8e-12; Accession=PF06974.4; Description=Protein of unknown function (DUF1298)
MEQLPLDKPLWEMHIFKYPTSNAAGTVIFKLHHALGDGYSFMTTLLSCVQNAENPSVPIKFPSSRSVESKSTKIMPKLLPQTVSMMFKSAFDFGWSLLKDSLIPDDQTPIRSGHKDVGFRPMSVTDVSLSLGNIKEVKDKLKVSVNDVLVGVIFLGIQLYMSAKNHKSSRAESTALVLLNTRKIRAYKSAEMMDHTNSEAPWGNRFHFMHVPMPMLSDTNYLNPLEYVLEANKNINRKRNSLAVPLTGVLLRLLNKIRGPQAATNYVYKILNNTSLSISHMVGPMEKVALANHPIKGLYFMTVGLSQSITVTITSYMGYLRVGFGVEEGFIDEYQLKSCFETSLEMILKAAKNVAKTRL

SEQ ID NO: 230002 - protein, 161 aa, Glycine max
  Coding DNA Sequence Number=SeqID_113224
  Gene Ontology: Mol. function=transcription regulator activity; Cellular component=nucleus; Biological process=regulation of transcription
MADHQQGDQPSSTKGIERRIGRELSRVDQIDEAINYIKNLETKVKMAQEKKESLILQRKRSRSGGSSSTSEAPKIEIHEVGSSLQIILTCGLDNQIIFSEIIRILQEENIVVKSVHSSSFAGNSMLNVVHAEIQQYSFLLETTAMSIEKLRRIVDMHGGNF

SEQ ID NO: 230003 - protein, 64 aa, Glycine max
  Coding DNA Sequence Number=SeqID_113225
MWSKVWLATLWTIWKQRNDVVFNGGQCCSVKMMELVKWYTGFTVEVASKRYACMYLGGHFIILK

SEQ ID NO: 230004 - protein, 62 aa, Glycine max
  Coding DNA Sequence Number=SeqID_113226
MANFLGLNKVNLGIKRMNGMLKINGYHSSYKAPNENKVEDEMVEGKSHSFQRGQLTKDVKGL

SEQ ID NO: 230005 - protein, 238 aa, Glycine max
  Coding DNA Sequence Number=SeqID_113227
  Gene Ontology: Mol. function=protein transporter activity; Cellular component=outer membrane-bounded periplasmic space; Biological process=protein transport
  Homolog annotation: Hit_ID=Q79AD1; Match level="QueryCoverage=65%, HitCoverage=62%, E-value=7e-63, Identity=84%"; Hit description=HasB protein
EHVGFAAAFRRARRCHALAPLPGAGAGAAPAGRGAALALARQGRAAVGAAAGGHGGDGRRTAGPGRGKTTAGRKDAAASAARPNIAVAPKQKKPPKPVKNPPLPRTPPQEKTIAPPKVQEQSVGAPPPGRADKTAAPQTRLTPYAQAGVDNWRSRISGRLNRFKRYPKDALRLKRQGVGQAGPCAGGDAGQQRRAAVAGSRNPGAGQARFAAAYAAGGCLRQRHGGIDVADRFQFARR

SEQ ID NO: 230006 - protein, 421 aa, Glycine max
  Coding DNA Sequence Number=SeqID_113228
  Homolog annotation: Hit_ID=Q57H85; Match level="QueryCoverage=12%, HitCoverage=100%, E-value=4e-14, Identity=61%"; Hit description =ORF16-lacZ fusion protein
  Subcellular localization annotation: CTP_CleavageSite=68; ConfidenceScore=5.21e-01
FCFTPLAGVLFAFPSRYWFTIGQSGVFSLGGWSPHIQTGYHVSRPTRRTHSSCIFVYGAVTRSWAAPRSLAATGGISVDFFSSGYLDVSVPPVRLVNLCIQLTIMHKCIGFPHSDIDGCSGSYHLTVAFRRLARPSSPLTARASTVLFRIVKEQYLKHDVTGGVLTARRRGHKVSRLRSRPARKEVIQPQVPLRLPCYDFTPVMNHKVVIALPKVKLPTSFATHSHGVTGDSNPDYDILYEGHDDLTSSPPSSSLSLAVSFEFPAGPLATKDKGTKASLLSSLDVKSGRLNALAPEATPQGHNLQVDIVYGVDYQVFVQGAAFATGIPPDLYAFHRYTWNSTPLYKTLACQFRMQFPVIPINACTLRITAAAGTELAGASSAGNACAHCAIFPTAASRRSLDRVSVPVWLVILSDQLGIVA

SEQ ID NO: 230007 - protein, 192 aa, Glycine max
  Coding DNA Sequence Number=SeqID_113229
  Gene Ontology: Mol. function=oxygen transporter activity; Biological process=oxygen transport
  Homolog annotation: Hit_ID=Q5PFF2; Match level="QueryCoverage=99%, HitCoverage=85%, E-value=5e-39, Identity=55%"; Hit description =Hypothetical protein yfiH
MGFPQPRRARRGRGGSRDAQSSARGRATCATGDAAVAGAGARPDGGASAGGCVPAASRCGDNAGKWRAMMAAKLPRHMPAGAGCVMGCWSRRWHSFTARRARFMPGSVRRLVRRHLKWGLRCAVRSWRRMPLPMRLFARPVRNILPISGCWQPSVCRPLACVLSRLMRAAPIRKAPIFSPSDATESPGVWQL

SEQ ID NO: 230008 - protein, 158 aa, Glycine max
  Coding DNA Sequence Number=SeqID_113230
  Gene Ontology: Mol. function=transferase activity, transferring glycosyl groups; Cellular component=integral to membrane; Biological process=metabolic process
  Homolog annotation: Hit_ID=Q7XZD0; Match level="QueryCoverage=98%, HitCoverage=31%, E-value=4e-60, Identity=73%"; Hit description =Isoflavonoid glucosyltransferase
GFEERNAEKGMIIKGWAPQVVILGHPAIGAFLTHCGWNSTVEAVSAGVPMITWPVHDEQFYNEKLITEVSGIGVEVGAKEWSILGFGERKHLVPRNSIEKAVRRLMDGGDEALAIRRRTNHYSIMAARAVQEGGSSHTNFKALIHHLKLFRDRKSLHQ

SEQ ID NO: 230009 - protein, 46 aa, Glycine max
  Coding DNA Sequence Number=SeqID_113231
MVSRDSIQRLMDDSDEAHNIRSRSKGKTGSSGRTKKWICGGVLPSE

SEQ ID NO: 230010 - protein, 1303 aa, Glycine max
  Coding DNA Sequence Number=SeqID_113232
  Homolog annotation: Hit_ID=Q8LGK0; Match level="QueryCoverage=38%, HitCoverage=83%, E-value=0.0, Identity=70%"; Hit description=F-box protein family, AtFBL4
  Pfam annotation: Domain name=Adap_comp_sub; Domain location=1037 -1257; Score=62.0; E_value=1.9e-15; Accession=PF00928.11; Description= Adaptor complexes medium subunit family
  Pfam annotation: Domain name=LRR_1; Domain location=204-225; Score =6.5; E_value=18; Accession=PF00560.23; Description=Leucine Rich Repeat
  Pfam annotation: Domain name=LRR_1; Domain location=250-272; Score =4.7; E_value=37; Accession=PF00560.23; Description=Leucine Rich Repeat
  Pfam annotation: Domain name=LRR_1; Domain location=275-306; Score =4.0; E_value=51; Accession=PF00560.23; Description=Leucine Rich Repeat
  Pfam annotation: Domain name=LRR_1; Domain location=404-428; Score =0.3; E_value=2.4e+02; Accession=PF00560.23; Description=Leucine Rich Repeat
  Pfam annotation: Domain name=LRR_1; Domain location=430-453; Score =8.2; E_value=8.2; Accession=PF00560.23; Description=Leucine Rich Repeat
  Pfam annotation: Domain name=LRR_1; Domain location=482-509; Score =7.1; E_value=13; Accession=PF00560.23; Description=Leucine Rich Repeat
  Pfam annotation: Domain name=LRR_1; Domain location=534-558; Score =0.6; E_value=2.2e+02; Accession=PF00560.23; Description=Leucine Rich Repeat
  Pfam annotation: Domain name=LRR_1; Domain location=559-586; Score =9.2; E_value=5.4; Accession=PF00560.23; Description=Leucine Rich Repeat
  Pfam annotation: Domain name=LRR_1; Domain location=611-634; Score =5.9; E_value=22; Accession=PF00560.23; Description=Leucine Rich Repeat
  Pfam module annotation: Pfam domain module=Adap_comp_sub::LRR_1::LRR _1::LRR_1::LRR_1::LRR_1::LRR_1::LRR_1::LRR_1::LRR_1; Domain location =1037-1257::204-225::250-272::275-306::404-428::430-453::482-509::534- 558::559-586::611-634
MVNMGIFKILKKDHELLLNMVRMWTKNGLCTKTRKEKQNVQKEKKIPTPLPDNHHLLCVPLGSPFLLWNHPYELLTRCFHPVEFNKVVNNGGFMNLLKVNLGMLSLLATSCTHGGVAVDEKDRRENEGRKGERNPPATLAPSFAAAGSASSAEPEQPSESAPPTSSSTVSPPVSPISEISTSTNAFPFPSTSSGKRRPNDEEGDLDSLCLSDAGLSALGEGFPKLHKLGLIWCSNVSSDGLTSLARKCTSLKALDLQGCYVGDQGLAAVGQCCKQLEDLNLRFCEGLTDTGLVELALGVGKSLKSLGVAACAKITDISMEAVGSHCRSLETLSLDSECIHNKGLLAVAQGCPTLKVLKLQCINVTDDALQAVGANCLSLELLALYSFQRFTDKGLRGIGNGCKKLKNLTLIDCYFISDKGLEAIANGCKELTHLEVNGCHNIGTLGLEYIGRSCQYLTELALLYCHRIGDVSLLEVGKGCKFLQVLHLVDCSSIGDDAMCSIANGCRNLKKLHIRRCYKIGNKGLIAVGKHCKSLTDLSIRFCDRVGDGALTAIAEGCSLHYLNVSGCHQIGDAGVIAIARGCPQLCYLDVSVLQNLGDMAMAELGEHCTLLKEIVLSHCRQITDVGLTHLVKSCTLLESCQMVYCSGITSAGVATVVSSCPNMKKVLVEKWKVSQRTKRRAGSVIACLDLCMVSVMSSLSVAPVTPPIPAPLPHPDTAVYQMTYMSKGAVRYGGMIGVAAMPSGCSIRAIWILNNLDGVVFSRFPVVEKRWRAACNSNAHNDTHQIFSSLPTDSDLADAFLDRKHREGSARGFGIRKSNSTLGSDSWVDDPITRHIIGLYISREGEENKNLLWPLILHTKGLYSILILPLVEPIHLNAYARLCKRPDCGAALGMDDGLSSLLLDLPSVTGAFMIAHAIGDIITGDTVEPEVIVSAAPSVGGLFDSLTGSIGISSRAKPVAPPVASSSPSSAAVPGSVTADAPKMGSRLLDKDALRTFISSSMPFGTPLDLNYSNIITIKTNGFSATDLPPADQKQPAWKPYLYKGKQRMLFTIHEIIHAALYDRDEIPDTISVSGQINCRADLEGLPDVSFHLAGLNTANLEVLSYHPCAQVSDQGLDKQGVMFSPPLGNFVLMRYQAAYALGPPIKGFYQLSMVSEDKGAFLFKLHLMEGYKAPLTMEFCTVTMPFPRRRIVSLDGTPSVGTVSTSEHSVEWKIVTSGRGLTGKSIEVTFPGTVKFAPWQTQRLSSSRSSFGITADEDSDNEAENASNMVNEEHLMGKMNKGLPPVDLEEPFCWQAYNYAK

SEQ ID NO: 230011 - protein, 107 aa, Glycine max
  Coding DNA Sequence Number=SeqID_113233
MTQRMTSLGSRERVTWREGRGRGYEEGGLRSKRASWKTTTKRKDSMSFWEKVGESMSSRKWVWQCRQRKGEGGSLRDTLMSHSWHQLVVGPAIDGGGGGGGGNGKKH

SEQ ID NO: 230012 - protein, 118 aa, Glycine max
  Coding DNA Sequence Number=SeqID_113234
MKHILSTNLGKLVSTGEILTNSDGCYSFPQDIKTPQLLLEHSCLGVDVTDLYGDSLAIIVRDDVETHKPVCKKKKNYKIEEVEEKNCEHEEEKEPRESRKTEEMVGKGHERRRMWLRG

SEQ ID NO: 230013 - protein, 237 aa, Glycine max
  Coding DNA Sequence Number=SeqID_113235
  Gene Ontology: Mol. function=transferase activity, transferring glycosyl groups; Cellular component=integral to membrane; Biological process=metabolic process
  Homolog annotation: Hit_ID=Q7XZD0; Match level="QueryCoverage=96%, HitCoverage=47%, E-value=1e-88, Identity=68%"; Hit description =Isoflavonoid glucosyltransferase
MGATYLGERPLKLHFIPYPAPGHMIPLCDISTLFASSGHEVTIITTPSNAQILHKSIPPHRRLHLHTVPFPSNEVGLPEGIENLSAVSDLVNAAKVHQATALLRCPIEQFVEHHLPDCIIADFLFPWVDDVANKLNIPRLAFNGFSLFAVCAIDKLQSNNTNSEEYSSFIPNLPHPITLNATPPKILTEFMKPLLETELKSYGLIVNDFAELGGEEYIEHYEQTTGHKAWHIGPASL

SEQ ID NO: 230014 - protein, 458 aa, Glycine max
  Coding DNA Sequence Number=SeqID_113236
  Gene Ontology: Mol. function=nucleic acid binding; Cellular component= intracellular; Biological process=DNA integration
  Homolog annotation: Hit_ID=Q53NL0; Match level="QueryCoverage=54%, HitCoverage=27%, E-value=2e-62, Identity=47%"; Hit description =Integrase core domain, putative
MSQLSLRILALKKKLRYTNDGKDLTVFPLCSSRRASLLALAITLMSKLSSMRLIGDAGRLAQEISEDALIVTQDKGKMERKENNHIPHTAKIKKKSREPNEGEWFIYSGNRMHSHIAAIGTFRIYNPNEKKLDPRIISAYFIGYVERSKGDLTQGIGVEKNQCDEAVPTLSYKLVFFGDTHQNRVTQAPHQVDSILEDPFEQHQTQNFEQPIEQHQTQDVEQLVEQQPEGVDVTLRRLTRIKKHALPSDYQVHLQESQYDFGVENDPKSFLQAINSCNSKLWYDAMKDELESMENNKVWDLVELPNGIKPTGCKWVFKTKKNSLGKIERHKARLVAKGFAQREGIEYRETFSPVSMKDSLRIIMTLVAHFDLELHQMDVKMTFLNGDLEEEVYMTQLEGSLDLSQKAYNNKVLERFWMKDCLPNMAPIVKGDRFNLNQCSKNELEREQMRNIPYVSIV

SEQ ID NO: 230015 - protein, 594 aa, Glycine max
  Coding DNA Sequence Number=SeqID_113237
  Gene Ontology: Mol. function=protein serine/threonine kinase activity; Cellular component=nucleus; Biological process=protein amino acid phosphorylation
  Homolog annotation: Hit_ID=Q9LV37; Match level="QueryCoverage=86%, HitCoverage=100%, E-value=0.0, Identity=76%"; Hit description =Mitogen-activated protein kinase 9
  Pfam annotation: Domain name=Kdo; Domain location=101-292; Score= -83.9; E_value=0.051; Accession=PF06293.4; Description=Lipopolysacchar ide kinase (Kdo)
  Pfam annotation: Domain name=Pkinase; Domain location=105-396; Score =298.9; E_value=9.3e-87; Accession=PF00069.15; Description=Protein kinase domain
  Pfam annotation: Domain name=Pkinase_Tyr; Domain location=105-394; Score=28.4; E_value=3.3e-14; Accession=PF07714.7; Description =Protein tyrosine kinase
  Pfam module annotation: Pfam domain module=Kdo::Pkinase::Pkinase_Tyr; Domain location=101-292::105-396::105-394
MGGVGGTLVDGIRSFFHRCNSINSHIHHHKNKKKNKNKNNNNINNIVFVRHLRAQLANVPTQQTPSFNLLKVPKRSHFKSPSMDRNKKGALEVEFFTEYGEASRYEIHEVIGKGSYGVVCSAVDTHTGEKVAIKKINDVFEHVSDATRILREIKLLRLLRHPDVVKIKHIMLPPSRREFRDVYVVFELMESDLHQVIRANDDLSPEHYQFFLYQLLRGLKFIHAANVFHRDLKPKNILANADCKLKLCDFGLARVSFNEDPSAIFWTDYVATRWYRAPELCGSFFSKYTPAIDIWSIGCIFAEMLSGKPLFPGKNVVHQLDLITDLLGTPPAETISRIRNEKARRYLASMPKKQPIPFSKKFPNADPLGLNLLERLLAFDPKDRPAAEEALRDPYFHGLSNVDREPSSTQPISKLEFEFERRKLAKDDVRELIYREILEYHPRMLEEYLRCGEQTSFMYPSGVDRFKRQFAHLEEHYGKGERSTPLLRHHASLPRERVPAPKDENNQNNDVENPTGANLQSPPGSDVTDSGNTDAQNGPSRPKCSARSLLKSASISGSKSIDVKQSKVSEEEPLREVNNEILDELTQKVASLHS

SEQ ID NO: 230016 - protein, 224 aa, Glycine max
  Coding DNA Sequence Number=SeqID_113238
  Homolog annotation: Hit_ID=Q1S600; Match level="QueryCoverage=75%, HitCoverage=39%, E-value=1e-35, Identity=50%"; Hit description=IQ calmodulin-binding region
  Pfam annotation: Domain name=IQ; Domain location=114-134; Score=17.3; E_value=0.057; Accession=PF00612.17; Description=IQ calmodulin -binding motif
  Pfam annotation: Domain name=IQ; Domain location=92-112; Score=14.4; E_value=0.41; Accession=PF00612.17; Description=IQ calmodulin -binding motif
  Pfam module annotation: Pfam domain module=IQ::IQ; Domain location =114-134::92-112
MALKARSMLCNRRVLSNSSVALLKELWLEVSKLHHQGKPVVEFNDGNLPNEFDNDGTQPIKDENGHRNIETHYLPSTSQQAHDAHNHQMREEWAAIHIQITFQGFLARRALQALKGVVRLQALVRGYAVRKQATSFGEGSGSCSGKACSHVIGNSSNTTETKQKLANKLPMHPICVQNVFMKEGWCDSIGSVEEIQAKILKRQEAAAKRERAMAYALAHQVNLQ

SEQ ID NO: 230017 - protein, 530 aa, Glycine max
  Coding DNA Sequence Number=SeqID_113239
  Gene Ontology: Mol. function=zinc ion binding; Cellular component =intracellular
  Homolog annotation: Hit_ID=Q1RSD4; Match level="QueryCoverage=87%, HitCoverage=87%, E-value=1e-139, Identity=67%"; Hit description=Zinc finger, RanBP2-type
  Pfam annotation: Domain name=zf-RanBP; Domain location=342-371; Score= 37.6; E_value=4.2e-08; Accession=PF00641.9; Description=Zn-finger in Ran binding protein and others
  Pfam annotation: Domain name=zf-RanBP; Domain location=381-410; Score= 23.1; E_value=0.00097; Accession=PF00641.9; Description=Zn-finger in Ran binding protein and others
  Pfam annotation: Domain name=zf-RanBP; Domain location=421-450; Score= 38.1; E_value=3e-08; Accession=PF00641.9; Description=Zn-finger in Ran binding protein and others
  Pfam annotation: Domain name=zf-RanBP; Domain location=452-481; Score= 37.9; E_value=3.4e-08; Accession=PF00641.9; Description=Zn-finger in Ran binding protein and others
  Pfam annotation: Domain name=zf-RanBP; Domain location=485-514; Score= 33.0; E_value=1.1e-06; Accession=PF00641.9; Description=Zn-finger in Ran binding protein and others
  Pfam module annotation: Pfam domain module=zf-RanBP::zf-RanBP::zf -RanBP::zf-RanBP::zf-RanBP; Domain location=342-371::381-410::421 -450::452-481::485-514
  Subcellular localization annotation: CTP_CleavageSite=56; ConfidenceScore=5.76e-01
MSSSKLTLYGIGTALFRTRRTAPVTVTPHSPFLFFKPIPFPPCFLRPDSSSSSSFSAAAAAAAETLPSVDHPWPEWVSFVDRLNTKGYLPKTSSSDDTVSLYANMNSLKDACLSFARDRYDLFKINDEKGICISEVIWYQSLPSDCLLDLWCHPLSDHLQMSSLAKFTFKMSSARHERGVLEIPCQLVMRLNLLPTNDIQAVVEGGCPNLLRKAVNSAKRLRAHLQLDEGDVCGACYLRSSCDRAYVILKDFETDARTVDIVRILLFYALDPLVLSGGDKPPGREVIESSVRKLLSQLIELSESPAPAPAPARSKPTAQDGVVEGQSLSVTTNQLFKDVEMKKGDWMCPKCNFMNFSRNTQCLNCKEDKPKDINPFTVQMKPGDWTCPECNYLNFARNRLCLECKIEGPAKEANTIEVERKKGDWTCPQCGFMNYARNTKCLRCPETRPKKHPGDWNCPGCGFMNFASKMKCLHCQEPNPSSKKYSGDWSCPKCDFYNYARNMACLKCNAERPKEQPTVDYEDHEWRRSN

SEQ ID NO: 230018 - protein, 723 aa, Glycine max
  Coding DNA Sequence Number=SeqID_113240
  Gene Ontology: Mol. function=nucleic acid binding; Cellular component= intracellular; Biological process=DNA integration
  Homolog annotation: Hit_ID=Q1T010; Match level="QueryCoverage=83%, HitCoverage=53%, E-value=1e-163, Identity=50%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=233-396; Score =150.7; E_value=3.9e-42; Accession=PF00665.16; Description=Integrase core domain
  Pfam module annotation: Pfam domain module=RVT_2::rve; Domain location=555-723::233-396
MADSKIAEKVLETLTLSFDHIVVAIEESKDLESITVEHFKPEPATSLEVVVAGKKEEEEDIKEAEVAIEMQKHMVQLPNIIILEAIQMISVIIPILEEATLSEVEVIGNNNAHSKYKKNDQAHLAQEEDGSDLDQVLLMVTTSSKEDCFSWYLDTGCSNHMIGNRDWLVDFNPNATISVRFQIIAPSLQKLLEKGFTMTMQANHVEIFDDKQRLVLKAPLSKNKTFKTKAPQRAKQPLGIVHSDVCGPFDAPSLGGNRYFPAFVDEFTKKIWIYLLKEKGAMFSLFVKSCTSVERQSELKLKILKTDGGGEYNSKEFKEFYEAKGIEHEVTTPYTPQHNGLAERRNRTLLDMGRCMLKGKRLPNCYWGEVVTTTACVLNRCPTKRLQFVTPKEAWTEDKPMVNHLRIFWSLSYKHIPYERRRKLDDKSEALILVGYHPTGAYKLYNPLKQQVVINRDVMVDETTAWKWENESKIPNSYILEDNPRTKNVNPAGSMQPPVRRSHRTRFPSTRLADYELYSNSSISDDGEMVHFAFMVDTEPVHWKQALDIIEWKAAMKEELDAVEKNRTWELVDLPYNIHPIDVRWVFKVKLKPDGSIANHKAKLIAKGFLHKQGIDYTKVYAPVARMETIRLVIVVTSSRNWTICRLDVKSGFLNGPLEEEVYILQPPGFEIKGKEHKAYKLLKSLYGLKQAPQAWNRLIDNFLNKQGFVKCTIEFGVYVKEI

SEQ ID NO: 230019 - protein, 106 aa, Glycine max
  Coding DNA Sequence Number=SeqID_113241
MVATDTPVVMTVSFIKEHIDLGIHDIMYQVSKQLVDIAKPMMAARTLSMPQHLCIPGIALWACHSARLKTQTKESNMHASQWASKPIMRKEADWWDPLVGCTTDQP

SEQ ID NO: 230020 - protein, 511 aa, Glycine max
  Coding DNA Sequence Number=SeqID_113242
  Gene Ontology: Mol. function=protein disulfide oxidoreductase activity; Cellular component=integral to membrane; Biological process=prostaglandin biosynthetic process
  Homolog annotation: Hit_ID=Q9FHX0; Match level="QueryCoverage=49%, HitCoverage=69%, E-value=1e-71, Identity=58%"; Hit description =Similarity to glutathione-S-transferase/glutaredoxin
  Pfam annotation: Domain name=DUF836; Domain location=142-214; Score= -1.4; E_value=0.012; Accession=PF05768.4; Description=Protein of unknown function (DUF836)
  Pfam annotation: Domain name=GST_C; Domain location=303-395; Score =9.9; E_value=0.022; Accession=PF00043.15; Description=Glutathione S -transferase, C-terminal domain
  Pfam annotation: Domain name=GST_N; Domain location=141-211; Score =14.1; E_value=0.039; Accession=PF02798.10; Description=Glutathione S- transferase, N-terminal domain
  Pfam annotation: Domain name=Glutaredoxin; Domain location=143-199; Score=43.5; E_value=7.4e-10; Accession=PF00462.14; Description =Glutaredoxin
  Pfam module annotation: Pfam domain module=DUF836::GST_C::GST _N::Glutaredoxin; Domain location=142-214::303-395::141-211::143-199
  Subcellular localization annotation: CTP_CleavageSite=53; ConfidenceScore=5.10e-01
MKITQISPPNKIATLPTPNLRSVNACNANPQILIEGQGCASSEGCTSSRSWCLAMVRHDAMRRVPSILFRTLTSPRVATSFSVPNRLLQAALYRSAAARSHRRRFSSLLGPLAAASLGVAGALVSQEVLAKEPPPPEALPNDVVLYQFEACPFCNKVKAFLDYYDIPYKIVEVNPLSKKEIKWSEYQKVPILMVDGEQLNDSSVIIDKLGHKILSKKIVDSTSEDEETKWRRLKEMKAGDTKKVEKLEQVAKHMFQDLVGMLKLHMNDNDKFSKDEHSLLQEWRLVKEEKDKHCLLEGYLEKFSVKYAGAAAMYFVSKKLKKKYNITDERAALYEAAETWVDALDGREFLGGSKPNLADLAVFGVLKPIRYLRSGKDMVEHTRIGEWYARMESAGQSSSKHHCPVIDGSEIIALKSSIRALNTRTLIYETQNILEVEEELVVTEDWLGRSVVFVVSIGKRLATDERGLQEESNGYYVGNAMILMSSTMSPSVVVSTGEDVCRNLALEIWDM

SEQ ID NO: 230021 - protein, 177 aa, Glycine max
  Coding DNA Sequence Number=SeqID_113243
  Gene Ontology: Mol. function=protein serine/threonine kinase activity; Cellular component=integral to membrane; Biological process=protein amino acid phosphorylation
  Homolog annotation: Hit_ID=O49445; Match level="QueryCoverage=83%, HitCoverage=26%, E-value=8e-26, Identity=37%"; Hit description =Receptor protein kinase like protein
MNARLGDFGLARMHDHQGQVVSTTRVIGTVGYIAPEVIRSGTASTMSDVFGFGILVLEVVCGRRPIEEHKPGLIEWLMSLMMQGQLHNPGIRPTMRQAVKILEVEIDSTESDEENIEMSFLGKIKSAAMWSRAECALPYRGYPSFDEVKMFSFNSRTSGSGSSTFPGSESEITRENR

SEQ ID NO: 230022 - protein, 100 aa, Glycine max
  Coding DNA Sequence Number=SeqID_113244
MVHQGLNSDALIPCHETTFQKLKLLGEKKDLLFWRAMVGMKYLSAPIMCVYVKARTMGDALYEAAKIWVDTESQGVPWRNSSVGVALSFRDTWRRKMEFL

SEQ ID NO: 230023 - protein, 659 aa, Glycine max
  Coding DNA Sequence Number=SeqID_113245
  Gene Ontology: Mol. function=oxidoreductase activity; Biological process=electron transport
  Homolog annotation: Hit_ID=Q012U1; Match level="QueryCoverage=83%, HitCoverage=89%, E-value=1e-99, Identity=39%"; Hit description =Homology to unknown gene
  Pfam annotation: Domain name=DAO; Domain location=220-434; Score= -20.4; E_value=0.00011; Accession=PF01266.14; Description=FAD dependent oxidoreductase
  Pfam annotation: Domain name=FAD_binding_2; Domain location=220-633; Score=-136.5; E_value=0.021; Accession=PF00890.14; Description=FAD binding domain
  Pfam annotation: Domain name=HI0933_like; Domain location=219-632; Score=-249.4; E_value=0.0026; Accession=PF03486.5; Description =HI0933-like protein
  Pfam annotation: Domain name=Pyr_redox; Domain location=220-302; Score=4.3; E_value=0.0066; Accession=PF00070.17; Description =Pyridine nucleotide-disulphide oxidor
  Pfam annotation: Domain name=Pyr_redox_2; Domain location=220-617; Score=-2.2; E_value=0.00036; Accession=PF07992.4; Description =Pyridine nucleotide-disulphide oxidor
  Pfam module annotation: Pfam domain module=DAO::FAD_binding_2::HI0933_ like::Pyr_redox::Pyr_redox_2; Domain location=220-434::220-633::219 -632::220-302::220-617
MFLLPSPSSSYLMKHQSHNALWFRGLPYGSGKLIRHIRCAKRTGKQRYPSEKKRLRTKQKELLSDSKEKSKFEGTWRLFKLAVPLDQDPGKDSLHVSDALLQQIATVLKFPVASLLPPEAFTIVRKSFDARKKLKEPKFVHTVDMDVQKLISLEPRCWDFISRLEPKVGLVERLHDERDFGDLASIIHDSKENKVALKGENGHSIFSTEFYKNQATRKPNIAVVGSGPSGLFAALVLAELGADVTLIERGQPVEKRGRDIGALVVRRILELESTWSDGKLVTRIGRNSGSVLAVMRTLVHFGAPKQILIDGKPHLGTDRLVPLLRNFRQHLQNLGVTIKFGTRVDDLVIKDRHVLGVMVSESADKLHLTSQKMEYDGVILAVGHSARDIYEVLLSHNVELIPKDFAVGLRIEHPQELINSIQYAELASEVCHGRGKIPVADYKVANYIDKEDFNDVSDSGVTNRSCYSFCMCPGGQVVLTSTSPSEICINGMSFSRRASKWANAALVVTVTTKDFEALNYYGPLAGVKFQREFEKRAAMMGGGNFTVPVQTVTDFLENKLSDSLTFQLPGFICNDALLHGVETRTSSPIQIPRNGDTYECTSVKGLYPVGEGAGYAGGIISAAVDGMHAGFAVAKKFSLFHGDVESVLGKAQNVGVVKY

SEQ ID NO: 230024 - protein, 279 aa, Glycine max
  Coding DNA Sequence Number=SeqID_113246
  Gene Ontology: Mol. function=protein serine/threonine kinase activity; Cellular component=transcription elongation factor complex b; Biological process=protein amino acid phosphorylation
  Homolog annotation: Hit_ID=Q9LDC1; Match level="QueryCoverage=51%, HitCoverage=24%, E-value=9e-58, Identity=73%"; Hit description=CRK1 protein
  Pfam annotation: Domain name=Pkinase; Domain location=136-278; Score=- 83.5; E_value=0.0014; Accession=PF00069.15; Description=Protein kinase domain
  Pfam annotation: Domain name=Pkinase_Tyr; Domain location=136-270; Score=-144.7; E_value=0.0014; Accession=PF07714.7; Description =Protein tyrosine kinase
  Pfam module annotation: Pfam domain module=Pkinase::Pkinase_Tyr; Domain location=136-278::136-270
MGCIASKSAAVEDSREGVAREFTSSSKRAASKMKASVLNSEKRIDGVWGKDKILDGADMKVSLIDKGSSGSMRSSNNKNGKKKKEKPELAVLDHPGLGRVPKGLEGEQVAAGWPTWFSSVAGEAVQGWIPRKADTFERFHKIGQGTYSTVYKARDLTDQKIVALKRVRFDNCDAESVKFMAREILVLRRLDHPNVIKLEGLITSKTSRSLYLVFEYMEHDLTGLASSPSIKFSEPQYKTIHGSSHNNLSFRDNWSLTWYQSFLNKVVRNLIFAAHILLN

SEQ ID NO: 230025 - protein, 417 aa, Glycine max
  Coding DNA Sequence Number=SeqID_113247
  Gene Ontology: Mol. function=transition metal ion binding; Cellular component=nucleus; Biological process=protein amino acid phosphorylation
  Pfam annotation: Domain name=Transposase_21; Domain location=158-297; Score=32.3; E_value=2.3e-17; Accession=PF02992.5; Description =Transposase family tnp2
  Pfam annotation: Domain name=Whi5; Domain location=58-82; Score=9.9; E_value=0.077; Accession=PF08528.2; Description=Whi5 like
  Pfam module annotation: Pfam domain module=Transposase_21::Whi5; Domain location=158-297::58-82
QMGSQTKHVDVEIGNRLKDMIHDLGQESIRQAHALLYDILESDSKKSLYPWYKKSLTLLSMVLSLVNVKARYGWSDKSFTQLLKVVQSILPEENTLSKGYYEAKKILCSMGIEYKKIHACPNDYILYRDDFEEIHKCPRCGVSRYKSKDDGKCSDDTKDLTWHVDRRKCDGMLRHPVDSSQWKKINHLYIDFRKEARNLRLGLAIDGMNPFGSLSTKHSSWPIFLVIYNLLPWLLKKVMDEGVDVFDGNRNETFKFPAMKNVSDSVIDMLLNIQGKTKDDLNTCQDLAEMGIRDQLHPRQMATPLSSPPLESTPSPFMLKRIRKATQLRSLSARPVGVEIPVVHVDLTTEKALADDKDDGDDTVYEKYEHPDRVRTIGVSVKIKQYFGPTSAGSRTSMLIIPEELDRLKQNIKDELT

SEQ ID NO: 230026 - protein, 87 aa, Glycine max
  Coding DNA Sequence Number=SeqID_113248
MTKEEGLVPIRDAQALDYSPESFETRATASELSEYGGDHALSAGFVLSAPLGFLVGLVLAKLELTTKREDALGLSCFQKEEEFKEEE

SEQ ID NO: 230027 - protein, 353 aa, Glycine max
  Coding DNA Sequence Number=SeqID_113249
  Gene Ontology: Mol. function=adenosylmethionine decarboxylase activity; Cellular component=cellular_component; Biological process =spermidine biosynthetic process
  Homolog annotation: Hit_ID=Q75KG4; Match level="QueryCoverage=98%, HitCoverage=97%, E-value=1e-82, Identity=47%"; Hit description =Putative S-adenosylmethionine decarboxylase
  Pfam annotation: Domain name=SAM_decarbox; Domain location=1-350; Score=369.6; E_value=4.8e-108; Accession=PF01536.7; Description =Adenosylmethionine decarboxylase
MAVSGFEGFEKRLELHFFGDDPAMFPLGLRKLEFDSIEQVLEAVQCTVVSAVGNSYFDAYVLSESSLFVYPTKIIIKTCGTTQLLKSILPLIHYADHHLGLTLSSCRYTRGSFIFPKAQPFPHTSFKDEVTYLQDTIPSSLCFRKASIMPSKSSSHSWHVFTANDNTHTHTHSPMPYDHDNELLFTMEICMTELDPILARKFFRRPDDEKSGDSAGKEMTELTGINEINPDALICDFAFDPCGYSMNGMDGDWYSTIHVTPEDGFSYASFECVGSVDNGNIGHVLMKVVQIFRPGTMSISTTCNGFSSNDVMWTEMASAVEPLGFKCRSWAMDQFPNAGTVVFQTFTSRRKSV

SEQ ID NO: 230028 - protein, 355 aa, Glycine max
  Coding DNA Sequence Number=SeqID_113250
  Gene Ontology: Mol. function=protein serine/threonine phosphatase activity; Cellular component=protein serine/threonine phosphatase complex; Biological process=protein amino acid dephosphorylation
  Homolog annotation: Hit_ID=Q6K3D4; Match level="QueryCoverage=88%, HitCoverage=27%, E-value=1e-104, Identity=64%"; Hit description =Putative PKG-Ib
  Pfam annotation: Domain name=PP2C; Domain location=54-351; Score =101.3; E_value=2.8e-27; Accession=PF00481.12; Description=Protein phosphatase 2C
MGCVHGKCCCGDSSSSDDGSRDYRELDFINGHRKNVLAQRSLKHVPVPSHNFILEYTFLTQRGYYPDSPDKENQDSFCITTQLQSNPNVHFFGVYDGHGQFGSQCSNFVKDRLVEKLSNDPALLEDPAQAYNSAFVATNQELRSTSEIDDSMSGTTAITVLVIGDTLYVANVGDSRAVLAVKDGNHIVAQDLSSDQTPFRRDEYQRVKLCGARVLSVDQVEGLKDPDIQHWGDEESWGGDPPRLWVPNGMYPGTAFTRSIGDSLAETVGVIAIPEVKAVQLTPNHLFFVVASDGIFEFLTSQTVVDMNLSSTSVDGNNDVICYRQQAIWILMMHVQLLQRSRINYGWNLRTEQMI

SEQ ID NO: 230029 - protein, 221 aa, Glycine max
  Coding DNA Sequence Number=SeqID_113251
MPSLLITIARKVRSFLFWPMPMTHLTGDARRAAQGLSVTHLLFMYGWSCTSFIMKVDHLSPARSPHMHREREGKLRATLELGYPMRGAPSEEIITHFIARGFSDPNARILQGVHKAWGTMQIKDKELRGSNNGIVGGYHKWLKAWTQELDWVPKLKTSNEEEAETPEESEEVQALKVKLERAQAVKEKFKTMTIKVWKECDELRDINVATTETLEWETKRA

SEQ ID NO: 230030 - protein, 720 aa, Glycine max
  Coding DNA Sequence Number=SeqID_113252
  Gene Ontology: Mol. function=metal ion binding
  Homolog annotation: Hit_ID=Q9ZT97; Match level="QueryCoverage=94%, HitCoverage=69%, E-value=2e-71, Identity=31%"; Hit description =Putative inhibitor of apoptosis
MSPSVSSQEKGSRNKRKFRADPPLGEPNKFIPAPQLECLSYEFSAEKFEITPGHRQVAACDLCGLSQDHSDGLKLGLGLYSPGTSEVGPSQSKDKPETDEINDADWSDLTEAQLEELVLTNLDIILKSAIKKIVACGYTEEVATKAILRPGICYGCKDTLSNIVDNTLAFLRNAQEIDTLREHYFEDLVQLEKYVLAELVCVLQEVRPFFSVGDAMWCLLICDMNVSHACAMDCNPLSSLGNDNTTSAGSSSQAEPQSKAETKCPELSLLSPSKSIPAGSHYSQSKKPFVTGIPVVNNLNSQIIGGTSEKEGASCGSECINKAFSAAGTSQSGLMEEKRGTVRKVHSGSTMRDYVLRHKSFHVEKKFRTYELKGSSRGGKVNGLSGLVLDKKLKSVSESSTINLKSASLQISKAMGIDTTQDNINVNFSSNAGTSTSTAFSPVDSSNAVCRSTNTSFAINAAHTIPLFSCPASLSATNTDLSLSLSSKIKPSTESVCSNNEAPNSSYMGIPYNNIKSPRQWIPQDGKDEMLLKLFPRVQELQNQLQEWTEWANQKVMQAACRLSKEKAELQTLRQEKEEVERLKKEKQSLEENTLKKLSEMENALCKVSGQVERANAAVRKLEVEKAALRKEMEAAKIHATETAASCQEVSRREKKAQIKFQSWEKQKSFFKEELTIEKQKLAQLLHELEQARVQQEQVEAFGLMVYSYDLIKSEVMTSE

SEQ ID NO: 230031 - protein, 72 aa, Glycine max
  Coding DNA Sequence Number=SeqID_113253
MELESSETCEGNGKTNTICRRLLSLEQQEVEGDKYRKRSIGTKTRSQRVDALLHHMLSAELCQNEPSSTQTS

SEQ ID NO: 230032 - protein, 204 aa, Glycine max
  Coding DNA Sequence Number=SeqID_113254
MVSVGLGKFYGTSLPRPRIYTDVKFNDRRVDPPTPVNGPLMSWAAEAHWSMGDLSFKRLRLQGKIEGNVERLCSQREKGQAQSPPPPPRSLLRGSKGASSPSLPPAPFVTKRRRNMDLIQEEEEQVKTPRSGVRKVASLENEGAEMTWLKTRSSRLVKGVEAVKKTVVEAAENSNRKTKKITSEAAEETVLELHPDWPSVCPIR

SEQ ID NO: 230033 - protein, 46 aa, Glycine max
  Coding DNA Sequence Number=SeqID_113255
MGKEETGPAMKAVLAHNRGWAPRITKKLRPMQNKKKDSQIGISIAS

SEQ ID NO: 230034 - protein, 42 aa, Glycine max
  Coding DNA Sequence Number=SeqID_113256
MAALPIMKYCLYSPTGSSRLISPFQFCLRVSQTQINGKGTGL

SEQ ID NO: 230035 - protein, 141 aa, Glycine max
  Coding DNA Sequence Number=SeqID_113257
  Gene Ontology: Mol. function=serine carboxypeptidase activity; Cellular component=cellulose and pectin-containing cell wall; Biological process=proteolysis
  Homolog annotation: Hit_ID=Q9SFB5; Match level="QueryCoverage=76%, HitCoverage=23%, E-value=1e-34, Identity=64%"; Hit description =Putative serine carboxypeptidase II
  Pfam annotation: Domain name=Peptidase_S10; Domain location=37-141; Score=-214.2; E_value=0.058; Accession=PF00450.12; Description =Serine carboxypeptidase
MGYPSRLYLVLLLSICGVVSLASPIEDQKKDRITQLPGQPKNVGFAQYSGYVTVNEQSGRSLFYWLVEAPVRRGPRSRSLVLWLNGGPGCSSIAYGASEEIGPFHIRPDGKTSPGAAVKLCLGDLLVMGSNPETASLHMQG

SEQ ID NO: 230036 - protein, 1138 aa, Glycine max
  Coding DNA Sequence Number=SeqID_113258
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q9ZT82; Match level="QueryCoverage=99%, HitCoverage=64%, E-value=0.0, Identity=71%"; Hit description =Putative glucan synthase component
  Pfam annotation: Domain name=Glucan_synthase; Domain location=242 -1017; Score=1209.2; E_value=0; Accession=PF02364.6; Description=1,3 -beta-glucan synthase component
MKLEFNQGEANKFSLIWNEIIMCFREEDIISDREVELLELPKNPWNVRVIRWPCFLLCNELLLALSQAKELVDAPDRRLWRKICKNEFRRCAVIETYDCIKHLLFQIIKPDSEEHSIVMVLFQEIDHSLEIGKFTKVFKTTTLPQLHNKLIKLIELLNREKVNSKQLVYTLQAIYEIVVRDFFKEKRNTEQLREDGLAPQNPSSSDVLLFENATQLPEAINENFYRQIRRLHTILTSRDSMQNIPVNLEARRRISFFTNSLFMNMPHAPQVEKMMAFSVLTPYYSEEVVYSKEQLRVGNEDGISTLYYLQTIYDDEWKNFMERMKREGMNNERDIWTDKLSDLRSWASYRGQTLSRTVRGMMYYYKALKLLAFLDSASEIETQEGARELVPLNQENSNGSNLERSPSPMTLSKASSSASLLFKGHEYGTALMKFTYVIACQIYGAQKERKDPHADEILYLMKNNEALRVAYVDEVPTGRDAKEYYSVLVKFDQQLDKEVEIYRVKLPGPIKLGEGKPENQNHAIIFTRGDAVQTIDMNQDNYFEEALKMRNLLEEYRHNYGLRKPTILGVRENIFTGSVSSLAWFMSAQETSFVTLGQRVLANPLKVRMHYGHPDVFDRFWFITRGGISKASRVINISEDIFAGFNCTLRGGNVTHHEYIQVGKGRDVGLNQISMFEAKVASGNGEQVLSRDVYRLGHRLDFFRMLSFFYTTVGFFFNTMMVVLTVYSFLWGRLLLALSGIEAAMESNSNNNKALSIILNQQFMVQIGLFTALPMIVENSLEQGFLQAVWDFLTMQLQLSSVFYTFSMGTRSHFFGRTILHGGAKYRATGRGFVVEHKSFAENYRLYARSHFVKAIELGLILTVYASHSTVATDTFVYIAMTFSSWFLVASWIMAPFVFNPSGFDWLKTVYDFEDFMNWIWNRQRVFAKAEQSWEKWWYEEQDHLKVTGFWGKLLEIILDLRFFIFQYGIVYQLGIAARSTSIVVYLLSWVYVFVVFGIYVVVAYAQNEYEAKHHIYYRLVQSMLIVIAILVIVALLKFTEFKFMDIFTSLVAFIPTGWGMILIAQVFRPCLQCTIVWNVVVSLARLYDILFGVIVMTPVALLSWLPGFQPMQTRILFNEAFSRGLRIFQIVTGKKSL

SEQ ID NO: 230037 - protein, 112 aa, Glycine max
  Coding DNA Sequence Number=SeqID_113259
MTWCYIGVWMQERPNKCYWRCMRDPLVRMLSYPNLIWGLSFVMIFFINGFLCFLKDEWQQNGERKRERRRHFKEKMSLEEAHHHRRPWIRARRKKEMNERRGREEHGILCSK

SEQ ID NO: 230038 - protein, 51 aa, Glycine max
  Coding DNA Sequence Number=SeqID_113260
SLLRHFSAPGPTRNLRDEVTSSPERARLLQEEASSLLGRATAQPPPLICYK

SEQ ID NO: 230039 - protein, 318 aa, Glycine max
  Coding DNA Sequence Number=SeqID_113261
  Homolog annotation: Hit_ID=Q47522; Match level="QueryCoverage=15%, HitCoverage=59%, E-value=2e-21, Identity=97%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLNSIHAAHQVRAAARWVTHHDGDGLAGVSRGLRKGCRRQGQASQCTDRPMKNAAAHQAYRYRRPRGGARYQLLFPLVRVNFELGVIMVIAVSFGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 230040 - protein, 80 aa, Glycine max
  Coding DNA Sequence Number=SeqID_113262
MGLNQAHAFKERFIKTRSKEVQEGMKVDMEAMKEQMATMMEAMMSMKKIMEVNAAAVATTSAIAEVRDVTTRLIAMVSIL

SEQ ID NO: 230041 - protein, 145 aa, Glycine max
  Coding DNA Sequence Number=SeqID_113263
SDLDNLLMQFKKTIESTQRAFKSLEIQVGKLVKEVAKFVATREENFVEVEAHEESLVEEHDSREKGEEKSEEKAQQWKKCSQVEIQQESILQVNTPPHQLIVKEERHGEHEKSISVILSLITSTSLAMTWKVFPKYMSFMESLAK

SEQ ID NO: 230042 - protein, 180 aa, Glycine max
  Coding DNA Sequence Number=SeqID_113264
MKIAKTPPKLIPIDISKDPYTSAPIEFLNVKETEKGLKPPLVLSPCDLFFSLQKYYLTNPNGKSVRNLISNNISKFHKNPTVKKTGIVVLPRQLWVSAGKENATMRGVFLLAQNIKIPNGGNSRNWVANVVLKFHDDPTVNEFEIVIFLRQVRWPTGKREGFGKREKKQHCEAEEAKESV

SEQ ID NO: 230043 - protein, 1000 aa, Glycine max
  Coding DNA Sequence Number=SeqID_113265
  Gene Ontology: Mol. function=transferase activity, transferring phosphorus-containing groups; Cellular component=chloroplast; Biological process=phosphorylation
  Homolog annotation: Hit_ID=Q42910; Match level="QueryCoverage=99%, HitCoverage=99%, E-value=0.0, Identity=73%"; Hit description =Pyruvate, phosphate dikinase, chloroplast precursor
  Pfam annotation: Domain name=PEP-utilizers; Domain location=541-631; Score=170.8; E_value=3.4e-48; Accession=PF00391.13; Description=PEP -utilising enzyme, mobile domain
  Pfam annotation: Domain name=PEP-utilizers_C; Domain location=643 -1000; Score=577.3; E_value=1.4e-170; Accession=PF02896.8; Description=PEP-utilising enzyme, TIM barrel domain
  Pfam annotation: Domain name=PPDK_N; Domain location=79-490; Score =527.0; E_value=2e-155; Accession=PF01326.9; Description=Pyruvate phosphate dikinase, PEPpyruvate
  Pfam module annotation: Pfam domain module=PEP-utilizers::PEP -utilizers_C::PPDK_N; Domain location=541-631::643-1000::79-490
  Subcellular localization annotation: CTP_CleavageSite=52; ConfidenceScore=5.23e-01
MSSIVKGIFIRSTADVCKNSMVLKKQSEIVGRRSTRVQWQLHLRSKSNTWKRGSRRSYQPPIRGQAILTPATPPTTKKRVFTFGKGRSEGNKAMKSLLGGKGANLAEMATIGLSVPPGLTISTEACQEYQQNGKKLPDGLWEEVLEGLQFVENEMGAILGNPLKPLLLSVRSGAADHLWNLESRLVRAYRKMYKLTCFPYIYKISMPGMMDTVLNLGLNDEVVAGLAAKSGERFAYDSYRRFLDMFGDVVMDIPHSLFEEKLEKLKHTKGVKLDTDLTTYDLKDLVEQYKNVYLEARGEKFPSGAESNTPTSSRFVYFLVVLAIDPYPKKQLELAVKAVFNSWDSPRAIKYRSINQITGLKGTAVNIQSMVFGNMGNTSGTGVLFTRNPSTGENKLYGEFLINAQGEDVVAGIRTPEDLEVMKSCMPDAYKELEGNCEILEKHYKDMMDIEFTVQENRLWMLQCRSGKRTGKGAFKIAVDMVNEGLVDIRSAIKMVEPQHLDQLLHPQFEDPSTYKDKVIAVGLPASPGAAVGQVVFTADDAEEWHAQGKSVILVRNETSPEDVGGMHAATGILTARGGMTSHAAVVARGWGKCCVSGCSDILVNDAEKVFVVGDKVIGEGEWISLNGSTGEVILGKQPLSPPALSDDLEIFMSWADEIRHLKVMANADTPEDAVTARQNGAQGIGLCRTEHMFFASDERIKAVRMMIMAVTPEQRKAALDLLLPYQRSDFEGIFRAMDGLPVTIRLLDPPLHEFLPEGDLEHIVRELTSDTGMKEEEIFSRIEKLSEVNPMLGFRGCRLGISYPELTEMQARAIFQAAVSVSNHGITVHPEIMVPLIGTPQELRHQVNLIRNVADKVLSEMGSSLSYKVGTMIEVPRAALVADEIAKEAEFFSFGTNDLTQMTFGYSRDDVGKFLPIYLSGGILQHDPFEVLDQKGVGQLIKICTEKGRAARPNLKVSQIFSSTSSENENIAISIDKLKLRGLFCRVPIARLAAAQVAV

SEQ ID NO: 230044 - protein, 209 aa, Glycine max
  Coding DNA Sequence Number=SeqID_113266
MVSLLNPEAPEYLPSHNHKLQQQQQQLQPLACPTSLFPHHGHFSVFSLFPSRHPNPFFYYPTLTLPPPPSIPLALEAHQQTRFHNIKNDSDSNPVEAHAVHQKKDQVVLAEPKTGGGSIGLVKKQALNAYINGRRSAESWRQKSYPPRKKVEENGQRKNVDFLRNRKVFRQPDDEQPFRGFPKRNRFNLSLPVRDGETTVMIRNIPSKY

SEQ ID NO: 230045 - protein, 659 aa, Glycine max
  Coding DNA Sequence Number=SeqID_113267
  Gene Ontology: Mol. function=DNA binding; Cellular component=nucleus
FVNLLGSKLRRSPRLPCGAAIWLPRVRSVKRCRAVLLSVAAHAIGLVLMPPEPLPWDRKDFFKERKHERSESLGSVARWRDSSHHRDFNRWGSAEFRRPPGHGKQGGWHLFSEESGHGYAISRSSSDKMLEDDSRPSFSRGDGKYGRSSRENRGGPFGQRDWRGHSWEPSNGSISFPRRQQDVNNDHRSIDDALAYSPHPHSDFGNAWDQHHLKDQHDKMGGVNDFGAGPRCDRENSLGDWKPLKWTRSGSLSSRGSGFSHSSSSRSMGGADSHEAKAELLPKSVAVNESHSGEAAACATSSVPSEDTTSRKKPRLGWGEGLAKYEKKKVEVPEASANKDGPVLSTSNTEPCNLLSPSLVDKSPKVIGFSECASPATPSSVACSSSPGMDDKLFGKTANVDNDVSNLTGSPAPVSENHFARFSFNLEKFDIDSLNNLGSSIIELVQSDDPTSLDSGPMRSNAINKLLIWKADISKVLEMTESEIDLLENELKSLKSESGETCPCSCPVALGSQMVGGDEKYGEEHVGVSDQVIRPLPLKVVDDPNTEKMPLSTNLHSIHENGKEEDIDSPGTATSKFVEPLPLIKAVSCDTRGYDNFSRDLDAVQSTAVKCLVPCTTRKEASVSTFVDGNTSMALKDSMDILYKTIISSNKESANRASE

SEQ ID NO: 230046 - protein, 175 aa, Glycine max
  Coding DNA Sequence Number=SeqID_113268
  Gene Ontology: Mol. function=1,3-beta-glucan synthase activity; Cellular component=1,3-beta-glucan synthase complex; Biological process=1,3-beta-glucan biosynthetic process
  Homolog annotation: Hit_ID=Q8S1X0; Match level="QueryCoverage=60%, HitCoverage=5%, E-value=2e-31, Identity=51%"; Hit description =Putative callose synthase 1 catalytic subunit
MVLKTIVAAAWFVVFLVFYLKIWEQRNRDGKWSVEANKRLITFLEVAFVFVVPELLALVLFVLPWVRNFIENSDWRVCYMVSWWFQTKTFVGRGLREGLVDNIRYGVGLFSHLGEIRSMQQLKLRFQFFASAVLFNLMPEEQLLNARKTLSGKVKDGIHRMKLRYGFGQPYMKLS

SEQ ID NO: 230047 - protein, 131 aa, Glycine max
  Coding DNA Sequence Number=SeqID_113269
MKVAKTGFQNHFFEFPIHHPQSLFLRHLEKPQEEVAKTGFRSGGTWICRRGVETALGDRKKKSWDESCLLLRTKHRVDLEKRYQGNTVSQVVDGIIRISDIDKVIAGFDCCHPDLTAPTAWNQSSDSRKTG

SEQ ID NO: 230048 - protein, 58 aa, Glycine max
  Coding DNA Sequence Number=SeqID_113270
MAKSQLSCELERTNTFHFPVVPHLKSCNLPGTLRDSKCLIKATILYRSRGLFFPNTEP

SEQ ID NO: 230049 - protein, 289 aa, Glycine max
  Coding DNA Sequence Number=SeqID_113271
  Gene Ontology: Mol. function=binding; Cellular component=clathrin coat of trans-Golgi network vesicle; Biological process =intracellular protein transport
  Homolog annotation: Hit_ID=Q9XFS0; Match level="QueryCoverage=87%, HitCoverage=30%, E-value=1e-107, Identity=75%"; Hit description =Gamma-adaptin 2
  Pfam annotation: Domain name=Adaptin_N; Domain location=14-289; Score= -129.1; E_value=0.0017; Accession=PF01602.10; Description=Adaptin N terminal region
MIRAIRACKTAAEERAVVRKECAAIRAAINENDNDYRHRNLAKLMFIHMLGYPTHFGQMECLKLIASPEFPEKRIGYLGLMLLLDERQEVLMLVTNSLKQYPVFSQRNICSAEMARDLAPEVERLLQFRDPNIRKKAALCSIRIIKKVPDLAENFINPATSLLREKHHGVLITGVQLCTDLCKISTEALEHIRKKCTDGLVRTLKDLANSPYSPEYDIAGITDPFLHIRLLKLLRVLGEGNADASDTMNDILAQCSCCNAWVIWHFCMAPCMNLYVENHLEYLVHFHVI

SEQ ID NO: 230050 - protein, 343 aa, Glycine max
  Coding DNA Sequence Number=SeqID_113272
  Homolog annotation: Hit_ID=Q9FHJ5; Match level="QueryCoverage=84%, HitCoverage=83%, E-value=1e-83, Identity=56%"; Hit description =Arabidopsis thaliana genomic DNA, chromosome 5, P1 clone:MFC19
MDFFTRDINEDSMLRCPFLRNINEPTNFSFSSPLALPMPVRGAKGPIFEDGPNFDLAFRLFHGSDGVVPLSDRSFRPSEKKVQAEPPKSQFNPLAAKAATISLSSFGFGGAFGFDAFSEKWNNQKRKSKSSKNNPSSQDGSKHEAGNDWLQNGNCPIAKSYRAVSNVLPLVAKVIQPPPGIKYKCPQAVVAARAAIARTAFAKNLRPQSLPTKVLVIGMLGMAANVPLGIWREHTKKFSPTWFAAVHAAVPFIAMLRKSVLMPKSAMAFTIAASVLGQVIGSRAERYRLKAVAARKVSITETSGVGPLQLPVATKKDKHCGDAVDWNAVSLQLATTSPTDVFC

SEQ ID NO: 230051 - protein, 944 aa, Glycine max
  Coding DNA Sequence Number=SeqID_113273
  Gene Ontology: Mol. function=DNA binding; Cellular component=nucleus; Biological process=negative regulation of transcription, DNA-dependent
  Homolog annotation: Hit_ID=UPI0000E810AC; Match level="QueryCoverage =31%, HitCoverage=10%, E-value=8e-19, Identity=23%"; Hit description =PREDICTED: similar to silencing mediator of retinoic acid and thyroid hormone receptor alpha
  Pfam annotation: Domain name=Myb_DNA-binding; Domain location=251 -296; Score=40.8; E_value=4.8e-09; Accession=PF00249.21; Description =Myb-like DNA-binding domain
  Pfam annotation: Domain name=Myb_DNA-binding; Domain location=36-81; Score=43.8; E_value=6e-10; Accession=PF00249.21; Description=Myb -like DNA-binding domain
  Pfam module annotation: Pfam domain module=Myb_DNA-binding::Myb_DNA -binding; Domain location=251-296::36-81
MPALILDEKEKMISKFVSSNGLVEDPLAIEKERAMINPWTPEEREVFLEKFAAFGKDFRKIASFLDHKTAADCVEFYYKNHKSDCFEKIKKQDGCKLGKSYSAKTDLIASGKKWNRELSASSLDILSAASLMADGIAGNKKLRTGSSLLGGYGKVKTSRGEDFIEKSSSFDILGDERETAAAADVLAGICGSLSSEAMSSCITSSVDPVEGNRDRKFLKVNPLCKPPMTPDVTQDVDDETCSDESCGEMDPTDWTDDEKTAFLQAVSSFGKDFAKIARCVGTRSQEQCKVFFSKGRKCLGLDLMRPIPENVGSPVNDDANGGESDTDDACVVETGSVVGTDKSGTKTDEDLPLYGTNTYHDESHPVEARNLSAELNESKEIIGTEVDLEDANVTSGAYQINIDSELGCDGSEVFLCVSNKSGSVGEQAGIIMSDSTEVGKDKANKLGGAATELISAPDSSEPCESNSVAEDRMVVSEVSSGGLGNELERYRVSATLCVDDRDNKYEADSGVIVDLKSSVHDLSTMVNSSLSSLGTSCSGLSFCSENKHVPLGKPHVSALSMDDLLATSNSLLQNTVAVDVQCEKTASQDQMSSTCDIQGGRDMHCQNSISNAGHQLPITGNLSDHVDAVSILQGYPFQVPLKKEMNGDMNCSSSATELPFLPHKIEQDDDHIKTFQSSDSDKTSRNGDVKLFGKILTNPSTTQKPNVGAKGSEENGTHHPKLSSKSSNLKFTGHHSADGNLKILKFDHNDYVGLENVLENVPMRSYGYWDGNRIQTGLSTLPDSAILLAKYPAAFSNYPTSSAKLEQPSLQTYSKNNERLLNGAPTLTTTRDINGSNAVIDYQLFRRDGPKVQPFMVDVKHCQDVFSEMQRRNGFEAISSLQQQSRGVMGMNGVGRPGILVGGSCSGVSDPVAAIKMHYSNSDKYGGQTGSIAREDESWGGKGD

SEQ ID NO: 230052 - protein, 586 aa, Glycine max
  Coding DNA Sequence Number=SeqID_113274
  Homolog annotation: Hit_ID=Q9M0H8; Match level="QueryCoverage=99%, HitCoverage=100%, E-value=8e-61, Identity=41%"; Hit description =Predicted proline-rich protein
  Pfam annotation: Domain name=DUF1421; Domain location=190-584; Score =109.8; E_value=8e-30; Accession=PF07223.2; Description=Protein of unknown function (DUF1421)
MASLPSGRSNGGSNGFDLGSGDILYSYDEEDYTNHDSSNGTHIDPTKKLLSFTAAKEICKGVLGIDAILMRLMKEDFVFKCRKGSFLLIKLLPKGLDSHASRMGRTSIVPATAYSPSEDSLSQDVIATVEKSMKTHADNLMQFLEGLGTRLSQLELYCYNLDKSIGAMRSDLTCDHEETDSKLNSLDKHLQEVHRSVLILKDRQELAETRKELAMLKHAQKESSSSSHSQSNEERSSPSSMDPKRIDNVSDTQNQELALALPHQVTPRQQPVASFYQVPAPNVRQATQRPHYYLMPTPLPNPQAVNQLPQNQYWPSDLLYRIPQSTSSSQATQSPPVQQFLQYQQLQHQQQQWLPQLPPQQVQVPPPQPPSAQSQVRPPSANVYTPYATSQATNPLPTETLPNSVPMQMPYSGIPPQGSSHGGGSSSGDAMPNGYSGAGRTVPQQPLLQLMRGSFSAQPADVYGTSGAQSHTTRPPASSYDVYDGENARAHYPPQPSHYAQAGYPPTSASHQNHAPHNLMVGSPSQSQFIRSHLYNDLIEKFVSMGFRGDHVANIIQRMEETQLPIDFNSVHDRLDVHNPQRGWSG

SEQ ID NO: 230053 - protein, 317 aa, Glycine max
  Coding DNA Sequence Number=SeqID_113275
  Gene Ontology: Mol. function=pseudouridine synthase activity; Biological process=RNA processing
  Homolog annotation: Hit_ID=Q4BZI0; Match level="QueryCoverage=89%, HitCoverage=98%, E-value=2e-22, Identity=28%"; Hit description =Pseudouridine synthase, RluD
MTSRKKFGIPWPECNDGLSYDDVVRASDAGATLIEFYSTKYKSSAPLQGELGNWITVDGGVVTDSNTVLRVGSKLIYHRLPWKEPDAPHMIDVLYEDDDMTKLARARLASHFADGTSHVGGKRLKISFLVNLFNSLSAVVYGSRDTKQELGKIAKMYRALVSGIVENDKVTINQPIGIVKYPGVAKGLYVASESGKATLMFIDFLSSAIVLMFPFLPKTSLHDILDHPVMHSDPLYGVGGQPKCLDCDFVDESFAEDGGYQRPTKPVPGDCGYYLHAHKLVLSHPTTNELIEIIAPLPSALHTAEEAKEIAIMQQTA

SEQ ID NO: 230054 - protein, 130 aa, Glycine max
  Coding DNA Sequence Number=SeqID_113276
  Homolog annotation: Hit_ID=Q9ZT82; Match level="QueryCoverage=61%, HitCoverage=4%, E-value=7e-30, Identity=76%"; Hit description =Putative glucan synthase component
AHLGVGEVEDEVLALVANVVGLEPEEEGKPVQEVHTWLPFRGAEEVPDGVEGGGGGADLREAEGWMVGERGVEGDDVVGLNVVVVAISDRHVMGNVDPEEQGTLRWFREVFVYYYKVCLCLERKKGGLVS

SEQ ID NO: 230055 - protein, 135 aa, Glycine max
  Coding DNA Sequence Number=SeqID_113277
MHMHKVQIPYLIALAVTPPTHSLEGTLLLWSQAHSIIVCERSLIQNERALTEFSSANKISITMTFGIYACKIKLVQAKHPDKGRHNQNVFYDLLFFFFLSMMNRAKIIWVLVPYPAVSQEHKGNVATKHNSLCTT

SEQ ID NO: 230056 - protein, 355 aa, Glycine max
  Coding DNA Sequence Number=SeqID_113278
  Homolog annotation: Hit_ID=Q75GP1; Match level="QueryCoverage=84%, HitCoverage=88%, E-value=3e-43, Identity=38%"; Hit description =Expressed protein
MAAESGGTPTNFDLPEEVVQVLPSDPFQQLDVARKITSIALSTRVNTLESELSSLRAQIADKDNLIADLQSQLDSLDASLSQIADKLLQTEQDKESLLQENASLSNTVKKLNRDVSKLEVFRKTLMQSLQEEDDNSGAAPDIVAKIQSQASLTSTSQIGDNDVSLPPSVSSSTGNSFAKDHESDAIRPRVSQNLLLASQGSTPRITPPGSPPSLSASVSPTRTSKPVSPQRHSISFATTRGMYDDRSSMFSSMSLTHGSISSSDAGTGSQTGRTRVDGKEFFRQVRNRLSYEQFGAFLANVKELNSHKQTKESWQDYKVAVGFLAVGMGGTLVLMFNAEHRLQVVSIKERLLHNH

SEQ ID NO: 230057 - protein, 137 aa, Glycine max
  Coding DNA Sequence Number=SeqID_113279
  Gene Ontology: Mol. function=tryptophan synthase activity; Cellular component=chloroplast; Biological process=tryptophan metabolic process
  Homolog annotation: Hit_ID=Q5KT13; Match level="QueryCoverage=85%, HitCoverage=24%, E-value=1e-36, Identity=67%"; Hit description =Tryptophan synthase beta subunit
MYKLKVLIEASKIHHLRHFTIRFSSGTTSMFDHGSQVSVDDRERNKDSSIGKMGKEARDVLVTCVGIGSNAIGLFHEFIAHSDVRLIRVETGGLGLESGRHSSKLTMGEVGIYHGSMSYLLQDDDGQVIEPHSIIVG

SEQ ID NO: 230058 - protein, 273 aa, Glycine max
  Coding DNA Sequence Number=SeqID_113280
  Homolog annotation: Hit_ID=Q5Z9X7; Match level="QueryCoverage=34%, HitCoverage=39%, E-value=2e-27, Identity=59%"; Hit description=DTW domain-containing protein-like
  Pfam annotation: Domain name=DTW; Domain location=136-261; Score= -38.1; E_value=0.0024; Accession=PF03942.6; Description=DTW domain
MVSSVPWTKSFFPLWFWNKTRVLLTHHYRYHHRHSPLSDTDMTEEGVVVSLQEWQGWGTTSPLPTMVSQIVEDLKVLEEDLDAHMNFGGNGGKLQGNFRVQEDKKHRATYQALGDSEKKLQFYSARQIACRILGSRGYLCQKCWLPMEDCMCSKVTSCSLYPGIRFWLYMHPKDFLRQNNTGKILWQVFGVDAATLCLFGIPEHEEIMWNSLKMAGKSNVWCLYPNKNAVLKSVQNVFGEESVARDEVAPSKKTRVNGKEKEIVEYTPTTLDQ

SEQ ID NO: 230059 - protein, 71 aa, Glycine max
  Coding DNA Sequence Number=SeqID_113281
  Gene Ontology: Mol. function=identical protein binding; Biological process=negative regulation of enzyme activity
  Homolog annotation: Hit_ID=Q9MAP6; Match level="QueryCoverage=91%, HitCoverage=8%, E-value=8e-10, Identity=50%"; Hit description=Second of four adjacent putative subtilase family>
  Pfam annotation: Domain name=Subtilisin_N; Domain location=7-71; Score=14.9; E_value=0.0051; Accession=PF05922.7; Description =Subtilisin N-terminal Region
MAVVVEQVHIVYMGERMNQSEQQLVEDSHLDILSRILRSKGAARRSIQYSYKHGFSGFVAVLSQSHAKLIA

SEQ ID NO: 230060 - protein, 948 aa, Glycine max
  Coding DNA Sequence Number=SeqID_113282
  Gene Ontology: Mol. function=catalytic activity; Cellular component =alpha,alpha-trehalose-phosphate synthase complex (UDP-forming); Biological process=trehalose biosynthetic process
  Homolog annotation: Hit_ID=Q2TSD5; Match level="QueryCoverage=89%, HitCoverage=98%, E-value=0.0, Identity=78%"; Hit description =Trehalose 6-phosphate synthase
  Pfam annotation: Domain name=Glyco_transf_20; Domain location=47-534; Score=929.3; E_value=1.6e-276; Accession=PF00982.11; Description =Glycosyltransferase family 20
  Pfam annotation: Domain name=Hydrolase_3; Domain location=582-824; Score=-83.3; E_value=0.027; Accession=PF08282.2; Description =haloacid dehalogenase-like hydrolase
  Pfam annotation: Domain name=Trehalose_PPase; Domain location=583 -818; Score=382.1; E_value=8.5e-112; Accession=PF02358.7; Description= Trehalose-phosphatase
  Pfam module annotation: Pfam domain module=Glyco_transf_20::Hydrolase_ 3::Trehalose_PPase; Domain location=47-534::582-824::583-818
LAGGLLDIPHMPRTIPRIMTVPGVISDLDVYGRYDGDSDVSSSGYRERKILVANMLPLQAKRDIETGKWCFSLDEDSILLQLKDGFSSDTEVIYVGSLKVEIDAHEQEQVAQKLLEDFNCIPTFLPHDVQKKFYHGFCKQQLWPLFHYMLPMFPDHGDRFDRLLWQAYVSANKIFADKVMEIINPDDDFVWVQDYHLMVLPTFLRKRYNRVKLGFFLHSPFPSSEIYRTLPVRDEILRGLLNSDLIGFHTFDYARHFLSCCKRMLGLDYESKRGHIGLDYFGRTIFIKILPVGIHMGRLESVLNLQSTSAKLKEIQEEFKGRKVILGVDDMDIFKGISLKLLAVEQLLQQNRDLKGKVVLVQIVNPARSSGKDVQEAKKETYLIAQRINDTYGSINYRPVILIDRPVPRFEKSAYYAVAECCIVNAVRDGMNLVPYKYIVCRQGTAQMDKALARKSDSPRTSMLVVSEFIGCSPSLSGAIRVNPWNIDAVADALYSAVTMNDSEKQLRHEKHYRYISSHDVAYWARSFMQDLERACKDHYTKRCWGMGLGLGFRVVSLSPGFRKLSVDHIVSAYKRTGRRAIFLDYDGTIVPKSSINKTPSPEVISMLNDMCNDPKNTVFIVSGRGRDSLSDWFTSCKMIGLAAEHGYFLRWSKDSEWETSPLSPDLDWKKIVEPVMQLYTEATDGSNIETKESALVWHHQDADPDFGSCQAKELLNHLESVLANEPAVVIRGQHIVEVKPQGLNKGLVAEKVLSTMVNDGNPPDFVMCVGDDISDEDMFESILRTVSCPSLPVVPEIFACTVGQKPSKAKYYLDDPADVLKLLQGLGASSKPKSRHLAQFQVSFESTIGFFAFSSAVMSLTNSSHVNGYIKLLYLLVPPIAVVVPRTVEHIVVCIEHEAPNSFIHKVGTRNNIGKSSIKMAWTVGLCLGYSEIQGIMPTIPNGYMRR

SEQ ID NO: 230061 - protein, 649 aa, Glycine max
  Coding DNA Sequence Number=SeqID_113283
  Gene Ontology: Mol. function=nucleic acid binding; Cellular component= intracellular
  Homolog annotation: Hit_ID=Q337G3; Match level="QueryCoverage=76%, HitCoverage=99%, E-value=1e-100, Identity=40%"; Hit description =Expressed protein
  Subcellular localization annotation: CTP_CleavageSite=97; ConfidenceScore=5.56e-01
MTCVKEKESQISVNFSFRFVSRFSSSFFPHFLSLQTACNSSSFSAIHGDVVNGGFALLRDSLHGSRRFPPTRTISTITEQFYTDCPTNISFYALVLRSFLRSPYLFVYFAVYARNSNSRISLTRDFRFIRQSYCSVLNFAFECLVGEILMAGKLELGPPKSDISNPKEQAARKILKIVRSQGHPYVELRENGKKFIYFCTLCLAPCYSDDVLFDHLKGNLHRERLSAAKVTLLGPKPWPFNDGLVFFDTSTESDKELEVADSYRNRLLKFNDDDSSLAIVKFGEGVQSNAKPCSIEGMQDDECALVIPNLLIGDEIFDLKVKEVGLGKIAARFLEKCHALNGIKRIWCEWLGKESNGERDGVEVLEHDFAVVIFAYNYDLGRSGLLDDVKTLLPVSAGQKGKTSLSDSDDVSDFLCNQYDSSAEESSDSNNSSSRLTLDQFNNHLCTRFISSKALRKELRRKQRLAAEKVCNICQQKMLPGKDVAALLNLKTRRVACSSRNRTGAFHVFHTSCLIHWIILCEFEIIINHLVRPNIRRVVKRKVASDGDKMGKEKDIGKHIRTVFCPECQGTGMIIDGDGVEQPEFSLSQMFKFKIKACDARRDWIKSPEVLQNCSTGFHFPSQSEEIFEEKVEPINLLHFYRADDQSGA

SEQ ID NO: 230062 - protein, 467 aa, Glycine max
  Coding DNA Sequence Number=SeqID_113284
  Gene Ontology: Mol. function=binding; Cellular component =mitochondrion; Biological process=protein amino acid phosphorylation
  Homolog annotation: Hit_ID=Q8LNF8; Match level="QueryCoverage=92%, HitCoverage=84%, E-value=9e-57, Identity=31%"; Hit description =Putative leaf protein
  Pfam annotation: Domain name=PPR; Domain location=178-211; Score=5.9; E_value=1.5; Accession=PF01535.11; Description=PPR repeat
  Pfam annotation: Domain name=PPR; Domain location=284-318; Score =13.4; E_value=0.19; Accession=PF01535.11; Description=PPR repeat
  Pfam annotation: Domain name=PPR; Domain location=319-353; Score =20.7; E_value=0.0051; Accession=PF01535.11; Description=PPR repeat
  Pfam module annotation: Pfam domain module=PPR::PPR::PPR; Domain location=178-211::284-318::319-353
MMLIRSKCKLVKMCGVSVCGSLGMCMYSTESVVASLENGVFKNGDPLSSVSPILNQWVEEGREVTKLQLEDLAYRLTQSRRFTHALQVLEWMSNERNYELSPGSIAKQINLISKVHGLEQAERYFRGIPDDKIEFKIYAALLRCYAEHKSVEEAEAGKYEKLDRLMQEMKEKDICNASTYTIRLNAYVVVTDIKGMEKLLMQMEADPVATVDWYTYMTAANGYRRVHNFEKVAEMLKKSEHLARGNTRRLAFESIQTMYAIIGNKDEVYRLWNMCTSLKKPNNSSYIRMLSSLAKLDEIDGAEKILEEWESKYANFDVRIPNLMISAYCKWGQFDKAEAYIRRLLDGGKQLDGRTWDRLACGYKAGNDMEKAVQAMKKAVSKNLGGRRPDPFTLVACVKYLKEKGDLDLALEILKLCIENSHISVTSYDGLSSYVHSETPDTGPLDLIKGDYQMFENENTQLLDGEN

SEQ ID NO: 230063 - protein, 214 aa, Glycine max
  Coding DNA Sequence Number=SeqID_113285
  Gene Ontology: Mol. function=metal ion binding; Cellular component =integral to membrane; Biological process=ubiquitin cycle
  Homolog annotation: Hit_ID=Q6R567; Match level="QueryCoverage=79%, HitCoverage=71%, E-value=4e-40, Identity=48%"; Hit description=Ring domain containing protein
  Pfam annotation: Domain name=zf-C3HC4; Domain location=46-93; Score =34.2; E_value=4.7e-07; Accession=PF00097.15; Description=Zinc finger, C3HC4 type (RING finger)
MALDQYFDEAVPQLDSLEDKSSLETWKCGSDDIADSDRNASGGFDCNICLECVQDPVVTLCGHLYCWPCIYKWLNLQTASSENEEEKQQCPVCKSEISQSSLVPLYGRGQTVLPSKGKGHQVGVVIPRRPLGPTLDSATVSPPISHVYHRHYPNHPQQFNSIPGSYTSMFNTGGSLANAFDTTYGVFENLWTDHVIFFLLEARYPHSQKHETNP

SEQ ID NO: 230064 - protein, 189 aa, Glycine max
  Coding DNA Sequence Number=SeqID_113286
  Gene Ontology: Mol. function=heat shock protein binding; Cellular component=integral to membrane; Biological process=protein folding
  Homolog annotation: Hit_ID=Q2R254; Match level="QueryCoverage=91%, HitCoverage=48%, E-value=2e-27, Identity=33%"; Hit description=DnaJ domain containing protein, expressed
ALEKFQIGQIWAFYSDEDGLPKYYGQIKKIATSPDLELHVYWLTSCWLPENTINWDDKDILISCGRFEVNKTDDLLSVYSTTSCVSHQVHADAVGKNKNYAIFPRKVVEETDLSINVLVLEFVSGYTSVFRGKSNEGSSVNLRIPREELLKFSHQIPAFKLTEEHGNLKGFWELDPDGTSASSNILVLC

SEQ ID NO: 230065 - protein, 206 aa, Glycine max
  Coding DNA Sequence Number=SeqID_113287
  Gene Ontology: Mol. function=identical protein binding; Cellular component=cellulose and pectin-containing cell wall; Biological process=negative regulation of enzyme activity
  Homolog annotation: Hit_ID=Q1SB16; Match level="QueryCoverage=84%, HitCoverage=21%, E-value=6e-34, Identity=45%"; Hit description =Protease-associated PA; Proteinase inhibitor I9, subtilisin propeptide
  Pfam annotation: Domain name=PA; Domain location=8-112; Score=55.1; E_ value=2.4e-13; Accession=PF02225.12; Description=PA domain
MGQSLYTGKDLSKFYRIVFGEDIAASDADEKSARSCNSGSLNATLAKGKAILCFQSRSQRSATVAIRIRTVTEVGGAGLIFAQFPTKDVDTSWSKPCVQVDFITGTTILSYMEATRNPVIKFSKTKTVVGQQLSPEVAFFFSRGPSSLSPSVLKPDIAAPGVNILAAWSPASSARLVSDAANEDESDLHPLNFNIESGTSICHAPT

SEQ ID NO: 230066 - protein, 231 aa, Glycine max
  Coding DNA Sequence Number=SeqID_113288
  Gene Ontology: Mol. function=transferase activity
  Homolog annotation: Hit_ID=Q1RWV8; Match level="QueryCoverage=99%, HitCoverage=34%, E-value=7e-96, Identity=75%"; Hit description=IMP dehydrogenase/GMP reductase
MVEKMLDTFPVAIHDVDSDNKNVVLLAIENRQPRVYKLLTKRNLVKESAFRHIDNQGNSALHLAAMYREHRPWRVPGAAMQMQWEYKWYKLVKNSMAPNFYARYNKGQTAKQVFIITQEPLVREGRKWLSKTSESCSLVAALVETVAFTNSAAIPGGANEVTGVPVLSEQPAFKVFAVASLVALCSSVTALVLFLSILTSRFQEKDLQKKLLMGMTSLWTSIASVLVSFCA

SEQ ID NO: 230067 - protein, 128 aa, Glycine max
  Coding DNA Sequence Number=SeqID_113289
  Gene Ontology: Mol. function=metal ion binding; Biological process =metal ion transport
  Homolog annotation: Hit_ID=UPI00001634B5; Match level="QueryCoverage =98%, HitCoverage=99%, E-value=7e-15, Identity=37%"; Hit description =copper ion binding / metal ion binding
  Pfam annotation: Domain name=HMA; Domain location=16-78; Score=33.4; E_value=8.1e-07; Accession=PF00403.16; Description=Heavy-metal -associated domain
MGKNKKVEQQNKVIIVEYKVSMYCNACERTIAKVISKCKGVEKFITNMNEHQVVVTGRIDPMKVLEKLKKKTGKKVEIVSKMDDHEEPDDESDKLVIMHQFAPENDSCINIQTMMMFSDENPNACAVM

SEQ ID NO: 230068 - protein, 495 aa, Glycine max
  Coding DNA Sequence Number=SeqID_113290
  Homolog annotation: Hit_ID=Q33XR1; Match level="QueryCoverage=28%, HitCoverage=31%, E-value=1e-08, Identity=36%"; Hit description =Purine nucleosidase
  Pfam annotation: Domain name=IU_nuc_hydro; Domain location=128-424; Score=-70.3; E_value=1.1e-06; Accession=PF01156.9; Description =Inosine-uridine preferring nucleoside hydrolase
MRCWVAVAVAVTALIITGGGRGCAPHRILVDTDVDTDDFFALLYLLKLNTSQFQLELILYNVSNIFWMSFNEKLKEKYKRKAKKGISISANAWTSAGHAVNQIYDLLYMMGRDDVAVGVGGEGGILQNGTILPNVGGYLPIIEQGMTTVGGCRYRRAIPVGLGGRLDIDANYGIRKAFLPQGTRKYTPLQQPTAQEVLIEKISAGPITLLVIGAHTNIAIFLMNNPHLKKNVEHIYIMGGGVRSSNPTGCCPKNASSTCVPRQCGDRGNMFTDYNTNPYAEFNIFGDPFAAYQTWMILPQVIHSGIPITLVPLDATNTIPINEQFFDAFEKSQDTYEAQYIFKSLKMARDTWFDNEFYSSYFMWDSFAAGIAVSIMSKPNNQKGENEFAEMEYMNITVITSNKPYGVSDGSNPFFDGRRVPKFNLEKGGVHSGHVQQGLRDPLCFVNNGKGKCQDGYTAEVSGPDSVRVLVATKAKPNKDVGSSLDREYFISFLN

SEQ ID NO: 230069 - protein, 429 aa, Glycine max
  Coding DNA Sequence Number=SeqID_113291
  Gene Ontology: Mol. function=sugar porter activity; Cellular component=integral to membrane; Biological process=carbohydrate transport
  Homolog annotation: Hit_ID=Q8LBI9; Match level="QueryCoverage=98%, HitCoverage=98%, E-value=1e-108, Identity=46%"; Hit description =Sugar transporter ERD6-like 16
  Pfam annotation: Domain name=MFS_1; Domain location=54-404; Score =21.2; E_value=3.4e-05; Accession=PF07690.6; Description=Major Facilitator Superfamily
  Pfam annotation: Domain name=Sugar_tr; Domain location=42-427; Score =16.4; E_value=2.2e-07; Accession=PF00083.14; Description=Sugar (and other) transporter
  Pfam module annotation: Pfam domain module=MFS_1::Sugar_tr; Domain location=54-404::42-427
MSTVLEEHKAVDNGEANWIQGLQDPFIQHGKDAAAACKDVESNTIVEKGSIGMVLFSTFVAVCGSFSFGTCFSVFGSLVTIGTMLGAITSGRIMDFIGRKGAMRMSTGFCITGWLAVFFSKVFIFCNKFIFRKMLENGTEVSLVLFYQLQDPYSLDLGRFCTGYGIGVISFVVPVYIAEIAPKNLRGGLATTKQLMIVIGASISFLLGSFLSWRQIALAGLVPCLSLLIGLHFIPESPRWLDYIETLQSLPKTKLMDLFQSKHVRSIVIGVGLMVCQQSVGINGIGFYTAETFVAAGLSSGKIGSIAYALVNYVIFKLKVRFNLKFHHLFGTACNQIYVGAFSIGMGPVPWIIISEENSSNVLILVFTLQIFPIHVKGTAGSLVILVNWLGSWVVSYTFNFLMSWSSPAKLVPETKGKTLEEVQACINS

SEQ ID NO: 230070 - protein, 111 aa, Glycine max
  Coding DNA Sequence Number=SeqID_113292
MTYRDGRGRDDYYSPERSRSYSRSLSPSGGKDYRKSPRLRENGRSPNDKKDQTPSRSESPRGNDRSPSRSRSRSYRMLYINHSSGNSCSEIGHSTLICEQAEIGMWNVECG

SEQ ID NO: 230071 - protein, 154 aa, Glycine max
  Coding DNA Sequence Number=SeqID_113293
MQASADPCMIAHLYHNCTIENVQSNERNHRMDRFYLKLKHNQGKNWHLKNDKDISLLLIEDSADSEDDYGFFTVCPSSIAISDDNEDDAESCSCDTTSTRGLPKDSEDDKEFAEFCGNEVAALEDEAETRIDEVIVNESEDRLFWETCMAVGYP

SEQ ID NO: 230072 - protein, 239 aa, Glycine max
  Coding DNA Sequence Number=SeqID_113294
  Homolog annotation: Hit_ID=Q9FYB0; Match level="QueryCoverage=37%, HitCoverage=37%, E-value=3e-36, Identity=78%"; Hit description=SC35 -like splicing factor SCL28, 28 kD
  Pfam annotation: Domain name=RRM_1; Domain location=51-122; Score =85.5; E_value=1.6e-22; Accession=PF00076.12; Description=RNA recognition motif. (a.k.a. RRM, R
MGRYRSRSRSYSPRRRSRSPPAPRGRNRYVDDRYGDSRSYRDRRSPLPSGLLVRNLPLDARPEDLRIPFERYGPVKDVYLPKNYYTGEPRGFGFVKYRYGEDAAEAKQHLNHTIIGGREIRIVFAEENRKTPQEMRVNTRGSGRYGGGRRRNHTRSPRRRYRSIPCLSYMLFLQHILGLHHQLGMIQVSTMNPKCAVAVAVDAVSLRIHPCRKLTMYSRDPTWFRDAITIAFSPKPATL

SEQ ID NO: 230073 - protein, 2089 aa, Glycine max
  Coding DNA Sequence Number=SeqID_113295
  Gene Ontology: Mol. function=protein binding
  Homolog annotation: Hit_ID=Q5BN47; Match level="QueryCoverage=11%, HitCoverage=7%, E-value=8e-83, Identity=66%"; Hit description =SPLAYED splice variant
MKAISLLIRAGGVGVNLQAADTVDLQAQARAHRIGQKRDVLVLRFETVQTVEEQVRASAEHKLGVANQSITAGFFDNNTSAEDRREYLEALLRECKKEEAAPVLDDDALNDVLARSESELDIFEAVDKKRKEDELATWKKLMLGQAADGSDIPQLPARLVTDEDLKQFYEAMKISDVPKAEVESSGVKRKGGYIGGLDTQHYGRGKRAREVRSYEEQWTEEEFEKMCQVETPDSPNKVKEVAEKSCPTNTSSSVVSTSNLQPVPVPPAVPTLPAVESLPVVVQQVKEITPPAKRGRGRPKRITSDKSPAVVVSPVTSGTVEVDTQLQKGFGSGHLASSTPDSVAHSAEVVGVNAPVQQSDTVVSPNSQSVIPMPTIPPNSQVAAVPVSVPIQARGQGRKSHGGEGIRRRGKKQVMISPAIPVGSVGPDLKVNDKLEDKLVSPSGQAISQSETVPSFAAEPHPPSASLSSGKDPLGVGVVLNSQAPPPLPSNTTLVQTAPTYPSVQMLSKGQNQKSQTGVSRRRGKKQATILAPVPDLLHQDLHQTANLPISSGSISGEKATELKSLQESNVQESKCVVLDQASQSVGDQDLKSLGGSDDSSKQTVIMSSCQDSMIKSPGQDLDTVKNPDAHDSSVKVVKSSEITSSKIDEVCNNSGNETLLGTTVPVTGVIQDQHSGGKTHNQTVEISKTIPSVVDTPINSLTDNETTQSINKSLDPVTPTIVPSTLTTVYPTPGSESTHPGLAESIPTKRQGRKTQNRAEPPRRKGKKSAAVLPVVPDAVTGQDPKLSHHAQNSPVDSLPGKATANITQTQALEILLPSGVVSHDSKRKERATNSTQNKLQKVASTRIDGAPMSTDKISVHDVARVMKEVFSGTCLPKPKAHDSAGSEDRNTPVVPVLTKAAVDVASNNQSLEDRACSNIAATGAACLASNVPVNVSEKQPEMASNMDNLEGKASLDMPTTGEHSLTSDVKEKAEQMQHSVESSTTSCKIALDTTLNAVQKIDGSSERLPTGSALNDLNIDSSSHQMCSSSGAEPLAVLDRKLKNQSDSLEKCSRSSPLDIGGTGCPPTPLEPDSFSNNPVTSQADTCTRSHSSSNKPPDTTEHISNEKLEPLQPSLKSSSLACVDGSGLLVQTENLGDQPQVIPSCSATDLPPMAMIVSSISEYTEVKNETESTLKPSTELSSDEGIVGYKIPASQLLEPEDRIAFEHNSQMALEPSTKQCLESASEMKVPVSPKAVEVQKHPDALEPADLHGTPLIESCPKSLCEEKRDDRVSKCEQLQSCVVEPINIDPVSQENIVLSNPINNPKTDSSEACHMEMDTSDRSVLPQPSSGLEAVGNELVDISGVGSLLEGSKSEAAVLPPSTLIEEQNRGSAVTCPVRSSEPLEESMEKGVANNSAVQEEAKVDKVETDVQMDSSISQTLQVKHEIFQANVNLPSHLMAKEENIEVSSSRPLSISSSPSHELKDSELELGDKYISPVGDFQTESKDNMLKSLDLVSSPSVRKEEGISSTSDIDGSEGLSMSLNVHQLITVPDAVESSSSQVKEEKKIGVSSDSKLVVRSVSENDMEGSGLLPENPVLEINKMSSDSSTIVSHSVEGQVSFVKEDNSEIKIGDQMDASHVSENDLERITSKCMDVPSCLQMEGDKVDMLSDKGPLCSSLASSEPRDPLIENSRDGIEDSVANPLPQQKSKCSESGKVDEMKTSDVVRVDPGLKSKIADFPSSLVMEQDKAAASYDSPLAAAEPKYCLTGENCENANEEPNPSEAEIGNEMNASDVAGVNTQLSSSSIIVPSSSLMTEDDNIVVSSDNGPQCSMQVLKESKDCQTEEGSCKDATEGPSTNPVLLQELIINSEAETCNEGKTQIGGLSVEDVTASEGKREVETLPDEGPQGILEAQDGSRGLADIEDGTDSKSCAAEMENVSEVPKPSVSAEKGEDLSKKGIIGSQAKRQVSEESEAVTGGGIDVTPDCLAVPETATNDGASSLCSSAEGSEHVDSLSEKDLVGNPVAELDTKVSEAGVSDQENQVVQENALEDMEHEENLSETGLVGNAVAKLSTNKSEAGVSNQEKQENALKDIEKSPPSAAEGCS

SEQ ID NO: 230074 - protein, 108 aa, Glycine max
  Coding DNA Sequence Number=SeqID_113296
  Gene Ontology: Mol. function=protein dimerization activity
  Homolog annotation: Hit_ID=Q8S7P4; Match level="QueryCoverage=78%, HitCoverage=14%, E-value=5e-13, Identity=38%"; Hit description =Putative transposase
HAFGKQSGGDTFVIEGFTNWNKKERLSSHVGGPNSAHNIAWRKRLTTSINCIRFLLKQGLAFRGHDESTNSANQARDISNKEQMTIALRYANKKGSIVERFFGMVHAK

SEQ ID NO: 230075 - protein, 859 aa, Glycine max
  Coding DNA Sequence Number=SeqID_113297
  Gene Ontology: Mol. function=heat shock protein binding; Cellular component=integral to membrane; Biological process=protein folding
  Homolog annotation: Hit_ID=Q9SQT7; Match level="QueryCoverage=67%, HitCoverage=96%, E-value=5e-62, Identity=45%"; Hit description =Putative DnaJ protein
  Pfam annotation: Domain name=DnaJ; Domain location=301-362; Score =95.8; E_value=1.3e-25; Accession=PF00226.21; Description=DnaJ domain
  Pfam annotation: Domain name=PPR; Domain location=32-66; Score=41.5; E_value=2.9e-09; Accession=PF01535.11; Description=PPR repeat
  Pfam annotation: Domain name=PPR; Domain location=67-100; Score=0.1; E_value=7.3; Accession=PF01535.11; Description=PPR repeat
  Pfam module annotation: Pfam domain module=DnaJ::PPR::PPR; Domain location=301-362::32-66::67-100
MHALAPVHPMFVLEQPYMLWLLFHDILEKDLVSWNSMLFAFGLHGRANEAICLYWEMVASGVKPDEVTFTGLLMTCNHLGLINEGFAFFQSMSLEFGVSHGMDHVACMVDMLGRGGYVAEATSLAEKYSKTSITRSNSCEVLLGACYAHGDLGTGLKNLEPEKEAAYVLLCKWEVEGSRDGPEGIGGSRGEEESAWVNLKSTSVYRLGDWWDVGLNVASLGHSIHYNIFPSGSLMDCNKEEALRAKDIAEKKMENRDFVGARKIALKAQQLYPDLENIAQMLVVCDVHCSAEQKLYGNEMDWYEILQVEQTAGDAIIKKQYRKFALQLHPDKNNFAGAEAAFKLIGEAQRVLLDREKRSLFDMKLRVPMNKPAMSRFDSTVRNNVRSHSTSSNARQQQQQSRQPAQQQQQNVNVQSTSSPASNSTQQASDQQKDGLNHGTFKMGAGSHGNSQAEKSNMGPYDKKRPSNVSGKPYGKRKRKQVAESSEGSDSMRTNDSEEDIVAGKDGNSGVENHSTSREGLPRRSTRQKHQVSYKENVKNSDNGFLKPRGDGESHGETTKINDQNGLAPELKEVKQKQHLYSERNEETKTDKGKDAVGGSTQMDGTSEHSPDSTSKAENHPNVYVYPDAEFSDFDKGKNKECFTAGQIWAIYDTSEGMPRFYALIRKVLSPGFRLQIIWFEPHPDCKDEINWVNEEMPVACGKYKLSDIDITEDHLMFSHPVLCEKISRNTFKVYPRKGETWALFKNWDIKWYMDVKSHQLYEYEIVEILTDYVEGEGVYVAYMAKVPSFKMTGQEGVGVPAGSYELDPGALSVNLEEIAVPETSDVKVGHSSSGLVNTSPSDRSELLMTSEGDASIPK

SEQ ID NO: 230076 - protein, 666 aa, Glycine max
  Coding DNA Sequence Number=SeqID_113298
  Gene Ontology: Mol. function=potassium ion transporter activity; Cellular component=integral to membrane; Biological process =potassium ion transport
  Homolog annotation: Hit_ID=Q8W4I4; Match level="QueryCoverage=90%, HitCoverage=77%, E-value=0.0, Identity=69%"; Hit description =Potassium transporter 6
  Pfam annotation: Domain name=K_trans; Domain location=10-666; Score =1025.5; E_value=0; Accession=PF02705.7; Description=K+ potassium transporter
MVIGACLDTKLKVLFGAFESFSTGKYNWSFTSMMIHINKCLHGRSTEVLELELKFHLNNSCKKVFSAVSGLELSMSKEKHTYVEVPAACIILIGLFALQHYGTHRVGFLFAPVIITWLFCLSTIGIYNIFYWNLHVYKALSPYYAFQLLRKTQKGGWMALGGILLCITGSEAMFADLGHFTQLSIKIAFTSVVYPSLILAYMGQAAYLSKHHNIAQDYHFGFYESVPEKLRWPVLVIAILAAVVGSQAIITGTFSIIKQCSSLSCFPRVKVIHTSSKIHGQIYIPEINWLLMMLCLAVTICFRDTKRLGHAAGLAVITVMLVTTCLMSMVIVLCWHQNVLLALGFVFIFGSIEALFFSASLIKFLQGAWVPIALALVLLTVMYAWHYGTLKKYEYDVQNKVSINWLLDQGPSLGIVRVHGVGLLHTELVSGIPVIFFQFVANLPAFHQVLVFLCIKHVPVPHVKAKERFLVGRIGPKEFRIYRCIVRYGYHDVHRDDFEFENDLICSIAEFIRTERTESNSPNDEPLKDDRMAVVGTCSTHSLLMSEDKVDNVENVDLPGPSELKEIKSLKVTQQQKKRVRFLVPESPKIDTRVMEELEELMEAREAGVAYIIGQTHMRAKPGSSMLKKIGINLVYEFLRRNSRAPSFVTGVPHASSLEVGMMYQV

SEQ ID NO: 230077 - protein, 597 aa, Glycine max
  Coding DNA Sequence Number=SeqID_113299
  Gene Ontology: Mol. function=binding; Cellular component =intracellular; Biological process=nuclear mRNA splicing, via spliceosome
  Homolog annotation: Hit_ID=Q8W3F7; Match level="QueryCoverage=100%, HitCoverage=97%, E-value=0.0, Identity=45%"; Hit description =Putative pre-mRNA splicing factor
  Pfam annotation: Domain name=PRP1_N; Domain location=102-266; Score =286.9; E_value=3.9e-83; Accession=PF06424.3; Description=PRP1 splicing factor, N-terminal
  Pfam annotation: Domain name=TPR_2; Domain location=387-420; Score =16.5; E_value=0.093; Accession=PF07719.7; Description=Tetratricopepti de repeat
  Pfam module annotation: Pfam domain module=PRP1_N::TPR_2; Domain location=102-266::387-420
MVFIVSPNHKTFSIDINPNTTTLHLLKLAIQHILTLPISHQRLFLSHSRRLSADNDGSDDSLLISDLGVGPYSTLTLHVPFLGGTNPPAVPKPRFDFLNSKPPPNYVAGLGRGATGFTTRSDIGPARAAPDLPDRSATTIGGTSGAGRGRGKPGEDEDDDDGEDKGYDENQKFDEFEGNDVGLFASAEYDEDDKEADAVWEAVDKRMDSRRKDRREARLKQEIEKYRASNPKITEQFADLKRRLYTLSPDDWQSLEKFESGGYSSRNKKKRFESFVPVPDTLLEKARQEQEHVTALDPKSRAANGTETPWAQTPVTDLTAVGEGRGTVLSLKLDRLSDSVSGMTNVDPKGYLTVLNSMKITSDAEISDFKKARLLLKSVTQTNPKHPPGWIAAARLEELAGKLQAARQLIQKGCEECPKNEDVWLEACRLANPDEAKAVIARGVKSIPNSVKLWMQASKLENDDANKSRVLRKGLEHIPDSVRLWKAVVELANEEDARLLLHRAVECCPLHVELWLALARLETYDNAKKVLNRARERLSKEPAIWITAAKLEEANGNTSMVGKIIERGIRALQREGVVIDREAWMKEAEAGERAGSI

SEQ ID NO: 230078 - protein, 258 aa, Glycine max
  Coding DNA Sequence Number=SeqID_113300
  Gene Ontology: Cellular component=extracellular region; Biological process=sexual reproduction
  Homolog annotation: Hit_ID=Q9M0I2; Match level="QueryCoverage=87%, HitCoverage=86%, E-value=8e-92, Identity=68%"; Hit description =Expansin-B3 precursor
  Pfam annotation: Domain name=DPBB_1; Domain location=69-149; Score =122.3; E_value=1.4e-33; Accession=PF03330.8; Description=Rare lipoprotein A (RlpA)-like double
  Pfam annotation: Domain name=Pollen_allerg_1; Domain location=161 -241; Score=124.2; E_value=3.7e-34; Accession=PF01357.11; Description= Pollen allergen
  Pfam module annotation: Pfam domain module=DPBB_1::Pollen_allerg_1; Domain location=69-149::161-241
MQCQRFSAVLFLSLCFRIAQVYAHGDSDLDEHWYTGTATWYGDPEGNGSNGGACGYGTLVDVKPLKGRVAAVGPVLFKKGEGCGACYKVKCLDRSICSKRAVTVIITDECPGCRTDRTHFDLSGSAFGRMALSGENVKLRNRGEIPILYRRASCKYGGKNIVFHVNEGSTPFWLSLQVEFQNGDGVIGSMHIQQAGSSEWLQMKREWGANWCIIKGPLKGPFSVKLSTSTGKSLIAKDVIPSNWAPKASYTSRLNFLS

SEQ ID NO: 230079 - protein, 328 aa, Glycine max
  Coding DNA Sequence Number=SeqID_113301
  Gene Ontology: Cellular component=clathrin vesicle coat; Biological process=intracellular protein transport
  Homolog annotation: Hit_ID=Q9SKU1; Match level="QueryCoverage=73%, HitCoverage=71%, E-value=4e-50, Identity=47%"; Hit description =Expressed protein
MASFDSFEEQSHQSPTRGPFEDDNSYTDMGMGYESHQHYDYDDQHPQFNNVDPNNNNFSDNAHSPPVYGFGISTPNPDFVSPFEPAAADDTTFSSDGPMLPDPSQMQEEGRARREWRRLNAIHLEEKETREKEMRNQIIKEAEEYKEAFYEKRKVNCEKNKENNREREKIHLANQEKFHKEAHNHYWKAIAEIIPREVPNIEKRRGKKEGENKPSVHVIQGPKPGKPTDLARMRQMILKLKQNPPSHMMPPPPKEEKDAKEGKDGKDNKNAKEGKDDKDVKSSTPTATTGVVENKPSSPAKDVAANGEPQDPAIVEGEQVASSEPKAA

SEQ ID NO: 230080 - protein, 262 aa, Glycine max
  Coding DNA Sequence Number=SeqID_113302
  Gene Ontology: Mol. function=transcription factor activity; Cellular component=cytoplasm; Biological process=regulation of transcription, DNA-dependent
  Homolog annotation: Hit_ID=Q9SKT1; Match level="QueryCoverage=75%, HitCoverage=55%, E-value=2e-47, Identity=50%"; Hit description=AP2 domain transcription factor
  Pfam annotation: Domain name=AP2; Domain location=59-123; Score =139.2; E_value=1.1e-38; Accession=PF00847.10; Description=AP2 domain
  Subcellular localization annotation: CTP_CleavageSite=35; ConfidenceScore=5.05e-01
PEILLHLVHHHHQQQQQHQQQLLQYWSGALNLSPRGMLTRLGPDGRPLFSPPTQRINTTKLYRGVRQRHWGKWVAEIRLPRNRTRLWLGTFDTAEDAAMAYDREAFKQRGENARLNFPELFFNKDKKEQGEEEASSPVLSAIAKQNEPPPAHHRDVTIEESNENDSGDATVSDEVHAPAATASSEGVSQELVWGEMSAWFNAIPAAWGPGSPMWDDLDATNNLLCQSHIPFSNPNQQQFNDADDAQRQEQNTGPGYLWKDQD

SEQ ID NO: 230081 - protein, 528 aa, Glycine max
  Coding DNA Sequence Number=SeqID_113303
  Gene Ontology: Mol. function=sugar porter activity; Cellular component=integral to membrane; Biological process=carbohydrate transport
  Homolog annotation: Hit_ID=Q1T0Z1; Match level="QueryCoverage=99%, HitCoverage=100%, E-value=0.0, Identity=76%"; Hit description=Sugar transporter superfamily; Major facilitator superfamily MFS_1
  Pfam annotation: Domain name=MFS_1; Domain location=58-461; Score =100.6; E_value=4.7e-27; Accession=PF07690.6; Description=Major Facilitator Superfamily
  Pfam annotation: Domain name=Sugar_tr; Domain location=54-498; Score =412.3; E_value=6.7e-121; Accession=PF00083.14; Description=Sugar (and other) transporter
  Pfam module annotation: Pfam domain module=MFS_1::Sugar_tr; Domain location=58-461::54-498
MGFQQGNAEVGLSGITFGTKNKYKRMNSELPEGCDDVLHQEARRNSTWKYVIACAFYASLNNLLLGYDVGVMSGAVIFIKEDLKISEVKEEFLVAILSIISLLGSLGGGRTSDIIGRKWTMAIAAVIFQIGSLIMTLAPSFSILMVGRLLAGVAIGFGGSIGPIYIAEISPNNTRGFLTTFPEIFINIGILLGYVSNYSFSGFSPHINWRIMLAVGILPSVFIGFALFIIPESPRWLVMQNRIEEARSVLLKTNESDREVEERLAEIQQAAGVANCENYEEKPVWYELLFPSPSLRRMMITGIGIQCFQQISGIDATLYYSPEIFKAAGIEDNAKLLAATVAVGVTKTLFILVAIFLIDKKGRRPLLLVSTIGMTICLFSIGVSLSLFPQGSFVMALAILFVCGNVAFFSVGLGPVCWVLTSEIFPLRVRAQASSLGAVGNRVCSGLVDMSFLSVSRAITVAGAFFVFAAISSLAIVFVYMLVPETKGKSLEQIEIMFKNEHEREGSEMELGDVEVEQLVQDKTVLTN

SEQ ID NO: 230082 - protein, 420 aa, Glycine max
  Coding DNA Sequence Number=SeqID_113304
  Gene Ontology: Mol. function=transferase activity; Cellular component= intracellular; Biological process=nuclear mRNA splicing, via spliceosome
  Homolog annotation: Hit_ID=Q1SFG8; Match level="QueryCoverage=97%, HitCoverage=75%, E-value=0.0, Identity=38%"; Hit description=Protein prenyltransferase; PRP1 splicing factor, N-terminal
  Pfam annotation: Domain name=HAT; Domain location=18-50; Score=11.9; E_value=0.22; Accession=PF02184.7; Description=HAT (Half-A-TPR) repeat
  Pfam annotation: Domain name=HAT; Domain location=194-226; Score=3.0; E_value=8.4; Accession=PF02184.7; Description=HAT (Half-A-TPR) repeat
  Pfam annotation: Domain name=HAT; Domain location=326-358; Score=0.7; E_value=21; Accession=PF02184.7; Description=HAT (Half-A-TPR) repeat
  Pfam annotation: Domain name=TPR_2; Domain location=139-172; Score =4.5; E_value=9.9; Accession=PF07719.7; Description=Tetratricopeptide repeat
  Pfam annotation: Domain name=TPR_2; Domain location=180-213; Score =5.1; E_value=8.5; Accession=PF07719.7; Description=Tetratricopeptide repeat
  Pfam annotation: Domain name=TPR_2; Domain location=248-281; Score =8.6; E_value=3.3; Accession=PF07719.7; Description=Tetratricopeptide repeat
  Pfam annotation: Domain name=TPR_2; Domain location=312-345; Score =12.3; E_value=1.2; Accession=PF07719.7; Description=Tetratricopeptide repeat
  Pfam module annotation: Pfam domain module=HAT::HAT::HAT::TPR_2::TPR _2::TPR_2::TPR_2; Domain location=18-50::194-226::326-358::139 -172::180-213::248-281::312-345
EDRKRTWVADAEECKKRGSIETARAIYAHALTVFLTKKSIWIKAAQLEKSHGTRESLDALLRKAVTYRPQAEVLWLMGAKEKWLAGDVPAARAILQEAYAAIPNSEEIWLAAFKLEFENHEPERARMLLAKARERGGTERVWMKSAIVERELGNIEEERRLLDEGLKQFPSFFKLWLMLGQLEEQLAENEKRLDRMNAAKKVYEAGLRNCPNCVPLWLSLANLEEEMNGLSKERAVLTMARKKNPQNPELWLAAVRAELKHGYKKEADILMAKALQECPNSGILWAASIEMVPRPQRKTKSADAIKKCDHDPHVIAAVAKLFWHDRKVDKARTWLSRAVTLAPDIGDFWALLYKFELQHGTEENQKDVLKRCIAAEPKHGEKWQAISKAVENSHQPTESILKKVVVALGKEENAAENNKH

SEQ ID NO: 230083 - protein, 79 aa, Glycine max
  Coding DNA Sequence Number=SeqID_113305
DGDLDLNASPQALDKLLGHVLAFKACSKIDPSNVDCDDATHAECQSLSVTAYHDPVVGLPLTPKKRMSSDEADDELGSS

SEQ ID NO: 230084 - protein, 88 aa, Glycine max
  Coding DNA Sequence Number=SeqID_113306
MARMKKSSQMTSKVGKEIVDKIDSLEEQASQGSFVAHGRQDVLTTTIGQPEHPSRVNAAGVGVTIKQYFGPTSRSFCTSTSMAPEDLE

SEQ ID NO: 230085 - protein, 136 aa, Glycine max
  Coding DNA Sequence Number=SeqID_113307
MDSRDGGYCRGGSGASDDVNLSRSGSFDTGYSGLDDATSGLHLSPLGPSIIINGSYTNDQPCFYDVLDLFKSASSHGPFKCFMVLPLGYVLITWHVLDRGKCIGLHKWYKMVRTEYRTLGELVLLGKATSVNRCLV

SEQ ID NO: 230086 - protein, 40 aa, Glycine max
  Coding DNA Sequence Number=SeqID_113308
MEEARGEALAAQQHWFRRSNKASGNRLQDVVIDYRLPVLV

SEQ ID NO: 230087 - protein, 71 aa, Glycine max
  Coding DNA Sequence Number=SeqID_113309
  Subcellular localization annotation: CTP_CleavageSite=41; ConfidenceScore=5.30e-01
MAEPSKKRKGSSSTAAAAAHRRHGPSEAPTTPIHPSLSSPRSSTLFSSDDQRLWYLSQFSSRIILDPKYLD

SEQ ID NO: 230088 - protein, 348 aa, Glycine max
  Coding DNA Sequence Number=SeqID_113310
  Gene Ontology: Mol. function=nucleic acid binding; Cellular component= nucleus; Biological process=chromatin modification
  Homolog annotation: Hit_ID=Q5BN47; Match level="QueryCoverage=100%, HitCoverage=10%, E-value=1e-158, Identity=77%"; Hit description =SPLAYED splice variant
  Pfam annotation: Domain name=DEAD; Domain location=22-180; Score= -36.9; E_value=0.0074; Accession=PF00270.19; Description=DEADDEAH box helicase
  Pfam annotation: Domain name=ResIII; Domain location=18-174; Score =4.3; E_value=2e-05; Accession=PF04851.6; Description=Type III restriction enzyme, res subunit
  Pfam annotation: Domain name=SNF2_N; Domain location=24-306; Score =349.9; E_value=4.1e-102; Accession=PF00176.13; Description=SNF2 family N-terminal domain
  Pfam module annotation: Pfam domain module=DEAD::ResIII::SNF2_N; Domain location=22-180::18-174::24-306
MAHSIKESIAEQPSSLQGGKLREYQMNGLRWLVSLYNNHLNGILADEMGLGKTVQAKNDRGPFLVVVPSSVLPGWDSEINFWAPGVHKIVYAGPPEERRRLFKERIVQQKFNVLLTTYEYLMNKHDRPKLSKIHWHYIIIDEGHRIKNASCKLNADLKHYQSSHRLLLTGTPLQNNLEELWALLNFLLPNIFNSSEDFSQWFNKPFESAGDSSPDEALLSEEENLLIINRLHQVLRPFVLRRLKHKVENELPEKIERLIRCEASSYQKLLMKRVEENLGSIGNSKARSVHNSVMELRNICNHPYLSQLHAEEVDNFIPKHYLPPIIRLCGKLEMLDRLLPKLKATDHR

SEQ ID NO: 230089 - protein, 116 aa, Glycine max
  Coding DNA Sequence Number=SeqID_113311
AHWQLLVMYPGDNIVLWFCSLRKKPDAAIKAAVNSAMKSLSKSEEGKPAQPVPQWIEAKSHVQMGNYECGYYVMHCAYSTKFRALLSLSPHSSPSSSKLLSMASYGGELLLDSSSP

SEQ ID NO: 230090 - protein, 172 aa, Glycine max
  Coding DNA Sequence Number=SeqID_113312
  Homolog annotation: Hit_ID=Q5BN47; Match level="QueryCoverage=88%, HitCoverage=4%, E-value=8e-32, Identity=47%"; Hit description =SPLAYED splice variant
GFKTVPVDNASKHGISFATEQDGNERLVSADFPPSPKYTMSERWIMDQQKKRRLLEQNWMLKQQKTKQRMATSFHKLKENVSSSEDISAKTKSVIELKKLQLLELQRRLRSDFLNDFFKPIATEMEHLKSIKKHRHGRRVKQLERFEQKMKEERQKRIRERQKEFFSEIEVH

SEQ ID NO: 230091 - protein, 98 aa, Glycine max
  Coding DNA Sequence Number=SeqID_113313
  Homolog annotation: Hit_ID=Q1EPJ3; Match level="QueryCoverage=34%, HitCoverage=11%, E-value=5e-08, Identity=73%"; Hit description=DNA -binding WRKY domain-containing protein
  Pfam annotation: Domain name=WRKY; Domain location=47-98; Score=-4.6; E_value=0.0026; Accession=PF03106.6; Description=WRKY DNA -binding domain
MEVCTIWHLEENLTDVLARFRNKPKKKEKKSREPRFVFFTKTEINHLEHGYRWRKSGQKAVKNSPYLRNSAHKDPSFRGLGSKVHERENNKMVVEHDS

SEQ ID NO: 230092 - protein, 38 aa, Glycine max
  Coding DNA Sequence Number=SeqID_113314
MATYGIKTSSAVQAISNSPGSQHQFPVSQSKRAVVQKF

SEQ ID NO: 230093 - protein, 154 aa, Glycine max
  Coding DNA Sequence Number=SeqID_113315
MGVSQKRKIRIRVIQVQDSDSDLVVQLKKEQNFRICIPMKSKTESDAKVISLRPTHLQFSVWKEQNQIREQAGIRAMTDFSFGSTNFCGTSKRNSQVVKAGEIVLFVTCEEQKSVGRELSTCCNKGTPKENSYVTVLFVHTRDVLNADWWLHHW

SEQ ID NO: 230094 - protein, 79 aa, Glycine max
  Coding DNA Sequence Number=SeqID_113316
MTIVDFGAFLDGPVQVPVLEFVAFYDGHFQPLLISSLLFTTSETTTVVNRYRMPSITNIECCFCSSDITIIMNVLRYFI

SEQ ID NO: 230095 - protein, 610 aa, Glycine max
  Coding DNA Sequence Number=SeqID_113317
  Gene Ontology: Mol. function=nucleic acid binding
  Homolog annotation: Hit_ID=Q5BN47; Match level="QueryCoverage=79%, HitCoverage=10%, E-value=6e-49, Identity=44%"; Hit description =SPLAYED splice variant
  Pfam annotation: Domain name=QLQ; Domain location=388-423; Score=6.9; E_value=0.051; Accession=PF08880.1; Description=QLQ
MASSHNVELEAAKFLHKLIQDSKDEPAKLATKLYVILQHMKSSGKEHSMPYQVISRAMETVINQHGLDIEALKSSRLPLTGGPQIGSSSQSVNVTKDSRVGLAENEVSKMDPFASGRPPVAPSGGAPDYYQGSVAQRSSQSFDQGSPSSLDSRSANSQSQDRRDTANWDKQVSQKDGKKATTKRKRGDTSSPVELHVDSPSQLDPRNTGVNARKGKITKAESSDGLPVKNGELTNFNMTPNSGQMENVSALSGSMRTMLRANQEGHHLLAKQTDLTKVGNPMVRAPNSKYAEDTEVSSAHIASGKQQGAYANVHGGMSLAAGASSMVEAFSNSMQYGGAVERDRGSSTTLSDGHKIVQVGRQNSGSEMNMLRQGVSPRDTGKSTVPAMPFKEQQLKQLRAQCLVFLAFRNGLAPKKLHLEIALGTAFSREDGSRKDLIDLKGKSQSFNEPGNSSGAMMPFGGPSNARQTDKNLLGSSSVGKIVEADSLSKGTESPRMLEDKGNLHVTKRGEVDRRIQERVASQASSATSCQQQDSSSTRGALVGNNHLDDVDIGNMQVGRSNQSSVAGPNNWAGFAGANEASKGPPQVSAIQHELPIERRENIPSQFQNV

SEQ ID NO: 230096 - protein, 895 aa, Glycine max
  Coding DNA Sequence Number=SeqID_113318
  Homolog annotation: Hit_ID=Q3LHL2; Match level="QueryCoverage=16%, HitCoverage=29%, E-value=6e-27, Identity=40%"; Hit description =Hypothetical protein PPS5
  Pfam annotation: Domain name=DUF292; Domain location=254-374; Score =204.0; E_value=3.5e-58; Accession=PF03398.5; Description=Eukaryotic protein of unknown function, DUF292
  Pfam annotation: Domain name=Hin1; Domain location=102-228; Score =12.8; E_value=0.00013; Accession=PF07320.4; Description=Harpin -induced protein 1 (Hin1)
  Pfam module annotation: Pfam domain module=DUF292::Hin1; Domain location=254-374::102-228
MATFLRSSTLSRSRRYKYETLGGVPSSGRDHILKSISYRRRRAKQRKIFLTTYKLDSFTEPESPKLNNVALKFKKIVASVLKLVQTKAAYVPKRYESLENPFAHKPPRKRSRRGSGFCGKESKVYTDVVIVVKADNPNEEIGLDYLENEVGIMYVGSQLSSGQIPPFLQPGKNTTTVTVELKGENEFSVEMQNHFMEDQEKGNIPLLITVKLPIRIVINDLIHLRKVVEWKAEEIGVGLAYLGLIMGIVAIKRARCRLRLLKNKRQAIARQLRKDLAELIQSGHEETAFNRVEQLMGDESLTAAYELLDHFCEFILTQLSYIQRHKDCPNDINEAVSSLIFASARCGDLPELGVIRKLFGQRYGERFATAAVELSPGNLLKENLSVKSVPDDMKYRMVDEIARDNCLQQQVLAIQYYPDWQQVQVKENKGYQLVESDAKIIDIISGFKVHPSEIEEITRDVTCVNPSISKQSDSCSLPEPNLADTSAMASAVQQYPPYFLRYPLEKKVVDIDFPELLSSLNFDLQNKGERMALTSSAQRVSFPPYSEEMVDYVDGIKEFSVPNDGGCQDQMLFKFRSSGLSRRQKTQFGYDSDIGQDGSESENSSTRTSTKSKRRPEKRSRRRSSSMENLGLMDIGYMIYYHKPCKSPLAHKHSSRKHHKPSLEGISPSSYGQKRLMLHGFSEEGNVLQSCHSQDGTRRKLFNFKMSGCSLDQPCYFCLHDDEDYLEPQSMKQKRGIRATHAQQELLPDECCHCQLFCDNELNQGIELVTIPRRPNRRSYSGAAEYHVFNYQDCQAGNGNNETKEKISASPKVSNPRTGGSSTIVETEATYSRAMTMPQERHRNSKDKMLRTYSCPSPHPIHVHPKLPDYDDIAAKFTALKKERMENMDRSKDQN

SEQ ID NO: 230097 - protein, 107 aa, Glycine max
  Coding DNA Sequence Number=SeqID_113319
MSSTNSSQLKPHEYGDGSNDESSSISSNFSSNQDDQEQPITPCGFINPLKAHEGHFYLHPCTDDGINVITFLDHYLHYECYPIPIMSWFQTSGSKELRIAAKEADWK

SEQ ID NO: 230098 - protein, 291 aa, Glycine max
  Coding DNA Sequence Number=SeqID_113320
  Subcellular localization annotation: CTP_CleavageSite=64; ConfidenceScore=5.65e-01
IISYTLCTGFFVTPTTSGLRTAPSLFHSWRPLRPPPISKPSLADLSFSGEIPSSVSIFSAPLTVQSLKTSNCQSLPLEDPDVEEVKYFVEKRFGVEILLGLNAFGEDGILSLGTLSLSKDAKAFAASFCSDHHGAAEVVAVVTDEEGEGLQSRGLWSLVGVGKKNLVPEERARIEAQIKTAEAAARMRAEEESRQRREKEREASRAAIEKMKRTVDIEHNMEIIKELESLSGCTLSYKAVGGRNGYKVALETLDKHQFENPLERLGLFIKEDFTTDLDEEVQASGSSSELL

SEQ ID NO: 230099 - protein, 267 aa, Glycine max
  Coding DNA Sequence Number=SeqID_113321
  Gene Ontology: Mol. function=structural molecule activity
  Homolog annotation: Hit_ID=Q5JMK3; Match level="QueryCoverage=93%, HitCoverage=82%, E-value=8e-10, Identity=33%"; Hit description =Putative VAP27
MATHLLHIEPAELRFVFTMQAQRMAPPDMLCKDKFLIQSTVVPVGTTEDDITSDMILKRLNDFRPFLFQQFAKDSGKFIEEKKLRVVLISPPSSPVLLPVNGDMKHDPSNEINVQKDRLPSGVENIPPPRKLSNNHHPNVSEEVKGLEPAQDMKEDRADEDIVPRQAENVGDMKPAKDDVQSNLANESEELKSKLSVMDSKLREAEVTITKLNEERRRNTQEKDLLKKELEVLKRQINTKGNQAGFPFLFVCMVALISVAVGYYIHP

SEQ ID NO: 230100 - protein, 424 aa, Glycine max
  Coding DNA Sequence Number=SeqID_113322
  Gene Ontology: Mol. function=kinase activity; Cellular component =cellular_component; Biological process=regulation of transcription, DNA-dependent
  Homolog annotation: Hit_ID=Q7XIR9; Match level="QueryCoverage=35%, HitCoverage=29%, E-value=4e-34, Identity=52%"; Hit description =Putative RING3 protein
  Pfam annotation: Domain name=Bromodomain; Domain location=79-168; Score=123.8; E_value=4.7e-34; Accession=PF00439.15; Description =Bromodomain
MIATETIVPSTKLKIKFSTKRIEIDSGPKCEFGQKVYHNDKNRRCNSNENSSALNSNKRGPPVSVEGQKEKRQKIDRKGSMQCATILKSLMSHSYSWVFLKPVDPVALSIPDYFTIISHPMDLGTIKSKLERNIYSGTEEFADDVRLTFSNAMKYNPPGNDVHMMAKELSKIFDRKWKDFGRKWKFEDEHDKSETETIKETGRKSLDAMLPRHKDSLPKKTQLFEHKGMHKIRSLATKDARVETPKLSQIPCKLIEKDLHKGSKGNHDVEQPAGSLKSYFSVRFVTSKCRICGNIICHCENPSNSTQVSSDISSEGSEGRDLIARGADSLRQDCRTKCTSPMEKKSDLDSDGAVSSLDSEHVCPSSQHVTPTTDASSGEGQLLFAYYASVNCCYLLYVDLYGANLYAVCCFSMEHACFARPAFS

SEQ ID NO: 230101 - protein, 396 aa, Glycine max
  Coding DNA Sequence Number=SeqID_113323
  Gene Ontology: Mol. function=sodium:hydrogen antiporter activity; Cellular component=integral to membrane; Biological process=sodium ion transport
  Homolog annotation: Hit_ID=Q4VT46; Match level="QueryCoverage=85%, HitCoverage=56%, E-value=1e-139, Identity=77%"; Hit description=Nhx1 antiporter
  Pfam annotation: Domain name=Na_H_Exchanger; Domain location=4-396; Score=56.7; E_value=7.8e-14; Accession=PF00999.11; Description =Sodiumhydrogen exchanger family
  Subcellular localization annotation: CTP_CleavageSite=39; ConfidenceScore=5.73e-01
MSPSSTGFGMPKSKCSLRCKPSSSTLSFHHTPMPINTIPFQVKKKQFFRNFMTIMLFGAVGTLISFCIISLGAIHFFQKLDIGSLKIGDFLAIGAIFSATDSVCTLQVLNQDETPLLYSLVFGEGVVNDATSVVLFKAIQNFDLSHIDLTTALQLLGNFLYLFIASTVLGIFAGLLSAFIIKKLYFGKLIRHSTDREVALMVLMAYLSYMLSELFSLSAILTVFFCGIVMSHYTWHNVTESSRVTTKHVFATLSFIAEIFIFLYVGMDALDIEKWRIVSQSPRKSIGVSSLLLALILVGRAAFVFPLSFLSNLLKKSQSEKIELKQQVCAFLPFPCQGLELLITEVLHSCDDLVSQVTIWWAGLMRGAVSIALAYNQVKESNFIAFNSSSLATFKF

SEQ ID NO: 230102 - protein, 283 aa, Glycine max
  Coding DNA Sequence Number=SeqID_113324
  Gene Ontology: Mol. function=protein phosphatase type 2C activity; Cellular component=nucleus; Biological process=protein amino acid dephosphorylation
  Homolog annotation: Hit_ID=Q1SAL1; Match level="QueryCoverage=99%, HitCoverage=59%, E-value=1e-116, Identity=77%"; Hit description =Protein phosphatase 2C-like
  Pfam annotation: Domain name=PP2C; Domain location=1-169; Score= -37.9; E_value=0.00096; Accession=PF00481.12; Description=Protein phosphatase 2C
GSTAVTIVKQGSNLFMGNIGDSRAIMGSKDGNDSMVAIQLTIDLKPDLPREAERIKQCKGRVFALQDEPEVHRVWLPFDDAPGLAMARAFGDFCLKEYGVISIPEFSHRLLTDKDQFIVLASDGVWDVLSNEEVVRIVSSAPTRSSAARTLVDSAAREWKLKYPTSKMDDCAVVCLFLDGKMDSESDCDEQCSSSATIQKNHWGNPVESDDSQKPEPSLRRNFTVRSSEENETYGGGGVEEVSVGVEDRTSAAEDQHWSGLEGVTRVNSLVQLPRFSEERPNS

SEQ ID NO: 230103 - protein, 392 aa, Glycine max
  Coding DNA Sequence Number=SeqID_113325
  Gene Ontology: Mol. function=protein binding; Cellular component =cytoplasm; Biological process=abscisic acid mediated signaling
  Homolog annotation: Hit_ID=O82257; Match level="QueryCoverage=98%, HitCoverage=89%, E-value=1e-129, Identity=60%"; Hit description =Putative tubby protein
  Pfam annotation: Domain name=F-box; Domain location=12-67; Score =28.4; E_value=2.5e-05; Accession=PF00646.23; Description=F-box domain
  Pfam annotation: Domain name=Tub; Domain location=79-392; Score =485.6; E_value=5.8e-143; Accession=PF01167.8; Description=Tub family
  Pfam module annotation: Pfam domain module=F-box::Tub; Domain location=12-67::79-392
MIEVQANAMEQSWWANMPHELLREVLLRIESSESTWPLRRSVVACGGVCRTWRRLIVKEIVKPPQFSSNITFPISLKQPGPREHLLQCFIRRNSASQTYYLFLSLSSALVADDGKFLLAARKFRRPTCTDYIISLDADDMSRESNAYVGKLRSTLNQILLLAILLFLFLSAKTNPLSSHFIRSNFLGTKFTIYDRKSCSTELVVNSKQVSPRPRVPTGNYPVAHISYELNVLGSRGPRRMHCVMDTIPASAIEPGGVAVAAPSQTDFSVSNRDTSFPFFQTNSTSLENSISGDQSNKKDDVLVLRNKAARWHEQLQCWCLNFHGRVTIASVKNFQLAVSPENGHAGLQEDEVILQFGKIGKDLFTMDYRYPISAFQAFAICLSSFATTVACE

SEQ ID NO: 230104 - protein, 106 aa, Glycine max
  Coding DNA Sequence Number=SeqID_113326
MGNGDWLLLNFPSEAHNNKENSNLDERYWRINQVGIESNAENLENDEAEESEEEQNEKVIDKDKERGGAVIPLILRFGDGFVQFFDLRHCRAERRVEGSDLHRGYC

SEQ ID NO: 230105 - protein, 113 aa, Glycine max
  Coding DNA Sequence Number=SeqID_113327
MACRPSSFLALLLITTILLATTWQAVARRHIGPKHSNNGDKKEPQFLFPPEGLPPFFGFTPQNPNTGGSGLGSGPAGRGYVPGGDDTFVPNPGFEVPNPGSGGGVPVPVPVNP

SEQ ID NO: 230106 - protein, 67 aa, Glycine max
  Coding DNA Sequence Number=SeqID_113328
MEKVAALLEDDEEREQVVFEDLSSMKETLTIEKDHITKMTNGKPSGKVELRKWKQSDLVLNPSNGDS

SEQ ID NO: 230107 - protein, 153 aa, Glycine max
  Coding DNA Sequence Number=SeqID_113329
  Gene Ontology: Mol. function=hydrolase activity; Biological process =intracellular signaling cascade
  Homolog annotation: Hit_ID=Q69L69; Match level="QueryCoverage=95%, HitCoverage=21%, E-value=1e-21, Identity=38%"; Hit description =Calcineurin-like phosphoesterase-like protein
  Pfam annotation: Domain name=DUF1723; Domain location=27-76; Score =60.3; E_value=6.2e-15; Accession=PF08330.1; Description=Protein of unknown function (DUF1723)
MSSLDPRIEPLLVQVGFSDVVKLRQVKIDNGLVIALVGRWRPESNTFHLLVNECTITLEDVALQLGLHIDGRPVTDPTYYENALMGSTLKLKWFKENMLTLPAEPTPQQFVAHCKAYILRLIGGVLMPNKLGNKVHLIYLPLLTDLDWAGWYN

SEQ ID NO: 230108 - protein, 165 aa, Glycine max
  Coding DNA Sequence Number=SeqID_113330
MEVHLFIFIYYSSKHAEAISLQVEAPANVVDDIIVRKVPIYLIDTGVMDKTLEVSHAAPADEVVPQDKEPASKQFITSHEATSREKGEPDAIIVYSTSLGLTPLNYPLATIMTRDQNLQQAQMIMLGVVAPTPVPTQEPTTLKPTPLSIEATPPTQPSPPPQVQD

SEQ ID NO: 230109 - protein, 75 aa, Glycine max
  Coding DNA Sequence Number=SeqID_113331
MDKSLKVEEDEWRERERERRNTKFCASNEPNLLGVFYPMPLGNRIASMSMDEEDLPMEQEIIEEDSTQDSSEESY

SEQ ID NO: 230110 - protein, 166 aa, Glycine max
  Coding DNA Sequence Number=SeqID_113332
MEYSLPYYHNQGQMTRLMLHPSFYIDVIETKWKHYDVLHPTPSYYHFAASMSKFVIPFESHSPFTDITMFYAGSDSSSKDTNATSPSLMYPHLVLPKAWVPPGVDMVDLVWEDEGENRGRTGGGHVYEEKMSDVALCGACRPWIFFINGVLLFLRFNGRGMEKEER

SEQ ID NO: 230111 - protein, 235 aa, Glycine max
  Coding DNA Sequence Number=SeqID_113333
MYVKELLKKFNIKDAKQIKTPMHSTTDLGLDIESTKVDGTQYKRAYHPMNLSIHLHRSTYGHLLTHLHLSIETLGIAFTLSKKTFRLPFYDQTLFLTLHLTSLMNASNSFVVEIIPVIEITIIHIENEPSIHIEHFFDIQELEKRNVEFANRKVIIPKFWEPRWCFPAILLPRPLGSFLREALIKKGGTRMMTPMWQRLCKKRMMIKLGKCGSKASKLILMMPKTQVKNQDSSKF

SEQ ID NO: 230112 - protein, 37 aa, Glycine max
  Coding DNA Sequence Number=SeqID_113334
MTRHSPMEGAIQGEVEAVSLMGGARQADVMFDNMKVY

SEQ ID NO: 230113 - protein, 104 aa, Glycine max
  Coding DNA Sequence Number=SeqID_113335
  Gene Ontology: Mol. function=ligase activity; Cellular component =cytoplasm; Biological process=response to auxin stimulus
  Homolog annotation: Hit_ID=Q9ZNS2; Match level="QueryCoverage=98%, HitCoverage=17%, E-value=1e-31, Identity=63%"; Hit description =Putative GH3-like protein
VEKGSQLLNKAKAELVDFTSYADVSNQPGCYVIFWEIKGEAEDKVLEACCREMDAAFVDHGYVVARKTSSIGPLMLCIVERGTFKKILDYFVENGAGLGQFKTP

SEQ ID NO: 230114 - protein, 482 aa, Glycine max
  Coding DNA Sequence Number=SeqID_113336
  Gene Ontology: Mol. function=ligase activity; Cellular component =cytoplasm; Biological process=response to auxin stimulus
  Homolog annotation: Hit_ID=Q9ZNS2; Match level="QueryCoverage=95%, HitCoverage=76%, E-value=1e-152, Identity=60%"; Hit description =Putative GH3-like protein
  Pfam annotation: Domain name=GH3; Domain location=19-482; Score =411.8; E_value=9.7e-121; Accession=PF03321.4; Description=GH3 auxin -responsive promoter
MEPQILGYNNNGNCLSDSDIITWFEDVSKNAGSVQTQTLCKILKQNCGVEYLKKWLGDYNISEMDASALESLFTSVVPLASHKDFEPYIRNIADGDTAPILTQQPITTLSLRLCSSGTTEGKQKLVPFTRHSAQTTLQTFTLAAAYRSRVYPTREGGRILEFIYSSNHFKTKGGLTVGTATTHYYASEEFKTKQEKTKAFTCSPYEVISGGDYKQSTYCHLLLGLFFSDHVEFISSAFVYGIVQAFCTFEEVWKDLCNDIRDGTLSSRIKLPKMREAVLGIITSNPSLASKLEATCLELEDVDWFGLVPKLWPNAKFVCSIMTGSMQPYLKKLRHYTNGVPLISGDYGSTESWIGVNVDPSLAPEKVTFAVVPTFSYFEFIPLYYRQKQGCSSVADHDFMEEEPIPLSQVVHKSLFVTPNKLFQTFGSPTQQKFFHTVWQDWLEPLSSHKIMLSVETLFRKEAIDDPQLDMNKDMYRIISYL

SEQ ID NO: 230115 - protein, 211 aa, Glycine max
  Coding DNA Sequence Number=SeqID_113337
  Gene Ontology: Mol. function=protein translocase activity; Cellular component=chloroplast outer membrane; Biological process =intracellular protein transport
  Homolog annotation: Hit_ID=Q9LUS2; Match level="QueryCoverage=82%, HitCoverage=17%, E-value=7e-39, Identity=50%"; Hit description =Chloroplast outer envelope protein-like
  Pfam annotation: Domain name=AIG1; Domain location=2-179; Score= -55.0; E_value=6.1e-06; Accession=PF04548.7; Description=AIG1 family
  Pfam annotation: Domain name=MMR_HSR1; Domain location=1-105; Score= -15.3; E_value=0.025; Accession=PF01926.13; Description=GTPase of unknown function
  Pfam module annotation: Pfam domain module=AIG1::MMR_HSR1; Domain location=2-179::1-105
MLIGKTGVGKSATINSIFDEVNKANTSAFHMGTDKVHRVVGTVEVSRCVKLTRLDFYLPGQISQRRNEKILHSVKRFVEKTTPPDVVLYLDSDDMPLLHTITKILGPSFWSNAIVVLTHAASSSSYSYDLFVTLGSHVVHETIRRAVGDNKDLRNPVVLVENNMRVLPNGQDSRPRPTKKPSLPFLLSSLLKIRPQLKSSSAKDLTSLTTP

SEQ ID NO: 230116 - protein, 90 aa, Glycine max
  Coding DNA Sequence Number=SeqID_113338
MDFEICQIVQQKAVKFVQQNFPNVQKNACALLVMGKGPGAERNEGKGYVGVQWYLEICRGGQETLGTSGGVLLPKTKLDQSRANPGIVSQ

SEQ ID NO: 230117 - protein, 88 aa, Glycine max
  Coding DNA Sequence Number=SeqID_113339
MSRWRDLAGGDGHPVGLTEAHNQSWKHQGSIGLLRDPHSSPCSGWVKSCPGKHSICTIASLSGCARTVCTPPGSRGGSGTDKRKLLAP

SEQ ID NO: 230118 - protein, 222 aa, Glycine max
  Coding DNA Sequence Number=SeqID_113340
  Gene Ontology: Mol. function=chitin binding; Cellular component =extracellular region; Biological process=chitin metabolic process
  Homolog annotation: Hit_ID=UPI000044A8F0; Match level="QueryCoverage =93%, HitCoverage=99%, E-value=3e-27, Identity=29%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHSLTLRGLHILAIRGLHILAFRGLHALTLRGLHVLAIRGLHVLAFKGLHALAFRGLHVLAFRVLHALAFRGLHILAIRELHVLAFKGLHALAFRGLHALAYRGQHALAFRGPHVLAFRGLHALAFRGLYILPFKGLHVLAFRGLHVITFRGLHALTFRLHVLAFRGLHVLAIRGLHVLAFRGLHALAFRGLYILAFRGLRVPTFSGLHIRTLRVFKVLYP

SEQ ID NO: 230119 - protein, 46 aa, Glycine max
  Coding DNA Sequence Number=SeqID_113341
MRVSAKRNTPGLSARKNPEEDELYRFAKRVDRLTVKEKLKPKPVSL

SEQ ID NO: 230120 - protein, 56 aa, Glycine max
  Coding DNA Sequence Number=SeqID_113342
MEQGWFLDSQLRNCRRFWFIVCLLRLGRTWLIGQCRNVNFDSIKAAESVKSLAISL

SEQ ID NO: 230121 - protein, 203 aa, Glycine max
  Coding DNA Sequence Number=SeqID_113343
  Pfam annotation: Domain name=HLH; Domain location=52-100; Score=20.9; E_value=0.00086; Accession=PF00010.16; Description=Helix-loop-helix DNA-binding domain
  Subcellular localization annotation: CTP_CleavageSite=51; ConfidenceScore=5.11e-01
MQGHAETNNSIMAPLSQIPPSSSLHPSNIAETGNIYTTTSRKRVKKMDHTNCESLNVERERRSKMTQMFTQLQTTVPGVLPQATREVIINETIKYIKELEMKMQKLEELKESMKEGSILLACGNNNMNCSVTVSVSANVAFFGIQSLPRSGLVSVIMKVFCKHRAEILAANVSVNNGKLILAITAMVQNGGVVENIRRQILSL

SEQ ID NO: 230122 - protein, 50 aa, Glycine max
  Coding DNA Sequence Number=SeqID_113344
MGLDDTPQPKSKAAAGWIVVKCNRQKGSTECGYYVMHLMSTIILRSFRNN

SEQ ID NO: 230123 - protein, 60 aa, Glycine max
  Coding DNA Sequence Number=SeqID_113345
MGKDYSKAKHAGQGCQCLAKERKKKKEIREIDKRLGIEIPNPYLNLVNKACNKNFILNVL

SEQ ID NO: 230124 - protein, 206 aa, Glycine max
  Coding DNA Sequence Number=SeqID_113346
MGCCFSTPNSKPPQNGDKHQQPHLGSHEQNCRIRIRQSVEEESVKEVLSETPISKPQQVPTLMPQTKTQLPVIQPQKKFLSCWKHAATARASPPPPPPPPSRKTEKTKPRAREATELAIGSVLTPSTAETGGPNLRRESRKFRQGHGHFAGGSPTMSAVILARGLSGSRGLRRVAVGVSSGRREGLAGEFLRLRLRVLWRKTTPFQ

SEQ ID NO: 230125 - protein, 197 aa, Glycine max
  Coding DNA Sequence Number=SeqID_113347
  Gene Ontology: Mol. function=metal ion binding; Cellular component =cytoplasm; Biological process=ubiquitin cycle
  Homolog annotation: Hit_ID=Q2QP88; Match level="QueryCoverage=88%, HitCoverage=61%, E-value=4e-66, Identity=65%"; Hit description=CHY zinc finger family protein, expressed
  Pfam annotation: Domain name=zf-C3HC4; Domain location=66-108; Score =40.4; E_value=6.1e-09; Accession=PF00097.15; Description=Zinc finger, C3HC4 type (RING finger)
MGEYFCNICKFFDDDVEKEQFHCDDCGICRVGGRDNFFHCKKCGSCYAVGLHDNHLCVENSMRHHCPICYEYLFDSLKDVIVMKCGHTMHHECYLEMIKNDKYCCPICSKSVIDMSKTWKRIDEEIEATVMPQDYRNRKKFTSTFLAKNVVTADHIIPAQLHLQFFPNDQISWVQEGNTVSRKLKLAPCYYYGGLLN

SEQ ID NO: 230126 - protein, 72 aa, Glycine max
  Coding DNA Sequence Number=SeqID_113348
MGSNWLRRMYGKKRVFETYDNKTLDLLLCNFDLHGLILSELKQSVEENATGLITLNNFSVLSPSDPKWEGAL

SEQ ID NO: 230127 - protein, 160 aa, Glycine max
  Coding DNA Sequence Number=SeqID_113349
MGCVGNNPSPTSTNNTTILDFISERQPSPLELAFRVELGLSNSLSKMSSLCGDKHPPFVVHAPSLGSAWREEGQPSPLELAFGVDLDPNSHSKMISEKVLPLLAEAGDFHEFENTVSELVKFLDSLLDAAVTDPDSEMQRMMHLKLSLRSIDIFVLLLLT

SEQ ID NO: 230128 - protein, 105 aa, Glycine max
  Coding DNA Sequence Number=SeqID_113350
  Subcellular localization annotation: CTP_CleavageSite=79; ConfidenceScore=5.27e-01
MGPIKTVMSAARCTQQYCWCTQQLCFFLPPAQLLHSSSSLPVFFFFTAIAAIVAVFRRKVWVFAFVVWVFTFVLLLRVSASSSRKRCREVAGLFTDHLIRKLLAA

SEQ ID NO: 230129 - protein, 190 aa, Glycine max
  Coding DNA Sequence Number=SeqID_113351
MGCGKSKHDVASGNTVLQRKKSTVNSKENNETQTVDKNNDANVDNVSLEVEEKNKENVKEIGVEGKGGDESNDVAGITKVQQEDKALEKSAQAEAEENEAPEEVKAVAVAEEKQPTEENKYEVDVSIKEETLPLVKEEESKDTDEEALVKEEESIGTKEETLDKEEETKETTEQEKTLVKEGETKGTTES

SEQ ID NO: 230130 - protein, 59 aa, Glycine max
  Coding DNA Sequence Number=SeqID_113352
MVGAFSQNIVTLTGLPMILLSESDLTNPWCARNVITHSLCVVVFGSCDDLELVFGGADE

SEQ ID NO: 230131 - protein, 465 aa, Glycine max
  Coding DNA Sequence Number=SeqID_113353
  Homolog annotation: Hit_ID=Q2HRX8; Match level="QueryCoverage=27%, HitCoverage=16%, E-value=2e-10, Identity=34%"; Hit description=IMP dehydrogenase/GMP reductase
  Pfam annotation: Domain name=DUF1723; Domain location=161-210; Score =42.0; E_value=2e-09; Accession=PF08330.1; Description=Protein of unknown function (DUF1723)
PHHQKPGTELLPPSPFHLKIMVWTKGLSRALGHVTGKGRVVVTAAHDELVVLAPNVEADVFPDDPMAPADSEEIVADIPADTGVEAAEDEHEGFSGGPSDPSVLTQYADHIACSVWTGERPELKLSSHGRKVHSLGRPVPAIDGLVAGTGLSPLIACSVDTGDWGLLSSFVERWHRETSSFYLSVGELTITLDDVSSLLHLLVVGDLHAFQPLHVDDVVQMLVDLLMVSAESAMAKTAQCRGPYVRLQWGVAALVHMYDQLNDASISNSRQLGSYITLLQVDCDEEDREEHMYTGILGAPGPTLNSGCLLDPFGYTQTIPAPPVDSWVSYDDIHDKWMHYSDHIVSAGEVCTVPGQCASDYMDWFFHILHPFMTPGHASDPLPDGHALQPRVVPQAPQTDISHVPEPGAPSTSVEEPRHAVEVCDEIAERLECHLSLGVVTPGSSTHEVIEECLRMARSVTQDHL

SEQ ID NO: 230132 - protein, 315 aa, Glycine max
  Coding DNA Sequence Number=SeqID_113354
  Gene Ontology: Mol. function=protein binding; Cellular component =signalosome complex; Biological process=red or far red light signaling pathway
  Homolog annotation: Hit_ID=Q8W1P0; Match level="QueryCoverage=65%, HitCoverage=50%, E-value=6e-56, Identity=57%"; Hit description=COP9 signalosome complex subunit 6b
MSLSDSHFVSQFSYHVVEKCWRSDVVDVKSGRGDLRYDEYLYTSGRTSRGYEGSYGVYDLGEGNVEDKSILDFLLAHDFTIANTLFFGVVLSAYCTKEINCVIAGAGYYNTELHVIDGIPQLIFVRSSYTIETVEAERISVDHVAHLKPSDGGSAATQSFGVGEVFDFCSDCQLVMSLNNRGGLSWAVNSKHEILLNLTKASEGFMAAHLTGIHSAIKMLHSRIKVLHHYLLAMQKGDVPCENSLLRQVSSLLRRLPAIESGKFQDDFLMEYNDTLLISYLAMLTNCSSAMNELVDKFNIAYDRHSRRGGRTAFM

SEQ ID NO: 230133 - protein, 602 aa, Glycine max
  Coding DNA Sequence Number=SeqID_113355
  Gene Ontology: Mol. function=nucleic acid binding; Cellular component= nucleus; Biological process=chromatin modification
  Homolog annotation: Hit_ID=Q5WN07; Match level="QueryCoverage=84%, HitCoverage=44%, E-value=0.0, Identity=87%"; Hit description =Putative ATPase
  Pfam annotation: Domain name=DEAD; Domain location=185-351; Score= -31.6; E_value=0.0026; Accession=PF00270.19; Description=DEADDEAH box helicase
  Pfam annotation: Domain name=Helicase_C; Domain location=520-591; Score=41.0; E_value=4.1e-09; Accession=PF00271.21; Description =Helicase conserved C-terminal domain
  Pfam annotation: Domain name=ResIII; Domain location=181-345; Score =0.6; E_value=4.2e-05; Accession=PF04851.6; Description=Type III restriction enzyme, res subunit
  Pfam annotation: Domain name=SNF2_N; Domain location=187-465; Score =477.8; E_value=1.3e-140; Accession=PF00176.13; Description=SNF2 family N-terminal domain
  Pfam module annotation: Pfam domain module=DEAD::Helicase _C::ResIII::SNF2_N; Domain location=185-351::520-591::181-345::187-465
MGRPSKTQVSNEFSSEEEKEEASAAAANHEIEDDDEELEAVARYVSSDDDDNSPDEAAEDDDEDKQDESNVDPEVSKREKARLREMQQLKKQKVQEILDAQNATIDADMNNRGKGRLNYLLQQTELFAHFAKGDQSSQKKAKGRGRHASKVTEEEEDEEYLKGEEDGLANTRLVTQPSCIQGKMRDYQLAGLNWLIRLYENGINGILADEMGLGKTLQTISLLGYLHEFRGITGPHMVVAPKSTLGNWMNEIRRFCPVLRAVKFLGNPDERKHIREELLVAGKFDVCVTSFEMVIKEKSALRRFSWRYIIIDEAHRIKNENSLLSKTMRLYNTNYRLLITGTPLQNNLHELWALLNFLLPEIFSSAETFDEWFQISGENDEHEVVQQLHKVLRPFLLRRLKSDVEKGLPPKKETILKVGMSQMQKQYYKALLQKDLEVVNAGGERKRLLNIAMQLRKCCNHPYLFQGAEPGPPFTTGDHLITNAGKMVLLDKLLPKLKERDSRVLIFSQMTRLLDILEDYLMFCGYQYCRIDGNTGGDDRDASIEAFNKPGSEKFVFLLSTRAGGLGINLATADVVILYDSDWQVFILIVSSLLTCSGAISS

SEQ ID NO: 230134 - protein, 338 aa, Glycine max
  Coding DNA Sequence Number=SeqID_113356
  Gene Ontology: Cellular component=integral to membrane; Biological process=protein transport
  Homolog annotation: Hit_ID=Q9SKT3; Match level="QueryCoverage=82%, HitCoverage=85%, E-value=1e-106, Identity=69%"; Hit description =Putative secretory carrier-associated membrane protein
  Pfam annotation: Domain name=SCAMP; Domain location=108-320; Score =321.2; E_value=1.8e-93; Accession=PF04144.4; Description=SCAMP family
MKIHITRKKLTIHQKRKKKEAHDFKKDGTAKGNASGQSNRGGGAASRLSPLSPEPYDRAATVDIPLGSSKDLEAKEKELQAREAELKRREQELKRKEDAIARAGIVIEDKNWPPFCPIIHHDIANEIPIHLQSIQYVAFTTWLGLVICLLWNIIAVTVAWIKGEGLSIWFLSIIYFISGVPASYVMWYRPLYRATSSMYIWGLCEQNFSLTKGGARSRKSEKGESCGDRWSMLMTDSALRFSLFFLSYGVHILFCVYAAVAPPIIFKGKSLTGILPAFEVLDYNALVGILYFIGFGFFCIESLLSIWVIQQVYMYFRGSGKAAEMRRAAAQGAMRAAL

SEQ ID NO: 230135 - protein, 84 aa, Glycine max
  Coding DNA Sequence Number=SeqID_113357
  Gene Ontology: Mol. function=structural constituent of ribosome; Cellular component=intracellular; Biological process=translation
  Homolog annotation: Hit_ID=Q8LK53; Match level="QueryCoverage=60%, HitCoverage=78%, E-value=1e-19, Identity=90%"; Hit description =Ribosomal protein small subunit 28
  Pfam annotation: Domain name=Ribosomal_S28e; Domain location=20-84; Score=149.4; E_value=9.4e-42; Accession=PF01200.9; Description =Ribosomal protein S28e
MLSTILTPLNIMNALCLSRMESQVKHALVVKVMGRTGSRGQVTQVRVKFLDDQNRHIMRNVKGPVREGDILTLLESEREARRLR

SEQ ID NO: 230136 - protein, 166 aa, Glycine max
  Coding DNA Sequence Number=SeqID_113358
MKWKRELGKKETYGEGINLVLGEGVGVVGTHAKHGDIDTVREKEIYIKMKKKNMDARFGEGMKIFVGGEGNRNERLLFAIVILFVGQQGGGRKVKRNGEKQVRALPYEGRKIFMHRFLIYLTTSAKFYVKDNDMFEVNLISHTVPVERIHTSATRNEEGDGEKKSE

SEQ ID NO: 230137 - protein, 205 aa, Glycine max
  Coding DNA Sequence Number=SeqID_113359
  Gene Ontology: Mol. function=protein serine/threonine kinase activity; Cellular component=membrane; Biological process=protein amino acid phosphorylation
  Homolog annotation: Hit_ID=Q6TKQ5; Match level="QueryCoverage=82%, HitCoverage=62%, E-value=4e-24, Identity=34%"; Hit description =Protein kinase-like protein
  Pfam annotation: Domain name=Pkinase; Domain location=52-205; Score= -99.4; E_value=0.012; Accession=PF00069.15; Description=Protein kinase domain
  Pfam annotation: Domain name=Pkinase_Tyr; Domain location=52-203; Score=-133.3; E_value=0.00027; Accession=PF07714.7; Description =Protein tyrosine kinase
  Pfam module annotation: Pfam domain module=Pkinase::Pkinase_Tyr; Domain location=52-205::52-203
  Subcellular localization annotation: CTP_CleavageSite=27; ConfidenceScore=5.22e-01
MLTPTATTLMPPSMMLDATKRERRPPSAFANPASTTARVFTYEEILDATTDFNLEGLLGRGVFGSVYRCQLRNGQLDPSSKQGDKEFRQDVNLLSSLNYPNFVKLIGYAIGPVCVDHEKEHLDLRTRMLIAFGVAKGLRTTIYPDCEVYNEVGTFSYMDPNYVNIGLVTFSSDVYSFGMALLELLTGHKVNDSKREGGQQNLILW

SEQ ID NO: 230138 - protein, 58 aa, Glycine max
  Coding DNA Sequence Number=SeqID_113360
MTVRCGGFLIKRHQIAVALRVSNGGTMETVIGLTVVQNYGCLGLTRPNPKLGFGIKMR

SEQ ID NO: 230139 - protein, 81 aa, Glycine max
  Coding DNA Sequence Number=SeqID_113361
  Gene Ontology: Mol. function=nucleic acid binding; Biological process= DNA integration
MKDIGEASVILRVKIIRKGDSTLLSQEHYVEKLLSWRLAKQTIIARSAMESQFVVLKMAGSEAKWLKNFLANIPLGMKPNH

SEQ ID NO: 230140 - protein, 125 aa, Glycine max
  Coding DNA Sequence Number=SeqID_113362
  Subcellular localization annotation: CTP_CleavageSite=34; ConfidenceScore=5.55e-01
MAEAAKLVNNVDASNPMPLTATFVKPPPNISKLRSSLAKTFITVVFALSTPKTDVAADASQLQQMGLGQQGILRDMRLSHTQIHCRGLGQIEIHHCQLLLLDHEQRKRRQGTNQRIPQAARRLGD

SEQ ID NO: 230141 - protein, 514 aa, Glycine max
  Coding DNA Sequence Number=SeqID_113363
  Homolog annotation: Hit_ID=Q10Q83; Match level="QueryCoverage=38%, HitCoverage=43%, E-value=4e-24, Identity=32%"; Hit description =Expressed protein
  Pfam annotation: Domain name=DUF566; Domain location=112-503; Score =41.2; E_value=2.9e-09; Accession=PF04484.3; Description=Family of unknown function (DUF566)
  Subcellular localization annotation: CTP_CleavageSite=65; ConfidenceScore=5.41e-01
MKTPNGSPVSSSSPKPRHHRNREPGSATHSSECHSPVRRKSSSPGRPHVVITEDAGPTRHQLWPSTAKRSSGTLADHITEDRIIERTSTANNNTPTTIGGSARHVARFSTPSESKKLSYNNNNIAPGRLSLDENAKSFSSRRHSRNSLELDSDAGKKLTSKKADLEVAKSDATTTPRRARRGTSDSNVANLNGDSSSSVLKRFTLKTAIRRANSLAGTYKSSKTSWALSPGRSESPAMSVESMDKAVSFSSFKVPPTSPTKVKGVEKLLNMGFDLFKGKKSGGFGSLSPVGFGVHSEVVHRLRLLDNRLVQWRFANARAQVVNGNTSHKAQSNLICVWDGLTKLQQSVLKKKIQFVREKLEMKIAFVLYSQMKLLEAWGGMERQHLLAITAIKECLHSVVCRVPILEGAKVNMQPTSIALRHASDLTVSIKSILTTFSSSVCLLTLEVDKISAMLSELAKVVAREKQLLEEFYDLFQAICVFEVQERSVKCNLVQLEGWQQKYQRQQLLPEITS

SEQ ID NO: 230142 - protein, 56 aa, Glycine max
  Coding DNA Sequence Number=SeqID_113364
MEKKEEFLKGKFSSFSCWSGLGPAYSHKACTARLAQVPVFVLSLHFSLSMGACICA

SEQ ID NO: 230143 - protein, 220 aa, Glycine max
  Coding DNA Sequence Number=SeqID_113365
MEVGSVRQVVVEVVLEARRPALWLWLWHNRALGRNDHLSVTQCSDQLREPQPRGARLGDLGKVKIRKYAPCLSERSEILPQQLPWGPIGVQDESSFGKDDEGVKDVVDGLCVKSDNMPPHLTYPVPLPPLELFVKFIEHACRELHIPLRRNPMWIPLLEWALLGVSMRPSEKIGAHLAPSLEASGLSATVSLSASYSLSDFIHLYECATRFARLAMLFNC

SEQ ID NO: 230144 - protein, 86 aa, Glycine max
  Coding DNA Sequence Number=SeqID_113366
GINCLIEFISSYPIAVANVGRGAVGALVPQLLPETESWQRLQTRSPAQGQFIFEFPAQVKAMQYSGDKEEAVPGLRSRPDLRTFEM

SEQ ID NO: 230145 - protein, 51 aa, Glycine max
  Coding DNA Sequence Number=SeqID_113367
  Gene Ontology: Mol. function=oxidoreductase activity; Biological process=electron transport
  Homolog annotation: Hit_ID=Q655G1; Match level="QueryCoverage=92%, HitCoverage=8%, E-value=3e-20, Identity=87%"; Hit description =Putative external rotenone-insensitive NADPH dehydrogenase
MESGDWVSMGHSTQWLWYSIYESKQVSWRTRVVVISGWTRRFIFGRDSSRI

SEQ ID NO: 230146 - protein, 136 aa, Glycine max
  Coding DNA Sequence Number=SeqID_113368
  Homolog annotation: Hit_ID=Q9SBR5; Match level="QueryCoverage=44%, HitCoverage=68%, E-value=2e-15, Identity=62%"; Hit description =Putative wound-induced protein
  Subcellular localization annotation: CTP_CleavageSite=61; ConfidenceScore=5.02e-01
MSSTSRAWAWTVAAGVGVVEAMKDQGICRWNSVMRSAQQHAKHNMRSLSQTKKLYSQSSVMASAKLKDEKAKQSEESLRTEDEKWKTQKMHQSEKILNMSSAAGERRMDWIWKSAPVPIHGNRLNLIDNHLWNDEI

SEQ ID NO: 230147 - protein, 160 aa, Glycine max
  Coding DNA Sequence Number=SeqID_113369
  Subcellular localization annotation: CTP_CleavageSite=47; ConfidenceScore=5.35e-01
MMLGGATARGVSLIKLLPPFRFRFKHSSALSKTICKSSLALGSFQVYSTEASPGIERVTHEVLKEFLATVENAPTSNAKVYYGYIDKICKAGNLSVASKMLEILNDKNIVVTLDVYNLILVEASQKNDIDLSCQVFRKLLLSCESPSATSCLKFAQAFSK

SEQ ID NO: 230148 - protein, 98 aa, Glycine max
  Coding DNA Sequence Number=SeqID_113370
  Subcellular localization annotation: CTP_CleavageSite=68; ConfidenceScore=5.18e-01
MCRGTFVVATTVGVVEALKDQGYCKMNNTMMKSVAQQAKSHLGSATRAKKLASPSPSSSSATSNNEKRRMAEESLRTVIVLITYSTVDGLIVQGFDPY

SEQ ID NO: 230149 - protein, 1034 aa, Glycine max
  Coding DNA Sequence Number=SeqID_113371
  Gene Ontology: Mol. function=zinc ion binding; Cellular component =integral to membrane; Biological process=multicellular organismal development
  Homolog annotation: Hit_ID=Q6ZKF1; Match level="QueryCoverage=98%, HitCoverage=98%, E-value=0.0, Identity=66%"; Hit description =Putative vacuolar protein sorting protein 18
  Pfam annotation: Domain name=Pep3_Vps18; Domain location=268-419; Score=227.6; E_value=2.7e-65; Accession=PF05131.5; Description =Pep3Vps18deep orange family
MDQGRQVFTVDLLERYAAKGRGVITCMAAGNDVIVIGTSKGWVIRHDFGVGNSNEIDLSVGRPGDQSIHRVFVDPGGSHCIATVVGPGGAETFYTHAKWTKPRILSKLKGLVVNAVAWNKQQITEVSTKEVILGTENGQLHELAVDEKDKKEKYIKFLFELTELPEVFMGLQMETASMINGTRYYVMAVTPTRLYSFTGFGTLEIVQYILWNFLVTYQTGKLLALSKIRILLLYHGNIQHKIELHFFIKQRRAVHFAWLSGAGIYHGGLNFGGQQSSSSGNENFIENKALLDYSKLSEGAEVVKPSSMALSEFHFLLLLGNKVKVVNRISEKIIEELQFDQTSDSASKGIIGLCSDATAGLFYAYDQNSIFQVSINDEGRDMWKVYLDMNEYTAALANCRDPFQRDQVYLVQAEAAFSSKDYFRAASFYAKEFDLQINYILSFEEVTLKFISAGEQDALRTFLLRKLDNLEKSDKCQITMISTWTTELYLDKINRLLLEDDSASDNSNLEYQSIIKEFRAFLSDSKDVLDETTTMKLLESYGRVEELVYFASLKGHYEIVVHHYIQQGEAKKALEVLQKPSVPIDLQYKFAPDLVALDAYETVESWMTTKNLNPRKLIPAMMRYSSEPHAKNETHEVIKYLEYCVHRLHNEDPGVHNLLLSLYAKQVAWLALLYMIHEDDSSLLRFLQSKFGKGPENGPEFFYDPKYALRLCLKEKRMRACVHIYSMMSMHEEAVALALQIDSELAMAEADKVEDDEDLRKKLWLMIAKHVVEQEKGTKRENIRKAIAFLKETDGLLKIEDILPFFPDFALIDDFKEAICSSLEDYNKQIEQLKEEMNDATHGADNIRNDISALAQRCTIIDRDEECGGKGTLTNPKFGQEVCQRKILTAGREFGTGRGYTLVGQMAPFYIFPCGHAFHAECLIAHVTRCTVEAHAEYILDLQKQLTLMGSEARRESNGTLSPEESIPSMTIDKLRSQLDDAIASECPFCGDLMIREISLPFINPEEEQHVLSSWEIKPSAGSQRNSISLPASA

SEQ ID NO: 230150 - protein, 566 aa, Glycine max
  Coding DNA Sequence Number=SeqID_113372
  Gene Ontology: Mol. function=DNA binding; Cellular component =membrane; Biological process=DNA integration
  Homolog annotation: Hit_ID=Q1SKN1; Match level="QueryCoverage=57%, HitCoverage=33%, E-value=1e-71, Identity=47%"; Hit description =Integrase, catalytic region
MVISWLVHSITPSIRQSILWMDNARDIWNTVKILTRRSAENFRVAVRNGFYKTRNVIFYEYCFPFIGQDKPDPIIVLSIPFSQCIDQSEGVSSKLSIDHIMPVSNNNDSDPLTLEQPSNITRRSLRQTHRPSKYKDFYVSYSSSIVVSYFCGLEPWTYNEASKDPVWIEAMNAKINALELNDTWVLTDLPQHKNVVNWKWVYKIKNKSDGSVEIHKASNVLQIILCFSNMESMTALLVYMDNIVLSGNDLIEIQGITQLLDNAFKIKDLGDLRYFLGFEVARKPASINLCQRKYALDILSDAGMLGSKPISTPSDYATKMHQQSGTLLSMEDASSFRSDCDWASCIDIKRSITGYATYIGDSLISWKSKKQVTVSRCSSKAEYKALASVICELQWLTYLLEDFKVDFQQSATLYCDNKSALRIAVNPMFHERTKHIEIDCHIVREKVLSGLVKLLPIPSTNQLDDVYTKVLMPDLYTKMSSSRTWAVAASVGVVEALKDQGLCRWNNALRSAQYQVKNHVRSLSQANKVSSSSSSAVVSSRLKEEGAKQSEESLRTVMYLSCWGPN

SEQ ID NO: 230151 - protein, 122 aa, Glycine max
  Coding DNA Sequence Number=SeqID_113373
MGPTSNEYYTENHIPSERKKEENKRKKKNMSYLNRVWMAATVAVAQGHTDPGHKCKTALNSIHHNRSRLFSGGALSDLRPLSGVVGPDVSGAAAGSSDAKNRVSQADDSLRKVMYFSCWGQG

SEQ ID NO: 230152 - protein, 166 aa, Glycine max
  Coding DNA Sequence Number=SeqID_113374
  Homolog annotation: Hit_ID=Q9SBR5; Match level="QueryCoverage=98%, HitCoverage=97%, E-value=2e-19, Identity=56%"; Hit description =Putative wound-induced protein
MSSATSKAWIVAASVGAVEALKDQLGVCRWNYVLRCAQQHMKNHFRSLSQAKNVSSSSALVASKLKGDEKAKKAEESLRTVMRAWTVAISVGVVETLKDQGLCRWNSAFKSAQQSVKSHLRSLSQAKKLSSSSSAMLSSTLQHGEKAKHSEESLRTVMYLSCWGPN

SEQ ID NO: 230153 - protein, 215 aa, Glycine max
  Coding DNA Sequence Number=SeqID_113375
MTDFCIRYPNRIRKDMKMNFSSLCRAIRLAKRIDRSILKSIVTPSTGLPRQSQLKNDIVAFSKDLILRGYVGSQLGKRDLRGGRKGEKTRGGIFYPTICVMKSFGFPQWSPFIRYPYDQKNEERSPWSTETAESTIHSLSGLDTSVSLLTQAPLVDYRNLPRLALSATDRWPLSLKTHLIRTLFGKSVGDCLDAIFSRSMKYPFFAQFEVSYSLE

SEQ ID NO: 230154 - protein, 78 aa, Glycine max
  Coding DNA Sequence Number=SeqID_113376
MSLHVLYLYVFSGFPPGIPRLLYLPLQSFKEVNVGAGSSRATFWGRDKVKAAENQSRTDRSSFLPGAGQAENVAARQP

SEQ ID NO: 230155 - protein, 87 aa, Glycine max
  Coding DNA Sequence Number=SeqID_113377
MSWTLYPTSWILHTLLKVRAVMQVGSATFIIRVIKHSGICRGDSKILQVASRFQDVKTSHVTSAFCSPCLHAPTAVKQFTAASSISY

SEQ ID NO: 230156 - protein, 53 aa, Glycine max
  Coding DNA Sequence Number=SeqID_113378
TGQGSQGHAMRPTGGVLHTESFDEGVEAIYGSWWESTIPCQCCSLEGYREDTT

SEQ ID NO: 230157 - protein, 182 aa, Glycine max
  Coding DNA Sequence Number=SeqID_113379
  Gene Ontology: Mol. function=helicase activity; Biological process =viral genome replication
  Homolog annotation: Hit_ID=Q9LTU4; Match level="QueryCoverage=100%, HitCoverage=15%, E-value=1e-42, Identity=40%"; Hit description =Helicase-like protein
MREWFAYRLRSRSNEAHTLFHSQKLFQQFNVEGYTMLESERLSYIRNNQKKLRVDKYSSLQSSLDTGTAKGLTKGKRVILPSTFVGSPRYMDQLYFDDRPDIVSRIFRLKYEQMLSDLTKGQLLGKVVAYMHTIEFQKRGLPHVHLLLFLHPDNKYPSSTDIDQIISAEIPSHEDDPELYRL

SEQ ID NO: 230158 - protein, 248 aa, Glycine max
  Coding DNA Sequence Number=SeqID_113380
  Homolog annotation: Hit_ID=Q9AVH2; Match level="QueryCoverage=70%, HitCoverage=100%, E-value=8e-30, Identity=53%"; Hit description =Putative senescence-associated protein
TRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRIDRATLSRFVFVLEIRIKRAFTLLVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESR

SEQ ID NO: 230159 - protein, 1199 aa, Glycine max
  Coding DNA Sequence Number=SeqID_113381
  Gene Ontology: Mol. function=protein serine/threonine kinase activity; Cellular component=integral to membrane; Biological process=protein amino acid phosphorylation
  Homolog annotation: Hit_ID=Q75N53; Match level="QueryCoverage=95%, HitCoverage=96%, E-value=0.0, Identity=60%"; Hit description =Putative leucine rich repeat-type serine/threonine receptor-like kinase
  Pfam annotation: Domain name=LRRNT_2; Domain location=53-95; Score =32.0; E_value=2.1e-06; Accession=PF08263.3; Description=Leucine rich repeat N-terminal domain
  Pfam annotation: Domain name=LRR_1; Domain location=124-145; Score =5.2; E_value=30; Accession=PF00560.23; Description=Leucine Rich Repeat
  Pfam annotation: Domain name=LRR_1; Domain location=147-170; Score =16.9; E_value=0.073; Accession=PF00560.23; Description=Leucine Rich Repeat
  Pfam annotation: Domain name=LRR_1; Domain location=172-190; Score =4.0; E_value=51; Accession=PF00560.23; Description=Leucine Rich Repeat
  Pfam annotation: Domain name=LRR_1; Domain location=192-213; Score =7.4; E_value=12; Accession=PF00560.23; Description=Leucine Rich Repeat
  Pfam annotation: Domain name=LRR_1; Domain location=217-236; Score =6.3; E_value=19; Accession=PF00560.23; Description=Leucine Rich Repeat
  Pfam annotation: Domain name=LRR_1; Domain location=242-261; Score =13.5; E_value=0.77; Accession=PF00560.23; Description=Leucine Rich Repeat
  Pfam annotation: Domain name=LRR_1; Domain location=265-286; Score =8.4; E_value=7.8; Accession=PF00560.23; Description=Leucine Rich Repeat
  Pfam annotation: Domain name=LRR_1; Domain location=288-311; Score =10.9; E_value=2.6; Accession=PF00560.23; Description=Leucine Rich Repeat
  Pfam annotation: Domain name=LRR_1; Domain location=313-336; Score =15.6; E_value=0.18; Accession=PF00560.23; Description=Leucine Rich Repeat
  Pfam annotation: Domain name=LRR_1; Domain location=338-360; Score =16.4; E_value=0.11; Accession=PF00560.23; Description=Leucine Rich Repeat
  Pfam annotation: Domain name=LRR_1; Domain location=363-385; Score =17.1; E_value=0.062; Accession=PF00560.23; Description=Leucine Rich Repeat
  Pfam annotation: Domain name=LRR_1; Domain location=387-410; Score =8.4; E_value=7.6; Accession=PF00560.23; Description=Leucine Rich Repeat
  Pfam annotation: Domain name=LRR_1; Domain location=412-434; Score =12.9; E_value=1.1; Accession=PF00560.23; Description=Leucine Rich Repeat
  Pfam annotation: Domain name=LRR_1; Domain location=436-458; Score =14.5; E_value=0.39; Accession=PF00560.23; Description=Leucine Rich Repeat
  Pfam annotation: Domain name=LRR_1; Domain location=459-481; Score =11.7; E_value=1.8; Accession=PF00560.23; Description=Leucine Rich Repeat
  Pfam annotation: Domain name=LRR_1; Domain location=483-505; Score =12.7; E_value=1.2; Accession=PF00560.23; Description=Leucine Rich Repeat
  Pfam annotation: Domain name=LRR_1; Domain location=507-529; Score =4.3; E_value=45; Accession=PF00560.23; Description=Leucine Rich Repeat
  Pfam annotation: Domain name=LRR_1; Domain location=532-554; Score =17.8; E_value=0.038; Accession=PF00560.23; Description=Leucine Rich Repeat
  Pfam annotation: Domain name=LRR_1; Domain location=556-578; Score =7.9; E_value=9.4; Accession=PF00560.23; Description=Leucine Rich Repeat
  Pfam annotation: Domain name=LRR_1; Domain location=580-602; Score =10.9; E_value=2.6; Accession=PF00560.23; Description=Leucine Rich Repeat
  Pfam annotation: Domain name=LRR_1; Domain location=604-626; Score =13.6; E_value=0.74; Accession=PF00560.23; Description=Leucine Rich Repeat
  Pfam annotation: Domain name=LRR_1; Domain location=696-718; Score =13.9; E_value=0.59; Accession=PF00560.23; Description=Leucine Rich Repeat
  Pfam annotation: Domain name=LRR_1; Domain location=720-742; Score =17.5; E_value=0.047; Accession=PF00560.23; Description=Leucine Rich Repeat
  Pfam annotation: Domain name=LRR_1; Domain location=744-766; Score =11.2; E_value=2.2; Accession=PF00560.23; Description=Leucine Rich Repeat
  Pfam annotation: Domain name=LRR_1; Domain location=768-789; Score =11.9; E_value=1.7; Accession=PF00560.23; Description=Leucine Rich Repeat
  Pfam annotation: Domain name=LRR_1; Domain location=99-122; Score =2.7; E_value=90; Accession=PF00560.23; Description=Leucine Rich Repeat
  Pfam annotation: Domain name=Pkinase; Domain location=915-1174; Score= 116.4; E_value=8.2e-32; Accession=PF00069.15; Description=Protein kinase domain
  Pfam annotation: Domain name=Pkinase_Tyr; Domain location=915-1174; Score=67.9; E_value=3.3e-17; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::Pkinase::Pkin ase_Tyr; Domain location=53-95::124-145::147-170::172-190::192 -213::217-236::242-261::265-286::288-311::313-336::338-360::363 -385::387-410::412-434::...
  Pfam module annotation: Domain location=436-458::459-481::483 -505::507-529::532-554::556-578::580-602::604-626::696-718::720 -742::744-766::768-789::99-122::915-1174::915-1174
MKREKPYLMKKMPWSPRREAPIVVRFVVIALFIMITVPTPPTAADAEAEAATTTSDAVLLIQFKHLHVSSDPYSFLSDWDPHAPSPCAWRGITCSSSGGVSAIDLSGAALSGTLHLPTLTSLSSLQNLILRGNSFSSFNLTVSPICTLETLDLSHNNFSGKFPFANLAPCIRLSYLNLSNNLITAGPGPWPELAQLDLSRNRVSDVDLLVSALGSSTLVFLNFSDNKLAGQLSETLVSKSLNLSTLDLSYNLFSGKVPPRLLNDAVQVLDFSFNNFSEFDFGFGSCENLVRLSFSHNAISSNEFPRGLGNCNNLEVLDLSHNELMMEIPSEILLNLKSLKSLFLAHNKFSGEIPSELGSLCKTLVELDLSENNLSGSLPLSFTQCSSLQSLNLARNYFSGNFLVSVVNKLRSLKYLNAAFNNITGPVPVSLVSLKELRVLDLSSNRFSGNVPSSLCPSGLENLILAGNYLSGTVPSQLGECRNLKTIDFSFNSLNGSIPWKVWALPNLTDLIMWANKLTGEIPEGICVKGGNLETLILNNNLISGSIPKSIANCTNMIWVSLASNRLTGEITAGIGNLNALAILQLGNNSLSGRIPPEIGECKRLIWLDLNSNNLTGDIPFQLADQAGLVIPGRVSGKQFAFVRNEGGTSCRGAGGLVEFEDIRTERLEGFPMVHSCPLTRIYSGWTVYTFASNGSMIYLDLSYNLLSGSIPENLGEMAYLQVLNLGHNRLSGNIPDRLGGLKAIGVLDLSHNSLNGSIPGALEGLSFLSDLDVSNNNLTGSIPSGGQLTTFPAARYENNSGLCGVPLSACGASKNHSVAVGGWKKKQPAAAGVVIGLLCFLVFALGLVLALYRVRKTQRKEEMREKYIESLPTSGGSSWKLSSFPEPLSINVATFEKPLRKLTFAHLLEATNGFSAESLIGSGGFGEKLIHVTGQGDREFMAEMETIGKIKHRNLVQLLGYCKVGEERLLVYEYMRWGSLEAVLHERAKGGGSKLDWAARKKIAIGSARGLAFLHHSCIPHIIHRDMKSSNILLDENFEARVSDFGMARLVNALDTHLTVSTLAGTPGYVPPEYYQSFRCTAKGDVYSYGVILLELLSGKRPIDSSEFGDDSNLVGWSKMLYKEKRINEILDPDLIVQTSSESELLQYLRIAFECLDERPYRRPTMIQVMAMFKELQVDTFNDMLDSFSLRDNVIDEA

SEQ ID NO: 230160 - protein, 238 aa, Glycine max
  Coding DNA Sequence Number=SeqID_113382
  Gene Ontology: Mol. function=calcium ion binding; Cellular component =nucleus; Biological process=protein amino acid dephosphorylation
  Homolog annotation: Hit_ID=Q65XE2; Match level="QueryCoverage=89%, HitCoverage=44%, E-value=1e-105, Identity=85%"; Hit description =Putative tonneau 2
  Pfam annotation: Domain name=efhand; Domain location=135-163; Score =5.4; E_value=3.6; Accession=PF00036.22; Description=EF hand
  Pfam annotation: Domain name=efhand; Domain location=60-88; Score =18.2; E_value=0.03; Accession=PF00036.22; Description=EF hand
  Pfam module annotation: Pfam domain module=efhand::efhand; Domain location=135-163::60-88
MKNCSNWWFWFTKLSRKACIKKVLLSNCLQELMELHQESEEEVTDTEQAENWFSLTSAQRICDMFLALDKDTNGTLSKQELREYADATLADIFIERVYDEHVRRGKSGGGNAREMDFESFLDFVLALENKDTPEGLTYLFRCLDLQGRGYLTTADVHSLFRDVHHKWIEGGNYELCIEDVRDEIWDMVKPADPLKITLADLLACKQGGTVASMLIDVRGFWAHDNRETLLQEEEPEEE

SEQ ID NO: 230161 - protein, 354 aa, Glycine max
  Coding DNA Sequence Number=SeqID_113383
  Gene Ontology: Mol. function=transcription factor activity; Cellular component=nucleus; Biological process=regulation of transcription, DNA-dependent
  Homolog annotation: Hit_ID=Q6J9Q2; Match level="QueryCoverage=53%, HitCoverage=68%, E-value=9e-37, Identity=42%"; Hit description =Putative AP2/EREBP transcription factor
  Pfam annotation: Domain name=AP2; Domain location=46-110; Score =114.2; E_value=3.8e-31; Accession=PF00847.10; Description=AP2 domain
  Subcellular localization annotation: CTP_CleavageSite=33; ConfidenceScore=5.36e-01
MSTSRTSSDTAFKGYDPSQTQMCLSLLQRNTSPCGERRGRRKQAEPGRFLGVRRRPWGRYAAEIRDPTTKERHWLGTFDTAQEAALAYDRAALSMKGSQARTNFVYSDNINFHTLQLSPMNVQVQPLLPASQTFFTNTTTTTTQTKTPTNQNSLSQIIHSASNCGNPSPLNNDMCVETTYGSAQDDNFFFSSDSNSGYLECIVPDNCFRPASSSSNSSNSRKSNVNDQKTNTSSMESTNHHHHHQFSHVDHMTSFSQEEGINEMAPRASYNLSDLSYQSEVSQGSWDWNCSELSAIFKNPMRVENGCMDDALYPINDSPTSPSYGLMNEAGSSSTTCSPSLPPFGDVDLGYPLF

SEQ ID NO: 230162 - protein, 565 aa, Glycine max
  Coding DNA Sequence Number=SeqID_113384
  Gene Ontology: Mol. function=transferase activity; Cellular component= nucleus; Biological process=mRNA editing
  Homolog annotation: Hit_ID=Q84SD0; Match level="QueryCoverage=88%, HitCoverage=97%, E-value=1e-131, Identity=47%"; Hit description =Putative pentatricopeptide (PPR) repeat-containing protein
  Pfam annotation: Domain name=PPR; Domain location=119-153; Score =30.0; E_value=8.4e-06; Accession=PF01535.11; Description=PPR repeat
  Pfam annotation: Domain name=PPR; Domain location=18-52; Score=19.3; E_value=0.014; Accession=PF01535.11; Description=PPR repeat
  Pfam annotation: Domain name=PPR; Domain location=181-215; Score =23.6; E_value=0.0007; Accession=PF01535.11; Description=PPR repeat
  Pfam annotation: Domain name=PPR; Domain location=243-277; Score =36.0; E_value=1.3e-07; Accession=PF01535.11; Description=PPR repeat
  Pfam annotation: Domain name=PPR; Domain location=280-314; Score=7.0; E_value=1.1; Accession=PF01535.11; Description=PPR repeat
  Pfam annotation: Domain name=PPR; Domain location=346-380; Score =38.6; E_value=2.2e-08; Accession=PF01535.11; Description=PPR repeat
  Pfam annotation: Domain name=PPR; Domain location=381-415; Score =33.6; E_value=6.7e-07; Accession=PF01535.11; Description=PPR repeat
  Pfam annotation: Domain name=PPR; Domain location=416-449; Score=8.0; E_value=0.83; Accession=PF01535.11; Description=PPR repeat
  Pfam module annotation: Pfam domain module=PPR::PPR::PPR::PPR::PPR::PP R::PPR::PPR; Domain location=119-153::18-52::181-215::243-277::280 -314::346-380::381-415::416-449
MANYAYSMLHHLHIPDSFSWGCVIRFFSQKCLFTEAVSLYVQMHRTSLCPTSHAVSSALKSCARIHDMLCGMSIHGQVHVFGFNTCVYVQTALLDLYSKIGDMGTARKVFDEMANKSVVSWNSLLSGYVKAGNLDEAQYLFSEIPGKDVISWNSMISGYAKAGNVGQACTLFQRMPERNLSSWNAMIAGFIDCGSLVSAREFFDTMPRRNCVSWITMIAGYSKGGDVDSARKLFDQMDHKDLLSYNAMIACYAQNSKPKEALELFNDMLKQDIYVHPDKMTLASVISACSQLGDLEHWWWIESHMNDFGIVLDDHLATALIDLYAKCGSIDKAYELFHNLRKRDLVAYSAMIYGCGINGKASDAIKLFEQMLAECIGPNLVTYTGLLTAYNHAGLVEKGYQCFNSMKDYGLVPSIDHYGIMVDLFGRAGYLDEAYKLILNMPMQPNAGVWGALLLACRLHNNVELGEIAVQHCIKLETDTTGYCSLLSSIYATVEKWDDAKKLRKGMEGKDFTGCSWTRSEALGSVLQPRAWPFFPNHFLTFHSLLCISSMPSSWTCDSTCRKLE

SEQ ID NO: 230163 - protein, 750 aa, Glycine max
  Coding DNA Sequence Number=SeqID_113385
  Gene Ontology: Mol. function=structural constituent of ribosome; Cellular component=intracellular; Biological process=translation
  Homolog annotation: Hit_ID=Q0WWX4; Match level="QueryCoverage=99%, HitCoverage=100%, E-value=0.0, Identity=56%"; Hit description =RanGAP1 interacting protein
  Pfam annotation: Domain name=Kelch_1; Domain location=154-200; Score =19.9; E_value=0.0093; Accession=PF01344.15; Description=Kelch motif
  Pfam annotation: Domain name=Kelch_1; Domain location=205-251; Score =17.6; E_value=0.04; Accession=PF01344.15; Description=Kelch motif
  Pfam annotation: Domain name=Kelch_1; Domain location=257-302; Score =28.4; E_value=2.6e-05; Accession=PF01344.15; Description=Kelch motif
  Pfam annotation: Domain name=Kelch_1; Domain location=307-352; Score =16.9; E_value=0.048; Accession=PF01344.15; Description=Kelch motif
  Pfam annotation: Domain name=Kelch_1; Domain location=96-141; Score =24.0; E_value=0.00052; Accession=PF01344.15; Description=Kelch motif
  Pfam annotation: Domain name=Kelch_2; Domain location=154-200; Score =27.1; E_value=6e-05; Accession=PF07646.5; Description=Kelch motif
  Pfam annotation: Domain name=Kelch_2; Domain location=205-251; Score =16.4; E_value=0.11; Accession=PF07646.5; Description=Kelch motif
  Pfam annotation: Domain name=Kelch_2; Domain location=256-302; Score =22.8; E_value=0.0012; Accession=PF07646.5; Description=Kelch motif
  Pfam annotation: Domain name=Kelch_2; Domain location=307-352; Score =3.4; E_value=14; Accession=PF07646.5; Description=Kelch motif
  Pfam annotation: Domain name=Kelch_2; Domain location=96-141; Score =19.0; E_value=0.017; Accession=PF07646.5; Description=Kelch motif
  Pfam module annotation: Pfam domain module=Kelch_1::Kelch_1::Kelch _1::Kelch_1::Kelch_1::Kelch_2::Kelch_2::Kelch_2::Kelch_2::Kelch_2; Domain location=154-200::205-251::257-302::307-352::96-141::154 -200::205-251::256-302::307-352::96-141
MFGFSRRRMKLGRLKVQLSEANPGTRTPVRPPKRNGTEIGDAAGGSSGHSDEVDCQPSTEITSCGSSENWMVLSIAGDKPIPRSNVCLFLQLLLLVSFKHAAAVIGNKMIVVGGESGTGLLDDVQVLNFDRFSWTTASSKLYLSPSSLPLKIPACKGHSLVSWGKKALLIGGKTDPGSDRISVWAFDTETECWSLMEAKGDIPVARSGHSVVRASSVLILFGGEDAKRRKLNDLHMFDLKSLTWLPLHYTGTAPSPRFNHVAALYDDKILYIFGGSSKSRTLNDLYSLDFETMAWSRVKMRGFHPSPRAGCCGVLCGTKWYITGGGSRKKRHGETVIFDIVKNEWSVAITSPPSSITTNKACLLFICCHLLASLLSIMEEAFLDALYFGFSMVLVQHKEKDFLVAFGGSKKEPSNQVEVLIMEKNESALGRQSAPSKCSASVLLEKHSSSTRLAPQLNDCSQRLVDSVARQNLASAIEHGSGRRSLSESLVVDPNFPPTNTSLRKQFDHDEEYNTDLKMDKNSDENSFPRAVDHRTNENDHGKQMNSSGAKNITEEQQALLSGIPIQQNLVFENDMLESDNVSFTENIKSGSLTTSNVYHCYESKLASLIRKNGILEGQLAASLASKEAAEKSLASVLKSRQEMERKLAESHKEMELMREKLTSLELAQEEANNLSNIVHSDNVRLEHDVAFLKAVLDDTQKELHSTRGVIAGERARAFQLQYEVFHLKQRLQSMENRASTTPRKPFHVQ

SEQ ID NO: 230164 - protein, 764 aa, Glycine max
  Coding DNA Sequence Number=SeqID_113386
  Gene Ontology: Mol. function=inorganic anion exchanger activity; Cellular component=integral to membrane; Biological process=anion transport
  Homolog annotation: Hit_ID=Q7X9F3; Match level="QueryCoverage=95%, HitCoverage=96%, E-value=0.0, Identity=64%"; Hit description=Boron transporter
  Pfam annotation: Domain name=HCO3_cotransp; Domain location=7-569; Score=-142.0; E_value=4e-11; Accession=PF00955.11; Description=HCO3- transporter family
MEETFVPLRGIKNDLKARIPCYRQDWTSGFQAGIRILAPTTYIFFASAIPVISFGEQLERNTDGSLTAVQTLASTALCGVIHSIIGGQPLLILGVAEPTVLMYTFMYNFAKDRKDLGHKLFLPWTGWVCVWTALLLFLLAVLGACSIINRFTRIAGELFGLLIAMLFMQQAIKGLVEEFGAPKNQREGTNQVALQSSWLFGNGMFALVLSFGLLFTGLQSRKARSWRYGSGWLRGFIADYGVPLMVLVWTAVSYIPVNEVPKGIPRRLFSPNPWSPGNVECAPLIYCWSIYTSNYDAVLYYFDHSVASQLAQQKEFNLRKPSSYHYDLLLLGFLTILCGLIGIPPSNGVIPQSPMHTKSLATLKHQLLRNKLVSTARKSMRRNVNLSQLYQSMKEAYDEIQTPLVPQMPLTLVNVLPWFPILKFVIFFLLILGLFIQQGLKELKESTIELASSQGYLDAPVDELVFDVNKDVDDLLPVEVKEQRLSNLLQALMVAACVAAMPVLKKIPTSVLWGYFAFMAIESLPGNQFWERILYLFTAPSRRYKLLEEYHATFVETVPFKTIAMFTVFQTLYLLLCFGITWIPIAGVLFPLLIMLLVPVRQYFLPKFFKGAHLQELDAAAYEEAPAIAFNMSFETTPLNTCITYIWQSSCSQFNVYNPWQGPSNQAPTVNISGGEILDEVITRSRGEFRHTQSPKTTSSTPTSMGDIRPANSPQLTRRISSPPVTELRGESSLRPTRKEIKLMQTPSPRSPGLGKVTKDSPST

SEQ ID NO: 230165 - protein, 268 aa, Glycine max
  Coding DNA Sequence Number=SeqID_113387
  Gene Ontology: Mol. function=DNA binding; Cellular component=nucleus; Biological process=regulation of transcription, DNA-dependent
  Homolog annotation: Hit_ID=Q9S7L2; Match level="QueryCoverage=74%, HitCoverage=44%, E-value=4e-57, Identity=57%"; Hit description =Transcription factor MYB98
  Pfam annotation: Domain name=Myb_DNA-binding; Domain location=1-37; Score=19.4; E_value=0.013; Accession=PF00249.21; Description=Myb -like DNA-binding domain
  Pfam annotation: Domain name=Myb_DNA-binding; Domain location=43-88; Score=60.1; E_value=7.4e-15; Accession=PF00249.21; Description=Myb -like DNA-binding domain
  Pfam module annotation: Pfam domain module=Myb_DNA-binding::Myb_DNA -binding; Domain location=1-37::43-88
LLIQLVEQYGLRKWSHIAKILPGRIGKQCRERWHNHLRPDIKKDTWTDEEDKVLIEAHAEVGNKWAEIAKKLPGRTENSIKNHWNATKRRQYSRRKCRSKYPRGTLLQEYIKSLNLDKNPPRDYRRKSSSNYSSAIMSNNETTTSKVSTTAPTLPQTAFQFCAATDCLAPNYDFNVVPDFFFGENFFEEGCSIDSLLDGVPCAPLMDNMKDFEGKLQCDDRTMCVPFVNIDENHVETEMPLEMMGVEVKKELDLVEMMSQISNEILRV

SEQ ID NO: 230166 - protein, 510 aa, Glycine max
  Coding DNA Sequence Number=SeqID_113388
  Gene Ontology: Mol. function=DNA binding; Cellular component=nucleus; Biological process=regulation of transcription, DNA-dependent
  Homolog annotation: Hit_ID=Q1SCC9; Match level="QueryCoverage=63%, HitCoverage=74%, E-value=1e-110, Identity=67%"; Hit description =Always early protein 3-related
  Pfam annotation: Domain name=Myb_DNA-binding; Domain location=53-98; Score=35.1; E_value=2.5e-07; Accession=PF00249.21; Description=Myb -like DNA-binding domain
MAPSRKSRSVNKRFSTVREAASSKDKITENASKNRLKVSPGIQKKRKLADMLGPQWNKEELEHFYEAYRKYGKDWKKVALAVHNRSVEMVEALYTMNRAYLSLPEGTASVVGLIAMMTDHYSVLGGSDSGKESNDDAEISKKSQKRLRGKHLSDSKALEGHFSDHSQSHSVASGDGCLSLLKKRHSGIRPHAVRKRTPRVPISYSIGKDNGDRFFSSARQGSKQMVDTNDVAHKIALALTEASQRGGSSKISGSPDKKFVPSLGLKSGKKHPKSEIAGANFCSSDLDDGSSELSLGSTEGNNEDYSRKTIHRSGRENTGRERNQEKKIKKYGKNFETGENLNKHLNDVKEASSGTDDGKNLSFIKSDFVTDFADAKNARSSYKGSRTKSKKLRLEKDEGSAFDALKTLADLSLMLPVTNPDTESSAQFKEGNHDAVDESKMETHKVFPRIESTASSKLGKVFSDNGVAVPEAEGAHQLNAGFRKRKQKSFNLKYDEIHTGSHLSGSQKSK

SEQ ID NO: 230167 - protein, 146 aa, Glycine max
  Coding DNA Sequence Number=SeqID_113389
  Gene Ontology: Mol. function=nucleic acid binding
MNDNITLVLHHGGRFTPRASDGKVEYIGGEFDVWEDISADCLNAFILYDLVKACKKYSNIGECFWLIDKDLDFNHGLRSCTTDGDILHLVRDAFENENEINVYFHHEVDPILEEVPQMLYLECYPIRKAVENEDDLDDVPVAGHEE

SEQ ID NO: 230168 - protein, 127 aa, Glycine max
  Coding DNA Sequence Number=SeqID_113390
MDLETMFKESYVSQPMDLQESCLQPSMKDMLPFGNLPSHGLFQDFHHIDQFHHVNVSSSIQTPNFDVFDNFTITGSSPDFDFYEFKPFVEDGGNGHGHAHVMDNFLYGNYSLNLPPRNQLDMMVANQ

SEQ ID NO: 230169 - protein, 279 aa, Glycine max
  Coding DNA Sequence Number=SeqID_113391
  Gene Ontology: Mol. function=electron carrier activity; Cellular component=nucleus; Biological process=electron transport
  Homolog annotation: Hit_ID=Q1SCC8; Match level="QueryCoverage=94%, HitCoverage=41%, E-value=1e-105, Identity=78%"; Hit description =DIRP; Cytochrome c region
MVFSSSSKSQPKVVCSEIGIGNAQLASSSQPSLLDHVHSKEADILAISELNRALDKKELVLSELKHMNDGVSESQKYGDNSVKDSEPFKRNYASVSSALFCLRQRNTYQASSSVLSLKPMANFDDPSGQASSSNCSACHNQESISQSHITEIVESSRRKARMMVVQATQAMSNLRKTESKVERIEDAINFINNQLSVDEPTASATTFLPTDSFSLASQDQLTASVLNPLASCHVQDAELNSSSDQNEMKIPSELISHCLATLFVIQNKQSNTKVEIAAF

SEQ ID NO: 230170 - protein, 58 aa, Glycine max
  Coding DNA Sequence Number=SeqID_113392
EGGQRGGEGWRVVGNVEESVVQDGEAEVKDVEVVDGIQKDVHGLEVVEGVIMAVAEGG

SEQ ID NO: 230171 - protein, 46 aa, Glycine max
  Coding DNA Sequence Number=SeqID_113393
MASANFLFPEGNSINKPPIFNGEVLRICGTLYKLHMRAQLMSNDLG

SEQ ID NO: 230172 - protein, 210 aa, Glycine max
  Coding DNA Sequence Number=SeqID_113394
  Gene Ontology: Mol. function=RNA-directed DNA polymerase activity; Cellular component=chromatin; Biological process=chromatin assembly or disassembly
  Pfam annotation: Domain name=rve; Domain location=1-179; Score=47.5; E_value=4.6e-11; Accession=PF00665.16; Description=Integrase core domain
MDFIVGLPTYRDNTCILMVVDRFSKGVHLGTLPFHHTSQSVAQLFMELVGKLHGMPKSITSDRDPLFMSKFWQALFSLSGTKLRMSSTYHPQTDGQTEVANRVIEQYLRAFVHRRPMRGGVSYYGLSVTFGRKPPSFLQYLTGTSKIEAVDELLSQREFIFALLRQKLQKAQARMKAITDEHRHDHEFQVGERVLVKLCPYCQTTASSTS

SEQ ID NO: 230173 - protein, 232 aa, Glycine max
  Coding DNA Sequence Number=SeqID_113395
  Gene Ontology: Mol. function=RNA-directed DNA polymerase activity; Cellular component=chromatin; Biological process=chromatin assembly or disassembly
MTSKFDELLHRMNQLETSHTNPHVPSAFVGPSFAATTNSAYRLKLEVPRFDGSDLEGWIFKITQFFEYHVTPNHDRLTIASFYMKAYEDPTGVLCKLTQRSTISAYLSEFEARAHRIIGLPASFVLSCFVSGLSPAIRREVQVMRMSVPRNSIPDPCRQFLFVPLKTRHQRVGLLPEFTPSKYFDVASNGGQWGGTAVQPVAQITGACPNGLYISYYEIHLWWQVDRAYRGS

SEQ ID NO: 230174 - protein, 43 aa, Glycine max
  Coding DNA Sequence Number=SeqID_113396
MAGHLSDVDVAAVEWGLCIPFSLDPSKGLPSFHDNHQNTDSDE

SEQ ID NO: 230175 - protein, 118 aa, Glycine max
  Coding DNA Sequence Number=SeqID_113397
  Gene Ontology: Mol. function=transcription regulator activity; Cellular component=nucleus; Biological process=regulation of transcription
  Homolog annotation: Hit_ID=Q6S7B0; Match level="QueryCoverage=98%, HitCoverage=17%, E-value=3e-53, Identity=80%"; Hit description=TAF5
  Pfam annotation: Domain name=WD40; Domain location=29-67; Score=50.6; E_value=5.3e-12; Accession=PF00400.22; Description=WD domain, G-beta repeat
  Pfam annotation: Domain name=WD40; Domain location=71-106; Score =24.5; E_value=0.00038; Accession=PF00400.22; Description=WD domain, G-beta repeat
  Pfam module annotation: Pfam domain module=WD40::WD40; Domain location=29-67::71-106
MCVQWHVNCNYIATGSSDKTVRLWDVQSGECVRVFIGHRSMILSLAMSPDGRYMASGDEDGTIMMWDLSSGCCVTPLVGHTSCVWSLAFRSLLASGSADCTVKFWDVTTGIKVPRNEE

SEQ ID NO: 230176 - protein, 384 aa, Glycine max
  Coding DNA Sequence Number=SeqID_113398
  Gene Ontology: Mol. function=RNA-directed DNA polymerase activity; Cellular component=chromatin; Biological process=chromatin assembly or disassembly
MMNHLFQSYLRKYIIVFFDDILIYSRNFEEHLNHLETAFQVVMDDKFTLKIAKCSFAQKHIEYLGHIVAGDGVQPIPDKVQAIQRWPQSRTARALRGFLGLVGFYRRFIRGYATMAAPLSKLLTKAEFVWSPEAGDAFQTLKDAITKSPVLALPNFNKPFMVEIDASSSSMGAVLSQEGHPIAFFSKQFCPKLLRSSTYVRELAVITTAIKKWRQYLLGHHFVILTDHWSLKELMSQVVQTPEQHMYLAHLLGFDYVIQYRAGKTNVVADVLSRSSRSANASFFILSMPHFVFLEDLCKELQSHDEFVSLREKIRTHPAAYPHHSLTSHFILHQGHIWLHSDCSFIKILLTEFDQSPIGGHMGLQKTLNRVVKNFTWNTMKVDT

SEQ ID NO: 230177 - protein, 303 aa, Glycine max
  Coding DNA Sequence Number=SeqID_113399
  Gene Ontology: Mol. function=transcription regulator activity; Cellular component=nucleus; Biological process=regulation of transcription
  Homolog annotation: Hit_ID=Q6S7B0; Match level="QueryCoverage=81%, HitCoverage=40%, E-value=2e-59, Identity=50%"; Hit description=TAF5
  Pfam annotation: Domain name=WD40; Domain location=227-265; Score =45.0; E_value=2.5e-10; Accession=PF00400.22; Description=WD domain, G-beta repeat
MSSVELIKPMDSHLVPQGEGLIQEQHTKWRYVEPLTHRKQPKTSADLVANSRVYRVCIEFTENLLKSELHTSQLTEEDCVDKTGSLLSDTEKGEGEGKEGENDEIKKRSIDGGKQGSSIKKAKKDKAGSATGKNAKPEANTVSAAPRIKPELPLPTLYSPNSTDVELSILEDLRNRVQLSSVALPSVNFYTIVWDMAKLEKQPTTSFSQGGNDTSQNEQNIGQNSGKRLCTLFQGHSGPVYAATFSPAGDFILSSSADKTIRLWSTKLNANLVCYKGHNYPIWDVQRNCVGTKDNVRKRDDVG

SEQ ID NO: 230178 - protein, 126 aa, Glycine max
  Coding DNA Sequence Number=SeqID_113400
  Gene Ontology: Mol. function=transcription regulator activity; Cellular component=nucleus; Biological process=regulation of transcription
  Homolog annotation: Hit_ID=Q1SXB5; Match level="QueryCoverage=87%, HitCoverage=56%, E-value=7e-25, Identity=52%"; Hit description =Lissencephaly type-1-like homology motif; WD40 associated region in TFIID subunit
MDEDQIEGCVSGYLKQKGFTQNDDQLQLTNTDSSLQPDTLNRAQLERGSARYHDGYGRLRSWAYRSLDSYKFCGYYTLFASSSLQHELLRVLFPLFIHCFMDLVAKGNLQEGLLAFANSTSLALDI

SEQ ID NO: 230179 - protein, 356 aa, Glycine max
  Coding DNA Sequence Number=SeqID_113401
  Gene Ontology: Mol. function=transferase activity, transferring phosphorus-containing groups; Cellular component=membrane; Biological process=two-component signal transduction system (phosphorelay)
  Homolog annotation: Hit_ID=Q3S4A7; Match level="QueryCoverage=99%, HitCoverage=36%, E-value=1e-61, Identity=39%"; Hit description =Cytokinin independent 2
  Pfam annotation: Domain name=Response_reg; Domain location=212-352; Score=79.6; E_value=9.6e-21; Accession=PF00072.14; Description =Response regulator receiver domain
MGGRLTVTSKEHCGSTFTFILPYKVSTVCDDSDDPDELSDVDDNDDDTTEGFFQFQPRTLGSLFSSNGPTRPQNVLPGFRSSHNFNGFSENSFSFLTTNIISKGTNSTEDASSVIVDAPEMSESTGSSSHSPQTKHENVVNTNNQNQDKAHARLQNGSVDSSQHKEAMTLGTMSSEPQQTCQGQVKTDITSQSVIKSNKYTSSEVTKSTLGPKILLVEDNKINVMVTQSMMKRLGYGMDVVNNGVEAVRAVQRHTYDVILMDVYMPVMNGLQTTKLIRSYEETGNWEAAREAGIEQCSPASNECSVPLKNRIHIIAMTANTMSESADECYANGMDSFVSKPVTFQKLKDCLEQYLR

SEQ ID NO: 230180 - protein, 114 aa, Glycine max
  Coding DNA Sequence Number=SeqID_113402
MTLTIPQLFLKLLQVSWDATMFGVHNDNFPLYIKQEHLSEIAHDGQCLSISVIQLWILHMTETSMRAGNIDVYGFLEPYSIQKFGQSQFESEDYIKKWMQNSLRDVYLGAYLNG

SEQ ID NO: 230181 - protein, 78 aa, Glycine max
  Coding DNA Sequence Number=SeqID_113403
MLNPAQFQVKEEKVKVVDDSLSEADWLSEMHPLSRTSSSLSVWETLEEDKSDICTPSAQPARPTRTLSLLTLSAPKLA

SEQ ID NO: 230182 - protein, 176 aa, Glycine max
  Coding DNA Sequence Number=SeqID_113404
  Homolog annotation: Hit_ID=Q8S8A0; Match level="QueryCoverage=52%, HitCoverage=58%, E-value=2e-11, Identity=43%"; Hit description =Expressed protein
  Subcellular localization annotation: CTP_CleavageSite=26; ConfidenceScore=5.74e-01
MRSIPIPPTTTTNTLAPTSSTVVVVTTMTTMTNKTSVPSAWHSPVPYLFGGLAAIMALIALALLMLACSYWRLTQESNNNNNNNVVKEGDDDSEKKEQPKVYEEKILVIMAGDHNPTFLATPSSSFGCCSNFDHKKHLGNSEDSNNSYKETVDDHVVLNATHESGSARHDQHSENL

SEQ ID NO: 230183 - protein, 326 aa, Glycine max
  Coding DNA Sequence Number=SeqID_113405
  Gene Ontology: Mol. function=kinase activity; Biological process =carbohydrate metabolic process
  Homolog annotation: Hit_ID=Q1SCC6; Match level="QueryCoverage=92%, HitCoverage=63%, E-value=1e-144, Identity=84%"; Hit description=CBS
  Pfam annotation: Domain name=CBS; Domain location=167-306; Score =29.6; E_value=1.1e-05; Accession=PF00571.18; Description=CBS domain
MDSARDASGVAGTVLIPMRFVWPYGGRSVYLSGSFTRWSELLQMSPVEGCPTVFQVIHSLVPGHHQYKFFVDGEWRHDDLQPCESGEYGIVNTVSLATDPNILPVLTPDIVSGSNMDVDNEAFRRMVRLTDGTLSNVLLPRISDVDIQTSRQRISAFLSMSTAYELLPESGKVVTLDVDLPVKQAFHILHEQGIPIAPLWDICKGQFVGVLSALDFILILRELGNHGSNLTEEELETHTISAWKGGKWTGFTQCFIRAGPYDNLKEIAVKILQHGISTVPIIHSEDGSFPQLLHLASLSGILKYKLDTYQIDFSGICSSSKFNTNS

SEQ ID NO: 230184 - protein, 253 aa, Glycine max
  Coding DNA Sequence Number=SeqID_113406
  Gene Ontology: Mol. function=zinc ion binding
MEIKIGRGKERQMQANIEFEEGEAFFCYKDDDDDDNTDLDSLSYIKFSTIIVKILKNNVLATDKQRTNNLLPVLFKDERIQHALGHFRKEFEGGVSAGRLGAKFGDYGSFLPTCEHSPPLRSCSKTPQKHNSSPKSPSNLHMAAAFRNSKALPNMPFSMRVGTASYEAPPFRNIRVPSADYSVKNTDISSNEVIEKFTLKDCANKSEILTDQRTLKLRIKVKSDILAKKNAAIYSGLGLDDSPSPSMENSHEE

SEQ ID NO: 230185 - protein, 719 aa, Glycine max
  Coding DNA Sequence Number=SeqID_113407
  Gene Ontology: Mol. function=zinc ion binding
  Homolog annotation: Hit_ID=Q10LI9; Match level="QueryCoverage=30%, HitCoverage=24%, E-value=1e-24, Identity=34%"; Hit description=CW -type Zinc Finger family protein, expressed
  Pfam annotation: Domain name=zf-CW; Domain location=394-442; Score =61.7; E_value=2.4e-15; Accession=PF07496.5; Description=CW-type Zinc Finger
MTSFTIPGGVLISPLHDSLLYLIRKEKALGNIKPMSSLNGNSVSINESDSFVGDGHLLKKRKVTVVDQSHKQHMNGNCSENDMTLHTKKKLGNRTPDRKDFLSNDLRCTPLSSSICDAGETAEVTVKGFEVSKEVDGVKCRMVSTEAVKEDSLESISGQDFDKIEKQNTGSGFMKNVLEHKMIISQNNNSTNPKTNSKCNTFAISKRIKCDALKCKVDQDTQKCETNQEGKVKSESKNESKGERSPGNVMTLAEKDSIGTSNNAMVNDRKRTSIDVTSLKSKMHKIKSLKVNKVRDCDRDSLKGKKSQQKVDRINPTDGPTLNKATVNSSLDHVDKSAYRVKGNERPSGNKVVNQLSAGPCVKDAPGAFPIAENKPTSEMVLSSEAATPQVIEEDWVCCDSCQKWRLLPMGLKPEQLPEKWLCSMLYWLPGMNRCNISEEETTKALYALYQMPISEGQNNMQSHAAGPETGVGSVDALQLGLNRKKSSSDVMLDRGKKKHGINEKTRSGVNNDMHRLSNNAQESVKNRSLNEMNKQSTDSNRIKKSISKHSSRLNNLIEEKNTPKVKEKQMNGGDRNHVRLKRKMEDNQHGSGTPKKSKAEDVCYADKPLNPGMEFKKVGLISRNSLPTKASGRNMRKYDDYCWSDDLVDKLVVPVKKGDRAQFSSDDGSLDATNTRKSGSIKKRKMADWLDNEKHNKTLSLEGNMQCGKEGNANKKEK

SEQ ID NO: 230186 - protein, 66 aa, Glycine max
  Coding DNA Sequence Number=SeqID_113408
  Gene Ontology: Mol. function=sequence-specific DNA binding; Cellular component=nucleus; Biological process=regulation of transcription, DNA-dependent
  Homolog annotation: Hit_ID=Q5D1M2; Match level="QueryCoverage=97%, HitCoverage=8%, E-value=2e-19, Identity=83%"; Hit description=Class III HD-Zip protein 5
  Subcellular localization annotation: CTP_CleavageSite=32; ConfidenceScore=5.70e-01
MTGSITIAPNLVPFTASSSFASGPFSPTLNPSKSREKQRKESLWLQAVNRKLTAMNKLLMEENDRL

SEQ ID NO: 230187 - protein, 83 aa, Glycine max
  Coding DNA Sequence Number=SeqID_113409
MTCDHSLVLVRCLAPIIRQFVKFQDMPKNQKNIDAQSHPGPLGPSGIFLQKTVASGGSNPARLGELSSPGRAGRQPPPLFCYK

SEQ ID NO: 230188 - protein, 152 aa, Glycine max
  Coding DNA Sequence Number=SeqID_113410
MAGLHSILGLEGFNMSSHMAPKKLAAKRARKATAREGSSAAPQAEIEFDGCRFRSEEHQHYFEMIKDWSLFKERRIISDAIHQFVGIAPLRHPMDPEKSNRALGFLALITSLCHFYWVPVALTKLIRPPINRSFIAKYCIPRQAQQLGQNHQ

SEQ ID NO: 230189 - protein, 56 aa, Glycine max
  Coding DNA Sequence Number=SeqID_113411
MDLHVGNLIDHDLHAWKNNEVATNFNQIDAQQIQSIPFLNLEATEILNDAISDEGR

SEQ ID NO: 230190 - protein, 290 aa, Glycine max
  Coding DNA Sequence Number=SeqID_113412
  Gene Ontology: Mol. function=diacylglycerol kinase activity; Cellular component=intracellular; Biological process=protein kinase C activation
  Homolog annotation: Hit_ID=Q2QXB0; Match level="QueryCoverage=74%, HitCoverage=42%, E-value=4e-47, Identity=43%"; Hit description =Pentatricopeptide, putative, expressed
  Pfam annotation: Domain name=PPR; Domain location=203-237; Score =13.5; E_value=0.19; Accession=PF01535.11; Description=PPR repeat
  Pfam annotation: Domain name=PPR; Domain location=89-123; Score=24.8; E_value=0.00031; Accession=PF01535.11; Description=PPR repeat
  Pfam module annotation: Pfam domain module=PPR::PPR; Domain location =203-237::89-123
MPKGTMIYNCLRNSFTLDWTNRIILCCAAQSVLVRVWEAWVLEKSLLVWCLGHEASDVIASALVDMYAKCGCVNYSAKVFRRIQNPSVIPYTSIILGAAKYGLGTLSLQLFQEMVVRRIKPNDITFVGHVCSHSGLVDKGLELLNSMDGKIWAYQLAKSFQVEGDEYAMLWGTLLSASRLYGRVDIALEASNRLIESNQQVAGAYVTLSNAYALAGDWENAHNLRSEMKHTGVCKEPGSNISKYTQGREMLSLPREMEERMKERGYVGGTKGLVFVDVEEEAKEEIEYAQ

SEQ ID NO: 230191 - protein, 113 aa, Glycine max
  Coding DNA Sequence Number=SeqID_113413
  Gene Ontology: Mol. function=serine carboxypeptidase activity; Biological process=proteolysis
  Homolog annotation: Hit_ID=Q1SGX9; Match level="QueryCoverage=85%, HitCoverage=32%, E-value=4e-24, Identity=58%"; Hit description =Peptidase S10, serine carboxypeptidase
MNEQYVGVGESEDVQAFYYSIESENNPKEDPLMLWLTVALVAHGPLAFNHEDYNGSLPTLILRPQSWTKLFMILSNEVYIGRRFILWHFYSSNCSRNFTRESSLGCLFSDGDG

SEQ ID NO: 230192 - protein, 460 aa, Glycine max
  Coding DNA Sequence Number=SeqID_113414
MAIGTEVKSVNKVQQPRKHNKIVASYQALDCFDPLSKDLGSGQLSLAATSSSSKVSGSHKARTNVEDVRGSPLESVTSSPLWTSNMDKHILESGDTSEKHDTRKGGLSKSLNNREGKLSVKMKERISYDIHPAHGNYGSSSHHEEKVNKSNKEDALSWQKSGRVTSLRVKEKDRISGSEVSREKMKVSASDNDFHKNGVSYESAVDPNRHASDTETRNDVKNSSLKSNHKIDNPSKKNSSRHWSNEAGKQTVLKQKDFGNSVLKVDATCSTNRKIISQQNLIQDFEKENKANQVCTGSRDGKAKVITSSEDKVKRETLYVGSRTAPESQRGDMSDGHPFHASGNDVPKFVRNPVDVSCKVGFNCSSESFIPDGQLSESGPVTTNSSKTATSILEEATKLKDSADHYKNSGFEFESNETYFKSALKFLHGASLLESSHGESSKHGEASQMQIYATTAKLFE

SEQ ID NO: 230193 - protein, 124 aa, Glycine max
  Coding DNA Sequence Number=SeqID_113415
  Gene Ontology: Mol. function=binding; Biological process=protein kinase C activation
  Homolog annotation: Hit_ID=Q1SCC3; Match level="QueryCoverage=96%, HitCoverage=63%, E-value=9e-44, Identity=54%"; Hit description =Tetratricopeptide-like helical
MVALPIHINERRVCNKVGPKTRSLNKSMSSSTSLKVGEDRTYINESGKCEFIGQNQGSLHLMEQKKCHFGLTLADITSHKRSLGHDITVRYFVEQFLCRVDSKEPEIAVSEMVGGKSVIGQNRI

SEQ ID NO: 230194 - protein, 167 aa, Glycine max
  Coding DNA Sequence Number=SeqID_113416
  Gene Ontology: Mol. function=zinc ion binding
  Homolog annotation: Hit_ID=Q10LI9; Match level="QueryCoverage=93%, HitCoverage=17%, E-value=3e-28, Identity=45%"; Hit description=CW -type Zinc Finger family protein, expressed
MAAAALAYKCLEVVYMRLVYCKHSSINRDRHELQSTLQMVSQGESPSSSASDIDNLNNLAVADKATLTRGSNTHVPSNQVISARNRPNIVRLLDFTQDINLAMEASRKCKTTYMAASLNMEDSWNRDCITSIRKVVDFSFQDVDELVHLVLTATKAITCAGLGGVRD

SEQ ID NO: 230195 - protein, 412 aa, Glycine max
  Coding DNA Sequence Number=SeqID_113417
  Gene Ontology: Mol. function=protein binding; Cellular component =integral to membrane; Biological process=defense response to fungus
  Homolog annotation: Hit_ID=Q1SWI7; Match level="QueryCoverage=100%, HitCoverage=85%, E-value=7e-61, Identity=30%"; Hit description =Leucine-rich repeat
  Pfam annotation: Domain name=LRR_1; Domain location=133-155; Score =14.0; E_value=0.55; Accession=PF00560.23; Description=Leucine Rich Repeat
  Pfam annotation: Domain name=LRR_1; Domain location=157-179; Score =8.1; E_value=8.6; Accession=PF00560.23; Description=Leucine Rich Repeat
  Pfam annotation: Domain name=LRR_1; Domain location=181-203; Score =13.4; E_value=0.85; Accession=PF00560.23; Description=Leucine Rich Repeat
  Pfam annotation: Domain name=LRR_1; Domain location=205-227; Score =16.7; E_value=0.084; Accession=PF00560.23; Description=Leucine Rich Repeat
  Pfam annotation: Domain name=LRR_1; Domain location=229-251; Score =19.0; E_value=0.018; Accession=PF00560.23; Description=Leucine Rich Repeat
  Pfam annotation: Domain name=LRR_1; Domain location=258-280; Score =9.6; E_value=4.6; Accession=PF00560.23; Description=Leucine Rich Repeat
  Pfam annotation: Domain name=LRR_1; Domain location=282-305; Score =10.5; E_value=3.1; Accession=PF00560.23; Description=Leucine Rich Repeat
  Pfam annotation: Domain name=LRR_1; Domain location=3-25; Score=14.4; E_value=0.42; Accession=PF00560.23; Description=Leucine Rich Repeat
  Pfam annotation: Domain name=LRR_1; Domain location=307-330; Score =9.7; E_value=4.4; Accession=PF00560.23; Description=Leucine Rich Repeat
  Pfam annotation: Domain name=LRR_1; Domain location=355-377; Score =5.8; E_value=24; Accession=PF00560.23; Description=Leucine Rich Repeat
  Pfam annotation: Domain name=LRR_1; Domain location=385-404; Score =11.6; E_value=1.9; Accession=PF00560.23; Description=Leucine Rich Repeat
  Pfam annotation: Domain name=LRR_1; Domain location=51-74; Score =13.7; E_value=0.68; Accession=PF00560.23; Description=Leucine Rich Repeat
  Pfam annotation: Domain name=LRR_1; Domain location=76-97; Score=9.3; E_value=5.2; Accession=PF00560.23; Description=Leucine Rich Repeat
  Pfam annotation: Domain name=LRR_1; Domain location=99-121; Score =4.4; E_value=44; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1; Domain location=133-155::157-179::181-203::205-227::229 -251::258-280::282-305::...
  Pfam module annotation: Domain location=3-25::307-330::355-377::385 -404::51-74::76-97::99-121
MTSLTHLNLSHTGFRGKIPPQIGNLSNLVYLDLSYVFANGTVPSQIGNLSKLRYLDLSDNDFEGMAIPSFLCAMTSLTHLDLSSGFMGKIPSQIGNLSNLIYLDLGGNYLLAENVEWVSSMWKLEYLDLSYANLSLLNFTGNEIQGPIPGGIRNLTLLQNLELSFNSFSSSIPNCLYGLHRLKYLDLSSSNLHGTISDALGNLTSLVGLDLSHNQVEGTIPTSLGNLTSLVELDLSYNQLEGTIPTFLGNLRNSREIDLKYLYLSINKFSGNPFESLGSLSKLSSLLINGNNFQGVVNEDDLANLTSLKEFDASGNNFTLKVGPNWLPNFQLSYLDVTSWQIGPNFPSWIQSQNKLRYVGLSNTGILDSIPTWFWEAHSQDKPMQLEFLNLASNNLSGEIPDCWINWPFLVD

SEQ ID NO: 230196 - protein, 360 aa, Glycine max
  Coding DNA Sequence Number=SeqID_113418
  Gene Ontology: Mol. function=oxidoreductase activity; Cellular component=cytoplasm; Biological process=flavonoid biosynthetic process
  Homolog annotation: Hit_ID=Q9LIF4; Match level="QueryCoverage=99%, HitCoverage=99%, E-value=1e-122, Identity=59%"; Hit description =Arabidopsis thaliana genomic DNA, chromosome 3, P1 clone:MHC9
  Pfam annotation: Domain name=2OG-FeII_Oxy; Domain location=209-310; Score=141.7; E_value=2e-39; Accession=PF03171.10; Description=2OG -Fe(II) oxygenase superfamily
MATLPVSNPPINIDDVQELRKINPNTIPERFVQDVTERPNLNGIPLSLSPSPDDMPIIDFSKLTKGNKEETHEEILKLSTACEEWGFFQIINHDIDLDLLESIEKITRGFFMLPLEEKQKYALIPGTFQGYGQALVFSEDQKLDWCNMFGLAIETVRFPHLWPQRPAGFSEAVEEYSREVKKLCQNMLKYIALSLGLKGDVFEKMFGETLQGIRMNYYPPCSRPDLVLGLSPHSDASAITVLQQARGSPVGLEILKDNTWLPVLPIPNALVINIGDTIEVLTNGRYQSVEHRAVVHQEKDRMSIVSFYAPSSELELSPMPEFVDENNPCRFRSYNHGEYTVHVSESRLQGKKTLNNFARI

SEQ ID NO: 230197 - protein, 353 aa, Glycine max
  Coding DNA Sequence Number=SeqID_113419
  Gene Ontology: Mol. function=signal transducer activity; Cellular component=intracellular; Biological process=signal transduction
  Homolog annotation: Hit_ID=Q9M2Z2; Match level="QueryCoverage=93%, HitCoverage=95%, E-value=1e-132, Identity=69%"; Hit description =Putative WD-40 repeat-protein
  Pfam annotation: Domain name=WD40; Domain location=115-153; Score =50.9; E_value=4.3e-12; Accession=PF00400.22; Description=WD domain, G-beta repeat
  Pfam annotation: Domain name=WD40; Domain location=157-195; Score =54.2; E_value=4.2e-13; Accession=PF00400.22; Description=WD domain, G-beta repeat
  Pfam annotation: Domain name=WD40; Domain location=199-238; Score =4.6; E_value=11; Accession=PF00400.22; Description=WD domain, G-beta repeat
  Pfam annotation: Domain name=WD40; Domain location=22-60; Score=32.4; E_value=1.6e-06; Accession=PF00400.22; Description=WD domain, G-beta repeat
  Pfam annotation: Domain name=WD40; Domain location=264-305; Score =25.2; E_value=0.00023; Accession=PF00400.22; Description=WD domain, G-beta repeat
  Pfam annotation: Domain name=WD40; Domain location=309-349; Score =21.9; E_value=0.0023; Accession=PF00400.22; Description=WD domain, G- beta repeat
  Pfam annotation: Domain name=WD40; Domain location=73-111; Score =46.9; E_value=6.9e-11; Accession=PF00400.22; Description=WD domain, G-beta repeat
  Pfam annotation: Domain name=eIF2A; Domain location=38-206; Score= -82.6; E_value=0.0077; Accession=PF08662.1; Description=Eukaryotic translation initiation fact
  Pfam module annotation: Pfam domain module=WD40::WD40::WD40::WD40::WD4 0::WD40::WD40::eIF2A; Domain location=115-153::157-195::199-238::22 -60::264-305::309-349::73-111::38-206
  Subcellular localization annotation: CTP_CleavageSite=47; ConfidenceScore=5.40e-01
MTTEATVKAFSDSDSDSMKPNYTLSQTLSGHKRAISAVKFSSNGRLLASSAADKTLRTYGFTNSDSDSESLTLSPMQQYEGHEQGVSDLAFSSDSRFLVSASDDKTLRLWDVPTGSLIKTLHGHTNYVFCVNFNPQSNIIVSGSFDETVRVWDVKSGKCLKVLPAHSDPVTAVDFNRDGSLIVSSSYDGLCRIWDASTGHCMKTLIDDDNPPVSFVKFSPNAKFILVGTLDNTLIFGISWLYKYGEGEKQNELLFQRLWNYSTGKFLKTYTGHVNSKYCISSTFSTTNGKYIVGGSEENYIYLWDLQSRKIVQKLEGHSDAVVSVSCHPTENMIASGALGNDNTVKIWTQQKD

SEQ ID NO: 230198 - protein, 110 aa, Glycine max
  Coding DNA Sequence Number=SeqID_113420
  Gene Ontology: Mol. function=sequence-specific DNA binding; Cellular component=intracellular; Biological process=regulation of transcription, DNA-dependent
  Homolog annotation: Hit_ID=Q942Y5; Match level="QueryCoverage=78%, HitCoverage=49%, E-value=7e-38, Identity=82%"; Hit description =Putative HAP3-like transcriptional-activator
  Pfam annotation: Domain name=CBFD_NFYB_HMF; Domain location=23-88; Score=125.5; E_value=1.5e-34; Accession=PF00808.13; Description =Histone-like transcription factor (CBFNF-Y) and archaeal histone
  Pfam annotation: Domain name=Histone; Domain location=20-91; Score =8.7; E_value=0.018; Accession=PF00125.14; Description=Core histone H2AH2BH3H4
  Pfam module annotation: Pfam domain module=CBFD_NFYB_HMF::Histone; Domain location=23-88::20-91
MDNVGGSSSNIAENSGIIREQDRLLPIANVGKIMKQILPPNAKISKESKETMQECVSEFISFVTSEASEKCRKERRKTVNGDDICWALGSLGFDDYAEPLRSWYLHPFID

SEQ ID NO: 230199 - protein, 975 aa, Glycine max
  Coding DNA Sequence Number=SeqID_113421
  Gene Ontology: Mol. function=DNA binding; Cellular component=nucleus
  Homolog annotation: Hit_ID=Q10LJ1; Match level="QueryCoverage=89%, HitCoverage=89%, E-value=1e-98, Identity=32%"; Hit description =Expressed protein
MKDTGCVYSCYFVCVVYSLKKHHQLDDTVQVNDLNCIDEQSLSPEYSGVYDVFGEPDIFPRVGEQYQVEIPSLISKSDYYWLLRNPHEAESTASSTLHKFRVGLPIPIIWIKDGVENNRHDHQKKACKPNGGTNKIESSKLERIKETLNGLDCDKLKPKLGSVDSTLANGMKLGESENSNMQQETEIEMCKQHRDKGHCLVPGAASDTWNEIEEASFILGLYIFGKNLFQVKRFIGNKKMGDILSFYYGKFYKSDKYQRWSGCRKMRSRKCIYGQKIFTGPRQQELLSRLLPIVSEECYNKLLEVSKAFVEGKILLEDYVLTLKASVGLKALVEGVAVGKGKEDLAGTAMDSMKSTQALPARQEIPVGKACSILTPSEIISFLTGDFRLSKARTSDLFWEAVWPRLLARGWHSEQPDSHNYAVGSKHSLVFLVPGVKKFSRKLVKGNHYFDSVSDVLCKVASDPELIELESIADNDCTSNEGYGWTKDTKLDHENSRDQPRHCYLMVKTPNCSTDVMKFTVVDTSLASEQMTKVAELRSLPFEVLKACTFENDSDDENTSAEQTNESESVNTTCLERGKNGITKANNTTCLERGKNGITKANNTTCLDRGKNDFTKASKSNISKGVSSLLHGLKHNPSKEELPRSSMGSSSLSAASKGPKTEFLSNTLKRDGMKCPSLQRMVSDKKNDLVPVTKRRKRLTACSRAKKDSNTANFFVVSRVNQEEAGFCPDPDNSKFSANVTAKVFVASRVKQEEAIPHKSKCNESVLSWEIPPQEKKSSADLPSKKNKTLADPPSNPSSIINGEAVPDTSSSGTKDQCDKTQPQTMIDLNLPVPPEVEAGEPFVNEVAEMQKNNTGKESDDLSVVTNAKLSDHPDQQPDTHTRRQSTRNRPPTTKVLEAFAFGYLDRKEKRRSRDYLQDSSTTRPSRRVSRKVTGASIGGTDLEKEVQTDVVCNGNGSPSSDSNVIHTGSKCNEG

SEQ ID NO: 230200 - protein, 97 aa, Glycine max
  Coding DNA Sequence Number=SeqID_113422
  Subcellular localization annotation: CTP_CleavageSite=36; ConfidenceScore=5.13e-01
MASNLATGFSTNSCRNVPFCGRARQGSWVRFPKEERCAESPPTFICGKHRNNRRKPVKKKILSSGVVFKFEEGRQKRGFCSYVPSIEEEIRLTQFFL

SEQ ID NO: 230201 - protein, 90 aa, Glycine max
  Coding DNA Sequence Number=SeqID_113423
MAYVTSAECRPIIPQLLTEHPGIEPQNERDESKRTLVKFFLLRISRLANLEKYVQCAYCKSRYMFGIVELGQSFEYHKVWALYIKPKSRA

SEQ ID NO: 230202 - protein, 97 aa, Glycine max
  Coding DNA Sequence Number=SeqID_113424
MDKSLISHSGYDRRVVEAAPLVDEVIETPDIAIQILTSPTRFAIRSVKEEFPKVTAASPFVTRHVSSCFLLPGAQPSPLNFEPPPPPSIRVHLHRCF

SEQ ID NO: 230203 - protein, 103 aa, Glycine max
  Coding DNA Sequence Number=SeqID_113425
MTPGGHHKPSLLVGEPSHQEEHFNQTEILRIHLKGSVEKIPLILPFVASPRQSQPKVTTITESRDLTNMSLATLFGKLQEHEMELMKLYQHEENDKKKKGIAL

SEQ ID NO: 230204 - protein, 84 aa, Glycine max
  Coding DNA Sequence Number=SeqID_113426
  Subcellular localization annotation: CTP_CleavageSite=61; ConfidenceScore=5.13e-01
MVNKSSLLHLDPKSPEAQAFNQIDQKSNGGSIRPSPTPSVEGSSQNGRKQGTDETATAKNSASYIGKRFLESLVAVAGLLIWLS

SEQ ID NO: 230205 - protein, 74 aa, Glycine max
  Coding DNA Sequence Number=SeqID_113427
  Gene Ontology: Mol. function=metal ion binding
  Homolog annotation: Hit_ID=Q7X9G5; Match level="QueryCoverage=77%, HitCoverage=6%, E-value=1e-14, Identity=67%"; Hit description =Lipoxygenase
MEVNNQIVERSKRVKGRVVLMKKGVLDFHDIKANVLDRVHELLGKGVSLQLISATTPDPGPLDFLIIIFANCNY

SEQ ID NO: 230206 - protein, 46 aa, Glycine max
  Coding DNA Sequence Number=SeqID_113428
MARSLVSMISLNVILALAAMVLAANCRPLVMEHALNFLNVLPTAKF

SEQ ID NO: 230207 - protein, 147 aa, Glycine max
  Coding DNA Sequence Number=SeqID_113429
  Homolog annotation: Hit_ID=Q1SF88; Match level="QueryCoverage=32%, HitCoverage=3%, E-value=2e-08, Identity=56%"; Hit description =Integrase, catalytic region
MLEMTCYYFPRQQTLEGCPPQKPILKHEFRGFFYDQSLLQPPQASSRSIDALVANSQNSDDDMNHQNASQVGTRATTRKTTKIQVVRTLTKVVAMAVAPMRTTTIVGASAGCWRWQSQTVAAMADSLAMSVAARCSLDCGAMSISHI

SEQ ID NO: 230208 - protein, 133 aa, Glycine max
  Coding DNA Sequence Number=SeqID_113430
MVMVVWGKKGEGGFRKSGGACGEIVEGVIGGLGITFANPTQEPNKNNLLQIVFQNARVEEDLVEMEPHDDMDEETYKLYAHNDNELECCYAVRERVRCDDGKCDFHEDKELSGNDLDDILDGLEEQDDDIIKV

SEQ ID NO: 230209 - protein, 76 aa, Glycine max
  Coding DNA Sequence Number=SeqID_113431
MASSMDESTALLDPPPSQIHLCHRSNAFTDPLPSQIRLHHRCGFATITTSSLSWIYYRRDFIFVLDPPPSLPQIRC

SEQ ID NO: 230210 - protein, 47 aa, Glycine max
  Coding DNA Sequence Number=SeqID_113432
MGELIGLDEVMVEFSGPTHLFDEWLDCGDDGSHKMKYEGMKNEKKFH

SEQ ID NO: 230211 - protein, 158 aa, Glycine max
  Coding DNA Sequence Number=SeqID_113433
  Gene Ontology: Mol. function=DNA binding; Cellular component =mitochondrion; Biological process=DNA integration
  Homolog annotation: Hit_ID=Q1SAI8; Match level="QueryCoverage=98%, HitCoverage=24%, E-value=1e-38, Identity=70%"; Hit description =Integrase, catalytic region
MATIHTMLSLALSKAWPIHQLDVKNAFLHSELKETVYMHQPLGFKDPDCPNHVCLLQKSLYGLKQAPRACKSDNSFLIYWNDTAMDYILLYVDDIILTASFDTLRNLLSWSFKCQATLSLSSAEAKCEGIANVVSESCWLCNLLLELSYSEGYIGLLL

SEQ ID NO: 230212 - protein, 135 aa, Glycine max
  Coding DNA Sequence Number=SeqID_113434
  Homolog annotation: Hit_ID=Q10QG7; Match level="QueryCoverage=22%, HitCoverage=11%, E-value=1e-07, Identity=86%"; Hit description =Expressed protein
MVSILIVVLVRRVGLPPSGWVFVLGFVVLICASGICFNYDAFHAQNLGIWLGLQQEDEEMLVPHTDLAKNNHQPMEGPGAVNFIIDHGELDFVFVQDRKVIHVEKGHELDLLLVYGPVRSHLGFPAWRLRYTEIM

SEQ ID NO: 230213 - protein, 104 aa, Glycine max
  Coding DNA Sequence Number=SeqID_113435
MYNFIAGLRLMCFLVSTVVMKAERTLGRYLHGDAYVGHELGERGVGVREDSRSRMTSSLAVISRVLVVISKVWVVMVDRFRLRWYTTSSRQSRVGMVQGRGSDR

SEQ ID NO: 230214 - protein, 73 aa, Glycine max
  Coding DNA Sequence Number=SeqID_113436
MAHSLVSMILAKVIVTVMVIVLFSLGVSSKPRCVGACSQFPDCAAYCKTKGYQTGTCTLDVCCCAKAVEHIFS

SEQ ID NO: 230215 - protein, 104 aa, Glycine max
  Coding DNA Sequence Number=SeqID_113437
MASGTYVRAWCSKPKLENSLVNLLQGPQNLRSTIGTYARAQHLCYIQDSSKASHLLILIGLKNPRPVLGRTRHSSEGWTKLRTYMSLVQGSTNPKTTLSEASHY

SEQ ID NO: 230216 - protein, 117 aa, Glycine max
  Coding DNA Sequence Number=SeqID_113438
MSEGERNLAVRGRKATEREVVARDAAERERESHTCALRGRESWWCVERERALLRREKKSWWCAEKERASAKLPYTKDIQGYAKNIILLLEWLQVLSFSTRQPYANMKNYENYRNELK

SEQ ID NO: 230217 - protein, 85 aa, Glycine max
  Coding DNA Sequence Number=SeqID_113439
  Gene Ontology: Mol. function=RNA-directed DNA polymerase activity; Biological process=RNA-dependent DNA replication
MGEEWREAVKEEVDMLFHANFIRENNDRWRMCIDYTDLNRACPKDVYPFPSIDRLVDGAFGFQVLSFLDAYFGYNQIRMHPPDKE

SEQ ID NO: 230218 - protein, 287 aa, Glycine max
  Coding DNA Sequence Number=SeqID_113440
MSDGEALGELALTEGDHQVHVPSSLESFVYKAEEWTGDLRRHEVRYDNGDNHGVVLVDALEVLMPFSGLVGLSSIGKSASDGVDYTSDVLGGFLPWSRLSLTSLLLVSLPASVFCSSYVYFLVPYLVASDPGLGGFIWGSRIGTLRLNASSRIMVRLAIRGEEHEIQRYLGIEILDLDDRAPKYVHELSKGLIVYLSQTDQGSQGHAMRPTSGILCNESFNEGVEAVYGPTWESTVPGRLLGACLDLLSHRIARVDKRMSTDSSCCWMVHARCGQIACHPGMSNTSL

SEQ ID NO: 230219 - protein, 60 aa, Glycine max
  Coding DNA Sequence Number=SeqID_113441
MFGEGIVCDPRHGTAKERIGSMTRVVEQPRKALKTGGEDDGGGGGFGGGGGRCGSGRRCQ

SEQ ID NO: 230220 - protein, 398 aa, Glycine max
  Coding DNA Sequence Number=SeqID_113442
MASRKRKSIGSRPTTQYDTRRFHSFEAWTWYTDNVLGRHILPERKVEIYHTELDEFKAKLERHNFHKRLTNLVDNNIDLALVKEFYATLYSSEGPSLKQVRVRGHLVRIDADNLNTFLETPVLLAKGETLPAYSRYCRLPTNIREIEATLCIPGRGVLSYSNLAPTSHTSNLTADRARLIFGLVSQMDMNVRALISGQITSMAQSNSTRLGFPALITALCKSRGVASDSLVFERLSPVINLAYIWKNCWNPDDLTVTIRGARRARTRLAEAPSTSTTPPLAPWPGTQFSLHKEDEGPTAQVPQQMEVESSKTTIPKPLVRRKKADETQEAAATSEKSLEATSEPSEPVADTTSPQQAAESSTPEDQTTPVLSLNTSPTAIPVLYLTDEEDVQTQDTQD

SEQ ID NO: 230221 - protein, 203 aa, Glycine max
  Coding DNA Sequence Number=SeqID_113443
MGFSIEPSESLPPSLMAESNKKEDITVNRSTFASWRKKKGKPEARKQKNEQGSKKTMNNDPKSNVHSIYRGDGLFNNWQELKRCPKISHHNAPPLNHDHYSNTCPLHATTPDTGQQASILEGLTNSSPFTCQHYYPRHQTNFLNTGQAHLTWDNLFHLKIGSQLGSLCTVQDPQNLHGILFGTYRHMSTLHVSPVTGAQMPGP

SEQ ID NO: 230222 - protein, 370 aa, Glycine max
  Coding DNA Sequence Number=SeqID_113444
MSSFLFDSAIKLGGSDSEAVPRLRILIEVPLIVSHPPQRGGARKFGSSEEVRSSPRIRPSMSVGLPLSTPVIASYEWIRDDLLKYKSCLTLAMSVVALQCQVKAAPGCPPFFCMYKCLFKVLGVILPLIDFQCAFLEHLNVAFSQLHPNSWAMVKAFEVLCSFFNIWPSVLVFLLFFQMKLFGKIGWVSFNNVSKKLFEFDSNIFRHFKDHFFKVLATDVQQRQGAPLLVLLAGANLLERLALLLLLMRSPLALLSLSGRKKLKAPMSLRALRQVVGIGPIEGRLMTATHVVVEAVVPATLAYSIMVPSSTVTAPLLSDDVATIGAPSFFVGSSGLPCCYFCGYGIAFFVLVSLRLPYHLCASSDADSLW

SEQ ID NO: 230223 - protein, 54 aa, Glycine max
  Coding DNA Sequence Number=SeqID_113445
MRKDLEEDDLYRLTERTTSSHQEHCFSPSAEREKSAKQKFTNRLELEAGAVLRA

SEQ ID NO: 230224 - protein, 209 aa, Glycine max
  Coding DNA Sequence Number=SeqID_113446
  Gene Ontology: Mol. function=oxidoreductase activity, acting on the CH-OH group of donors, NAD or NADP as acceptor; Cellular component =peroxisome; Biological process=metabolic process
  Homolog annotation: Hit_ID=Q93XV7; Match level="QueryCoverage=73%, HitCoverage=36%, E-value=3e-52, Identity=68%"; Hit description =Hydroxypyruvate reductase
  Pfam annotation: Domain name=2-Hacid_dh_C; Domain location=3-89; Score=2.3; E_value=2e-09; Accession=PF02826.9; Description=D-isomer specific 2-hydroxyacid dehyd
MVPTPKINLHPVLDKTTYHLVNKERLAKMKKEAILINCSRGPVIDEAALVEHLKQNPMFRVGLDVFEEEPYMKSRLTELKNAIVVPHIASASNVIIINPNPYNIGKFQPVTSVLRALVKKLIGKIKGYPVWFDANRVEAFLKENARPPATCPSIVNAKALGGEHNQSSSSHVSSYIPISTSMQREELKDPENSTQSEHEPTQKQVKGEN

SEQ ID NO: 230225 - protein, 435 aa, Glycine max
  Coding DNA Sequence Number=SeqID_113447
  Gene Ontology: Mol. function=transferase activity, transferring glycosyl groups; Cellular component=membrane
  Homolog annotation: Hit_ID=Q10RW1; Match level="QueryCoverage=95%, HitCoverage=81%, E-value=1e-70, Identity=38%"; Hit description =Xyloglucan galactosyltransferase KATAMARI 1, putative, expressed
  Pfam annotation: Domain name=Exostosin; Domain location=31-386; Score= 391.5; E_value=1.3e-114; Accession=PF03016.6; Description=Exostosin family
MSKFHVMLLVLVALLWNSGASEAEECEKRWIHIRKLPSSLNLDLLANCSEYPMLDDLCPFLANHGLGQKTHNHSHSWYRTDPSMLELIFHRRMLEYPCLTQDPLQANAIYLPYYAALDSLRYLYGPEYNSSAKHGLSLFHFLQSDNPQIWNRHMGHDHFLVMARPAWDFSQPLFNDPPVWGTSFLELPQFFNLTALTLESRAWPWQEHAVPYPTSFHPPNLGLFESWLNRVRRSKRSVLAIFAGGGGVSATPNIRRSIRSECENATTSSDSSYDTLCEIVDCSNGICEHDPIRFMRPMLSASFCLQPPGDTPTRRSTFDAILAGCIPVFFEELSAKAQYGWHLPESEFEEFSVFIPKEEVVFRGMRILDVLQRIPRTRVRRMREKVLELIPSVLYRKHNSSPGLKTKKDAVDLAIDGTLDKIRSRLRDLHLDFVM

SEQ ID NO: 230226 - protein, 43 aa, Glycine max
  Coding DNA Sequence Number=SeqID_113448
MDHKKAAPGAAPEQNRKKGLADHQLKLIQRSYLTRLDTPIPYH

SEQ ID NO: 230227 - protein, 93 aa, Glycine max
  Coding DNA Sequence Number=SeqID_113449
  Gene Ontology: Cellular component=integral to membrane; Biological process=vesicle-mediated transport
  Homolog annotation: Hit_ID=O23429; Match level="QueryCoverage=67%, HitCoverage=28%, E-value=3e-27, Identity=89%"; Hit description =Vesicle-associated membrane protein 724
MSQESFIYGFVARGTMVLAEYTEFTGNFPAIAAQCLEKLPSSNNKFTYNCDHHTFNFLVEDGYGCHRNALVFCMAMTDETTAISSKSLSLTLY

SEQ ID NO: 230228 - protein, 116 aa, Glycine max
  Coding DNA Sequence Number=SeqID_113450
  Subcellular localization annotation: CTP_CleavageSite=21; ConfidenceScore=5.20e-01
MPQHLALSLRPFLPIFPRKYRFEKSSSISPQHLTLMDRRRNTSPIYARQWSGGSSSTDSSSSTMSPAYPQSHLSTTSATGISTVKRMQNVAAKAVAQRLARVMSSQNCWIKWPQNN

SEQ ID NO: 230229 - protein, 77 aa, Glycine max
  Coding DNA Sequence Number=SeqID_113451
MSLHHCDAPARISESVSFCTRMRFRDPLMVFFTMVLDDGADEEEGEGCWQREDIVLEPHGRKGRLMVVVRSVMVFPM

SEQ ID NO: 230230 - protein, 130 aa, Glycine max
  Coding DNA Sequence Number=SeqID_113452
MRAGCRCGRGRGGQGEGGCRGRRSEGERDRGWKSKKMWWDVGFMEKRAGTDNVQVEQHLGESDSRSNINLVRESLSDPTLNAFDIDNLVLNDNVKYHFSTKEELQDDGNEDDGGGGGDIGDDLIRGLMNN

SEQ ID NO: 230231 - protein, 268 aa, Glycine max
  Coding DNA Sequence Number=SeqID_113453
  Gene Ontology: Mol. function=RNA-directed DNA polymerase activity; Cellular component=mitochondrion; Biological process=RNA-dependent DNA replication
MIEKVALALITSVQRLRSYFQIHSVVVNTNYPIKQVLQKPKLAGRMVACFVELSQFDLQIILKGPDNVALEQPLKLNFKASNNHANKRSQSQEATKTPNLPRDRLPTDTRQRKQCCLSTITSPKTLIDNFECFEMYYIPRDNNTRVDLLFKLASTKKAGHLKTIIQEMLQTPTIDTKEVMVGEKEAPNWTTRYKNFLIQGVSPPDENEARHLKWKGCYYTIFDGDLFKKGLKKPLLKCLNNQQADFVMRKVHEGIYSLHTGGTSLPPK

SEQ ID NO: 230232 - protein, 349 aa, Glycine max
  Coding DNA Sequence Number=SeqID_113454
  Gene Ontology: Mol. function=DNA binding; Biological process=DNA integration
  Pfam annotation: Domain name=rve; Domain location=1-154; Score=40.0; E_value=8e-09; Accession=PF00665.16; Description=Integrase core domain
MDILGPLPKALRAAKYLLVIIDYFTKWIETRPLPEITTNKVETFTWKHLICRYDLPYTIFTNNGTQFNTQACENILTKLGIKNFITSVEHPQTNGQAEATNKVILSALDSKSPRTTDEVQEMARIKEEATKLQASRCYNTKVQPRAFQPEISVIPNLDSGAYQLQDPNVKSDSKNMECYSSEVLLQLTYCKIGCCILFPTQAHKTQGPPFVSLDSPKAQKAQGPPLVSLVSLEARKNRLVKPKVDSPKACQTQGPPLVILASLKARKTQVMQSYPARALGRRLQVDWARDPREGPRVLMSLRLSSSFSRKLLKEDPIEAQRSSLHRSPTSKLPSPGSTLDDSFKLIKPK

SEQ ID NO: 230233 - protein, 73 aa, Glycine max
  Coding DNA Sequence Number=SeqID_113455
MARSLVSIILPKVILAAMIIVLFSHAVSSQPTCPFTPGSCKNTEGCDAHCKFLNYEKGICIILSPTYSKCCCS

SEQ ID NO: 230234 - protein, 86 aa, Glycine max
  Coding DNA Sequence Number=SeqID_113456
MRAKSKKELFTHREGISTPRACHKGRQPLIECAQHDFNKGAALAPTHPQGKSYFGLVEARPGELMLSPEGMSSPRRVGARPGELVA

SEQ ID NO: 230235 - protein, 252 aa, Glycine max
  Coding DNA Sequence Number=SeqID_113457
  Homolog annotation: Hit_ID=Q1RSM5; Match level="QueryCoverage=36%, HitCoverage=24%, E-value=2e-07, Identity=36%"; Hit description=Heavy metal transport/detoxification protein
VFLPQRVDPQQQKVTVTGSVGVETLIRKLVKAGKHAEIWPENLAATGKGKSSCKDKMQRQNNNNNKEQGEPESVENNSTTVNAEPNSRNTSKKKGIEKNAEKRNNGGNKSTGSSKSVGVAGESEAAEPENKGGQREGGSGKKKKKKGQSGGERAACGDAPAHTGSEVQCSGQVNLSHTRQQSYMYPESYCYPPQPQVYLATTQNNNNRLCPSYYVSPLPYMCAGFDHDPPYRFQSPPFEIFSDENANACSIM

SEQ ID NO: 230236 - protein, 347 aa, Glycine max
  Coding DNA Sequence Number=SeqID_113458
  Gene Ontology: Mol. function=protein phosphatase type 2C activity
  Homolog annotation: Hit_ID=Q9LUS8; Match level="QueryCoverage=80%, HitCoverage=51%, E-value=4e-52, Identity=47%"; Hit description =Similarity to protein phosphatase-2c
MPSPQIDFDSSSLVLLAFPAKALSHSGIPWIRNCHSVRYFGRHGCHGCGMRPASSCRLQVNMLNSEGELKISFGYKCNRDRGIPCEVVSGCKILPGVCRTSSFSCLSGAALSANATLANTNICNGKIGEEILPSWDSPTSFRKVTSSPSLSKLDILSSSPPNSLSYLSCSPSTVSDILEYDSCTLKSMSDPSRSEGFLNAKEVQVAGGAAGEDRVQAVCSEENGWLFCAIYDGFNGRDAADFLAGTLYETIISYFNKLIWELEPGSIKAYDKGCLGGSLQYKLDDSLIYHENQSLSRFKGINNSNHGCFAKCNPSTKSEVSCDSFSHGVLDILQRAISQAENDFLYM

SEQ ID NO: 230237 - protein, 98 aa, Glycine max
  Coding DNA Sequence Number=SeqID_113459
PCCKIENSILESTDPTVLESQSLSITTDHDRSMLALSEPTEFEFQSVSVTGDHDPLLRIPLTPTKRVSSDELDNERKNFEISPAEVSSNKLAKHSQPE

SEQ ID NO: 230238 - protein, 428 aa, Glycine max
  Coding DNA Sequence Number=SeqID_113460
  Homolog annotation: Hit_ID=Q1PEW8; Match level="QueryCoverage=79%, HitCoverage=85%, E-value=1e-09, Identity=29%"; Hit description=F-box family protein
  Pfam annotation: Domain name=F-box; Domain location=218-268; Score =15.2; E_value=0.23; Accession=PF00646.23; Description=F-box domain
  Pfam annotation: Domain name=F-box; Domain location=23-73; Score =11.9; E_value=1.3; Accession=PF00646.23; Description=F-box domain
  Pfam module annotation: Pfam domain module=F-box::F-box; Domain location=218-268::23-73
MGDLRVKKKKGSNKKKHGSVSVTAIKFLPKELQVEIFAKVATRSVFDHCMIKLCCKEFLRAAEDNYVYRHASMENFALVPLPWFKGNNKEFPFLKRCRESGNSEILYREGMVQYFTSSMMELGLKNLKEAALEGHHDAKYVYCMLLMCGEDELGERKQGFQEEDGHRLRIKKMAVVLVFRANVAKASCPVRFQTLTVAGLGVKKRRNEKQHKHDGSFTTVKALPKDMLVEIFAKVATRSIFDLCMVKQCCREFLHAAEDDYVYRHASMENYALVPLQWLKESSFLKRCKESGNSEFAYREGMVQYFTYSRVELGLKNLKEAALEGDHDEAKYVYCMLLMCGEDELGQRKQGSDLLCSLKASSTSLVRCRKRVKSFVGTMWLNNKPVVPNRKSCFCGSDTSDSERLKKLSRSLRWSSFDANVALLIMNL

SEQ ID NO: 230239 - protein, 342 aa, Glycine max
  Coding DNA Sequence Number=SeqID_113461
  Homolog annotation: Hit_ID=Q1T493; Match level="QueryCoverage=97%, HitCoverage=61%, E-value=8e-35, Identity=27%"; Hit description =Nucleic acid-binding, OB-fold, subgroup
  Pfam annotation: Domain name=DUF223; Domain location=41-135; Score= -11.5; E_value=0.034; Accession=PF02721.5; Description=Domain of unknown function DUF223
MAHVADKIKLIDGSREALKLSVRITDLWFIGIPRKTEQAEMEVVDSDGDEIHFACKQDQLKSRMADLKENFTYVMHNFKVIKNDGKFRVCDHEYKLCFTEVIVVTQCDMEQLPFRKFRFVSFSSVIAGDFKIGLLVDVIGVVDEVVFRYVSSKNTRVVLNLKDLSGQVLSCTLWENYCLQFLSYLNDIEDERPIVILLTHARIKEAQGSYPASVSNSFKASKLMINDLVLEIQEFRESLLDLGIEVRAILVPIGQGSSQVSGSSQLSSKDAFLSKTEVKNISEINVSLEEFVCVTVAKITTIVMDNYSWCYPACGQCYKKADMQTVSFTCPCGKENDQPVLR

SEQ ID NO: 230240 - protein, 74 aa, Glycine max
  Coding DNA Sequence Number=SeqID_113462
MFALPDLPTQPANIKGKAKMVEEKNDKTILTPNEDIPVKGLPEKRDGCGKKEVSLEEASEFLRIIQQSEFKVIE

SEQ ID NO: 230241 - protein, 208 aa, Glycine max
  Coding DNA Sequence Number=SeqID_113463
  Gene Ontology: Mol. function=RNA-directed DNA polymerase activity; Biological process=RNA-dependent DNA replication
MADLEEVYGELCRGLGEGKFLGFMITHQGIKANPNKCTAILEMHNPTNKTELFLWDETCEQAFPTFKNTIATPSILSWPRLGIPLILYLSVADEVISLTLVQEEGKHQLPIYFTSLILHDAKKCYQMIKKASGVGIILEGPSIILMQFYPARALGRKLQVDWARDPREGPRVLMSLRVSLAIRELLKEVFSKKLLKEVFSRKLLKEAT

SEQ ID NO: 230242 - protein, 117 aa, Glycine max
  Coding DNA Sequence Number=SeqID_113464
MRVFSFFHGLFPSGWRLLSPLFLCLPLHLHGGKSPLKDLIKAQRSSLHRSPTSKFPSYPFRAFPKAILQSLKQPGRVRGTQCRSKTSNRSRDQEAMMLHKLVTCSRIMDIAKAFEDA

SEQ ID NO: 230243 - protein, 121 aa, Glycine max
  Coding DNA Sequence Number=SeqID_113465
MCWPCCYAPGWTVMNYSNATRTCRKRRRTWLESESKVWAAREREANKELEKELLISKKEVMEQHEKGFDKVVRQVEFFTKVLDLGDFDPFKDVKDDILLDEDNIASEEEVNKEEQGDDATI

SEQ ID NO: 230244 - protein, 227 aa, Glycine max
  Coding DNA Sequence Number=SeqID_113466
  Subcellular localization annotation: CTP_CleavageSite=57; ConfidenceScore=5.52e-01
MAPLFVVVAPLLRTSMVTTSASVAPPPYSSAPIVPPSTIVALTSTFSHPRVSLDHIYTSHDVDSLWETPRKVSFLEAEDAKWRATARTVWRVEHPKVAGAFVAFAEAVRLNHELSSKVGNVLAMLLRTRLDNDELFKCYKDLQEEKKNLAGRVEDLRQRRESKSKLWDARERETNKELEKELLISKKEVIEQHEKGFDKVVRQARFFTKEVNKEEQGVEEQGDDATI

SEQ ID NO: 230245 - protein, 97 aa, Glycine max
  Coding DNA Sequence Number=SeqID_113467
MPMLDQFHPCIHDFIENIVDVKADGMVEDSWSLVHNHLLKELAKWPNEYMNLVCGKDDVHSPLWFLFLQFSTNIFKGNETPESAPSRQPKILNLDPS

SEQ ID NO: 230246 - protein, 554 aa, Glycine max
  Coding DNA Sequence Number=SeqID_113468
MGNTPLLILSKIQSCPMSGWTWLRWAQRSRTSDDEWPLLRVHEGGLVKQRTSTLNGCYGNEGHKLVKALSMDKCCSVLRVVALTSVVRVASVKLSGVDTLFDARGSKRIGLELLKKVLRRVQHMHVVLTSYIRVTHGMTHIGDMVHGVVSIGGSSSEETRHGAFDSKSASSKSVTVLCRAGGGTSHLRGRVQPSTTSPVWELVLVTMILPLVVAGTLRRSLVCNVAIVLGCPRPPCRCRDDFPFLRATSGNSPFFFMYMCMFKVLSQVLSWITFQHALLEHLNMAPSQLHPNSWAMVKAFEILCPFFNIRPSVSDHFSKIPAIVIVTDGLPLTFNREGEPYFSFYWKFDPTRFKSFDEDLLTLVEKRRGQLTVEVGLASEVVEVFPNIPSSLLAKRKRDDGAGTSALAFAIVPSPPPPPTVVVKEVAPTAKVSAPATFASLVVAPSSTVTAPLFSANFLTTSALEMWPPSFFGPLTMTPRGSEQGGVLRGEDWQVEGQTINYLPRLVVFLPSCCAPGWMDKLAKVVVDLKARLKESESRMEDSELWASKEREAN

SEQ ID NO: 230247 - protein, 257 aa, Glycine max
  Coding DNA Sequence Number=SeqID_113469
  Subcellular localization annotation: CTP_CleavageSite=72; ConfidenceScore=5.18e-01
MAKIKEEATKLQPSRRYNTKDNCLPGHSTTGLSNPRSALGEPCSPKGSSSPRSTLSEPRFSKAQKNRSSNPRSALGESRSSKGSSNARSALRESQRLVIPKARKIPSPPLVSLTPQKACQTQGPYLASVTSSSNLSFALGESCSSYPRSTLGESHRLIKPKAQKTQGLSLVSLTGSSNPRPALGESHFSKGLSNPRFTLSESHFSKVSSNPMPALGESHITKGSLNQRSTLGTPQTQGLPLVWTLQNQRRALGKLTH

SEQ ID NO: 230248 - protein, 152 aa, Glycine max
  Coding DNA Sequence Number=SeqID_113470
MIRMFKMFKMFKNQESRFKVQASKNQDQDSRIKRRLNQDKYEKGTSFVVQVEGTSTRFKENKGGYIPCESLLVKGFLQGWKKKSQGPQDLNQKIASLAREKGNKHNESRKVSARILMILFVELMVLNKLEECWLHLQIHYIGECWPCNGVEV

SEQ ID NO: 230249 - protein, 128 aa, Glycine max
  Coding DNA Sequence Number=SeqID_113471
MQLFKEKNKMVQIFNNIIQLKKGAKDIIIIQGNQCPNWRIIQQFIQSENSELSSMLQDGESGKETASLDDSLEMIIRGGAGAGGGDNISSSREGGGSTTRGCGLAGIGSVLASLGLGGTTSWDLSNGS

SEQ ID NO: 230250 - protein, 259 aa, Glycine max
  Coding DNA Sequence Number=SeqID_113472
  Gene Ontology: Mol. function=RNA-directed DNA polymerase activity; Cellular component=extracellular region; Biological process=RNA -dependent DNA replication
MDEVADALYKGSGSDGTPALLYLQFWDIVGAEVTRLALEILNGNKDPSGINKTHIVLIPKLKLVLPELIDETQAVFVHDCQITGNAIANACPNEISDLKVCVSKVSFSVMINGQPQKDFEPQRGLRQRDPPSPYLFILCSETLSALINRAIERKHLHGILSLANILKTYEVAPGHKGLPTIIGRSKSQVFQFVKNKVWKKLKGWKEKFFSPAGRGLAVVQAIPSYVMECFRLLNSVCNQIEALTVKFFWSGNVDEREIH

SEQ ID NO: 230251 - protein, 334 aa, Glycine max
  Coding DNA Sequence Number=SeqID_113473
  Gene Ontology: Mol. function=aminoacyl-tRNA ligase activity; Cellular component=mitochondrion; Biological process=tRNA aminoacylation for protein translation
  Homolog annotation: Hit_ID=P93736; Match level="QueryCoverage=99%, HitCoverage=35%, E-value=1e-124, Identity=58%"; Hit description =Valyl-tRNA synthetase
  Pfam annotation: Domain name=Anticodon_1; Domain location=151-269; Score=55.3; E_value=2e-13; Accession=PF08264.3; Description =Anticodon-binding domain
MVMQGLKLGGDVPFTKIYLHPMVRDAHGRKMSKSLGNVVDPIEVINGISLEGLHKRLEAGNLDPKELAIAIEGQKKDFPNGIDECGVDALRFALVSYTAQSDKINLDIQRVVGYRQWCNKLWNAVRFAMSKLGDDYIPPANLIPDVLPFSCKWILSVLNKTIFKTVKSLESFEFSQATTAVYSWWQYQLCDVFIEVIKPYFTELWQRLPSTRECERAESIMICDYPSTVEGWNNEKVENDMDIIESTVKSLRSLAKESCDSHQLDIATLANLSSLTVITEKDAVSSGYADAVVNENLSVYLEFQGANSAEAEGKIKKIDELQKQIERLEKMMNA

SEQ ID NO: 230252 - protein, 570 aa, Glycine max
  Coding DNA Sequence Number=SeqID_113474
  Gene Ontology: Mol. function=oxidoreductase activity, acting on CH-OH group of donors; Cellular component=membrane; Biological process =alcohol metabolic process
  Homolog annotation: Hit_ID=Q9FJ99; Match level="QueryCoverage=91%, HitCoverage=90%, E-value=1e-169, Identity=55%"; Hit description =Mandelonitrile lyase-like protein
  Pfam annotation: Domain name=GMC_oxred_C; Domain location=402-556; Score=88.2; E_value=2.4e-23; Accession=PF05199.4; Description=GMC oxidoreductase
  Pfam annotation: Domain name=GMC_oxred_N; Domain location=46-334; Score=55.5; E_value=1.8e-13; Accession=PF00732.10; Description=GMC oxidoreductase
  Pfam module annotation: Pfam domain module=GMC_oxred_C::GMC_oxred_N; Domain location=402-556::46-334
MSWVYEQFICAFLVGCTFLSVLSHPDKAPKYTFLREAASAPQILTYDYIVIGGGTCGCPLAATLSQGATVLVLERGGSPYTNPEQININNFVNSLADISPSSFSQPFISRDGVLNSRARALGGGSVLNAGFYSRASSKYIVDSGWNETLAKDSYQWVEKKVAFEPPMLQWQSAVKDGLLEVGVLPYNGFTFDHLYGTKVGGTIFDKEGNRHTAADLLEYADPKRISVYLHATVQKILFKYNTEKRRQQAYGVIFKDALGVMHRAYLSTKGKSEIILSAGAIGSPQLLMLSGIGPANHLQAHGIKVVLDQPLVGQGMADNPLNVLLVPSPVPVEVSLVQTVGITKFGSFIEAASGLSLGHSWSERLQGIFEFVSNQSGQPSMFPPVADTIRSLANPILKGGVLLEKIIGPRSTGHLELINTNPNDNPSVTFNYFKDPEDLRKCVEGMRTIIDVINSKAFSKFRYHNMPVQSLIDLMLHLPVNLRPKHANAAFSLEQYCIDTVLTIWHYHGGCQSGKVVDHNYKVIGVEALRVIDGSTFHRSPGTNPQATVMMLGRYMGEKIIKKRFFHGRK

SEQ ID NO: 230253 - protein, 206 aa, Glycine max
  Coding DNA Sequence Number=SeqID_113475
  Gene Ontology: Mol. function=pyridoxal phosphate binding
  Homolog annotation: Hit_ID=Q9FGL6; Match level="QueryCoverage=78%, HitCoverage=29%, E-value=2e-34, Identity=52%"; Hit description =Arabidopsis thaliana genomic DNA, chromosome 5, P1 clone:MJM18
  Subcellular localization annotation: CTP_CleavageSite=4; ConfidenceScore=5.46e-01
MQYLGQNEASLACPHGCCPTSLLFNPPPPPPLQTQNTTTKPRNSSAECRHSFAATTASSIFPNTKFTNHESLPSLHESFSEFKKVYPQYSETDQVDHVRDKEYYHLSFSNQSCLDYIGIGLFSYYQRQHHHDTSKTQLASSSTPPSPPQYSDNIPFFSISYKTGNLKTLLLHGGQESEFESAMRRRIMNKQNLSFQACGRLISIPI

SEQ ID NO: 230254 - protein, 172 aa, Glycine max
  Coding DNA Sequence Number=SeqID_113476
  Gene Ontology: Mol. function=nucleic acid binding; Biological process= DNA integration
MSRLHCMQLLRKLASFFVRARSRQMAWSLAAIFLINCIALSGVYNLIFPPTEALNPWVGVFQSKPWKWSRASLNDSSGNLWNEEISIFPSAVLDSGKHFSKNFSTTSSHVYKLFLLNEYNHLFASPAKEKENRLRGMASSGTPAIFTLLQISMYVARWAYGSSLGSPWKRLP

SEQ ID NO: 230255 - protein, 148 aa, Glycine max
  Coding DNA Sequence Number=SeqID_113477
  Gene Ontology: Mol. function=endopeptidase inhibitor activity
  Homolog annotation: Hit_ID=Q1SMC6; Match level="QueryCoverage=98%, HitCoverage=76%, E-value=1e-31, Identity=44%"; Hit description =Calcium-binding EF-hand; Kunitz inhibitor ST1-like
  Pfam annotation: Domain name=Kunitz_legume; Domain location=5-147; Score=28.7; E_value=3.2e-07; Accession=PF00197.9; Description =Trypsin and protease inhibitor
MPYTSCRSPQGLGLSKIGNSCHFDVLFVDINHRMPLSIYTDLNIMFLACNITCPHHSTMWKIDNFNVSKGHGLVTTGGGVGNSGKETIGNWFNIVKYDGAYNYKIAYCLSMCPSCKHECKNVGMVMDQNGNQCLALSDVPFQFRFFKA

SEQ ID NO: 230256 - protein, 201 aa, Glycine max
  Coding DNA Sequence Number=SeqID_113478
MYDEFYGELQWRQWHGRITRLPEKQIDVALVKEFYFNIYDLEDGSPKQCRAIVTKLCTPRGRLMLTADGAPWKILRKDRTTLAQTWSVISYFNLSSTSHTLDLNMDRSSTSRVGFPALITALCDTQGVYSYTLTYEPLSPVINLAYIKKNYWNPTDSSIAFPGARRVHARATQDAPPPAPPLVIPPPVASSSVSPSSSSSQ

SEQ ID NO: 230257 - protein, 339 aa, Glycine max
  Coding DNA Sequence Number=SeqID_113479
  Gene Ontology: Mol. function=metal ion binding; Cellular component =intracellular; Biological process=metabolic process
  Homolog annotation: Hit_ID=Q1S7U1; Match level="QueryCoverage=95%, HitCoverage=72%, E-value=4e-50, Identity=28%"; Hit description =Tetratricopeptide-like helical
  Pfam annotation: Domain name=PPR; Domain location=175-209; Score =30.1; E_value=7.8e-06; Accession=PF01535.11; Description=PPR repeat
  Pfam annotation: Domain name=PPR; Domain location=273-307; Score =37.2; E_value=5.6e-08; Accession=PF01535.11; Description=PPR repeat
  Pfam annotation: Domain name=PPR; Domain location=74-108; Score=9.5; E_value=0.56; Accession=PF01535.11; Description=PPR repeat
  Pfam module annotation: Pfam domain module=PPR::PPR::PPR; Domain location=175-209::273-307::74-108
MDKAGQSLKWVLLDLIHKCNDLRSFKQIHAHLLTSSLIANDLVTKAANFLGKHVTDVHYPCKILKQFDWILSSFPCNMLISGYASGQLPWLAILIYRWTARNGFVPDVYTVPAVLKSCGKFSGIGEARQFHSVAVKTGLWCDIYVQNNLVHVYSICGDTVGAGKVFDDMLVRDVVSWTGLISGYVKAGLFNDAIWLFFRMDVEPNVATVVSILGACGKLGRSSLGKGIHGLVLKCLYGEDLVVCNAVLDMYMKCESVTDARKMFDEIPVKNIISWTSMIGGLVQCQCPRESLDLFNQMQCSGFEPDGVILTSVLSACASLGLLDDGRWVHEYIDRRRIK

SEQ ID NO: 230258 - protein, 86 aa, Glycine max
  Coding DNA Sequence Number=SeqID_113480
  Homolog annotation: Hit_ID=Q1SEQ4; Match level="QueryCoverage=93%, HitCoverage=8%, E-value=5e-15, Identity=44%"; Hit description=SBP
MGWLFHRSHLKVKLGSMTPFHDLFQFNLLTWLLDFSIDNGWCGVMKKLLDIIFEGGVEARKHASIELPLFNMGLLHRAIKRTIGLW

SEQ ID NO: 230259 - protein, 220 aa, Glycine max
  Coding DNA Sequence Number=SeqID_113481
  Gene Ontology: Mol. function=methyltransferase activity; Cellular component=intracellular; Biological process=protein kinase C activation
  Homolog annotation: Hit_ID=Q6ZI32; Match level="QueryCoverage=71%, HitCoverage=35%, E-value=2e-30, Identity=35%"; Hit description =Putative pentatricopeptide (PPR) repeat-containing protein
  Pfam annotation: Domain name=PPR; Domain location=100-134; Score=3.9; E_value=2.6; Accession=PF01535.11; Description=PPR repeat
  Pfam annotation: Domain name=PPR; Domain location=15-49; Score=28.8; E_value=2e-05; Accession=PF01535.11; Description=PPR repeat
  Pfam annotation: Domain name=PPR; Domain location=50-84; Score=14.4; E_value=0.15; Accession=PF01535.11; Description=PPR repeat
  Pfam module annotation: Pfam domain module=PPR::PPR::PPR; Domain location=100-134::15-49::50-84
MAQRIFNGMLFKNIRTWNAYIGGLAINGYGKEALKRFEDLVESGARPNEVTFLAVYTACCHNGLVDEGRKYFNEMTSPHYNLSPCLEHYGCMNVEFQDSGIYVLLSNLYATNKKWAEVRSIRRLMKQKGISKAPGSSIISVDGMSHEFLVGDISHPQTIQEQGGYVVAFYRVQRGILSCICETVTTFHVYDCEGLVNGHLNLDESSYCASSSDIETETEK

SEQ ID NO: 230260 - protein, 326 aa, Glycine max
  Coding DNA Sequence Number=SeqID_113482
  Gene Ontology: Mol. function=catalytic activity; Cellular component =nucleus; Biological process=regulation of transcription
  Homolog annotation: Hit_ID=Q9LT89; Match level="QueryCoverage=81%, HitCoverage=81%, E-value=4e-58, Identity=52%"; Hit description =Similarity to DNA binding protein PCF1
  Pfam annotation: Domain name=TCP; Domain location=56-254; Score =153.4; E_value=5.9e-43; Accession=PF03634.4; Description=TCP family transcription factor
MEANPTHDGDDTSETPPPPMVDPSPSPPPQMKEEVMDAEQGGDTSLPMTVVPAHLPVSKAAAKRPSKDRHTKVEGRGRRIRMPATCAARIFQLTRELGHKSDGETIRWLLEHAEPAIIEATGTGTIPAIAVSVGGTLKIPTSSAARPEGEVDTPKKRRRRASNSEFIDVNENQVSVSSGLAPIAQSAYGSGVGGGLVPLWHGNAAASGPFFMFPNASNPPQYWAIPATAAPFFNVQARPISGFVSALQMQHDNHHSLNGAASDSVNSSSTVGSTMSTVTVTTSSGSGSASGSSAATTTQMLRDFSLEIYDKKELQFLGQPPPSSKP

SEQ ID NO: 230261 - protein, 94 aa, Glycine max
  Coding DNA Sequence Number=SeqID_113483
  Gene Ontology: Mol. function=structural molecule activity; Cellular component=protein complex; Biological process=microtubule-based movement
  Homolog annotation: Hit_ID=Q9M406; Match level="QueryCoverage=74%, HitCoverage=32%, E-value=2e-23, Identity=58%"; Hit description=Alpha- tubulin 4
MVATRTLTSLGTTSPRYIKQQPMYLPCLGSHLAIILAGSNMTFVIYGTDNCSWLEWNLVISTLIPPSNLKEVSLLSLETSAVVYEFSEAIQAHI

SEQ ID NO: 230262 - protein, 124 aa, Glycine max
  Coding DNA Sequence Number=SeqID_113484
  Gene Ontology: Mol. function=oxidoreductase activity; Cellular component=vacuole; Biological process=hydrogen peroxide catabolic process
  Homolog annotation: Hit_ID=Q9LT91; Match level="QueryCoverage=50%, HitCoverage=19%, E-value=2e-21, Identity=76%"; Hit description =Peroxidase 66 precursor
MEDSVVVWDTGMDGAESDRFCVNERERELGSREVVHVLYGGPKRIGGESEVVRGSRCDASIGCDASILRDSTATNQAEKDGPPNMSVRSFYVIDEAEAKLELVCPRTVSCVDIIAISARDVVAM

SEQ ID NO: 230263 - protein, 39 aa, Glycine max
  Coding DNA Sequence Number=SeqID_113485
MFPGLEGFPNHTENATDVQDGMDRLSKLLDSISSVHNEA

SEQ ID NO: 230264 - protein, 39 aa, Glycine max
  Coding DNA Sequence Number=SeqID_113486
MWSGLDMVCALGLVDHLASMTVEEREAFRMGNASCGGGG

SEQ ID NO: 230265 - protein, 1104 aa, Glycine max
  Coding DNA Sequence Number=SeqID_113487
  Gene Ontology: Mol. function=protein binding; Cellular component =integral to membrane; Biological process=protein amino acid phosphorylation
  Homolog annotation: Hit_ID=Q1SLU2; Match level="QueryCoverage=99%, HitCoverage=100%, E-value=0.0, Identity=50%"; Hit description =Leucine-rich repeat, plant specific
  Pfam annotation: Domain name=LRRNT_2; Domain location=31-73; Score =24.5; E_value=0.00037; Accession=PF08263.3; Description=Leucine rich repeat N-terminal domain
  Pfam annotation: Domain name=LRR_1; Domain location=102-124; Score =13.0; E_value=1; Accession=PF00560.23; Description=Leucine Rich Repeat
  Pfam annotation: Domain name=LRR_1; Domain location=126-148; Score =13.8; E_value=0.64; Accession=PF00560.23; Description=Leucine Rich Repeat
  Pfam annotation: Domain name=LRR_1; Domain location=208-230; Score =14.2; E_value=0.48; Accession=PF00560.23; Description=Leucine Rich Repeat
  Pfam annotation: Domain name=LRR_1; Domain location=232-254; Score =9.9; E_value=4.1; Accession=PF00560.23; Description=Leucine Rich Repeat
  Pfam annotation: Domain name=LRR_1; Domain location=256-279; Score =9.7; E_value=4.4; Accession=PF00560.23; Description=Leucine Rich Repeat
  Pfam annotation: Domain name=LRR_1; Domain location=280-302; Score =8.5; E_value=7.3; Accession=PF00560.23; Description=Leucine Rich Repeat
  Pfam annotation: Domain name=LRR_1; Domain location=304-326; Score =11.0; E_value=2.5; Accession=PF00560.23; Description=Leucine Rich Repeat
  Pfam annotation: Domain name=LRR_1; Domain location=328-350; Score =12.3; E_value=1.4; Accession=PF00560.23; Description=Leucine Rich Repeat
  Pfam annotation: Domain name=LRR_1; Domain location=352-373; Score =15.3; E_value=0.22; Accession=PF00560.23; Description=Leucine Rich Repeat
  Pfam annotation: Domain name=LRR_1; Domain location=375-398; Score =18.9; E_value=0.019; Accession=PF00560.23; Description=Leucine Rich Repeat
  Pfam annotation: Domain name=LRR_1; Domain location=400-422; Score =8.7; E_value=6.7; Accession=PF00560.23; Description=Leucine Rich Repeat
  Pfam annotation: Domain name=LRR_1; Domain location=424-447; Score =2.0; E_value=1.2e+02; Accession=PF00560.23; Description=Leucine Rich Repeat
  Pfam annotation: Domain name=LRR_1; Domain location=448-470; Score =10.5; E_value=3.1; Accession=PF00560.23; Description=Leucine Rich Repeat
  Pfam annotation: Domain name=LRR_1; Domain location=472-495; Score =1.3; E_value=1.6e+02; Accession=PF00560.23; Description=Leucine Rich Repeat
  Pfam annotation: Domain name=LRR_1; Domain location=497-520; Score =4.5; E_value=41; Accession=PF00560.23; Description=Leucine Rich Repeat
  Pfam annotation: Domain name=LRR_1; Domain location=525-545; Score =5.6; E_value=25; Accession=PF00560.23; Description=Leucine Rich Repeat
  Pfam annotation: Domain name=LRR_1; Domain location=548-570; Score =10.1; E_value=3.6; Accession=PF00560.23; Description=Leucine Rich Repeat
  Pfam annotation: Domain name=LRR_1; Domain location=572-593; Score =10.2; E_value=3.5; Accession=PF00560.23; Description=Leucine Rich Repeat
  Pfam annotation: Domain name=LRR_1; Domain location=596-617; Score =10.4; E_value=3.3; Accession=PF00560.23; Description=Leucine Rich Repeat
  Pfam annotation: Domain name=LRR_1; Domain location=642-664; Score =9.9; E_value=3.9; Accession=PF00560.23; Description=Leucine Rich Repeat
  Pfam annotation: Domain name=LRR_1; Domain location=666-688; Score =16.5; E_value=0.099; Accession=PF00560.23; Description=Leucine Rich Repeat
  Pfam annotation: Domain name=LRR_1; Domain location=691-713; Score =12.0; E_value=1.6; Accession=PF00560.23; Description=Leucine Rich Repeat
  Pfam annotation: Domain name=LRR_1; Domain location=715-737; Score =17.3; E_value=0.054; Accession=PF00560.23; Description=Leucine Rich Repeat
  Pfam annotation: Domain name=LRR_1; Domain location=739-761; Score =10.1; E_value=3.7; Accession=PF00560.23; Description=Leucine Rich Repeat
  Pfam annotation: Domain name=LRR_1; Domain location=763-784; Score =3.2; E_value=72; Accession=PF00560.23; Description=Leucine Rich Repeat
  Pfam annotation: Domain name=LRR_1; Domain location=789-811; Score =5.8; E_value=23; Accession=PF00560.23; Description=Leucine Rich Repeat
  Pfam annotation: Domain name=LRR_1; Domain location=903-925; Score =7.9; E_value=9.4; Accession=PF00560.23; Description=Leucine Rich Repeat
  Pfam annotation: Domain name=LRR_1; Domain location=927-949; Score =9.5; E_value=4.8; Accession=PF00560.23; Description=Leucine Rich Repeat
  Pfam annotation: Domain name=LRR_1; Domain location=951-973; Score =19.6; E_value=0.012; Accession=PF00560.23; Description=Leucine Rich Repeat
  Pfam annotation: Domain name=LRR_1; Domain location=975-994; Score =10.6; E_value=2.9; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1; Domain location=31-73::102-124::126-148::208 -230::232-254::256-279::280-302::304-326::328-350::352-373::375 -398::400-422::424-447::...
  Pfam module annotation: Domain location=448-470::472-495::497 -520::525-545::548-570::572-593::596-617::642-664::666-688::691 -713::715-737::739-761::763-784::789-811::903-925::927-949::951 -973::975-994
MRAYKLLWLFLIQFCLINYSANIFPANGYFLGHQCSVVLHLKNSLIFNSTKSKKLTLWNQTEDCCQWHGVTCNEGRVIALDLSEESISGGLVNSSSLFSLQYLQSLNLAFNNLSSVIPSELYKLNNLSYLNLSNAGFEGQIPDEIFHLRRLVTLDLSSSFTSSHRLKLEKPDIAVFQNLTDITELYLDGVAISAKGQEWGHALSSSQKLRVLSMSSCNLSGPIDSSLAKLLPLTVLKLSHNNMSSAVPESFVNFSNLVTLELRSCGLNGSFPKDIFQISTLKVLDISDNQDLGGSLPNFPQHGSLHHMNLSYTNFSGKLPGAISNMKQLSTIDLAYCQFNGTLPSSFSELSQLVYLDLSSNNFTGPLPSFNLSKNLTYLSLFHNHLSGVLPSSHFEGLKKLVSIDLGFNFFGGSLPLSLLKLPYLREIKLPFNQFNGSLDEFVIASPVLEMLDLGSNNLHGPIPLSIFNLRTLGVIQLKSNKFNGTIQLDMIRRLSNLTTFCLSHNNLSVDIYTRDGQDLSPFPALRNLMLASCKLRGIPSFLRNQSSLLYVDLADNEIEGPIPYWIWQLEYLVHLNLSKNFLTKLEGSVWNFSSNLLNVDLSSNQLQGPFPFIPTFVNYLDYSNNRFNSVIPLDIGNRLPFVIWLSLSNNSFQGGIHKSFCNASSLRLLDLSQNNFVGTIPKCFSKLSITLRVLKLGGNKLQGYIPNTLPTSCTLKLLDLNDNFLEGTIPKSLANCQKLQVLNLRRNMLNDKFPCFLSNISTLRIMDLRLNKLHGSIGCLRSSGDWEMLHIVDVASNNFSGAIPGALLNSWKAMMRDNVRPEFGHLFMDIIEGYDPKNFKDLLAHLDKNIVAKLVKLVTNISRSILDQGSSDSYAVDLSRYQNSILITNKGQQMQLDRIQRAFTYVDMSSNNFEGPIPNELMQFTAMIGLNLSNNALSGHIPQSIGNLKNLESLDLSNNSFNGEIPTELASLSFLEYLNLSYNHLAGEIPTGTQIQSFDADSFEGNEELCGSPLTHNCSNDGVPTPETPHSHTESSIDWNLLSIELGFIFGFGIFILPLILWRRWRLWYSKHVEEMLHRIIPHLDFVYEHQGGHSYRTLWWRY

SEQ ID NO: 230266 - protein, 67 aa, Glycine max
  Coding DNA Sequence Number=SeqID_113488
MAEINQGKTMTGHDWSYIIWLLRAVEGLNEKALGLGCILKQWGMPHCPHSLAIYVQTCAHQVLGEMP

SEQ ID NO: 230267 - protein, 79 aa, Glycine max
  Coding DNA Sequence Number=SeqID_113489
  Subcellular localization annotation: CTP_CleavageSite=61; ConfidenceScore=5.52e-01
MPTSSRRLGDSSPESYSLHPATVILLPRTRMMHAPDSTLRRNVVRTNNNQTSGNSLSMSTRHSHLGNCAEFVETTRLCT

SEQ ID NO: 230268 - protein, 124 aa, Glycine max
  Coding DNA Sequence Number=SeqID_113490
  Homolog annotation: Hit_ID=Q47522; Match level="QueryCoverage=38%, HitCoverage=59%, E-value=2e-22, Identity=100%"; Hit description=LacZ protein
MRKEKIPHQAPFAIQAAQLLGRAIGAGLFAITPAGERGMCCKAIKLGNARVFPVTTLLLPIAVTFCAFMSQGNFNGGLSKSALDRQPKLLNPRSLVRLNIQPSSVDPSCKTAPDLDNLLRFRLT

SEQ ID NO: 230269 - protein, 89 aa, Glycine max
  Coding DNA Sequence Number=SeqID_113491
  Gene Ontology: Mol. function=transferase activity, transferring glycosyl groups; Cellular component=chloroplast; Biological process =biosynthetic process
  Homolog annotation: Hit_ID=Q6DW76; Match level="QueryCoverage=93%, HitCoverage=14%, E-value=1e-23, Identity=52%"; Hit description =Digalactosyldiacylglycerol synthase 1, chloroplast precursor
MTGIAVSPLFRAAYSSQATKQKLTLLVPWLCKSNEELAYPTNLNFTLPEELVEYNTWWRDCCQFIPSRDVGIAILEEPEHLKWYPTKLG

SEQ ID NO: 230270 - protein, 102 aa, Glycine max
  Coding DNA Sequence Number=SeqID_113492
MVCHDHADMTGRLLAGSFTFECHIMHCILCRILLPRSINLAQASEEDLILLWALQTGRQIDWAHLWVHKQDLPPPIPSEHTPSPPPQRDTSSSLLTDVLTEL

SEQ ID NO: 230271 - protein, 89 aa, Glycine max
  Coding DNA Sequence Number=SeqID_113493
  Gene Ontology: Mol. function=oxidoreductase activity, acting on paired donors, with incorporation or reduction of molecular oxygen, 2-oxoglutarate as one donor, and incorporation of one atom each of oxygen into both ...
  Gene Ontology: Mol. function=donors; Biological process=protein metabolic process
  Homolog annotation: Hit_ID=Q9LT92; Match level="QueryCoverage=98%, HitCoverage=39%, E-value=9e-17, Identity=49%"; Hit description =Arabidopsis thaliana genomic DNA, chromosome 5, P1 clone:MJM18
VGQRFGRHFDASVDLGDGKRTYYTLLVYLSGGPGELKSKPKNDSSNPSVSSVDPLVGGETVAPTEGTALLHLHGDKCFLHEARNVTKGV

SEQ ID NO: 230272 - protein, 269 aa, Glycine max
  Coding DNA Sequence Number=SeqID_113494
MLVFPINRRGGRLIKGLEGPEGQELREERKKKKKEEETRPNRDRDHSLLCFLFGVLRATTDSPLAFRPHSCQRVGCDNSQDEATTSPSSSESEEAKEEESSEEIYPQEEGQPLMVKDECKEVSVSSKRLAKKESHFALKTNIKETSPLRQPPHLRLCKKTLVSTATPVGLGVIPQVKELLDKSLVCKSLNPYALLVPKIVIPRVTMNPKRIKVILEWSTPPSIKKIWGFHGLRNFYKRFIPYFSILVAPLIELVRNHVLSWEDAQERGF

SEQ ID NO: 230273 - protein, 224 aa, Glycine max
  Coding DNA Sequence Number=SeqID_113495
MMTKVMTKSSKVNQRMSSRCSRRNQEQFKIKAQEEKLKNTSRFKKKDEFKIQIQGSSFKNQDQDSRFKIQESREDLIKISMKKIFQKLSSTWSFTKHVYQRVFTLCRGYIYLGLTENKRGYISCGSVLVEGTSTRVSKRNKGGLFEDHDEDQVNLCLMTKSDENNKEDSVLCNRYTKTQSYMQCGTMLVKNLVERLGEHDKTDHTLDQHMLKGALNPGVFTSKA

SEQ ID NO: 230274 - protein, 90 aa, Glycine max
  Coding DNA Sequence Number=SeqID_113496
  Subcellular localization annotation: CTP_CleavageSite=60; ConfidenceScore=5.58e-01
MSVKNLVGCLGVHDKTNHTLVSQVTLTSFNSSSKKGLNINSSPLKGLNINSLPKKRLNINSSPLKGLSINSSPLKGLSINSSPLKGLIVV

SEQ ID NO: 230275 - protein, 173 aa, Glycine max
  Coding DNA Sequence Number=SeqID_113497
MGEIKKVQEWMKANMEAMKEQMATMMEAMMSIKKILEVNAAAVTATNAVAEGGKELGSTGGPHFVQVQNKHAFLPYGLPPNYMPPNVAHTPDEIVNNSATIPVESQQLQADHAHVFQPMGETHEIPHHNLANFEPRLEYATKGQTVGGVPLPNTLEGPQFRPQPQPLHFVTGK

SEQ ID NO: 230276 - protein, 269 aa, Glycine max
  Coding DNA Sequence Number=SeqID_113498
MGEIKKVQEWMKANMEAMKEQMATMMEAMMSIKKILEVNAAAVTATNAVAEGGKELGSTGGPHFVQVQNKHAFLPYGLPPNYMPPNVAHTPDEIVNNSATIPVESQQLQADHAHVFQPMGETHEIPHHNLANFEPRLEYATKGQTVGGVPLPNTLEGPQFRPQPQPLHFVTGKVPPTMAEKGKLDHIKERLRAIEGGGDHAFADMAELCLVPDVVIPSKFKVSDFDKYKGTTCPKNHLKMCYRKMGGYAKDEKLLMHFFQESLTGAAVT

SEQ ID NO: 230277 - protein, 366 aa, Glycine max
  Coding DNA Sequence Number=SeqID_113499
  Gene Ontology: Mol. function=RNA-directed DNA polymerase activity; Biological process=RNA-dependent DNA replication
  Homolog annotation: Hit_ID=Q1S4Z4; Match level="QueryCoverage=100%, HitCoverage=66%, E-value=1e-19, Identity=30%"; Hit description=RNA -directed DNA polymerase
MMFVVEFHRHGVLPRGINSSFIALISKRDNPQNLGHYIPIWWVVYTKSLLANRMSKVLDKVIDPCQRAFIRGRQLLHSALVANEVTTHVSPLRVVAEDLSGLMREVKAKNLYGEYKKSCFGDLGVDERMVERYADLLNLKMFNLPFIYVGLPIGASHRRKGTGKPIIQKFSKKLALWKHKQVSFGGRNLVAIQRKSNGVVGCGGGICFTKRIVYGKMYSTQNMRGEKGVGTSIGLMKGVGEGDQCRFWKNEWLNGKSLANLFPRLYLISVQKKDLVGEVGFWRERWCGDLKWRRDTFVWEMALIDDSQSLLGVVQVKRNSSDSWRWSNISGTYSTSSAYKILIKEAEVEMDKDFYTLMWQLKIPNK

SEQ ID NO: 230278 - protein, 92 aa, Glycine max
  Coding DNA Sequence Number=SeqID_113500
  Subcellular localization annotation: CTP_CleavageSite=45; ConfidenceScore=5.38e-01
MSSKGDNAFIYFLKTKMSSKGDNVFIYFSKMTMSSKAELSCLMPVAAQSVRFFDVSEENAEITQKGGQKCHFTPFQTPGSPRLASGSPGPPK

SEQ ID NO: 230279 - protein, 67 aa, Glycine max
  Coding DNA Sequence Number=SeqID_113501
MTKEEGHEMRDFDNHCHNQSHWPACPPVQIRLAMLDWSSDGSFVGAPPLEGEGKGEGKDEDGHHTHL

SEQ ID NO: 230280 - protein, 101 aa, Glycine max
  Coding DNA Sequence Number=SeqID_113502
MDAVNSTGEKRVSPLSMARSMLTWLREEGAAIVLGETVDVDVVSLLPLVRSMLSRCSQWREAFHVSNAAIASCETPSRHACHSSEDGSVGLQCLGLGFVVF

SEQ ID NO: 230281 - protein, 220 aa, Glycine max
  Coding DNA Sequence Number=SeqID_113503
  Subcellular localization annotation: CTP_CleavageSite=48; ConfidenceScore=5.79e-01
MSSPASIAAAMKALRASSGFFLPASTAAQTSSALSSASPSSTGQSSIRAQEAAWDGFLPARVHRSSMLVSRPALNEAGGMRNPFRSRPVRSVVASEQPFAKDAPVSTALVLLSMRNSWVKGAGPAVVHPASASERAIAADDASVFILSSEVHLQKRYGGAEVPGSGGCGTKEKIDEEAKDEKRDEVRKTGHMILVSPSRYGGLSGEAETRQGVAHMVVGH

SEQ ID NO: 230282 - protein, 367 aa, Glycine max
  Coding DNA Sequence Number=SeqID_113504
MASGKRRASTFRPQEPYDTSRFVSEVAWERYEQNIHARNILPERNVELQVTQYDEFRQELERCRWHRVLTRQLDNHIDVALVKELYANVFDPEEKSPRQCRVWGKLIKFDVVILNEFLETPVDLTTLAQTWSVLSYSNLAPTSHTSDLNMDRARLVYALVMKMDMDVSYIISRQISQMAQSNSSRLRFPALITALCIARGVVPDSLTFESLSPTINLAYFRKNCWNPKDPMIKFPGSRKARAQGPSDTSTFAPAPTLAPAPAPVPPPAPSSPSTSSIDVIVLMLQSLYHGLCLVMQSETPTAQQSQPEAEAEETSDDTPAATPIEVTDEDGAVETSVDTDYVADDTLMPAQDAPTTPHDDPAPAQDD

SEQ ID NO: 230283 - protein, 105 aa, Glycine max
  Coding DNA Sequence Number=SeqID_113505
HAKPHSYDPWPLDHWGRETGGPRRSETGKADSPYKKKLRTYLGIVAHDKVDVTYETSKEVPATQKDLIWEDIQFKSDLTRKWALAADKDNVDDAVCEKYDISKEK

SEQ ID NO: 230284 - protein, 42 aa, Glycine max
  Coding DNA Sequence Number=SeqID_113506
MIKASRVRPIPENAMRCWEMVEVGPVYYSSPCAYFALGGWFT

SEQ ID NO: 230285 - protein, 44 aa, Glycine max
  Coding DNA Sequence Number=SeqID_113507
MGFSGNILVLLQRAEGQKHSYLLKDVKIAYLGNLVDECVVEVNV

SEQ ID NO: 230286 - protein, 46 aa, Glycine max
  Coding DNA Sequence Number=SeqID_113508
MPHPGPKDNIALRPIPYAWGRVQQGRHIQPHAYGADLASNKDLQIQ

SEQ ID NO: 230287 - protein, 109 aa, Glycine max
  Coding DNA Sequence Number=SeqID_113509
MGYAHNRIGGGRQGNCCSLVNHLHKVMVMGCPLGDPFGSVRSHGYVAIISPHWENNLVPKVVRITQGVPILPCADESNFQSSRESGLMTRWLSKLAGGRLNGESSKGPW

SEQ ID NO: 230288 - protein, 419 aa, Glycine max
  Coding DNA Sequence Number=SeqID_113510
  Homolog annotation: Hit_ID=Q9KIJ9; Match level="QueryCoverage=99%, HitCoverage=42%, E-value=0.0, Identity=85%"; Hit description=SrfB
  Pfam annotation: Domain name=SrfB; Domain location=1-419; Score =118.9; E_value=1.4e-32; Accession=PF07520.2; Description=Virulence factor SrfB
MVNGRYTLPGINGGSPEVVKPETTIPLHQSLAVLDGVWLPVPFLRFNPPRTFVEGPDNWARVQVRKLDTPDTAGNTHRVTLALDSQIAGHATSALSPVENDILNGTRFALAWRDAEVENFLDQTWIDGWLREAFTQYADGVENRSERDLQQAMRSFEYQAHWLNLLTMLGEQLTVPEVKFVTHTLSTPAIPVDLILDVGNTHTCGVIIEDHGDANDGLRQTAELQVRSLSEPQFLNEPLFTSRLEFSEARFGKQHFSVESGREDAFVWPSIVRVGDEARKLAMQRLGTEGNSGISSPRRYLWDETPVVQDWRFSQMNSKTQREPLATAFPLMNLMNDDGEPLFTLPQDERLPVFSPQYSRSTLMTHMLCELLAQALGQINSVATRLRLGFPASPRQLRTLILTLPSAMPKQEREIFRRR

SEQ ID NO: 230289 - protein, 118 aa, Glycine max
  Coding DNA Sequence Number=SeqID_113511
MMQKNFFLDFKLLLSKIQSLFKQALGPHSTKYGIEEKFRTLGWGLTSNRNLTRHEPALSITTQCDTTGDYTSDRSHNNALCQSASTLGTVLLLPPPKVTMQHQLRICVYVRSTEMRER

SEQ ID NO: 230290 - protein, 163 aa, Glycine max
  Coding DNA Sequence Number=SeqID_113512
  Gene Ontology: Mol. function=RNA-directed DNA polymerase activity; Cellular component=chromatin; Biological process=DNA integration
MVSHTRTLQDFYDRIERLDSITLFCLFEDCELVDFEEVVQYKRWRNAMDEEIRSIKKNATLELVSLPKGRKAIGVKWVYKTKKNAKGEIERYKARLVVKGYSQKASSTQVENSLDGHEVCLLEWSPRGRSIHQATVEIQGERRRRQSSQDKEDTLWTKTSRSS

SEQ ID NO: 230291 - protein, 297 aa, Glycine max
  Coding DNA Sequence Number=SeqID_113513
  Gene Ontology: Mol. function=nucleic acid binding; Cellular component= chromatin; Biological process=DNA integration
  Homolog annotation: Hit_ID=Q1RWN2; Match level="QueryCoverage=98%, HitCoverage=24%, E-value=1e-85, Identity=50%"; Hit description =Peptidase S8 and S53, subtilisin, kexin, sedolisin; Integrase, catalytic region; Zinc finger, CCHC-type
  Pfam annotation: Domain name=rve; Domain location=185-297; Score =52.8; E_value=1.1e-12; Accession=PF00665.16; Description=Integrase core domain
MLLMACIDVTKANEEVVWFLDSGCSNHMCGKKEYFSDLDENYKDSVKLGNNSSMAVTGKDLRNNLLSIGQLQEKGLSILFQHGKCKVFHPENGLIMETRISSNRMFMLHAISQPTKSTCFHTVTEDIVHLWHCRYGHLSFRGLNTLYQQSMVYGLPTMKAPTKLCQDCLVGKQSRASFPKKSTWRATQVLQLIHADICGPITPISNSKKRYLLTFIDDFSRKTWIDFLTEKSEALSVFKKFKILVEKEADSLIRSLRTDRGGEFTSQDFTNFCCDNGIRRQLTAAYTPQQNGKIEPS

SEQ ID NO: 230292 - protein, 254 aa, Glycine max
  Coding DNA Sequence Number=SeqID_113514
MTGFIKKTVVISIEFKSPMSGPYALDLSNFRGRPPSTSLPSLGEELPQIAYALNYVPDSALSLSDRVESSSNQKVKVLSVLDTLPPIAAIRSSVMMERHGVRPEHGSVEHGGGLSRGKFRVEGNGKLSQKAVAQIVSRKHVPPSIGKDASMTYAVSIPFNGLQWIRAFHHNSLHGTIPNELTNCTELRALMDDTVVLTTRGDDGGLCNENYLELFMRDGCLPKTEIANPVTFAIAAECVHISECPVLVISGAKD

SEQ ID NO: 230293 - protein, 599 aa, Glycine max
  Coding DNA Sequence Number=SeqID_113515
  Gene Ontology: Mol. function=nucleic acid binding; Cellular component= beta-galactosidase complex; Biological process=DNA integration
SKAYKLYDPISQKIIISRDVVFDEDKSWDWDKQYEETILCDLDWGDKDVEAVVEEEHEVRHNTDTPEEDIIISSDSMAEVNTSSPVQRRCRRPPLWMEDYETGEGLSEGSTEANLTMSATGESDPTHFDAAVQIAKWRKAMDEEMEAINKNDTWELMELPDGAKKVGGYAQEYGVDYTEVFAPVARMETIRLVVALAAQKGWPIYQLDVKSAFLHGELDETVYVDQPCGYEQKGEEHKVYKLKKAFYGLKQAPRAWYSRIEAYFLKEGFEKCDYEHTLFVKREKEDIILIVSLYVDDLIFTGNDELMFAKFKSSMKHEFDMTDLGNMIYFLGLEVMQRIDGVFLCQKKYALEMLQRFGMDKSNSVQTPIVPGVKLTKDDTGVKVDKTYYKQIVGSLMYLTSTRPDMMFVVNLISRYMENPTELHLLAAKRVLRYLKGTTEFGIFYKKGGNKEFLAYTDSDYAGDLDDRKSTSGYVFLLCSAAVSWSSKKQPIVSLSITEAEFIGAASCACQAIWLKRVLGKLCKMQDQATVIRCDSSSAIKLSKNPVMHGRCKHIDVRFHFLRDLTKAGTIKMMHCGTQEQVADIMTKPLKLDTFLKLR

SEQ ID NO: 230294 - protein, 1113 aa, Glycine max
  Coding DNA Sequence Number=SeqID_113516
  Gene Ontology: Mol. function=protein binding; Cellular component =integral to membrane; Biological process=defense response to fungus
  Homolog annotation: Hit_ID=Q1SLU2; Match level="QueryCoverage=96%, HitCoverage=97%, E-value=0.0, Identity=47%"; Hit description=Leucine- rich repeat, plant specific
  Pfam annotation: Domain name=LRRNT_2; Domain location=13-55; Score =21.5; E_value=0.003; Accession=PF08263.3; Description=Leucine rich repeat N-terminal domain
  Pfam annotation: Domain name=LRR_1; Domain location=108-130; Score =15.5; E_value=0.19; Accession=PF00560.23; Description=Leucine Rich Repeat
  Pfam annotation: Domain name=LRR_1; Domain location=190-212; Score =14.2; E_value=0.48; Accession=PF00560.23; Description=Leucine Rich Repeat
  Pfam annotation: Domain name=LRR_1; Domain location=214-236; Score =10.2; E_value=3.5; Accession=PF00560.23; Description=Leucine Rich Repeat
  Pfam annotation: Domain name=LRR_1; Domain location=238-261; Score =9.7; E_value=4.4; Accession=PF00560.23; Description=Leucine Rich Repeat
  Pfam annotation: Domain name=LRR_1; Domain location=262-284; Score =7.8; E_value=10; Accession=PF00560.23; Description=Leucine Rich Repeat
  Pfam annotation: Domain name=LRR_1; Domain location=286-308; Score =13.0; E_value=1.1; Accession=PF00560.23; Description=Leucine Rich Repeat
  Pfam annotation: Domain name=LRR_1; Domain location=310-332; Score =12.6; E_value=1.3; Accession=PF00560.23; Description=Leucine Rich Repeat
  Pfam annotation: Domain name=LRR_1; Domain location=334-355; Score =15.9; E_value=0.15; Accession=PF00560.23; Description=Leucine Rich Repeat
  Pfam annotation: Domain name=LRR_1; Domain location=357-380; Score =18.7; E_value=0.021; Accession=PF00560.23; Description=Leucine Rich Repeat
  Pfam annotation: Domain name=LRR_1; Domain location=382-404; Score =9.7; E_value=4.3; Accession=PF00560.23; Description=Leucine Rich Repeat
  Pfam annotation: Domain name=LRR_1; Domain location=406-429; Score =3.6; E_value=60; Accession=PF00560.23; Description=Leucine Rich Repeat
  Pfam annotation: Domain name=LRR_1; Domain location=430-452; Score =10.2; E_value=3.5; Accession=PF00560.23; Description=Leucine Rich Repeat
  Pfam annotation: Domain name=LRR_1; Domain location=454-477; Score =8.3; E_value=8.1; Accession=PF00560.23; Description=Leucine Rich Repeat
  Pfam annotation: Domain name=LRR_1; Domain location=479-502; Score =6.5; E_value=17; Accession=PF00560.23; Description=Leucine Rich Repeat
  Pfam annotation: Domain name=LRR_1; Domain location=507-525; Score =2.5; E_value=98; Accession=PF00560.23; Description=Leucine Rich Repeat
  Pfam annotation: Domain name=LRR_1; Domain location=530-552; Score =11.3; E_value=2.2; Accession=PF00560.23; Description=Leucine Rich Repeat
  Pfam annotation: Domain name=LRR_1; Domain location=554-574; Score =6.7; E_value=16; Accession=PF00560.23; Description=Leucine Rich Repeat
  Pfam annotation: Domain name=LRR_1; Domain location=579-604; Score =8.1; E_value=8.6; Accession=PF00560.23; Description=Leucine Rich Repeat
  Pfam annotation: Domain name=LRR_1; Domain location=625-647; Score =9.9; E_value=3.9; Accession=PF00560.23; Description=Leucine Rich Repeat
  Pfam annotation: Domain name=LRR_1; Domain location=649-671; Score =7.0; E_value=14; Accession=PF00560.23; Description=Leucine Rich Repeat
  Pfam annotation: Domain name=LRR_1; Domain location=674-696; Score =9.7; E_value=4.3; Accession=PF00560.23; Description=Leucine Rich Repeat
  Pfam annotation: Domain name=LRR_1; Domain location=698-720; Score =17.0; E_value=0.069; Accession=PF00560.23; Description=Leucine Rich Repeat
  Pfam annotation: Domain name=LRR_1; Domain location=722-744; Score =8.7; E_value=6.7; Accession=PF00560.23; Description=Leucine Rich Repeat
  Pfam annotation: Domain name=LRR_1; Domain location=746-767; Score =2.2; E_value=1.1e+02; Accession=PF00560.23; Description=Leucine Rich Repeat
  Pfam annotation: Domain name=LRR_1; Domain location=772-794; Score =7.4; E_value=12; Accession=PF00560.23; Description=Leucine Rich Repeat
  Pfam annotation: Domain name=LRR_1; Domain location=84-106; Score =13.0; E_value=1; Accession=PF00560.23; Description=Leucine Rich Repeat
  Pfam annotation: Domain name=LRR_1; Domain location=882-904; Score =7.9; E_value=9.4; Accession=PF00560.23; Description=Leucine Rich Repeat
  Pfam annotation: Domain name=LRR_1; Domain location=906-928; Score =13.8; E_value=0.64; Accession=PF00560.23; Description=Leucine Rich Repeat
  Pfam annotation: Domain name=LRR_1; Domain location=930-952; Score =19.6; E_value=0.012; Accession=PF00560.23; Description=Leucine Rich Repeat
  Pfam annotation: Domain name=LRR_1; Domain location=954-973; Score =9.6; E_value=4.5; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1; Domain location=13-55::108-130::190-212::214 -236::238-261::262-284::286-308::310-332::334-355::357-380::382 -404::406-429::430-452::...
  Pfam module annotation: Domain location=454-477::479-502::507 -525::530-552::554-574::579-604::625-647::649-671::674-696::698 -720::722-744::746-767::772-794::84-106::882-904::906-928::930 -952::954-973
MDANIFPANGYFLGHQCSIVLHLKNNLIFNSTKSKKLTLWNQTEDCCQWHGVTCNEGRVIALDLSEESISGGLVNSSSLFSLQYLQSLNLAFNNLSSVIPSELYKLNNLRYLNLSNAGFEGQIPDEIFHLRRLVTLDLSSSFTSRDRLKLEKPDIAVFQNLTDITELYLDGVAISAKGQEWGHALSSSQKLRVLSMSSCNLSGPIDSSLAKLLPLTVLKLSHNNMSSAVPKSFVNFSNLVTLELRSCGLNGSFPKDIFQISTLKFLDISDNQDLGGSLPNFPQHGSLHDLNLSYTNFSGKLPGAISNLKQLSAIDLSYCQFNGTLPSSFSELSQLVYLDLSSNNFTGSLPSFNLSKNLTYLSLFNNHLSGVLPSSHFEGLKKLVSIDLGFNFFGGSLPSSLLKLPYLRELKLPFNQFNGSLDEFVIASPLLEMLDLCNNNIRGPIPMSIFNLRTLRVIQLKSNKFNGTIQLDKIRKLSNLIELGLSHNNLSVDINFRDDHDLSPFPHMTHIMLASCKLRRIPSFLINQSILIYLDLSDNGIEGPIPNWISQLGYLAHLNLSKNFLTHLQESNTLVRLTNLLLVDLSSNQLQESFPFIPSFITHLDYSNNRFNSVIPMDIGNHLPFMNFLSLSNNSFQGQIPESFCNASSLLLLDLSLNNFVGMIPMCITKLSNTLKVLHFGGNKLQGYIPNTLPTSCTLKLLDLNDNLLEGTIPKSLANCQKLQVLNLQKNLLSDRFPCFLTNISTLRIMDLRSNKLHGSIGCPRSSGDWEMLHVVDLASNNFSGAIPGALLNTWKAMKPEFGHLFFDLVDYYDQKNFKDLLTHTNKSIVAILAKLVTNVPRSILDQTSSDNYNTGELSRYQDSIIITYKGKQIKLVRIQRAFTYVDMSSNNFEGPIPNELMQFKGLNALNLSNNALSGHVPSSIGNLKNLESLDLSNNSFNGEIPTELASLSFLAYLNLSYNHLVGEIPKGTQIQSFDADSFEGNEELFGPPLTHNCSNDEVPTPETPHSHTESSIDWTFLSVELGCIFGFGIFILPLIFWSRWRLWYSKHVDEMLHRIIPQLDFAYQHRGGKRYKILVWSIWKYSVLEIDARQTEAALLKKGLKLNVVTSF

SEQ ID NO: 230295 - protein, 151 aa, Glycine max
  Coding DNA Sequence Number=SeqID_113517
MELVKISTTFTSIDFSSNHYEGPVPKVLMHFKELYILNMSSHALFGKIPSSIVFRLIPQPPPSSLNLVFPSQPLFSRRPSNMSQKNDDLGLIHRWIVVKFKHQVRNPIPSILTIGNFEIMSELRGKPFALDPFIFPQKPKTVLLKIRSWIH

SEQ ID NO: 230296 - protein, 254 aa, Glycine max
  Coding DNA Sequence Number=SeqID_113518
MTYLKKFSFLIFVLLFILHVHLSTAQVNLNAGVGTSNDNGVVVVELGDDTDTSQEAVVSVEVNVDNDNGTSNEAGVEADVTITVNVEPDTEVPDEAPVEVTINVDADSDTDADPDTDVPDEAPVEVTINVDVDPDTDVPDEASIEVTINVAGNDTDTNLGAVSINGSEPETAVNIHGGYILCGTSRVYFYLGCNTENKRGYISCGSVQVEHTSTWLFKENKGWYIPCGSLLVKDFIRLLEILRTGGCLGTGCRH

SEQ ID NO: 230297 - protein, 216 aa, Glycine max
  Coding DNA Sequence Number=SeqID_113519
  Homolog annotation: Hit_ID=Q6AST9; Match level="QueryCoverage=84%, HitCoverage=75%, E-value=2e-27, Identity=38%"; Hit description =Expressed protein
MALTFCTVIYLFTKVKSFSSLNPFESNREFGSTRDLINQNRLWLYYKFFCKKSLPVSISETHYLHNVVGDTKIRKGEGMELDQLCKNMDTSEKKTCMCPFDLDVLSEAFHMRDMNPVHLSSTCCADVLYKGQKGLPNAVPKLENQSRDHERKNKKVKDKGEKYRKQKHRLHRINNGSCIENIRIRPHDPHPLQLKNQQDKKRRAEKSNNDPSVCKR

SEQ ID NO: 230298 - protein, 176 aa, Glycine max
  Coding DNA Sequence Number=SeqID_113520
MKRKRACRTTTLRFVVFYETSSRVENINMFPLWGSFIGPLDLSASKLMPSIVPTKFITMTDSTQPRRRNTDVRETQQKSSKSKWWKGSLWCSSGRRRRPIPARGGRRRVGFLRRREGNGFEEDKGRVGVAGAEQGGTVVVWANRSGEDASEVVITNDVVASGGGLRSDAAAAASGG

SEQ ID NO: 230299 - protein, 341 aa, Glycine max
  Coding DNA Sequence Number=SeqID_113521
  Homolog annotation: Hit_ID=Q6EAM9; Match level="QueryCoverage=22%, HitCoverage=12%, E-value=4e-26, Identity=74%"; Hit description =Cryptochrome 2A apoprotein
  Pfam annotation: Domain name=DNA_photolyase; Domain location=250-340; Score=-33.4; E_value=0.0052; Accession=PF00875.8; Description=DNA photolyase
MANSHNISIHSSQSHNQITRGINLNIDLQLAKFHGNTIYALRKISNDAADWLLSDVQPKCMWARHTYDSPCKSDHVTNNACEVFNAWIGDYKKYEKESTVNYMVTPRVRVLLDKTMQDEILHPMPELDVKKRGGYPNIDPPALKRLPRRPRKARRKNQVEGQFVIQARRSNIVRCSTYKEFGHNYRTCQRALVGKPIKNKGAGNVESVQANVACSQKFEVTTQRKERRKEVGIGDSDKIIFQVGNLSRSTYSLRDLRIEENPALAAVAKDDYVFPVYIWCLKEEGQFYPGQMSRWWLKQSLAHLDKWLKSLGAELVLIKTDRGIISSSRCQPYGYAKLHPH

SEQ ID NO: 230300 - protein, 683 aa, Glycine max
  Coding DNA Sequence Number=SeqID_113522
  Gene Ontology: Mol. function=galactosyltransferase activity; Cellular component=membrane; Biological process=protein amino acid glycosylation
  Homolog annotation: Hit_ID=Q1SGZ2; Match level="QueryCoverage=99%, HitCoverage=100%, E-value=0.0, Identity=79%"; Hit description =Glycosyl transferase, family 31; Arginase/agmatinase/formiminoglutama se; Concanavalin A-like lectin/glucanase
  Pfam annotation: Domain name=Gal-bind_lectin; Domain location=192 -403; Score=147.7; E_value=3e-41; Accession=PF00337.12; Description =Galactoside-binding lectin
  Pfam annotation: Domain name=Galactosyl_T; Domain location=449-633; Score=65.2; E_value=2.2e-16; Accession=PF01762.12; Description =Galactosyltransferase
  Pfam module annotation: Pfam domain module=Gal-bind_lectin::Galactosyl _T; Domain location=192-403::449-633
MKRAKSDPPNSRRFRLSHFLFGIGVLYLLFVSCKFPQFLRIVSTLSGDESEDRLEGAAVGDSEDSDLSKSFVSSVYKDAFHRRLEDNRDQGAPLRPNTEPRKEEERFPESPKQIPPRYGRITGKIMREYKRTNDLSVLERMADEAWILGLKAWKDVDKVDEKGSIKNSILDGKPESCPSWVSMNGDELIKGDNLMFLPCGLAAGSSITVVGTPHYAHKEYVPQLAKTKRGGGLVSVSQFMVELQGLKSVDGEDPPKILHLNPRIRGDWSKQPVIEHNTCYRMHWGTSQRCDGLPSGDEEEMLVDGYKRCEKWMRNDIIDSKESKTTSWFKRFIGREQKPEMTWPFPLVEGRMFVLTLRAGVDGYHINIGGRHVTSFPYRTGFTLEDATGLAIKGDVDVHSIYATSLPTSHPSFSPQRVLEMSETWKARPLPKHPIKLFIGVLSASNHFAERMAVRKTWMQSAAIKSSDVVARFFVALNPRTEVNAVLKKEAAYFGDIVILPFMDRYELVVLKTVSISEFGIQNVTAAYVMKCDDDTFIRVDTVLREIEKVPQEKSLYMGNLNLRHRPLRNGKWAVTYEEWAEEVYPPYANGPAYVISSDIVTFILSQHKDRKLKLFKMEDVSMGMWVERYNNTMAAVQYSHNWKFCQYGCMEGYFTAHYQSPRQMICLWDKLSRGRARCCNFR

SEQ ID NO: 230301 - protein, 175 aa, Glycine max
  Coding DNA Sequence Number=SeqID_113523
  Gene Ontology: Mol. function=RNA-directed DNA polymerase activity; Biological process=RNA-dependent DNA replication
  Homolog annotation: Hit_ID=Q1SUI8; Match level="QueryCoverage=94%, HitCoverage=70%, E-value=2e-15, Identity=27%"; Hit description=Beta tubulin
MLEKKIVVKEVYEAMINSYDPDKEEFYNILWKLPVPSETKGLVWRLAHDRLQTKDNLHKRLILPPGFQVQCVMRMCYVWIGDIRVLPANYLMHFWQHLGGIDGNKAKLVWGAVWISIVWSIWKLRNDIIFNNAACNLQSLIDESRYRAWLWCKTYVKDFNFTLYVWCMDPVNCIS

SEQ ID NO: 230302 - protein, 119 aa, Glycine max
  Coding DNA Sequence Number=SeqID_113524
  Subcellular localization annotation: CTP_CleavageSite=62; ConfidenceScore=5.84e-01
PSSAAVARITSTSGLPRCPPAPSTSPTAPSGPVELSFPTRSASVRHSATGRSHKSWPTSTPLLVMVVNINGVCGVGGGVTFVALWSDGGSSGWVQKGHGGNGGWGSTFVVSKKMKKGRW

SEQ ID NO: 230303 - protein, 165 aa, Glycine max
  Coding DNA Sequence Number=SeqID_113525
  Subcellular localization annotation: CTP_CleavageSite=43; ConfidenceScore=5.26e-01
MERTQLFYSYPSFASNPPQPPPPRVQIFNPILHHTTTLESPIASNTLQHLLFTLFSISPTNFGNNVKNQTSKETPKRNRSQRKELQIPKGTGSQANPGKKRKMDLGISTSTHSTAQKTEANVATENDHGYKRSSFGGDYGRATVAFSLSMLERMKTEPPLFLGVF

SEQ ID NO: 230304 - protein, 273 aa, Glycine max
  Coding DNA Sequence Number=SeqID_113526
  Gene Ontology: Mol. function=protein dimerization activity; Cellular component=nucleus; Biological process=regulation of transcription, DNA-dependent
  Homolog annotation: Hit_ID=Q1SGY6; Match level="QueryCoverage=93%, HitCoverage=28%, E-value=1e-137, Identity=93%"; Hit description =Transcriptional factor B3; Auxin response factor; Aux/IAA_ARF _dimerisation
  Pfam annotation: Domain name=B3; Domain location=120-225; Score =114.3; E_value=3.6e-31; Accession=PF02362.12; Description=B3 DNA binding domain
MTLGWGFAGEKRVLDSELWHACAGPLVSLPAVGSRVVYFPQGHSEQVAVSTNREVDGHIPNYPSLPPQLICQLHNVTMHADTETDEVYAQMTLQPLNPQEQKEAYLPAELGTPSKQPTNYFCKILTASDTSTHGGFSVPRRAAEKVFPPLDFSQQPPCQELIARDLHGNEWKFRHIFRGQPKRHLLTTGWSVFVSAKRLVAGDSVLFIWNEKNQLLLGIRRANRPQPVMPSSVLSSDSMHLGLLAAAAHAAATNSRFTIFYNPRYNCHTLVEF

SEQ ID NO: 230305 - protein, 220 aa, Glycine max
  Coding DNA Sequence Number=SeqID_113527
  Homolog annotation: Hit_ID=Q5W7C9; Match level="QueryCoverage=41%, HitCoverage=54%, E-value=4e-20, Identity=48%"; Hit description =Unknow protein
SAQQSAFAVGVLSDLYAFHRSTGNSLCPYHALRPIIPDNACILCLTAAAGTELADAYSPDTVIASSPGKEVHDPPSVADHPLGPATDHRLGKLLPHQLANQTRAPPRADSSFCSSAYGVLAAVSSCCSPPKGRFLRVTHPSATGNTTSPSDLHVLSMPPASDAPASRESQTRCPGWATSLSYLAVATPSNRPASFQRVPHESDERKTRERILVCGRWFAA

SEQ ID NO: 230306 - protein, 79 aa, Glycine max
  Coding DNA Sequence Number=SeqID_113528
MALQSGTWGMLTNLWFLGDMASTSWSCFHSTDLEILTNARHNQSGQMEPKLLLELNRGVGRWFLDVAQGVDHFVEYLIW

SEQ ID NO: 230307 - protein, 109 aa, Glycine max
  Coding DNA Sequence Number=SeqID_113529
MTVDKLLLDLSTVSDHYECVVVGLVHVDGDCGYELTHEQPQPNVRKNGGLVYKGLRDGTDRQFHIEVKGFDCANLLAGENLHGIMPLIFFINGVIYFLKINGSEMKEKR

SEQ ID NO: 230308 - protein, 140 aa, Glycine max
  Coding DNA Sequence Number=SeqID_113530
MTSLSLQSLTFGSWYYVVGDNPTRIDWVLTEKDLLADSYSDLEASILDEKEFLLLKSISKALQTLYLTILPVNSYREILMPPRASGTSLRGGRSTGKGFKLALPEPSPKEFTIIIWVTNPGWVMHPEAKTRRVIDPNNLN

SEQ ID NO: 230309 - protein, 155 aa, Glycine max
  Coding DNA Sequence Number=SeqID_113531
  Gene Ontology: Mol. function=structural molecule activity; Cellular component=protein complex; Biological process=microtubule-based movement
  Homolog annotation: Hit_ID=Q9M406; Match level="QueryCoverage=69%, HitCoverage=37%, E-value=3e-38, Identity=69%"; Hit description=Alpha- tubulin 4
  Pfam annotation: Domain name=Tubulin_C; Domain location=62-155; Score= 54.9; E_value=2.7e-13; Accession=PF03953.7; Description=TubulinFtsZ family, C-terminal domain
NQVIVKIATWTNENVINVSGCFNLFLQLMKASQFLIEPGQCMLRSNLVIGNQLTKGRFDGTINVDITEFHTNLVPYPRVHFIISLYTSVISTAKAYHEQLSILEITNAMFEPPSMMAKCDPRHGKYMGCYLMYHSDDVPKDVNAIVATIKIERIV

SEQ ID NO: 230310 - protein, 126 aa, Glycine max
  Coding DNA Sequence Number=SeqID_113532
  Gene Ontology: Mol. function=DNA binding; Cellular component =mitochondrion; Biological process=DNA integration
  Homolog annotation: Hit_ID=Q1SJP8; Match level="QueryCoverage=98%, HitCoverage=9%, E-value=6e-34, Identity=53%"; Hit description=D -galactoside/L-rhamnose binding SUEL lectin; Integrase, catalytic region; ...
  Homolog annotation: Hit description=Galactose-binding like; Peptidase aspartic, catalytic
MCPDIAFAVSMVNQFMHAPGHEHLEAFFRILRYLKGSPGRRLLYKNHGHLQSVVARSSAEAEFRALALRICETLWVEKLLQELKVHSSPLINYIATTGQQYILHITRSYMIGPSMSKLISTSSKRR

SEQ ID NO: 230311 - protein, 479 aa, Glycine max
  Coding DNA Sequence Number=SeqID_113533
  Gene Ontology: Mol. function=protein dimerization activity; Cellular component=nucleus; Biological process=regulation of transcription, DNA-dependent
  Homolog annotation: Hit_ID=Q1SGY6; Match level="QueryCoverage=99%, HitCoverage=52%, E-value=1e-150, Identity=76%"; Hit description =Transcriptional factor B3; Auxin response factor; Aux/IAA_ARF _dimerisation
  Subcellular localization annotation: CTP_CleavageSite=47; ConfidenceScore=5.16e-01
MVNYQSDMYQAMAAAALQDMWTSDPSKQHPTSAIQFQQQQNFPNRTSALMQTQMLQQSQPQQAFPNSQENSHPSPSPSQSQAQTQTHFQQHLQHQHSFNTQNQHNLLQQQQQSQLQQQQVVDHQQISSAVSTMSQFVSAPQSQSPPMQAISSLGHQQSFSDSNGNPVTTAVVSPLHSILGSFPQDDTSHLLNLPRSTSWVPVQHSTAWPSSKRVAVDPLFSSGASQCVLPQVEQLGQPQSTMAQNGIALPPFPGRECTIEGSNDPQNHLLFGVNIEPSSLLMHNGMSSLKGVSSNSDSPTIPFQSSNYLNTTVPDSSLNPGMTHNIGESGFLQTPENGGQGNPTNKTFVKVYKSGSFGRSLDITKFTSYPELRSELARMFGLEGELEDPVRSGWQLVFVDQENDVLLLGDGPWPEFVNSVGCIKILSPQEVQQMGNNGLELLNSVPIQRLSNGVCDDYAGREDPRNLSTGITIVGSLNY

SEQ ID NO: 230312 - protein, 121 aa, Glycine max
  Coding DNA Sequence Number=SeqID_113534
  Gene Ontology: Mol. function=kinase activity
  Homolog annotation: Hit_ID=Q1S7U6; Match level="QueryCoverage=99%, HitCoverage=7%, E-value=2e-40, Identity=68%"; Hit description =Prefoldin
  Pfam annotation: Domain name=KIP1; Domain location=1-45; Score=63.9; E_value=5.3e-16; Accession=PF07765.3; Description=KIP1-like protein
MIKLIDEEADSFARRAEMYYKKRPELMKLVEEFYRAYRALAERYDHAMGELRHAHKTIAEEHYMLTDDSSPCVESHTPGVPCPNYCESEHAEKADSEVQTLRKGLAKIQSDKDAIFLQYQK

SEQ ID NO: 230313 - protein, 423 aa, Glycine max
  Coding DNA Sequence Number=SeqID_113535
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=100%, HitCoverage=25%, E-value=1e-154, Identity=68%"; Hit description =Prefoldin
MLGQLQTLGLDPKCFAASVKDLQNENSNLKEVCKMERNAKEALREKSKDMDELLIENEFMEFSLSRLNDELDGLRATVRKFQESCQVLQEEKSMAVDEKSALFSQLQIVTESMQKLLEKNALLEKSLSDSKIELEDLKAKSTDLEEFCKLLNDEKYNLLSERSILVSQLESVEAKLSNLEKMFTKLEEKYADSEKDKESTGNQVEEIRASILVQKQKHANHKHLSEVRLTNLENLFHALQEELRLGKIEFEKEVDKAVNAQMEMFILQSCIEDLEQKNLALLTECEKHVEASKFSYKVISELETENFMQLMEEEFLLHEIRKLKMAIHQVCGALQIDPYGVHDKGIKQEEMPILHILDNIEDLKSSYVKSQEEKQQLLVENSVLLTSLEQNRSEREKMESEKKIMEQDFEKTRQKNSMLQKAK

SEQ ID NO: 230314 - protein, 500 aa, Glycine max
  Coding DNA Sequence Number=SeqID_113536
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q1S7U6; Match level="QueryCoverage=99%, HitCoverage=27%, E-value=1e-116, Identity=50%"; Hit description =Prefoldin
DKTNECQHCEAEAASFYLELQISSISEELLKGKVTELTGVCKRLDDESAGKGLVIEQMIERIGLLEKEIRGLKGQLSAYTPTITSLKEDFASLEHTYFLLTNKTFAVGNIEQKDVVTEICLQEANSYRSLKGNESTLTPDGVTDLLSMQTRIRAVEKLMMEELERHVEEESLTTNVKAEAVTEMTEHSNLEVGTYPEIDDRKVVMKIKKDNSKRGNNAWRTKSQKRLIMIDIPLDDYKDDPDSNKYCKRDHTRCNDHMLELCETDQHDVTEESKHNSVSIEDVITCHESERCQNYSSELETEKELGVDKLELWKTRKETTSEDSKRKILERLASDSQKLAILKMTLQDLKKKPETQKKSSKVNEIEYETVKRHIEDVEEAVMQQIGIYDQLAKDIEECTSSSSDTNTMQMEKQGGHGQRKKLTEQARRGSEQIGRLQFEVQNIQYILLKLADVKNNKCKNKNTRPTGVLLKDFIRIGRKNNRRRRKGCACGCSRPSTNED

SEQ ID NO: 230315 - protein, 57 aa, Glycine max
  Coding DNA Sequence Number=SeqID_113537
MGCNNWTQPRPMGSKIYHKVHENPRTFFSSSNPILLEPLAHGSSDWSLPREDCINDE

SEQ ID NO: 230316 - protein, 183 aa, Glycine max
  Coding DNA Sequence Number=SeqID_113538
  Subcellular localization annotation: CTP_CleavageSite=18; ConfidenceScore=5.44e-01
MVEPSRKRNGSSSTTTAVGQHRHSTSDDPPTPPNPSFSSQRSLTLFSSDEQHQRYRMHKALWANASFPYPHLVTLFLQHFNVPLEDEPFVKRKDVDGQWVHKHDLPPPIPDEHTPFLPPQQDSSSFLLNDILIELRYLRAFAGDRFDAMDSRITRLEDDMSFIRRCFDPPADPEKFLLHPTFI

SEQ ID NO: 230317 - protein, 56 aa, Glycine max
  Coding DNA Sequence Number=SeqID_113539
  Homolog annotation: Hit_ID=Q6X4V5; Match level="QueryCoverage=68%, HitCoverage=5%, E-value=7e-11, Identity=92%"; Hit description=ABC transporter
MECYQRAYGSGKSILLDALSSRLAANAFLSCTILLNGRKAKLSFGTAVSLFSFFLP

SEQ ID NO: 230318 - protein, 281 aa, Glycine max
  Coding DNA Sequence Number=SeqID_113540
  Gene Ontology: Mol. function=binding
  Homolog annotation: Hit_ID=Q8S3S1; Match level="QueryCoverage=54%, HitCoverage=21%, E-value=9e-36, Identity=51%"; Hit description =Putative kinesin light chain gene
MWWAWVMLAVNRWEIPEIPKYSIYCVLTWVFVNDVEQKECTDGDLQDKTPLGTVQVLTPSNQANTPQFSKPLKSDTMNKDAIIRSDDAEFGEADQEEKKYVDPLDKFLPPPSKARCSEELQSHRFIFMFLVMGRIFTNAGIGVAEGLDLEALVVAGDGSIDLVEHGEDVVELHVAREGGEGMIGAAFDVGNFDSAFEDGDDFFKASKAAVDGSEDVEAHGEVEAGLSLDDATLKGPGGPNSEVEDLGGPIARGNGVAGQLKEEWAEIWVVERGIREKRRGF

SEQ ID NO: 230319 - protein, 280 aa, Glycine max
  Coding DNA Sequence Number=SeqID_113541
  Homolog annotation: Hit_ID=Q6YS82; Match level="QueryCoverage=34%, HitCoverage=26%, E-value=5e-27, Identity=57%"; Hit description=RRM -containing RNA-binding protein-like
  Pfam annotation: Domain name=zf-RanBP; Domain location=11-42; Score =21.2; E_value=0.0023; Accession=PF00641.9; Description=Zn-finger in Ran binding protein and others
  Pfam annotation: Domain name=zf-RanBP; Domain location=75-104; Score =23.7; E_value=0.00067; Accession=PF00641.9; Description=Zn-finger in Ran binding protein and others
  Pfam module annotation: Pfam domain module=zf-RanBP::zf-RanBP; Domain location=11-42::75-104
MRIRMPLLNGLTTYWLCLKTSCSNVNFAFRGACNHCGTARPAGASGISGAGGRGKGCAAQESGGIGRPAGGGLFGPNDWPCPMCGNINWAKRTKCNICNTNKPGHNEGGVRHVAVVSLLLSSLVPKLVDPAVDPDAYRNVVSTVTLFAGIFQAAFGIFRLGFLVDFLSHAALVGFMAGATIMIGFSFRSVHQETLITNNYVMRIGAATPRKSSSHQQGDYIWNGQRVMLTADLGVRLEDIKHCLGGTIIVVLESENKTYTRNPSWTYKVRPRDLGKMFSI

SEQ ID NO: 230320 - protein, 262 aa, Glycine max
  Coding DNA Sequence Number=SeqID_113542
  Gene Ontology: Mol. function=porphobilinogen synthase activity; Biological process=tetrapyrrole biosynthetic process
  Homolog annotation: Hit_ID=P43210; Match level="QueryCoverage=33%, HitCoverage=22%, E-value=8e-26, Identity=69%"; Hit description=Delta- aminolevulinic acid dehydratase, chloroplast precursor
  Pfam annotation: Domain name=ALAD; Domain location=40-214; Score= -119.1; E_value=8.7e-09; Accession=PF00490.11; Description=Delta -aminolevulinic acid dehydratase
MFPMTTLGRLNWPRSNLRVPITPQSSSNEPHQANEAVEGDLRQRGGLASRRVRQPSPKPNVLQDGDGHHQPELKAATFEECTQVVALSENLFPREADEEHGGVEDMMRLAYLNEHGRAQAGADVVSPSDMMDGRVGALRATLDVEGFQHVSIMSYTTIFTLLIVGLLINLAWLNKSYQMNPTNYREALTEMREDESEGVDILLLFHTSLMLKSILNIPRYDFPVRRHNQLLISWYHKADMRTGRANLLATYKPSSILAWPTG

SEQ ID NO: 230321 - protein, 75 aa, Glycine max
  Coding DNA Sequence Number=SeqID_113543
MPKIFQENLFMVTRQVRKAAPSRHGNSRYSSGYEHRHRWTSKREVRGREEEESRTVLLVLDATMKILDDGGGGGA

SEQ ID NO: 230322 - protein, 117 aa, Glycine max
  Coding DNA Sequence Number=SeqID_113544
MNDSDIAMCLFYSLSPLLTLYSSKSATVETIDKTLFLPSRNGLSLPQPVSDKIRRCVRDIGRPVGRWCHASAQSRNSPRRVSEKCESSGGGGGCRRTDDDESVGNRMMYKNLCPSPI

SEQ ID NO: 230323 - protein, 909 aa, Glycine max
  Coding DNA Sequence Number=SeqID_113545
  Gene Ontology: Mol. function=RNA-directed DNA polymerase activity; Cellular component=chromatin; Biological process=chromatin assembly or disassembly
  Pfam annotation: Domain name=Chromo; Domain location=827-878; Score =28.6; E_value=2.1e-05; Accession=PF00385.14; Description='chromo' (CHRromatin Organisation MOdifier
  Pfam annotation: Domain name=rve; Domain location=525-681; Score =122.1; E_value=1.5e-33; Accession=PF00665.16; Description=Integrase core domain
  Pfam annotation: Domain name=zf-H2C2; Domain location=470-507; Score =14.2; E_value=0.0047; Accession=PF09337.1; Description=His(2)-Cys(2) zinc finger
  Pfam module annotation: Pfam domain module=Chromo::RVT_1::rve::zf -H2C2; Domain location=827-878::12-181::525-681::470-507
MLTIGVIQPSHSPFSSPILLVKKKDGSWRCCVDYRALNAVTVKDRFPMPTIDELLDDLGQASWFSKLDLRQGFHQIRMAEEDTHKTAFRTHQGHYEFLVMPFGLCNAPSTFQAAMNAALQPFLRRFVAVFFDDILVYSPDLQSHVSHLESVLSTLADREFLLKHSKCSFAQRQLSYLGHIISSQGVAPDPDKVAAMLEWPRPTCPTTLRGFLGLTGFYRKFVKGYAAIVAPLNSLLRKDSFIWSPEAQHAFHQLQQAMTQTPVLANPNFLLPFTLEIDASGTAMGAVLLQESHPIAYYSKVLCPRLQRASAYVRELHAITSAVRKWRHYLLGNSFIILTDHKSLKDLMSQTIQTPELQTYLSKLLGFDYSIKYKPGPANVVADALSRIVPTEATYLTLTMPHCLFLQKLRHALLQDPQYEQLLRDVREHPTEHPDLTTHQELLLRQGQIWIPFATPFTDSLLEEFHSSPLAGHPGVAKTLHRLRQNFDWPRIKTDVRRYVAQCATCQQTKYETKKSAGLLQPLPIPTHVWEDLSLDFVTGLPSSQGYTTILVVVDRFSKAAHFGALPTPHSAYKVATLFLDMVCKHHGFPRSLVSDRDPIFVSKFWRELFRLSGTKLRMSTAYHPQTDGQTEVLNRSLEQYLRAYVHTQPSNWYRFLSLAEWSYNTSLHSAIGMTPFEAVYGKSPPKIADYLRVQSSNDAVDSLLSTRIQIHDQLTRRLHRAQERMKLTADKHRRDVSFTIGDWVYVRLRPYRQTSIAPMYSKLAKRFYGPFQILECIGPVAYKLLLPESSRIHPVFHISLLKSHHDPLPASPASLPVNSNDNHPVVLPFAILDWKLDSSVTPPVKRVLVQWEGLPPEDASWELWDELRTLPNLEDKVVFDDGGVVSITADQHRPKRERKKPAYLQDFV

SEQ ID NO: 230324 - protein, 193 aa, Glycine max
  Coding DNA Sequence Number=SeqID_113546
  Gene Ontology: Mol. function=RNA-directed DNA polymerase activity; Cellular component=chromatin; Biological process=chromatin assembly or disassembly
MAGLDYSDGEHRRDLFLNFRFLEMGITEGGSEEGSAKMAEYRRRTAAIGVGVESVVRHVEEGGDSEGGASARRETCQPGLNEIMSRATIYQDDYWVTAHRTEKTERLRGRGTLHRVQADVWSNREIRSGRRWVVVRVQTGFAAVAVGPLFFTVVAESLFVADRKFLGGEAFYGDASGRKRVIGRGFRGEGSGR

SEQ ID NO: 230325 - protein, 91 aa, Glycine max
  Coding DNA Sequence Number=SeqID_113547
MAVLVEHNFLDAYAGESRDGSLSVKFSTGDIISMNSVITTTKDLNDLCYAVLAIFRSRFPKTEGITAGLCMKGQCLPRVLKDIEILTKNNC

SEQ ID NO: 230326 - protein, 99 aa, Glycine max
  Coding DNA Sequence Number=SeqID_113548
MSQHLFHFLSLPPPRAILSRHLLCPPCHLQHPPPHHHLQPPLQQQPFQLNKENKNNNKGNYNYYVFRGGGVVCAAPGGGSNFGRESEAEISCEVVQLIK

SEQ ID NO: 230327 - protein, 107 aa, Glycine max
  Coding DNA Sequence Number=SeqID_113549
MTVLVSKFLFMKDATNVAIVTNYEFLFMWVRCQGIKNLRPRPEDADISWKGADDHVGLYVSTGSLASGHDSRIETFLRSRPEDADLFRKGADDHIGLYVSTGSLASG

SEQ ID NO: 230328 - protein, 175 aa, Glycine max
  Coding DNA Sequence Number=SeqID_113550
ANEPVDAQRLTSSFVPFVIQGQRVRWQAEIPYGYPHLSSTEANGFDDMQARQRTRFFSAGRGAIKFDGMGKCRGSAGQDIDRSNDGQLSYPNFVWGPLFGGMQPSLDRLKGGVKIATKPTWAFHGVPTECGAFWWKQPSSPGLAELAWASWAATTSLFSPINRGKRAEQKCSALL

SEQ ID NO: 230329 - protein, 287 aa, Glycine max
  Coding DNA Sequence Number=SeqID_113551
  Gene Ontology: Mol. function=nucleic acid binding; Cellular component= ubiquitin ligase complex; Biological process=protein ubiquitination
  Homolog annotation: Hit_ID=Q1T0N5; Match level="QueryCoverage=99%, HitCoverage=34%, E-value=1e-114, Identity=72%"; Hit description=Zinc finger, RING-type; Zinc finger, CCHC-type
  Pfam annotation: Domain name=DWNN; Domain location=3-78; Score=169.5; E_value=8.2e-48; Accession=PF08783.1; Description=DWNN domain
  Pfam annotation: Domain name=zf-CCHC; Domain location=226-243; Score =11.0; E_value=0.015; Accession=PF00098.13; Description=Zinc knuckle
  Pfam module annotation: Pfam domain module=DWNN::zf-CCHC; Domain location=3-78::226-243
MAVYYKFKSARDYDSIPMDGPFISVGTLKEKIFESKHLGRGTDFDLVVTNAQTNEEYLDEEMLIPKNTSVLIRRVPGRPRLPIVTEIEYYLKPLISLLQLKISELIIQKVENKVVESEPENGSLPAEDTSAMKYPEDSDWDEFGNDLYSIPDQVPVQSSNLIPEAPPPSKADEDSKIKAFLDTPALDWQRQGSDFGTGRGFGRGTGGRMGGGRGFGMERKTPPQGYVCHRCKVPGHFIQHCPTNGDPNFDMRKVKQPTGIPRSMLMVNPQGSYALPNGSVAVLKPNE

SEQ ID NO: 230330 - protein, 307 aa, Glycine max
  Coding DNA Sequence Number=SeqID_113552
  Gene Ontology: Mol. function=nucleic acid binding; Cellular component= ubiquitin ligase complex; Biological process=protein ubiquitination
  Homolog annotation: Hit_ID=Q1T0N5; Match level="QueryCoverage=89%, HitCoverage=36%, E-value=2e-94, Identity=64%"; Hit description=Zinc finger, RING-type; Zinc finger, CCHC-type
IRDYIISKSICVCGATNILADDLLPNKTLRDTINRILESGNSSAENAGSTFQAQDMESARCPQPKIPSPTSSAASKGELKVSPVNEKTTNIQETTDDRKAVSAPQQTSEQVRNPRAADISEATHESMSVKEPASQWSAQQVEEEVQQKLVPTEAGKKKKKKKVRLLPNDLQWKTPHDFGAENYMMPMVPPAGYNSYWNGMQPMDGFMAPYGNPMQMMGYGLGPLDMPFGGMPQDPFGMQGYMMPGFPPHRDLADFSMGMNAPAPVMSREEFEARKADMRRKRENDRRPERYTESLFDGWLSCSDICG

SEQ ID NO: 230331 - protein, 44 aa, Glycine max
  Coding DNA Sequence Number=SeqID_113553
DFSKDRDFGREVSSVGDVSSMKSKTCQSISRGHFIQTYGHNLKP

SEQ ID NO: 230332 - protein, 130 aa, Glycine max
  Coding DNA Sequence Number=SeqID_113554
MYLVVLHGCSFISDAGFLQRLFTKAPGLNAIIKWCMATAEVKVSNVQCNLYKMLHEVVRSASGKLHAEAGGQVSGLWHDEDAFLRPELVAFSRSRTSCDVAPCGAYRPWIFFINGVLCFLKFNGSRMKKE

SEQ ID NO: 230333 - protein, 94 aa, Glycine max
  Coding DNA Sequence Number=SeqID_113555
MGVQEGKRRVGSKNYDAIELEEEEEEKRRSFFLVTLTDREWSKRQISELEHFVFGGDAYSELGRSGATKPTEILDRRRRYDDRSCVTSRLHDVP

SEQ ID NO: 230334 - protein, 161 aa, Glycine max
  Coding DNA Sequence Number=SeqID_113556
MVTKYQSDPSLMQLISKHFYSERIFDDSTSNNPKLRWRYRNFFSDNAVHGHRTHDRESNDKSQEHSHNDSNDKSLGWSENVTHSKRTNLETKRTFENADIMSEGDPLDCLFSYAPPVEDIHHSNSPNKPSGIHNRARRRSHRRRRMRNHDDLSNSESAAAI

SEQ ID NO: 230335 - protein, 373 aa, Glycine max
  Coding DNA Sequence Number=SeqID_113557
  Gene Ontology: Mol. function=pyridoxal phosphate binding; Cellular component=chloroplast; Biological process=cysteine biosynthetic process from serine
  Homolog annotation: Hit_ID=Q8W1A0; Match level="QueryCoverage=82%, HitCoverage=91%, E-value=1e-136, Identity=85%"; Hit description =Cysteine synthase
  Pfam annotation: Domain name=PALP; Domain location=12-312; Score =388.7; E_value=9e-114; Accession=PF00291.15; Description=Pyridoxal -phosphate dependent enzyme
MAVERSGIAKDVTELIGKTPLVYLNKLADGCVARVAAKLELMEPCSSVKDRIGYSMIADAEEKGLITPGKSVLIEPTSGNTGIGLAFMAAARGYKLIITMPASMSLERRIILLAFGAELVLTDPAKGMKGAVQKAEEILAKTPNAYILQQFENPANPKVHYETTGPEIWKGSDGKIDAFVSGIGTGGTITGAGKYLKEQNPNIKLIGVEPVESPVLSGGKPGPHKIQGIGAGFIPGVLEVNLLDEVIQRASPGAAVKLCLGDLLVMGSNPGNSLFAYARVGISSGAAAAAAFQIAKRPENAGKLIVSQKFQELSGEEILDPFASKNSIRKIGQNGIDAGTKNNAEDIAGGTRTTSRRGDNGNCDCDVSGDRKW

SEQ ID NO: 230336 - protein, 487 aa, Glycine max
  Coding DNA Sequence Number=SeqID_113558
  Homolog annotation: Hit_ID=Q94F64; Match level="QueryCoverage=98%, HitCoverage=92%, E-value=1e-103, Identity=43%"; Hit description=CDPK adapter protein 1
  Pfam annotation: Domain name=DUF1423; Domain location=68-468; Score= -259.4; E_value=0.067; Accession=PF07227.2; Description=Protein of unknown function (DUF1423)
MEKSNGLWNLQAVAPEVSGEGFPYAPENWPEQGDIWGWRTGRRVVANRSHFKDRYLYLPNRLIRALKEEKEKENAADSGSSSIRSRQHIFASKLAVECYIKKYYPEADLDAFFASFSWKIPALPSSSTNGNEVPIAAVPLLQIAQEAYDSDSGDVVKCKASNKKCTSLVLEEVEKYSPAMPCDICCSEPGFCRDCVCILCCKTVSSAYGGYSYIKCQVNIGGGICGHVAHMECALRSLLAGKVGGSIGLDAQYHCRRCDGRTDMISHVNNLLQTCRAADLDDEIRKKILNLGACLLRGSQKPVAKELLCRIELAISKAYDQFDSLYQLKCGTNLEEIWKEDDSLIAHSLDNGNDVMEVMVNDGPFEVRTGLESYDFQPRSLKLESEVDQVLQALRKSQELEYKVVEETLQDQKTYLKNLYQQVECEKYELACQNSSTSDVSSSAVRDRKKQIRREVEKFEIMKKVAYGFGRTSNDIVKEHFGLKVID

SEQ ID NO: 230337 - protein, 808 aa, Glycine max
  Coding DNA Sequence Number=SeqID_113559
  Gene Ontology: Mol. function=zinc ion binding
  Homolog annotation: Hit_ID=Q6ZA58; Match level="QueryCoverage=48%, HitCoverage=23%, E-value=2e-55, Identity=37%"; Hit description=PHD finger transcription factor-like
  Pfam annotation: Domain name=PHD; Domain location=755-797; Score =27.0; E_value=6.8e-05; Accession=PF00628.19; Description=PHD-finger
ASLSDHFGFFSGDLRRTRMQQFTARYGIREFSGEMESGVRSGGSGVVVKSRNSSGCLIVRKKGDVLGATASTSRKLYESKNRPNINVPLSDSGSSDESPVPPGRRLGPETIRVFNGFAAASERGGSEISRKRYRVQRIRGNGEGIAAEKGLEQWERKRSKLVVYDFDDYNGMDVENMRRRHLDGHGGGRFMGSVHAARIGIDREFKTGSSGRILDKRNNSYGDRPGGLYPGDNVDHSRYKINRDGLRVPLRLQREKFNSDESIRVQGRNGVLKVMVNKKKVGGPSEQYYDHHKPVERRQRLKTEETAKRLMTEETAKRLKTEEAAKRNVNVPIRPLSYLEMKPVEKTGLLKRPEKKRIASRKSLSSKDSKGDEGDSDNSDTSLNLGIRNTEARKPAKKIISEDEQTPVHEKLPTTRTKEGKIKRGSGTEKQKLRERIREMLLDSGWTIDYRPRRNRDYLDAVYINPAGTAYWSIIKAYEALQKQLNEDANEAKPKGDSSSFAPIADEVLNQLTRKTRKKMEKELKKKKKYDSESDNEKEPQIRSASHKRDMNSTDGDNNEEKLSSFIKQGSKSMKNKMFENTIISAPSKIQNATNHSGDGIEKSLFGCDPQIHGRKSKKHGRCTLLVRSSNKGSNSESDGFVPYTGKRTVLAWLIDSGTVELSQKVQYRRRKKVMLEGWITRDGIHCGCCSKILTVSKFELHAGSKLPQPYQNIYLESGVSLLQCQIDAWNRQEHAEKIGFHSVDIDGGDPNDDTCGICGDGGDLICCDGCPSTFHQSCLDIQGAVISHSLELCCFEVKGTEDTFLLL

SEQ ID NO: 230338 - protein, 329 aa, Glycine max
  Coding DNA Sequence Number=SeqID_113560
  Gene Ontology: Mol. function=structural constituent of ribosome; Cellular component=intracellular; Biological process=translation
  Homolog annotation: Hit_ID=Q1SDC7; Match level="QueryCoverage=98%, HitCoverage=97%, E-value=1e-125, Identity=70%"; Hit description =Ribosomal protein L18P/L5E
  Pfam annotation: Domain name=Ribosomal_L18p; Domain location=197-314; Score=-6.9; E_value=2.9e-05; Accession=PF00861.12; Description =Ribosomal L18pL5e family
MVSVLARKGASLYKRNFLSRTFNLCFKSLTTIPNKDVEAAASLPSEYSTSPHLSPFFSDFNHPSTGFDIELVDHDAWAVSSGVAQAWREPASRATTSFGPQVTGEALDDHVEGELDFEDIDNMRVRGNLFYKLERSSKEFEEYNLDFHRKKSSKRKEEVNKAKTTPNVVSKDHKLPKVDELTRSKSVVPRVDDINDGSTVNKRQRTPTFNQLTGPYHEPFCLDIFISKASVRACVVHRVTSKVVAVAHSISKDFKFDLASTKNKTTCAAVGAILAQRALADDIHDIVYTPRKGERVEGKLQIVLQSIIDNGINVKVKIKQRPKKSFNRI

SEQ ID NO: 230339 - protein, 109 aa, Glycine max
  Coding DNA Sequence Number=SeqID_113561
MVLEQTSLLVQYSSRMNQAEVGGNVTPQSNHIKMREIQKLCIVRATKKLEIRDVTHSLTSNNTSIHSLRHSLRWHFTLLCVCPRCRRHVPSWWLHSSSLELAFSDNIYF

SEQ ID NO: 230340 - protein, 147 aa, Glycine max
  Coding DNA Sequence Number=SeqID_113562
  Gene Ontology: Mol. function=2 iron, 2 sulfur cluster binding; Cellular component=chloroplast; Biological process=electron transport
  Homolog annotation: Hit_ID=Q1SVD7; Match level="QueryCoverage=99%, HitCoverage=100%, E-value=4e-53, Identity=70%"; Hit description=2Fe -2S ferredoxin, iron-sulfur binding site
  Pfam annotation: Domain name=Fer2; Domain location=50-125; Score =77.7; E_value=3.6e-20; Accession=PF00111.17; Description=2Fe-2S iron- sulfur cluster binding domain
MASLQLTRTPLSLFRQERQQHPRKKNSTAFELKAPRPRLTLSVRSYKVVIEHDGESTEVEVEPDETILSKALDSGLSVPHDCKLGVCMTCPARLISGSVDQSDGMLSDDVVERGYALLCAAYPQSDCHIKIIPEEELLSLQLATAND

SEQ ID NO: 230341 - protein, 74 aa, Glycine max
  Coding DNA Sequence Number=SeqID_113563
MIKLWESCFWFFRCFTVIKNTQEIMSNTIRIEKFNGKNNFNLWRIKMRALLKEQCVWAPVASTSVKKPVTSDSK

SEQ ID NO: 230342 - protein, 478 aa, Glycine max
  Coding DNA Sequence Number=SeqID_113564
  Gene Ontology: Mol. function=heat shock protein binding; Cellular component=integral to membrane; Biological process=protein folding
  Homolog annotation: Hit_ID=O23230; Match level="QueryCoverage=17%, HitCoverage=6%, E-value=4e-24, Identity=59%"; Hit description =Trichohyalin like protein
MDESQRIGIGLMRSFPRRRSVEDRSSSRRRRSIFSGAGISESVDADDFADVFGGPPRTLLAHKFSSSGSFYEEVFRPPEFTCPAPKGGRSLPVFRIPARNEGFYSDIFGSDDERRSRERSRSLSKENSSSAMSSEELSPRRPAIGDDVALSGFASKLRPINIPWRWNSSTVMPEAEEYPSKLGVPLFACKDQSFEIQHQDNEYKENFRSPHLGSSRRVSSPETISLESNSYQSIKVFTDDWELNSPFSDVSSLYQEPGAKFSVHDRVLSEQIIEGDDDDDDDDEIMSSYVIELNSNLRREECGESAIDEAIAWAKEKFQSRSSDEESSVRNYGKEKTVGIGSSDASEYHDDGIEIVQTQEKQQTETEKLDRDIRLWSSGKETDIRLLLSTLHHILRPESGWYAIPLKSLLESSQVKKAYQKARLCLHPDKLQQRGATLLQKYVAEKAFSILQFCLEICGQTPSLTFGMSGALVDKQQI

SEQ ID NO: 230343 - protein, 57 aa, Glycine max
  Coding DNA Sequence Number=SeqID_113565
  Homolog annotation: Hit_ID=Q8S3V0; Match level="QueryCoverage=89%, HitCoverage=22%, E-value=3e-08, Identity=50%"; Hit description =Putative serine threonine kinase
ISEADPPFHTVEIRKTGGDTLEFDNFCKDLSAGLQDIIWKEEPVNTEKDGASTSSAK

SEQ ID NO: 230344 - protein, 49 aa, Glycine max
  Coding DNA Sequence Number=SeqID_113566
MARFMIGHNTKPNTTPKLAHNTAEWSGKSTFCEEVMGSSTRPWVRVCQV

SEQ ID NO: 230345 - protein, 126 aa, Glycine max
  Coding DNA Sequence Number=SeqID_113567
  Gene Ontology: Mol. function=protein serine/threonine kinase activity; Cellular component=cytoplasm; Biological process=protein amino acid phosphorylation
  Homolog annotation: Hit_ID=Q6ZLP5; Match level="QueryCoverage=85%, HitCoverage=24%, E-value=1e-35, Identity=66%"; Hit description =Putative CBL-interacting protein kinase 23
  Pfam annotation: Domain name=Pkinase; Domain location=1-125; Score= -43.0; E_value=5.3e-06; Accession=PF00069.15; Description=Protein kinase domain
MCMSVILPSQTNSRSLTELEARKYFQQLICAVAFCHSRGVSHGNLKPENLLLDAKGVLKVSDFGMRPLFQQVPLHTPCSTPHYMAPEVASITCYEGAQADIWSCGVILFVLLAGYLPFNDKDIYLK

SEQ ID NO: 230346 - protein, 514 aa, Glycine max
  Coding DNA Sequence Number=SeqID_113568
  Gene Ontology: Mol. function=RNA binding; Cellular component =ribonucleoprotein complex; Biological process=RNA processing
  Homolog annotation: Hit_ID=Q1T402; Match level="QueryCoverage=99%, HitCoverage=100%, E-value=1e-134, Identity=50%"; Hit description=RNA- binding protein Lupus La
  Pfam annotation: Domain name=La; Domain location=346-416; Score=83.3; E_value=7.4e-22; Accession=PF05383.7; Description=La domain
  Subcellular localization annotation: CTP_CleavageSite=41; ConfidenceScore=5.34e-01
MAMTGNHSPRHSSDNLRSRRATRLPASSPWNQVVRGESEPVAAAPSSSTEDFPSAAVPVDDFSSSAAESSDNGGAALRPVWNKPSPNGAAAAASDVRPEMDANSWPLPSESTRAATKSESSKGLLDGSSVPQSQGLGSTSFSSSQREVSDNARTNNTNSLVPARQKSMKHHSSNASSNGGHAQHSVPQVSIAATGSRNSSPKDHTQRSGFASNDHPQQRNSFRNRNGGQHQRGDGSHHHNYGNRRDQEWNNNRSFGSRDTHVPPRVAPRFIRPPPPPPPNSAQFFHPSPMRPFGSPIGFHELAPPLVFVAAPPPPPDSLRGVPFVPPMPHHPLFFTGPDPQLHSKIVNQVDYYFRELTVVLPQLVYCSNENLVKDAFLRQNMDDQGWVPIKLIAGFNKVMHLTDNIQVILDAIQTSSVVEVQGDKIRRQNDWRRWIMHPPVQFSNATTIGVLNPDKLAEQVQNIALETSNYDGAGGLDVQPDTSQHRSTFGDLQQLSTSQVGIQGSDHFIPARN

SEQ ID NO: 230347 - protein, 57 aa, Glycine max
  Coding DNA Sequence Number=SeqID_113569
  Homolog annotation: Hit_ID=Q1SLU0; Match level="QueryCoverage=72%, HitCoverage=8%, E-value=3e-07, Identity=60%"; Hit description =Peptidase S8 and S53, subtilisin, kexin, sedolisin; Integrase, catalytic region
MEMTRCMLHEKELPKKLWVEAVKRDKLDKKGCQVHGRKTMELGGVNKEATTRNSTIH

SEQ ID NO: 230348 - protein, 118 aa, Glycine max
  Coding DNA Sequence Number=SeqID_113570
  Gene Ontology: Mol. function=nucleic acid binding; Cellular component= chromatin; Biological process=RNA-dependent DNA replication
MGNLNKGKVLELLKEAEYWWDDTRQCLEAKGQAMTWETFKRVFLDKYFPKDVKNNKEMEFLELKQGSMTMAEYAAKFKELVRYFPHNQGKDGESSKCLKFLNGLRPEVKQVINYQGVH

SEQ ID NO: 230349 - protein, 220 aa, Glycine max
  Coding DNA Sequence Number=SeqID_113571
  Homolog annotation: Hit_ID=Q4SUQ8; Match level="QueryCoverage=71%, HitCoverage=68%, E-value=1e-32, Identity=44%"; Hit description =Chromosome undetermined SCAF13844, whole genome shotgun sequence
MEDWNDEQCDDTLTMTTVSQHFFGDDSETPSFSISIIENMKEDYGLFVWPCSVVLAEYIWQHKHRFSGATVVELGAGTSLPGLVAAKLGARVTLTDDSTRLEVLDNMRRVLGLTWGVWDSSIFSLQPTIILGADVLYDSKAFDNLFATVTFLLRNSPGSTFITSYHNRSGHHLIEFLMGKWGLKCLKLLDGFSFLPPDKASLLSGNIQLAEIGLISKDNA

SEQ ID NO: 230350 - protein, 177 aa, Glycine max
  Coding DNA Sequence Number=SeqID_113572
MEDKRCGQVIEKEINIIKKNDTLEFSKRPKGHEIIGINVWTCCPYGDNSSSCLQGLKWDDIDIGLMDYYLGLEMKQMENDIFVSQESYGKVLKKFQKFDYNFLNTPMEGNLILSRLDGGNKEDPNSLKSLAGPSNEFKHTGFCDSDFGLFYSPSMMSGRINLESLASPIKIQIQNTT

SEQ ID NO: 230351 - protein, 110 aa, Glycine max
  Coding DNA Sequence Number=SeqID_113573
MAADINVLPPMCPSNTETSPLTPFSAVAPNYLVPFSKVQIKITLETIYEEEEDDEEEEKEDEMEKSSETHASSSPPIFFPIIQAAAATCSFEITGFFHFLVSFGHNYQHA

SEQ ID NO: 230352 - protein, 399 aa, Glycine max
  Coding DNA Sequence Number=SeqID_113574
  Gene Ontology: Mol. function=RNA-directed DNA polymerase activity; Cellular component=chromatin; Biological process=chromatin assembly or disassembly
  Pfam annotation: Domain name=RVP_2; Domain location=279-398; Score= -34.1; E_value=0.00046; Accession=PF08284.2; Description=Retroviral aspartyl protease
  Pfam module annotation: Pfam domain module=RVP_2::Retrotrans_gag; Domain location=279-398::92-182
MAEEGAAGGGERRSYARKKEPEGGARGRRRNEKKRKWKKWGAAIPVPNPHTLSHSQMKLDVPRFDGSDPSGWVFKITQFFEYHATPKPERLTIASFYMEGPALAWFQWMMRNHQLTTWPGFLQAIEARFTHSPYEDPIRLLCKLTQTGSVRDYLNQFEALANCVVGLPPSFLLSCFVSGLDLDIHREVKALQPMRKSSWRVVELRAIESLRCSTLTHPHPPLCPYPALIFLFHPLHLNPHPSQYGASPQKNLQAVVNEAYASTVTRDLHEAITVLRDFLSSSPMKNNQTAPETLRMVGRIAYHPVVILVDGGSMHNFVQQHLVKSFGLLAQDTPTLRVLVGNGKEVQSSHVCRDVVVQVQGRVFMVDLHVLPLCGADVVLGVQWFKSLGPVLTNYNIRP

SEQ ID NO: 230353 - protein, 110 aa, Glycine max
  Coding DNA Sequence Number=SeqID_113575
MVVRIMIRTRGFGRALGRGIGRGLVRKDEYHADDVPRRRRPTASARRQRVHVTVAEDVPHMAEDAPQMTTEDVAAAVAEGLAGDGAEGSPADDAEGFPGEPKLFPIVRLY

SEQ ID NO: 230354 - protein, 374 aa, Glycine max
  Coding DNA Sequence Number=SeqID_113576
  Gene Ontology: Mol. function=catalytic activity; Biological process =cellular metabolic process
  Homolog annotation: Hit_ID=Q10N92; Match level="QueryCoverage=85%, HitCoverage=67%, E-value=1e-125, Identity=54%"; Hit description =Rhamnose biosynthetic enzyme 1, putative, expressed
  Pfam annotation: Domain name=Epimerase; Domain location=1-138; Score=- 60.7; E_value=0.036; Accession=PF01370.11; Description=NAD dependent epimerasedehydratase family
MKELADQKRRDVSFEVGDIVLWRGLFLEDSSWEKWDELRQNYNLEDKVLGLIILELIACAYISRSYGLPVITTRGNNVYGPNQFPEKLIPKFILLAMQGKNLPIHGDGSNVRSYLYCEDVAEAFEVVMHKVRTTWEEGLKKTMDWYINNPNWWGDVTGALLPHPRMLMMPGGLESHFEGSEEEKPASFGSRWIGGLLGKLCEKQGIPYEYGKGRLEDRSSLLANLQNVKPTHVINAAGVTGRPNVDWCESHKTETIRTNVAGGSKPNFIGSFYSKTKAMVEELLKDYDNVCTLRVCMPISSDLSNPRNFITKISRYNKVVNIPNSMTILDELLPISIEMAKRNLKGIWNFTNPGVVSHNEILEMYRDYIDPNFK

SEQ ID NO: 230355 - protein, 250 aa, Glycine max
  Coding DNA Sequence Number=SeqID_113577
  Gene Ontology: Mol. function=RNA-directed DNA polymerase activity; Cellular component=chromatin; Biological process=chromatin assembly or disassembly
MATEDVSKTAFRTHHGHYEFLVMPFGLYNVPLSFQATMNLTFGPILRKFIIVFFDDILIYNKTFSEHIKHLQIAFQTLKDHSFFLKLPKCSFATQQVEYLGHIVSEQGVEPVPTKVTSVHQWPPPMSVRALRGFLGLSGFYHRFIKGYATLIAPLIALLAKDSFHWTQAADQAFRKLKEAFCTTLVLRLPDFSLPFVLETDALGTGMGVVLSQQHHPIAFFSKSFCPKLLRASTYVRELAAITVAVKKWR

SEQ ID NO: 230356 - protein, 562 aa, Glycine max
  Coding DNA Sequence Number=SeqID_113578
  Gene Ontology: Mol. function=transporter activity; Cellular component= integral to membrane; Biological process=oligopeptide transport
  Homolog annotation: Hit_ID=Q9ZTX4; Match level="QueryCoverage=99%, HitCoverage=81%, E-value=1e-172, Identity=66%"; Hit description =LeOPT1
  Pfam annotation: Domain name=MFS_1; Domain location=138-526; Score= -35.9; E_value=0.014; Accession=PF07690.6; Description=Major Facilitator Superfamily
  Pfam annotation: Domain name=PTR2; Domain location=200-562; Score =371.2; E_value=1.6e-108; Accession=PF00854.12; Description=POT family
  Pfam module annotation: Pfam domain module=MFS_1::PTR2; Domain location=138-526::200-562
MSTLFVEQGTMMNTCIGSFKLPLSTFDVMSVVLWVPLYDRIIVPIIRKFTGKERGLSMLQRMGIRLFISVLCMLSAAVVEIMHLQLAKELDLVDKHVAVPLSVLWQIPQYFFLGAAVVFTFVGQLEFLYDQSPDTMKTLGNECCERLAFFGIATNLVTYLTTKVHEGNVSAPRNVSIWLGTSYLTPLIGAALGDGYWGRYWTIAVFSVGMCTLTLSASLPALKPAECLGSVCPSATPAQYAVFYFGLYVIALGIGGIKSCVPSFGAGQFDDTDPKGRVKKGSFFNWYYFSINLGAIVSSSIVVWIQDNAGWGLGFGIPTLFMVLSVISFFIGTPLYRFQKPGGSPVTRMCQVLCTSVRKWNFVIPEDSSLLYEMSDKRSAIKGSHKLLHSDDLRCLDRAATVSDYESKSGDYSNPWRLCPVTQVEELKIFICMFPMWATGAVFSAVYTQMSTLFVEQGTVMNTNIGSFEIPPASLATFDVLSVVLWAPVYDRIIDNCSQRGISVLQRVTIGNFISVLSMLAAVVVEIMRLRLARDLDLVDEPVAVPLSILWQKTTIRIRGTA

SEQ ID NO: 230357 - protein, 564 aa, Glycine max
  Coding DNA Sequence Number=SeqID_113579
  Gene Ontology: Mol. function=transferase activity; Cellular component= mitochondrion; Biological process=translation
  Homolog annotation: Hit_ID=Q1SQR9; Match level="QueryCoverage=99%, HitCoverage=76%, E-value=0.0, Identity=41%"; Hit description =Tetratricopeptide-like helical
  Pfam annotation: Domain name=PPR; Domain location=116-150; Score =16.6; E_value=0.08; Accession=PF01535.11; Description=PPR repeat
  Pfam annotation: Domain name=PPR; Domain location=151-185; Score =40.3; E_value=6.4e-09; Accession=PF01535.11; Description=PPR repeat
  Pfam annotation: Domain name=PPR; Domain location=186-220; Score =49.0; E_value=1.6e-11; Accession=PF01535.11; Description=PPR repeat
  Pfam annotation: Domain name=PPR; Domain location=221-255; Score =35.5; E_value=1.9e-07; Accession=PF01535.11; Description=PPR repeat
  Pfam annotation: Domain name=PPR; Domain location=256-290; Score =15.8; E_value=0.1; Accession=PF01535.11; Description=PPR repeat
  Pfam annotation: Domain name=PPR; Domain location=322-356; Score =23.1; E_value=0.001; Accession=PF01535.11; Description=PPR repeat
  Pfam annotation: Domain name=PPR; Domain location=357-391; Score =27.5; E_value=4.7e-05; Accession=PF01535.11; Description=PPR repeat
  Pfam annotation: Domain name=PPR; Domain location=392-426; Score =57.4; E_value=4.8e-14; Accession=PF01535.11; Description=PPR repeat
  Pfam annotation: Domain name=PPR; Domain location=46-80; Score=41.9; E_value=2.1e-09; Accession=PF01535.11; Description=PPR repeat
  Pfam annotation: Domain name=PPR; Domain location=475-509; Score =42.6; E_value=1.4e-09; Accession=PF01535.11; Description=PPR repeat
  Pfam annotation: Domain name=PPR; Domain location=510-544; Score =47.6; E_value=4.1e-11; Accession=PF01535.11; Description=PPR repeat
  Pfam annotation: Domain name=PPR; Domain location=81-115; Score=39.0; E_value=1.7e-08; Accession=PF01535.11; Description=PPR repeat
  Pfam module annotation: Pfam domain module=PPR::PPR::PPR::PPR::PPR::PP R::PPR::PPR::PPR::PPR::PPR::PPR; Domain location=116-150::151 -185::186-220::221-255::256-290::322-356::357-391::392-426::46 -80::475-509::510-544::81-115
MERVGVIPHSYCFAAYIEGLCNNHRSDLGYEVLQAFRKGNAPLEVYAYTAVVRGFCNEMKLDEAQGVFDDMERQGVVPDVYVYSSLIHGYCKSHNLLRALALHDEMISRGVKTNCVVVSCILHCLGEMGMTLEVVDQFKELKESGMFLDGVAYNIVFDALCMLGKVEDAVEMVEEMKSKRLGLDVKHYTTLINGYCLQGDLVTAFNMFKEMKEKGLKPDIVTYNVLAAGLSRNGHARETVKLLDFMESQGMKPNSTTHKMIIEGLCSGGKVLEAEVYFNSLEDKNIEIYSAMVNGYCETDLVKKSYEVFLKLLNQGDMAKKASCFKLLSKLCMTGDIEKAVKLLDRMLLSNVEPSKIMYSKILAALCQAGDMKNARTLFDVFVHRGFTPDVVTYTIMINSYCRMNCLQEAHDLFQDMKRRGIKPDVITFTVLLDGSLKEYLGKRFSSHGKRKTTSLYVSTILRDMEQMKINPDVVCYTVLMDGHMKTDNFQQAVSLFDKMIESGLEPDTITYTALVSGLCNRGHVEKAVTLLNEMSSKGMTPDVHIISALKRGIIKARKVQFHK

SEQ ID NO: 230358 - protein, 77 aa, Glycine max
  Coding DNA Sequence Number=SeqID_113580
MVWEKPVWRRVWRTSKVEKEEGGVKGVLDRARVAEENGCQRMLKESLKAQSRMSMERRTTCGGGRGGCFTLQHSARF

SEQ ID NO: 230359 - protein, 876 aa, Glycine max
  Coding DNA Sequence Number=SeqID_113581
  Gene Ontology: Mol. function=nucleic acid binding; Cellular component= oxygen evolving complex; Biological process=DNA integration
  Pfam annotation: Domain name=rve; Domain location=331-503; Score =96.8; E_value=6.4e-26; Accession=PF00665.16; Description=Integrase core domain
  Pfam annotation: Domain name=zf-CCHC; Domain location=190-207; Score =25.9; E_value=5.3e-05; Accession=PF00098.13; Description=Zinc knuckle
  Pfam module annotation: Pfam domain module=RVT_2::rve::zf-CCHC; Domain location=652-876::331-503::190-207
MSEGSSNFVQPAIPRFDGVAVTEAQQKTREDLKLKDLKVKNYLFQAIDRTILEIILEKNTSKQIWDSMKRKYEGNARVKRSVLQSLRKDFETLEMKTGENVTEYFARVMSVANKMRAYGEQIRDDIDVLSIDELQSSLIVHEQKFQKHNGEEQVLKVTSEDRSGAGGRGRGSFRGRGRGRGRQTSNKDTMECYKCHKLGHFQYECPSWDKKVNYAELDEKEEMLLMSYVELNETKCEDAWFLDSGCSNHMCGNKAMFSEINEDFRHLVKLGNNTRMTVLGKGSVKLQVDGFSHVVTDVYCVPELKNNLLSVGQLQERGLVILIKSGMCKIYHPVRGLIIQTSMTANRMYGHPSHKGLRTLQYKKMVQGLPQLPTPTTMCTACVIEKSEAFQSFKYFKNLVEKETGQFIKCLRTDRGGEFNSEKFNEFCKENGIKRQLTTAYTPQQNGVAERKNRTVMNLVRSMLSDKKVPKTFWPEAVNWTMYVLNRCPTFAVRDMTPEEAWSGDKPSVEHFRVFGCVSEKSKGYRLYDPIAKKVVISRDVIFEEEKQWDWDVSYKEQILMHLEWGEEDNGTNENEAEEDGSEGDEIGGNDAEELGNTSSTTTSKDDVNPIEKRETHAPVWMRDYVTGEGLSEEENELNTTLTAPSDPLSYEEALPAGAKKIGVKWIYKTKLNEFGEVDKLKARLVAKGYAQKHGMDYTEVFAPVARMDTVRMIIAVAAQRSWSIYQLDVKSAYLHGELNEDVFVEQPRGYEQKGGEHKVYKLHKALYGLKQAPRAWFSRIEAHFTHEGFQKCISEHTLFVKQNSGGKILIVSVYVDDLIYTGDDEQMMLEFKESMMKVSDMTDLGKMRFFLGIEVLQMDLGIYVCQRKYAQEILK

SEQ ID NO: 230360 - protein, 210 aa, Glycine max
  Coding DNA Sequence Number=SeqID_113582
  Gene Ontology: Mol. function=serine carboxypeptidase activity; Biological process=proteolysis
  Homolog annotation: Hit_ID=Q9M099; Match level="QueryCoverage=58%, HitCoverage=27%, E-value=8e-32, Identity=54%"; Hit description =Serine carboxypeptidase 2 precursor (EC 3.4.16.6) (Serine carboxypeptidase II) ...
  Homolog annotation: Hit description=(Carboxypeptidase D) (Bri1 suppressor 1) [Contains: Serine carboxypeptidase 2 chain A (Serine carboxypeptidase II chain A); Serine carboxypeptidase 2 chain B (Serine carboxypeptidase II chain B)]
  Pfam annotation: Domain name=Peptidase_S10; Domain location=2-196; Score=-218.9; E_value=0.1; Accession=PF00450.12; Description=Serine carboxypeptidase
MGAKYLETVKQRLHAIKQWSPDEIRGENTAEVMTDTGENTLSKKATAIGSYKSILKYCNFIVEETSKKCDHVYSYAVNYEFGNIDQYNIYTRMCTTSQNNTVRHMRFKNLHMISGYDPCTENYAEKYYNLPEVQIAMHANVTNIPYKWNACRFGFSLAILLRKDEQKHCALIYNLQSKSRSSKFYEMTSFNTWLDTRSMESTNHHHDQHS

SEQ ID NO: 230361 - protein, 104 aa, Glycine max
  Coding DNA Sequence Number=SeqID_113583
  Gene Ontology: Mol. function=enzyme inhibitor activity; Cellular component=cell wall; Biological process=cell wall modification
  Homolog annotation: Hit_ID=Q9FLF6; Match level="QueryCoverage=91%, HitCoverage=13%, E-value=9e-17, Identity=55%"; Hit description =Pectin methylesterase-like protein
  Pfam annotation: Domain name=Pectinesterase; Domain location=2-102; Score=-247.1; E_value=0.0065; Accession=PF01095.10; Description =Pectinesterase
MVCNNGGDRCYKTVQEAVNAALANGTKRFAIYIKEEVYEETVRVPLEKRNVVFTCPFPCHVQCPCWCSCFIVDKIVITGNANVGQQGMTTYNSATVGNNNLIVG

SEQ ID NO: 230362 - protein, 301 aa, Glycine max
  Coding DNA Sequence Number=SeqID_113584
  Gene Ontology: Mol. function=transferase activity, transferring hexosyl groups; Biological process=carbohydrate biosynthetic process
  Homolog annotation: Hit_ID=Q5BMA4; Match level="QueryCoverage=95%, HitCoverage=47%, E-value=1e-143, Identity=76%"; Hit description =Secondary cell wall-related glycosyltransferase family 8
  Pfam annotation: Domain name=Glyco_transf_8; Domain location=1-171; Score=89.8; E_value=8.2e-24; Accession=PF01501.10; Description =Glycosyl transferase family 8
MSGSTRDLVILVDETIRQFKGSEKDAYNEWNYNKFRLWQLTDYDKIIFIDADLLILRNIDFLFGMPEITATRNNGTLFNSGVMVVELSNCTFKLLMDHINEFESYNGGDQGYLNEIFTWWHRIPRHMNFLKHFWVGDEEEKKQMKTLLFGADPPILYVLHYLGMKPWLCFRDYDCNWNCDVFHEFPSDVAHERWWKVHDVMPELLQQFCMLKSKQKAQLEWDRRQAEVANYTSGHWQIKVKDTRLKKCIDNLCSWENMLKHWGETNWTDDESHTPTPPAIATSSLSDLRLVNLAFYHPCKC

SEQ ID NO: 230363 - protein, 78 aa, Glycine max
  Coding DNA Sequence Number=SeqID_113585
  Subcellular localization annotation: CTP_CleavageSite=64; ConfidenceScore=5.57e-01
MQKRKKLALTRLQPSSCFSATTNLSPASSLQDVKRLGSSWIGQARCKGRTTKNKARVRVGLAVKVQRKKEERLPRSEL

SEQ ID NO: 230364 - protein, 151 aa, Glycine max
  Coding DNA Sequence Number=SeqID_113586
  Subcellular localization annotation: CTP_CleavageSite=41; ConfidenceScore=5.07e-01
MSGVKFDGTPPVHARPPEPTASQNPSRFVIGGFHEAVSFPKASKENAMLSVLLDCRRGGGGHGGLGWWLGRILKFWCCYVEYLVIIVAVILVWWPSTEKWCQGMGRHEEMVVLDYWIEIWTVGKERVNATWIIKRWKTQVNKGSVRHGRGL

SEQ ID NO: 230365 - protein, 78 aa, Glycine max
  Coding DNA Sequence Number=SeqID_113587
MAEEGAARGGGRRSCARKKELEGGTNGRRRNKKKRKWKKWVLIYSDEDYQKVMQKMLRMRSLSSYPSKIEAQDATFLS

SEQ ID NO: 230366 - protein, 218 aa, Glycine max
  Coding DNA Sequence Number=SeqID_113588
  Gene Ontology: Mol. function=transferase activity, transferring hexosyl groups; Biological process=carbohydrate biosynthetic process
  Homolog annotation: Hit_ID=Q5BMA3; Match level="QueryCoverage=92%, HitCoverage=33%, E-value=9e-69, Identity=58%"; Hit description =Secondary cell wall-related glycosyltransferase family 8
MELRIESTHRVKFISCRQNFVNRWVWGGLDRGYISNVDINWGDILQITAKLTGKKEFQGVGLLNFNNTELDHWEQLIPNVTHVVLELEYAAKNMTWESQYPEWIDEEEETEVPVCPSLPSLRSTGIRLNLIAVKLPHANGGNWSRDVARLHLQLAVARLTTSFKGNYPLYVLFVTNFFPIPNLFTCKELVGHVKGMFLGEKLHLPLGSCELAFPLRGK

SEQ ID NO: 230367 - protein, 508 aa, Glycine max
  Coding DNA Sequence Number=SeqID_113589
  Gene Ontology: Mol. function=pepsin A activity; Cellular component =anchored to membrane; Biological process=proteolysis
  Homolog annotation: Hit_ID=Q8VYV9; Match level="QueryCoverage=94%, HitCoverage=92%, E-value=1e-145, Identity=55%"; Hit description =Putative chloroplast nucleoid DNA-binding protein
  Pfam annotation: Domain name=Asp; Domain location=102-443; Score= -90.5; E_value=2.9e-08; Accession=PF00026.14; Description=Eukaryotic aspartyl protease
MACHRWLCISLLLLLLLSLASQSCHALHSFGFDIHHRFSDPVKEILGVHDLPDKGTRQYYVAMAHRDRIFRGRRLAAGYHSPLTFIPSNETYQIEAFGFLHFANVSVGTPPLSFLVALDTGSDLFWLPCNCTKCVHGIGLSNGEKIAFNIYDLKGSSTSQPVLCNSSLCELQRQCPSSDTICPYEVNYLSNGTSTTGFLVEDVLHLITDDDKTKDADTRITFGCGQVQTGAFLDGAAPNGLFGLGMSNESVPSILAKEGLTSNSFSMCFGSDGLGRITFGDNSSLVQGKTPFNLRALHPTYNITVTQIIVGEKVDDLEFHAIFDSGTSFTYLNDPAYKQITNSFNSEIKLQRHSTSSSNELPFEYCYELSPNQTVELSINLTMKGGDNYLVTDPIVTVSGEGINLLCLGVLKSNNVNIIGQNFMTGYRIVFDRENMILGWRESNCYDDELSTLPINRSNTPAISPAIAVNPEARSSQSNNPVLSPNLSFKIKPTSAFMMALFVLLAIF

SEQ ID NO: 230368 - protein, 66 aa, Glycine max
  Coding DNA Sequence Number=SeqID_113590
MALQGAVFGFCMLEPFGMGNGLWGCCVVMFSYFSFTACEREGQALSLEKSRKGSNGRVKLVYSYRN

SEQ ID NO: 230369 - protein, 172 aa, Glycine max
  Coding DNA Sequence Number=SeqID_113591
  Gene Ontology: Mol. function=metal ion binding; Cellular component =integral to membrane; Biological process=ubiquitin cycle
  Homolog annotation: Hit_ID=Q8GT74; Match level="QueryCoverage=95%, HitCoverage=60%, E-value=2e-37, Identity=60%"; Hit description=RING -H2 finger protein ATL2B
  Pfam annotation: Domain name=Rick_17kDa_Anti; Domain location=47-84; Score=7.2; E_value=0.033; Accession=PF05433.5; Description =Rickettsia 17 kDa surface antigen
MDFAPNPCPLRSSSFVNLVERIKQLGTLAVSAVIGNIFSAILTFCFALVGTLLGALTGALIGQETESGFIRGAAVGAISGAVFSIEVFESSLVLWQSDESGIGCVLYLLDGIPILIEEQDRKTFKECHIDVIVSLLSGRLVRERIGPAMFSAVQSQLMRAQETQFGDMFSFP

SEQ ID NO: 230370 - protein, 63 aa, Glycine max
  Coding DNA Sequence Number=SeqID_113592
MAKKGSFDDLRRPKAKPTTKEGSREFKRAFKLGVGGFHWPLFSLQVMSYWCRTKGLECPCFMR

SEQ ID NO: 230371 - protein, 97 aa, Glycine max
  Coding DNA Sequence Number=SeqID_113593
  Gene Ontology: Cellular component=plastid chromosome; Biological process=positive regulation of transcription, DNA-dependent
  Homolog annotation: Hit_ID=Q2RBI6; Match level="QueryCoverage=75%, HitCoverage=27%, E-value=2e-08, Identity=40%"; Hit description =Expressed protein
MALTTTRWMRTKWRRELDNKKDFDIKYNLFIPVVATIGTGDDNIVVAKSKSFVSMQGWDFDTIFCLVDCDFLIRKPPDPDNDVYDFREVPNPNNTTL

SEQ ID NO: 230372 - protein, 60 aa, Glycine max
  Coding DNA Sequence Number=SeqID_113594
MDDPVVDPNIVHPSNEHFVHEEQQPINEEPDIVNLSPCLDEVHTTNEVDLDEESKAPMSL

SEQ ID NO: 230373 - protein, 45 aa, Glycine max
  Coding DNA Sequence Number=SeqID_113595
  Gene Ontology: Cellular component=plastid chromosome; Biological process=positive regulation of transcription, DNA-dependent
  Homolog annotation: Hit_ID=Q2RBI6; Match level="QueryCoverage=93%, HitCoverage=12%, E-value=1e-11, Identity=62%"; Hit description =Expressed protein
MYVTPLDTNVYSIPKVLAPMPQKYIRCSQSDYGSYNVTKPPIDAP

SEQ ID NO: 230374 - protein, 861 aa, Glycine max
  Coding DNA Sequence Number=SeqID_113596
  Homolog annotation: Hit_ID=O04237; Match level="QueryCoverage=12%, HitCoverage=29%, E-value=1e-35, Identity=70%"; Hit description =Transcription factor
  Pfam annotation: Domain name=HABP4_PAI-RBP1; Domain location=586-680; Score=37.6; E_value=4.2e-08; Accession=PF04774.5; Description =Hyaluronan  mRNA binding family
  Subcellular localization annotation: CTP_CleavageSite=46; ConfidenceScore=5.42e-01
MATPPASPPKSNIQSPTKSRNTRKSTRLRRLTVRALDQPKPTVYVDAAIGRGSGPFKEKFHNYLGVVAREKIPIAHNSWKDVPDTLKDLAKFDIPEALNAKKKVMSTVASRWRQFKCNLMTRFVYGNSEGQHEHDPPVKYDVDKETWEQFAASRKTPNWQGIRKKMQEIQKYNEYPHVLSCGGYDLLEKKMMDEKMKKRQHDAMTTENTPNSGDPPSLIQRHAKWVLARTKQYGQMTSHSAQEISDKIGTFVPHGREGILNTAIGPPDHGGHVRAVGSGVTISQYFGRVARGSSCSSGSISHVQWAEIIGGLQEQWKNEIQPDIHVLGARVSTKGSNAESVVNPCLPNDVAPVEPPMGLYVQRQDSIELVALGKTYDGGSTIHNVAYTDDVVRVSVEQVINSDVEVPFPTSEIKCVRQTLHTFIAWTTPLVKKIFIEHEGSSPTKDTEAVEAVNDVVVDDPLRELIKSLVDIYEKPVELVWDVTKFGIPNAVASLFVTCADVNEIISGVQCLNIVILQLWTIQSDGLGSVYGFLEPQAILNANDRRGQCEEYIEKLLKESNRDAYLGAYLNQPDVHIKAAINNAFKTLETKSDGKFGHNTPRWIEVKVSLNETAKNFGDEKQNPSDEDDVAADGNKENPTNEAEQKEPENKEMTLEEYEKVLEERRKAFHALKTEERKVDTKVFESLQHLSNKKDNDDIFIKLGGDKDKRRETLDKEDKLKNLRAKGRVDEPAVRLYEDMLSVYNNSSDAATELMNDPVIVSTGQENGEESFEELQQLFEDMFQADIGLDGGPSLASSDSSTSSAYMTYSESSSSNKRNSSEMNFGKAENSSVFDAKSASYYISAYVTTDVEVSMFNIVAF

SEQ ID NO: 230375 - protein, 80 aa, Glycine max
  Coding DNA Sequence Number=SeqID_113597
MEREAASSRPSFHNYVAVMFIFSVVTRFACGLAAIDTGLGNGMNAISLVDSAYYSALGILSYRNSAFEIDHIFINQGHTY

SEQ ID NO: 230376 - protein, 92 aa, Glycine max
  Coding DNA Sequence Number=SeqID_113598
  Gene Ontology: Mol. function=ATP binding; Biological process=protein folding
  Homolog annotation: Hit_ID=Q10KY5; Match level="QueryCoverage=50%, HitCoverage=47%, E-value=8e-13, Identity=74%"; Hit description=10 kDa chaperonin, putative, expressed
  Pfam annotation: Domain name=Cpn10; Domain location=2-63; Score=-3.6; E_value=0.0018; Accession=PF00166.12; Description=Chaperonin 10 Kd subunit
MLNSEKVIAVGPGFHSKNGKLIPVAVKEGDTVLLPEYGGTEVKLDNKDLFYTLIQFFNFILKFNMQIKRKMKGRESLTIRACKKDMKWRERN

SEQ ID NO: 230377 - protein, 107 aa, Glycine max
  Coding DNA Sequence Number=SeqID_113599
MSWVVICAPKCKGGLGLRKMMEANLAFMMRAIWQLSSYEMSYVQEMLERNTDVVPINAAGLIRYRWRHPFFAHCCSYERLEILEGLLELLENKECAHWKAKYVSGWI

SEQ ID NO: 230378 - protein, 160 aa, Glycine max
  Coding DNA Sequence Number=SeqID_113600
MEQGENWACSGSQRRKTMGKMENAARGHQTSEPCCERFHPGKHGEKTSMENGKYLMEYSMQMVGYCCPLIIDNNPADDPLSPLSSPFTRSPADILPIVCHLILIQRILPYTSWNSSMMQAPLELVGLGSSSSMDSFASWKMNDSGMEKGKERGDATSRRR

SEQ ID NO: 230379 - protein, 54 aa, Glycine max
  Coding DNA Sequence Number=SeqID_113601
MEVRLVFEEPESGVTVVKLTHTDVPEEDSLNSRRYTLHKGAIRAAPFHAAGCLK

SEQ ID NO: 230380 - protein, 45 aa, Glycine max
  Coding DNA Sequence Number=SeqID_113602
MVLEVIAKAVKMQSKSYCETRRNVHYHQLKLSNKLVDRIEGSSQK

SEQ ID NO: 230381 - protein, 1341 aa, Glycine max
  Coding DNA Sequence Number=SeqID_113603
  Gene Ontology: Mol. function=RNA-directed DNA polymerase activity; Cellular component=chromatin; Biological process=chromatin assembly or disassembly
  Pfam annotation: Domain name=Chromo; Domain location=1257-1305; Score= 14.5; E_value=0.019; Accession=PF00385.14; Description='chromo' (CHRromatin Organisation MOdifier
  Pfam annotation: Domain name=rve; Domain location=981-1137; Score =96.0; E_value=1.1e-25; Accession=PF00665.16; Description=Integrase core domain
  Pfam annotation: Domain name=zf-H2C2; Domain location=922-963; Score =13.0; E_value=0.0067; Accession=PF09337.1; Description=His(2)-Cys(2) zinc finger
  Pfam module annotation: Pfam domain module=Chromo::RVT_1::Retrotrans _gag::rve::zf-H2C2; Domain location=1257-1305::539-708::203-293::981 -1137::922-963
MSKRLQEDWARAAEEGPRVLMNLRTHLLLEVASPLSFPFSIPLSFIFQEAKESIDEEDPRPTSSNGACIIELFQLVYGKIRCFGPQNQSSLPLTFGALVAMPNPPPNPLEVALLKLTDLHASLGETVHNMAQKFDALLLRFPSSPLSSSSANPSTPNFPPVPASQHKMKLDIPRFDGTDPFGWVFKINQYFKYHATPKHDRLTIVSFYMDGRALAWFQWMANNGQFTSWPAFIQALQNRFAPSHYDDPTGSLFKLQQTGTVAQYLSDFEDLANRIVGLPPQFLLSCFISGLSPDVRCEVQALQPLTLVQATGLARLQEEKLLDMQPSLRNRALVVVPVSPRPAPSPALLPLPVSRLPPPCLPPTLKRLSPEEISSRKERGLCFNCDEKYHRGHRCASKVFFLVTEEDEAVDPHIEGIDPSPDPFDIHYPGPAQISFNSLAGQLAPEMLRLIGTVAGTTVVILVDGANIVLGVQWLKMLGPVLTDYNTMSMKFFSEGQLIEFQATPVNMRPYRYPHFQKRKIELQVESMLQKRLIRPSTSPFSSPVLLVKKQDGSWRFCMDYRALNAVTVHDRFPIPTIDKLLDESGKACWFSKLNLLQGYHQIRMDSSDIAKTAFCTHHGHYEFKVMPFGLCNAPSSFQATMNMIFRPFLRRFLIVFFNDMLIYNTTIEEHVTHVEQAFQVLLDNHFVLKLSKCSFAQQQVEYLGHMVSKKGVEPVVAKVEAGYASIASPLVAATTVEPFQWTAAAQLAFDLLKKALFETPGHTIAYFSKPFLPKLQRSSTYVRELFAVMAAVKKWWQYLLGNRFIILTDHPSLKELLTQVIQTPEQHMYLAWLMGYDYQIQFRSAFHLSVAYLVDALLTFLEELRAQLAQNQPYHDRLQAIQSSPTKYPELTITNGLILKRGRIWLPPQLPLITTLLREYHATPTGGHLGIAKTIARVMDNFIWEGLREDVSKFVQSCVDYQYAKYETKRVAGLLCPLPVPHRPWEDLSLDFIMGLPSFQGNTVILVVVDHFSKGIHLGMLPASHMAHVVACLFMNIVGKIHGLPRSMVSDRDPLFISRFWQELFHLRGTQLRLSSAYHPQSDGQTEFLNRVIEQYLRSFVHCRSGSWGKLLLWVEWSHNTTWNAATGSTPYEITFRRKPFNFPEYLTGTSKVDAVDEMLTNREETFLLIRKKLLKAQELMKKYVDRKRREVVYQLGEWVMVEDCVGPVAYRLKLPEGANIHPVFHCSLLKSFKGSSKMTNSAPLPDQVVHNQPLIALLAILDYRQALAGEEAHWEVLVQWSGLPPEETSWERWTQLCEEYHHEDKVHLHGPWNDKQAEGLLSGLKGSSVGLLSMVRGQQ

SEQ ID NO: 230382 - protein, 198 aa, Glycine max
  Coding DNA Sequence Number=SeqID_113604
  Gene Ontology: Mol. function=hydroxymethyl-, formyl- and related transferase activity; Cellular component=cytoplasm; Biological process='de novo' IMP biosynthetic process
  Homolog annotation: Hit_ID=Q1SAA7; Match level="QueryCoverage=97%, HitCoverage=74%, E-value=1e-90, Identity=72%"; Hit description =Formyl transferase, N-terminal
  Pfam annotation: Domain name=Formyl_trans_N; Domain location=48-179; Score=56.7; E_value=7.5e-14; Accession=PF00551.9; Description=Formyl transferase
MTCSSLCDFVFDPVKWPRVQMEEDFLKLSQTFKAIRSVVRVPALDPKYKIAVLASKQDHCLVDLLHGWQDGRLPVDITCVISIDLYAKILSGNFLRSYGNDIINIHHGLLPSFKGGNPSKQAFEAGVKLIGATSHFVTEELDAGPIIEQMVERVSHRDNLQSFVQKSENLEKQCLSKAIRSYCELRVLPYEEKRTVVF

SEQ ID NO: 230383 - protein, 87 aa, Glycine max
  Coding DNA Sequence Number=SeqID_113605
MSSTPEAMSIEPKSSCIYPRPMKFILFYAESSLLLGFSLLPMIQPNTHNKEREQEFECLGFEWWLAKLMLCFAGCLVALRTSALPLI

SEQ ID NO: 230384 - protein, 249 aa, Glycine max
  Coding DNA Sequence Number=SeqID_113606
MVYNMYPFTNAFPPIAKEPKQKGKNKHKKKHRDKRHVVIEPFDREGSKKMKRQMLDFPSTHPLTNILALMNGGFFTNEFFLSCLIDLTHISYHDHLVLNKSDYVANWANFWAFQAQSTVIAQHLQGFLAVSKLKDELKKANDSLVSPLFAHIALVGDNLKLKACVIALELKSKGLETRTMNIKDSAKLSAEEVERLITSLALVEKEKDVEKKGKTQIEQKAYDDVYEAHVYIFHHFFRQVLFHYEVLDE

SEQ ID NO: 230385 - protein, 446 aa, Glycine max
  Coding DNA Sequence Number=SeqID_113607
  Gene Ontology: Mol. function=nucleotide binding
  Homolog annotation: Hit_ID=O23508; Match level="QueryCoverage=89%, HitCoverage=43%, E-value=1e-180, Identity=76%"; Hit description =Growth regulator like protein
  Pfam annotation: Domain name=DUF246; Domain location=25-368; Score =771.2; E_value=6.2e-229; Accession=PF03138.5; Description=Plant protein family
MLWHHLPAISNTSAVRERKSKGYLLIATSGGLNQQRNGITDAVVVARILNATLVVPELDHQSFWKDDSDFANIFDMNWFITYLAKDITIVKRVPDKVMRSMEKPPYTMRVPRKSEPEYYLDQVLPILSRRRVLQLTKFDYRLANNLDDELQKLRCRVNYHALRFTKPIRELGQRLVMRMRKMASRYIAVHLRFESDMLAFSGCYFGGGEKERRELGEIRKRWTTLPDLSHDGERKRGKCPLTPHEVGLMLRALGFTNDTYLYVASGEIYGGDETMQPLRDVFPNIYTKEMLAQKEELKPFLPFSSRLAAIDYIVCDESNVFVTNNNGNMAKILAGRRRYMGHKRTIRPNAKKLSALFMSRHEMDWDTFASKVKACQRGFMGEPDEMRPGRGEFHEYPSTCVCEKPFMDDLSQDGFRPPKLAANNVTVNGGGNEESVRKRSGRMAST

SEQ ID NO: 230386 - protein, 73 aa, Glycine max
  Coding DNA Sequence Number=SeqID_113608
MRQKCQHFRKYSSLVEQPEDVKELRCAGVLSNELGSDKEMENLFNKLNVLLVPETAAFALIRDQIEVHFKSKR

SEQ ID NO: 230387 - protein, 109 aa, Glycine max
  Coding DNA Sequence Number=SeqID_113609
MLVVDGCSVLQALDKSLDSDYPEKELKRSAGQQLRLHHDLFLLVNQIPYQLLKLLCGDKARLNRSMHNFLLVHGIDQASSGEGSIEQEHYITVEEDEQGKEEPVHLLGT

SEQ ID NO: 230388 - protein, 287 aa, Glycine max
  Coding DNA Sequence Number=SeqID_113610
  Gene Ontology: Mol. function=carboxypeptidase activity; Cellular component=membrane; Biological process=auxin mediated signaling pathway
  Homolog annotation: Hit_ID=Q9FGL0; Match level="QueryCoverage=92%, HitCoverage=71%, E-value=2e-77, Identity=55%"; Hit description =Nodulin-like protein
  Pfam annotation: Domain name=DUF6; Domain location=132-262; Score =21.0; E_value=0.0042; Accession=PF00892.11; Description=Integral membrane protein DUF6
  Pfam annotation: Domain name=TPT; Domain location=123-262; Score= -30.7; E_value=0.035; Accession=PF03151.7; Description=Triose -phosphate Transporter family
  Pfam module annotation: Pfam domain module=DUF6::TPT; Domain location= 132-262::123-262
MTNRNPRGITSYREQERIRERVTLFQSLFLKGINLTSPAMGTAMPNLAPGLIFIIAWIFRLEKVDLSCTYSRVKIIGTFLCVLGALTMSILQSISTTPITAKEGTIQLLSPPNVTFDRHKIIGCLYLLVAILILSSNIVLQAFTLGDFPAPMSLCAITSFFGTFMTAAVQLVEDHEFKTGWPIVGVGDMIAYSLLAGAVNGICLSVNGWALEKRGPVLISMFSPIGTVCSVIFSVVTLGQTINIGSFAGMFLMFTGLYFVLWAKGKEGFAKGGGLESEYDAEKPLLS

SEQ ID NO: 230389 - protein, 102 aa, Glycine max
  Coding DNA Sequence Number=SeqID_113611
MWWSLEEREIIFEFGGREVKECEEEFYGFVDVFGREGPCRVLGLGINRCQQRTGDCSCRSRRKSSAGGGCEFLLQDFFKIKPCLTMKGFKSFKAHVIDYQYM

SEQ ID NO: 230390 - protein, 176 aa, Glycine max
  Coding DNA Sequence Number=SeqID_113612
MISITNLILMFSTGSLASYVTGISRALHHLVLPKYATLNLDEVQGLHQVNVEVTSYFNGQLHGNRIWIGPGACHDKDVFFDLFTGESDPEFPLLFLHTTRCAQEPAKPQQLRCGVVVVVAAAVVEFSVVGGVVVVSRRSGADLKWALGRSVDLQGCKFHGFCTALSCAALKRCRRE

SEQ ID NO: 230391 - protein, 92 aa, Glycine max
  Coding DNA Sequence Number=SeqID_113613
MDANSTLFCLKHLQKPLIQVNHFNYSQIPSEISKLSQLRRYYVSTYRLSDYHHIVEIQARHRESQKVSNSLLGIVITADKRTLSISHKQGTL

SEQ ID NO: 230392 - protein, 98 aa, Glycine max
  Coding DNA Sequence Number=SeqID_113614
MRNLKFDIGKCTKRIYRTRNYNAGDGIESSLTEFEVKSQMRIGKGSSGYLRNGVVRLRFRAVEIDGGGNNGVESERRAITMFEREKPVVCMRRMENDE

SEQ ID NO: 230393 - protein, 285 aa, Glycine max
  Coding DNA Sequence Number=SeqID_113615
  Pfam annotation: Domain name=PPR; Domain location=184-218; Score=5.8; E_value=1.5; Accession=PF01535.11; Description=PPR repeat
  Pfam annotation: Domain name=PPR; Domain location=39-73; Score=17.6; E_value=0.045; Accession=PF01535.11; Description=PPR repeat
  Pfam module annotation: Pfam domain module=PPR::PPR; Domain location =184-218::39-73
MSIPKREGHGLRSQTTNMTKVELTKVVLDSNIPNKSLNEIKSVLVSALASHGQLSEALLVYEEIKKAGHNLEPKAVITLIEEFTKFNGELDGLLLLLEEMNDVDYWVDGCFKVIMYCIRNKNLSSTILLFKQLKDKFKNDDLVMEALFDAVFSLIASSESSHLQIGLDLLWAIKDELGLMPSRQCLDFLLSACANAGDLNNARLIWREYEVAGFPYNVLSYLRMYQALLAAGDDRSAHFMLKKIPQDDAEVCSVIIACQETYNDLNSVEEKKKQGKRKKKKERKE

SEQ ID NO: 230394 - protein, 212 aa, Glycine max
  Coding DNA Sequence Number=SeqID_113616
  Gene Ontology: Mol. function=nucleic acid binding
  Homolog annotation: Hit_ID=Q1T555; Match level="QueryCoverage=53%, HitCoverage=77%, E-value=3e-09, Identity=31%"; Hit description=RNA -binding region RNP-1
  Pfam annotation: Domain name=RRM_1; Domain location=62-132; Score =42.4; E_value=1.5e-09; Accession=PF00076.12; Description=RNA recognition motif. (a.k.a. RRM, R
MERESRKRNSGWERVRSRREKRESARARTTEGSGLTIEGRTTGQDHSYMRANWRDHRDITSFYFTRFPEDATAEDLWHHFKQTGDVREVFIPRKRNRQGRRYGFVRFKGVRDIQQIQKKLDSMIFGGMKMYVNVPKYGRAKKEEPQTEEGGRTEARQQQQGKKDMYLSRNAETKVGVQRGSYADMVTRNNQRAEQRRVPVKVSDNSHNSTSE

SEQ ID NO: 230395 - protein, 75 aa, Glycine max
  Coding DNA Sequence Number=SeqID_113617
MAVASLHIEKVVKLEMKCMVPLGGSPSPSFLRCSSNCTRRKKVWVAVINAIWYHCNNVVFRVGVVDVEEIQHMSS

SEQ ID NO: 230396 - protein, 394 aa, Glycine max
  Coding DNA Sequence Number=SeqID_113618
MGDDMVLLLGLTDTKAEQLIQEEIHETPPLFYTLQKWNPSLCPGYGLTWVQCWGIPLLAWDTMQIKKIVVEVDDDVDERRRLDRARVLIKTPWKPAIQHTLNVYIDSEVYEVRILEECGYSTDICHCRRSSVMVSPEEIDSDGSFMGSPIKERTHASEKDDAARDTETPATTRAHYGAIAEPIAEVTKTSARNYLVVKTKYNDHWVIVISCGHTRYKEGHEVGELSWKEKEARDPMWKRKLVQMSWAFLFTPLLKPQHPMVPAHKLITQLQLPLGRCILKLGAHNTESRLNITSTQQQQNKISAQQQQVTDRDKGGKGYNHNLVHREVLSVQDAVEDASLGENNMQHATKIWEIAKHLGATGAADQGRIIGKIMTMEERDRKEAKRLGNRSDNP

SEQ ID NO: 230397 - protein, 164 aa, Glycine max
  Coding DNA Sequence Number=SeqID_113619
  Gene Ontology: Mol. function=protein disulfide oxidoreductase activity; Cellular component=chloroplast; Biological process=cell redox homeostasis
  Homolog annotation: Hit_ID=Q84Z96; Match level="QueryCoverage=58%, HitCoverage=58%, E-value=2e-36, Identity=72%"; Hit description =Glutaredoxin protein family-like
  Pfam annotation: Domain name=Glutaredoxin; Domain location=82-145; Score=71.1; E_value=3.6e-18; Accession=PF00462.14; Description =Glutaredoxin
  Subcellular localization annotation: CTP_CleavageSite=58; ConfidenceScore=5.87e-01
MALGLGNAVALPISNLKPSLKLSSSSFTKLLFSYSRPFSCINVSPPMPNRIPTLAVVRAFSSSSFRSCLEDTIKKTVAENPVVIYSKTWCFYSSEMKILFKKLGVDPLVFELDELGPQGPQLQKVLERITGQHTVPNVFIGGKRIGGCTDTLKLYRKGELEPLL

SEQ ID NO: 230398 - protein, 109 aa, Glycine max
  Coding DNA Sequence Number=SeqID_113620
MQTRFILVRPLHVPMSSPQATHLRFILVRPLHPQSPELEATKHPKRIHLKFLPPYNLLRCFPQKNNVKGVSTSSAVTETRSHEASKAHTSQIPPSISSPTLFSSDEQRI

SEQ ID NO: 230399 - protein, 598 aa, Glycine max
  Coding DNA Sequence Number=SeqID_113621
MKMFVNRPKFERRKAVRLNIKDDCQPDNGKPQRVINYEERLQRTSTTDGRLRSYAEVVKTSSMGDGALHNQGADSSQPSMAEHRPPAVITTNMEQNKWIQQAWVGRLKNRGMFERLEDELKWVLDPEVTPCYWGDDWIILHNMEDTKATRLVKEEKTYGSTPILDLQKWSQDIRPSHRLAWILLWGLPPSAWDSECMGKVVEGVGEMVEVDDYVERRRRLDVARILIRTAMKPGIRTELQAVIDGTEIALHVIEDMSCLGTTRDQQRMGSWLPPSPLSTEPNSPVSDGTDIFGIDSILEFPEDGPEDDGVGVSTAERRVRDTQTCCDQWTQTTGRCGLDRSFTANDDVDASHDDNAVLKNYPTVEGLARSHETGVGQNGLQQGTLNASGNRREKFPLRAPLRHLEQHAGQQRNPNEETSADIDHYSEKKQEQKHRNVACPPTPPAMTDNRDNISPHQHETNMAKGDMGLRPPGPIPGSAETKFYVRRRKIIKGLRETAHINQVLPEEHLTPLTMVPTTKGTSQTGHITTASLLELNSTKQDLCFGEPNPYILESQCALIEEMGLTHGDNSRKLREMMSDMEKRDSNLAVEMGIKQAQP

SEQ ID NO: 230400 - protein, 1332 aa, Glycine max
  Coding DNA Sequence Number=SeqID_113622
  Gene Ontology: Mol. function=DNA binding; Cellular component=beta -galactosidase complex; Biological process=DNA integration
  Homolog annotation: Hit_ID=Q1SD84; Match level="QueryCoverage=98%, HitCoverage=92%, E-value=0.0, Identity=45%"; Hit description =Integrase, catalytic region
  Pfam annotation: Domain name=rve; Domain location=455-618; Score =167.3; E_value=4e-47; Accession=PF00665.16; Description=Integrase core domain
  Pfam module annotation: Pfam domain module=RVT_2::rve; Domain location=893-1132::455-618
MADSSSATSDDQNKEKEIVAPKDLQGKLRYLNGERPKPDTADPQYAVWDAENSMVMTWLVNSMEEDISSNYMCYSTAKELWDSVTEMYSDLGNKSQIYELTLQAREIRQGGNNVTKYFHSLKRVWQDLDLFNTYKWNSAEDAKNHQQTVEEETTALKSSTNQKNFSNLWCDHCNKPRHTRKTCWKINGRPAHLKSNKSGPKVHRPFPTAHEAEKTSLRKEQVEELIRLLNSKFLSGTPSGSVAQTGKRDITLSKNIDLKNVLHDRTSGKMIGSAKMMDGLYYFENTFKNKEARGLSGMSSVPSGSVAQTGKRDITLSKNIDLKNVLHVPKLTYNLLSVSKICTDSHCSVKFFDTHCVFQDRTSRKMIGSAKMMDGLYYFENTFENKEARGLSGMSSVPVRDQIMLWHKRLGHPSFQYLRHLFPNLFKNVDCSSLECESCVLAKNQRAPYYSQPYHASRPFYLIHSDVWGPSKITTQFEKRWFVTFIDDHTRLCWVYLMHEKSEVPNIFKLFSQMIETQFDTKISILRSDNGTEYFNKNLNEFLKNKGIQHQSTCLNTRQQNGTAERKNKHLLEVARAIMFESNVPKYLWGDAVLTATYLINRMPTRVLNYRTPLDTFKTIFPACRLHTEMPLKVFGCTVFMHTPSISRSKLDPRAEKYIFVGYSPNHKGYRVFNPITKKLCVSMDVTFLEHQPFFQKNSLQGENDNVSEDNFLHLHEPLPIPVVHTENTDFIDQTNENKLHNKEDHVETSPEFSKGNPMPDLGGAQAGKEIPQSNKECHVYTRKYPKRIKEQPIISAPNQAEHPEEGQGEIPRESRGNTEIPASTIELPIAIKKGTRSCTQNSKKATTNHPISQYVSYKNLSQNHRAFTSKITNLFVPRNIEEALDDPNWNLAVLEELNALKKTGTWELVDLPRDKKQVGCKWVFTIKCKADGSVERYKARLVAKGFTQTYGVDYQETFAPVAKLNSVRILLSLAANCNWPLHQLDVKNAFLNGELEEEVFMSLPLGFEELGRNKVCRLKKSLYGLKQSPRAWFERFGTVVKGLGYIQSQADHTLFYKHSTNNKIAILIVYVDDIILTGDDSLELKNLREKLAKAFDIKELGPLKYFLGIEFARSKEGLLGCKAAETPMEPNLKLQSAETENMVDKGRYQRLVGRLIYLSHTRPDIAFAVSMVSQFMHAPGHEHLEAAFRILRYLKGSPGRGLYKNHGHLQSVVARSSAEAEFRALAHGICETLWVKKLLQELKVHSSPPIKLYCDNKSAISIAHNPVLHDRTKHIEVDKHFIKEKIERGQICITYIPTTEQSADILTKGLPKKSFDNITSKLSMEDIFKPA

SEQ ID NO: 230401 - protein, 97 aa, Glycine max
  Coding DNA Sequence Number=SeqID_113623
MIPSFTPGLKLEKEGNCRIPMHHCTLPGQQCWPDKKNYREVEETSHLGSQKNFEEFPVATYLQSNNGKMHSAFIFRDPILVVEVELDASTKDLSWPL

SEQ ID NO: 230402 - protein, 127 aa, Glycine max
  Coding DNA Sequence Number=SeqID_113624
MEIKSWWSARVQLRQVRSEIKSFLATQNRAEEATQSPLSLSLSLSLSLSLSIWEEQSRRSNTEQNHQTHSKPPMLRSSGAKNRSATRSATIAAAPAATRNRPATHVYVADGCRSALPRHYSGRYGRY

SEQ ID NO: 230403 - protein, 73 aa, Glycine max
  Coding DNA Sequence Number=SeqID_113625
MPMRRENTTLKMPGLLNTNDHHDRKTQSPDAEEEDDAHDGNATQRTEVKHNSILPLAALKHISMFWTTGKRHS

SEQ ID NO: 230404 - protein, 274 aa, Glycine max
  Coding DNA Sequence Number=SeqID_113626
MVTTTIGGVSKSESSFVSTMSQKLCKTVFKNGMQITWDILDKSYMGAYKLKKMLTLTNQMKTCGEKLEDLTIIDEILRILLSPRFDHIVGKKLPRKEDEAQSAHDEGSDSNNVMLMTTTNLEGDNSNLWYLDTCYSNLKTGQRKWFVNLDEKQRKTAPLSKNRTFEIWIQIMEHQCLATAISDESWARHHRIVAMNLENDQDKESSVSTRNHPRKSQMERHMPQMLNDNFEIFPDATITVEGDLVKFALFSETELVSFEQALQVSNWVATMEEE

SEQ ID NO: 230405 - protein, 183 aa, Glycine max
  Coding DNA Sequence Number=SeqID_113627
  Pfam annotation: Domain name=GRP; Domain location=68-132; Score= -11.7; E_value=0.0011; Accession=PF07172.2; Description=Glycine rich protein family
MDYITIGGGGDNNNGGEDGGGSCVDDNSGGGCTSNDNGDDNGGDGGGCGDDNDSGGNGGCSSNNGDPLLVVIAMVMMVVAVVTMVTIMAMVVTMTIMTVSDGNKAGGGCYDGNGDEGGGGCYGSDGGYGDNGRVVVVIVMTRAMVAVVAAAEITVSGGNDDDGGGGCDSYMEVFLTLVEEKKI

SEQ ID NO: 230406 - protein, 131 aa, Glycine max
  Coding DNA Sequence Number=SeqID_113628
  Gene Ontology: Mol. function=protein serine/threonine kinase activity; Biological process=protein amino acid phosphorylation
  Homolog annotation: Hit_ID=Q49N12; Match level="QueryCoverage=79%, HitCoverage=11%, E-value=4e-30, Identity=55%"; Hit description =Putative receptor-like protein kinase 2
MMGVFSGFPLLFLLPFCFASLAFGATLPEDEVQALRDIAHTIGKKNWNYSVDPCTGKSNWNSSEKNVVTCNCSFVNHTCHVVSIILKEQNLSGIISADLVRLPYLQQIDFTRNYLNGTIPKQLGTLNLVNM

SEQ ID NO: 230407 - protein, 194 aa, Glycine max
  Coding DNA Sequence Number=SeqID_113629
  Homolog annotation: Hit_ID=Q1T010; Match level="QueryCoverage=47%, HitCoverage=7%, E-value=4e-10, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MWRMSVSTNWCVELCSFPGTRSFFPKMISHNENFPASLSILNDGVQERGRNPLMGKGKLIMIQTRNMMQITWDILDKSNMGAYKLKKGKKLPRKEDEAQSAHDEGSDSDNVMLMTTTNLEGDNSNLWYLDTCYSNHKTGQRKWFVNLDEKKVLTRWWFKEEMDNDPSSIMCSMFPTRRTICLVLGSYIFEKGYM

SEQ ID NO: 230408 - protein, 127 aa, Glycine max
  Coding DNA Sequence Number=SeqID_113630
MAKSMMKRKEMSHYFWGEAVSIASYILKRSPIRRQKETPPEEAWTVAMNLEDDQDRESSVSTRNHPGKSQMERHMPQMLNDDFEMFPHATITVEGDLVKVALFSETELVSFEQALQVSNWVATMEEE

SEQ ID NO: 230409 - protein, 104 aa, Glycine max
  Coding DNA Sequence Number=SeqID_113631
MPKSASPSLSKAEVVVIAKAKQRSLANAKRRARIEKAMKIKAEVEVAKKVVILEGHASEEIPKEVIIESLKTMIGEEELKKATASDQVLEEVVLDAIIVVFEDE

SEQ ID NO: 230410 - protein, 85 aa, Glycine max
  Coding DNA Sequence Number=SeqID_113632
MNNDTYLEVAAMASLTIHVTCFGTDADKATNRPLTQAYRRRKKGKGQLNQAKRGMEQSLVEEREGKITERTGGMRGVKKGDSATD

SEQ ID NO: 230411 - protein, 131 aa, Glycine max
  Coding DNA Sequence Number=SeqID_113633
  Gene Ontology: Mol. function=protein serine/threonine kinase activity; Biological process=protein amino acid phosphorylation
  Homolog annotation: Hit_ID=Q49N12; Match level="QueryCoverage=79%, HitCoverage=11%, E-value=8e-29, Identity=54%"; Hit description =Putative receptor-like protein kinase 2
MMGVFSGFPLLFLLPFCFASLAFGATLPEDEVQALRDIAHTIGKKNWNYSVDPCTGKSNWNSSEKNVVTCNCSFVNHTCHVVSIILKEQNLSGIISTDLVRLSYLQQIDFTRNYLNGTIPRQLGTLNLVNM

SEQ ID NO: 230412 - protein, 159 aa, Glycine max
  Coding DNA Sequence Number=SeqID_113634
  Gene Ontology: Mol. function=RNA-directed DNA polymerase activity; Biological process=RNA-dependent DNA replication
  Homolog annotation: Hit_ID=Q1T0R3; Match level="QueryCoverage=28%, HitCoverage=22%, E-value=3e-09, Identity=58%"; Hit description =Hypothetical mitochondrial protein atmg00310
VLKKVTDKLVSFQRRFLWGGDYEQKKIAWIKWETICLPKEDGGLGIKDINSSNLSLLVSGLTSATWGYNEEHNIMEENQDGAFEELWKLQVPTKIVAFAWRLLKDRLPTRLNLRRRQIEQDNSGMVEIVVMDEYGGCFPTSPKATFSPTHSWSDRGNEG

SEQ ID NO: 230413 - protein, 51 aa, Glycine max
  Coding DNA Sequence Number=SeqID_113635
  Homolog annotation: Hit_ID=Q49N12; Match level="QueryCoverage=90%, HitCoverage=4%, E-value=1e-10, Identity=70%"; Hit description =Putative receptor-like protein kinase 2
MNRKLEFNQLSGSLPLELGNLAQIEKLHLTSNNFTGELPATLARLTTLKEL

SEQ ID NO: 230414 - protein, 47 aa, Glycine max
  Coding DNA Sequence Number=SeqID_113636
MWMIHFFEATLNNVLVIKSMMRCFELMFDLKESLLMLTLGERKHGSP

SEQ ID NO: 230415 - protein, 43 aa, Glycine max
  Coding DNA Sequence Number=SeqID_113637
MTGTKVLYLGQQGIRSEGQPKELPKWLGWGLYGPLIWCRNSME

SEQ ID NO: 230416 - protein, 714 aa, Glycine max
  Coding DNA Sequence Number=SeqID_113638
  Homolog annotation: Hit_ID=Q6F3A8; Match level="QueryCoverage=44%, HitCoverage=26%, E-value=7e-17, Identity=30%"; Hit description =Putative cell wall protein
MGFFGTEAVQEVRDHHQETALIEEQIANESSAKQVVGETSVQINCSDGDGLTELEKLLKQKTFTRSEIEHLTELMRSRTVGSSVVEEGTSTEVVPSDPILPREQKEEYPKTPDPENAIENQLVSTPYVTKAISTVSVDDVASPAELAKAYMGSRPSKLSPSMLGLRSSPREDPFLLKNQHVAQKSPVKSIVPKATNLARVHENGFVTPRSHGRSAIYSMARTPYARVYPGSMSKGAGVAVEGDPSSSAQHVIDHDMLSGSKHGVLKRRSSVLDNDIGSFGPIRRIRHKSNLLSTKSLTLPYSGNALAIDRSGVGIDAAQQPSSSMQKPNLLGEAKHRHTKLSAENVDDIMPRTSIPPLPSKSSEMASKILMQLDKLVSPKEKSPTKLSSSMLRGQALRSMETVDSSKFLDNVWDNGLDGTHGNLSAGAQKLKSKIDETESGQSKLVAPTDVLVPVDAYATAPKKQDISILKSGDSSGTKSNSHPPQKKRAFHMSAPELTELDYLELDDDALPNGAVSPFSTSGKETTVSTAVADKTISAVETAVLEKPPGSSVLMPSKSFTIDGKPQVRTADWSKVEKKVDVPTSITSSVSDPIFKPITAASNTSLGFNQSTTPNGSVANPPLFNFGNKVVPSMELTAADAPPQDSTKSGSLFGLEKVPLSKEPGTDAPFVNSGFNKNVGNVSQVPVTFSSSVGESAVFKFGSSSDSKPISSIR

SEQ ID NO: 230417 - protein, 60 aa, Glycine max
  Coding DNA Sequence Number=SeqID_113639
MEVKSMTHLVKPFSEQVAEGPVKPVDMLDPDIDMRYLMTLIIPKLFLKSLQVSRDASVFG

SEQ ID NO: 230418 - protein, 158 aa, Glycine max
  Coding DNA Sequence Number=SeqID_113640
WARVADLVLEIKRELLDFMSFGVGSMDDHWIVQCPLNNKSERSACVIRFWILDGFAAEGFVSTGNHGQRGVSKSDESSGNVTVSFFKSMGEKSDREDDSDKEQISKGGDVRDMRKVGWVSLTSRRGKGLLQPFHGSFKGYKDKLFIVKDGKGLSSFVY

SEQ ID NO: 230419 - protein, 154 aa, Glycine max
  Coding DNA Sequence Number=SeqID_113641
VVASVINDARLRKLSRRKEKVTTFNAGATVKQHSIIDFSLSRVVEERNKRRKHNDSIDREVNSRSKLHLLQTQFSFPIIDGDVSWHEAFAFEEFEGEEGVRSIWSKTFPIREILDQNFVGVSDLAKLDKVGFSDTYKALQHIGVGVGVMSCLME

SEQ ID NO: 230420 - protein, 297 aa, Glycine max
  Coding DNA Sequence Number=SeqID_113642
  Gene Ontology: Mol. function=protein binding; Cellular component =integral to membrane; Biological process=G-protein coupled receptor protein signaling pathway
  Homolog annotation: Hit_ID=Q7XAB8; Match level="QueryCoverage=97%, HitCoverage=97%, E-value=1e-113, Identity=71%"; Hit description =Protein THYLAKOID FORMATION1, chloroplast precursor
  Subcellular localization annotation: CTP_CleavageSite=49; ConfidenceScore=5.56e-01
MAALTSLSFSAVTHCSERKVTLSSTRFLASSSELFGFRTDFSYHYVGVRASNSASKMVVQCMSSATDVPPTVSETKLNFLKAYKRPIPSIYNTVLQELIVQQHLMKYKRSYRYDPVFALGFVTIYDKLMEGYPSDEDRDAIFQAYIKALKEDPEQYRIDARKLEEWARVQSPTSLVEFSSKEGEAERILKDIAERAGGKGEFSYSRFFAVGLFRLVELANATEPTILDKLCAALNINKRSVDRDLDVYRILLSKLVQAKELLKEYIDREKKKRDERVEPQKANEAITTCLGQQLHGL

SEQ ID NO: 230421 - protein, 60 aa, Glycine max
  Coding DNA Sequence Number=SeqID_113643
  Gene Ontology: Mol. function=diacylglycerol kinase activity; Biological process=protein kinase C activation
  Homolog annotation: Hit_ID=Q9FVC9; Match level="QueryCoverage=95%, HitCoverage=11%, E-value=7e-19, Identity=74%"; Hit description =Diacylglycerol kinase variant B
MDAQVSYAFHSERKMNPEKFKNQLVNLSTYAKLGCTQGWFFAPLFLPPSSKFAKPSNIGG

SEQ ID NO: 230422 - protein, 123 aa, Glycine max
  Coding DNA Sequence Number=SeqID_113644
  Gene Ontology: Mol. function=diacylglycerol kinase activity; Biological process=protein kinase C activation
  Homolog annotation: Hit_ID=Q9C5E5; Match level="QueryCoverage=95%, HitCoverage=24%, E-value=2e-34, Identity=65%"; Hit description =Putative diacylglycerol kinase
MPDMALFCLLQMEMELALLRIRFEFHKGAAEYTFMRIDGEPWNQPLPVDNDTVLVEISLHGQVNMLATHDSKSKSVNDPSSPHHNDVEEDDSDDEEAKADEFRKFGTADTFKIPDEVDHAHLS

SEQ ID NO: 230423 - protein, 88 aa, Glycine max
  Coding DNA Sequence Number=SeqID_113645
MVKGWKKKKVKATGVSLSEAYALSEDHPLSEALSSLSELRGSGRESAIHARAQCAISSLSESFVSSGTQRTQLAKPKVTNLRLTRKWR

SEQ ID NO: 230424 - protein, 92 aa, Glycine max
  Coding DNA Sequence Number=SeqID_113646
MGLLDHPLTPSRVWGWHGKINSNYRYLWVLTYEAQGHLVVALPPSLVLHEDGDDPGTAIISWEWLAQDGGWRWVYSEGRIWGTMVGQHAHFP

SEQ ID NO: 230425 - protein, 65 aa, Glycine max
  Coding DNA Sequence Number=SeqID_113647
MGLDLLNVPATMILRQESKVKNCVAQDSDDDELCYLVFLADCRDSTPELSFPSRYFGNCGNDQEE

SEQ ID NO: 230426 - protein, 64 aa, Glycine max
  Coding DNA Sequence Number=SeqID_113648
MFNQTLTPTKTSRLEELEMTLKRIPKLSHLTLMGGPGPCSSAMQGQHVRAPVASYYNGPSPSKN

SEQ ID NO: 230427 - protein, 469 aa, Glycine max
  Coding DNA Sequence Number=SeqID_113649
  Gene Ontology: Mol. function=acyltransferase activity; Cellular component=nucleus; Biological process=regulation of transcription, DNA-dependent
  Homolog annotation: Hit_ID=Q69FA1; Match level="QueryCoverage=98%, HitCoverage=98%, E-value=1e-137, Identity=52%"; Hit description =Anthocyanin acyltransferase
  Pfam annotation: Domain name=Transferase; Domain location=2-462; Score=22.8; E_value=4.7e-12; Accession=PF02458.6; Description =Transferase family
MAQVKILEQSEVGPPPCSLPSTTLPLTFFDIPWFYCHPIQRIFFYDFPHPTHHFLQTALPILKHSLSLTLQHFFPFSSNLIVPPQQPHLSHIRYLDGDSLSFTVAESTADFTLLTSDSPQDVPNWHPLVPAFPTPRVDQDGARVFPLMAIQVTIFPKSGFTICLTFNHLASDGKSLHHFIKFWASLCKAKGNMASLQTSLSLPSHERDKVKDPKGLKLIYFQELEHPESRNMEFAGLVREVSSNKVRFTVALSREQVEKFKKWVSLKCASYTSDETLHISTFVVTCSLIWVCMIRLEESKGNYVAQDYAEFCHLVFLADCRGRPEFSLPSTYFGNCLTTCFVAMKRSEIVGENGIIGVAKAIERQIRDLKSDALRNAERLMSYYRELGKPGKSVLVVAGSPKLGVYHTDFGWGKPKKSEAAHIESSGSISLSDCRDENGGIEVGLALERIQTNNFFNILEEQLNNINKF

SEQ ID NO: 230428 - protein, 324 aa, Glycine max
  Coding DNA Sequence Number=SeqID_113650
  Homolog annotation: Hit_ID=Q2LME6; Match level="QueryCoverage=39%, HitCoverage=34%, E-value=6e-69, Identity=91%"; Hit description=MYB18
  Pfam annotation: Domain name=Myb_DNA-binding; Domain location=14-61; Score=46.7; E_value=7.8e-11; Accession=PF00249.21; Description=Myb -like DNA-binding domain
  Pfam annotation: Domain name=Myb_DNA-binding; Domain location=67-112; Score=49.3; E_value=1.3e-11; Accession=PF00249.21; Description=Myb -like DNA-binding domain
  Pfam module annotation: Pfam domain module=Myb_DNA-binding::Myb_DNA -binding; Domain location=14-61::67-112
MGRAPCCDKNGLKKGPWTSEEDLLLTNYIQTHGPGNWRTIPKNAGLQRCGKSCRLRWTNYLRPDIKRGRFSFEEEEAIIQLHSVLGNKWSAIAARLPGRTDNEIKNYWNTHVRKRLLRTGIDPVTHAPRLDLLDISSILRSAIGNVNPSILNLQGLLGAQALMNPEFLKLAATATLLSLKNNENPSNLVSQVQQQFNSAGNCLVQNQVAAPNDPFQTPTHVNNGLSSSSPENSILSHLGENNNYQLNAQQINQVDLLLDHELEHYLNCVNQNIGYESVTPLSTPTPLNSSSTYVNSSTEEERDTYCSDIFKLEIPESLDISDFL

SEQ ID NO: 230429 - protein, 61 aa, Glycine max
  Coding DNA Sequence Number=SeqID_113651
MAHGYHRFGHGAYYGHGKFKHGKYGKRWKHGRTTSKSIEAYAPDVGLKFVFLFAIYLVLLV

SEQ ID NO: 230430 - protein, 474 aa, Glycine max
  Coding DNA Sequence Number=SeqID_113652
  Gene Ontology: Mol. function=transferase activity
  Homolog annotation: Hit_ID=Q1T1Y8; Match level="QueryCoverage=93%, HitCoverage=94%, E-value=1e-138, Identity=55%"; Hit description =Transferase
  Pfam annotation: Domain name=Transferase; Domain location=1-453; Score=-8.2; E_value=1.5e-10; Accession=PF02458.6; Description =Transferase family
MVVLKQHKLVENFQVVPAVRTTTSLPLTFLDLPLAGPIYVRRQFFYHFPNSTLHFCETILPCLKTSLSQTLQHFFPLAGNLICPPTPHKPFIRSTDDDSVTLTIIESEADFNHLSSNHPKSIKDLDHLVPKLTCTNTHDGTFVFPLVALQATVFPNHGLCIAITYCHVMDDSCCSHFMKSWSSICRSGGVDFTLVEKSPPCFDREVLKDPKGLEAIFLRYYLENRSTWKDKLIGKTSEIAGGNEDYFKATIVFGRDDIEGLRIWVLNQWKNSDEFITPQYLSKFVVTCAFVWVCMVKTRCRNDAEDDVQEDYFFFGANCRDRLEHPVPKTYFGNCLTLCSAMLKRKDLKGEGGFLNAVKLIEKEVTDLKSDLFKDAENWRESFTKMFVLETILMVTGSPKFGVYETDFGFGRPTKVEMVHSFKGMSLAESGDEEGGLEDNAILVQDQSPSYTTKSVVSCDWLKIGDGETTFFHV

SEQ ID NO: 230431 - protein, 209 aa, Glycine max
  Coding DNA Sequence Number=SeqID_113653
MSNRKDKNDDESSERGIFSHLGYPSAPPPYPPPHGYPPSGYPPPGGYPPTAYPPLGGYPHSGYYPSEYPPAYPPPGGYPPTAYPHSGYHPPAYPAPHGYPPAAPPYPGDLSTAPLLSAMEVTILGHRPSWLPIDPIQVRRGAGMGGLLAGGVAAAAAAYGAHHMAHGYHRFGHGAYYGHGKFKHGKYGKRWKHGRFGFGKHKHGWKRWK

SEQ ID NO: 230432 - protein, 258 aa, Glycine max
  Coding DNA Sequence Number=SeqID_113654
  Gene Ontology: Mol. function=methyltransferase activity
  Homolog annotation: Hit_ID=Q117P8; Match level="QueryCoverage=56%, HitCoverage=50%, E-value=9e-14, Identity=40%"; Hit description=TRNA (Guanine-N(7)-)-methyltransferase
  Subcellular localization annotation: CTP_CleavageSite=26; ConfidenceScore=5.38e-01
MLRFSPFLATPPTPSSLSFSSNCHVSSSAQATLQQQHEQQPLPQSSQLVALEYADLNLSYNLDLGHVRIRQHVNPLSSSFSVPAQVPDWNHAFADPTLPLMVDIGCGNLNLNDNLFDAFSVSVKDWHRSCSGRFLMWLAKRTPKERNFLGLEIRERIVKRAESWAKDLALDNMYYPKTTYIDGGTFLVCKRDNFFQAVGRIISRALGLSFSIGCHLHFYSTKLVGPIEQPKAVQQEGECFLGQLRPLWSIARQEGLVD

SEQ ID NO: 230433 - protein, 136 aa, Glycine max
  Coding DNA Sequence Number=SeqID_113655
  Homolog annotation: Hit_ID=Q8RUX8; Match level="QueryCoverage=74%, HitCoverage=57%, E-value=4e-33, Identity=69%"; Hit description =Expressed protein
  Pfam annotation: Domain name=DUF498; Domain location=60-126; Score= -20.9; E_value=0.065; Accession=PF04430.4; Description=Protein of unknown function (DUF498)
MAVRQRAVSALPTLLRTLRKEPLKPRNHAHVNALPSLRRAFSLYDQINLIDQVPEDQLRFQGYNDTGFTVNGVEYEGSLLCVGNLLMSWKPKKFSEITADSVCPETDSLYLKLKECSGNCAALVIQVQSFEFTFEA

SEQ ID NO: 230434 - protein, 142 aa, Glycine max
  Coding DNA Sequence Number=SeqID_113656
  Gene Ontology: Mol. function=plastoquinol-plastocyanin reductase activity; Cellular component=ubiquinol-cytochrome-c reductase complex; Biological process=electron transport
  Homolog annotation: Hit_ID=P26291; Match level="QueryCoverage=93%, HitCoverage=58%, E-value=2e-70, Identity=91%"; Hit description =Cytochrome b6-f complex iron-sulfur subunit, chloroplast precursor
  Pfam annotation: Domain name=Rieske; Domain location=31-121; Score =58.7; E_value=1.9e-14; Accession=PF00355.16; Description=Rieske [2Fe- 2S] domain
MSVDSKRNISGSSAGGTVAKDAVGNDVIAENWLKAHGPGDRTLTQGLKGDPTYLVVEKDRTLATFAINAVCTHLGCVVPWNQAENKFICPCHGSQYNDQGRVVRGPAPLSLALAHCDIDDGKVVFVPWVETDFRTGDAPWWA

SEQ ID NO: 230435 - protein, 85 aa, Glycine max
  Coding DNA Sequence Number=SeqID_113657
  Gene Ontology: Cellular component=nucleus
  Homolog annotation: Hit_ID=Q8RUX8; Match level="QueryCoverage=87%, HitCoverage=44%, E-value=1e-25, Identity=73%"; Hit description =Expressed protein
  Pfam annotation: Domain name=DUF498; Domain location=1-79; Score =40.2; E_value=7.2e-09; Accession=PF04430.4; Description=Protein of unknown function (DUF498)
MTCSPMFWHVNTLSIFQIVRPIPEILIIGCGKNIQHVDPELRRFIRSTGIKLEAVDSRNAASTYNILNEEGRIVAAALLPHGVSS

SEQ ID NO: 230436 - protein, 1500 aa, Glycine max
  Coding DNA Sequence Number=SeqID_113658
  Gene Ontology: Mol. function=ATPase activity, coupled to transmembrane movement of substances; Cellular component=integral to membrane; Biological process=response to nematode
  Homolog annotation: Hit_ID=Q9M1C7; Match level="QueryCoverage=98%, HitCoverage=97%, E-value=0.0, Identity=55%"; Hit description =Multidrug resistance-associated protein 9
  Pfam annotation: Domain name=ABC_membrane; Domain location=318-588; Score=92.6; E_value=1.2e-24; Accession=PF00664.13; Description=ABC transporter transmembrane region
  Pfam annotation: Domain name=ABC_membrane; Domain location=943-1219; Score=75.2; E_value=2.1e-19; Accession=PF00664.13; Description=ABC transporter transmembrane region
  Pfam annotation: Domain name=ABC_tran; Domain location=1292-1475; Score=146.0; E_value=1e-40; Accession=PF00005.17; Description=ABC transporter
  Pfam annotation: Domain name=ABC_tran; Domain location=662-833; Score= 130.2; E_value=5.6e-36; Accession=PF00005.17; Description=ABC transporter
  Pfam annotation: Domain name=MMR_HSR1; Domain location=1293-1392; Score=-7.8; E_value=0.0051; Accession=PF01926.13; Description=GTPase of unknown function
  Pfam annotation: Domain name=SMC_N; Domain location=651-836; Score= -130.2; E_value=0.045; Accession=PF02463.9; Description=RecFRecNSMC N terminal domain
  Pfam module annotation: Pfam domain module=ABC_membrane::ABC _membrane::ABC_tran::ABC_tran::MMR_HSR1::SMC_N; Domain location=318 -588::943-1219::1292-1475::662-833::1293-1392::651-836
MYLYDIDIDDCLTLTELKSPFWTSWQPFESPCLLEHVTLPVELGFFVILLVQLLRKYINLISKQNKVTDSAKEIVHPTAIKFGFAYKLSFVCTTLLLVVHSSLLSLILNHETQCTSKLQAFTSEIVQVLSWAITLVAIWKTSKSNTYFPWVLRAWWLCNFILCIISTALQVHFSVTNNGQIGLRECADFLGFLASTCLLVISTRGKTGTVLLATNGAASEPLLGEKAEKEKHSECQKESPYGKATLLQLINFSWLNPLFAVGYKKPLEQIDIPDVDINDSAEFLTCSFDESLRQVKEKDATANPSIYKAIYLFARKKAAINALFAVVNASASYVGPYLITDFVDFLGEKGSHGLKSGYLLSLAFLCAKMVETIAQRQWIFGARQLGLRLRAALISHIYQKGLHLSSRSRQSHTGGEIMNYMSVDVQRITDFVWYVNVIWMLPIQISLAVFILHTNLGLGSLAALAATLAVMTLNIPLTKIQKRYQAKIMDAKDNRMKATSEILRNMRTLKLQAWDRQFSQRIEGLRQIEYNWLTKSLRQAAFTAFIFWGSPTFISVITFWACMFMGIELTAGRVLSAFATFRMLQDPIFSLPDLLNVIAQGKVSVDRIASFLREEEIQHDVIENVAKDKTEFDIVIQKGRFSWDPESKTPTIDEIELNVKRGMKVAVCGSVGSGKSSLLSGILGEIYKQSGTVKISGTKAYVPQSAWILTGNIRDNITFGKEYNGDKYEKTIEACALKKDFELFSCGDMTEIGERGINMSGGQKQRIQIARAVYQDADIYLFDDPFSAVDAHTGTHLFKECLMGILKEKTIIFVTHQVEFLPAADLILVMQNGRIAQAGKFKDLLKQNIGFEVLVGAHSKALESIIVAENSSRTNLNSIAEEGESNFSSKSSHQHDHTQHDTVQDNPPEGKGNDGKLVQEEERETGSIAKEVYWEYLTTVKGGILVPLILLAQSSFQILQIASNYWMAWVCPTSSDAKPIFDMNFILLIYMALSVAGSFCVLLRAMMVLNAGLWTAQTFFTKMLHSVLRAPMAFFDSTPTGRILNRASTDQSVLDLEMANKIGWCAFSIIQILGTIAVMCQVAWQVFVIFIPVTGVCIWYQRYYTPTARELARLAQIQITPILHHFSESLAGAASIRAFDQEGRFIYTNLLLVDGFSRPWFHNVSAMEWLSFRLNLLSNFVFAFSLVMLVSLPEGIINPSIAGLAVTYGINLNVLQASVIWNICNAENKMISVERILQYTNITSEAPLVIEDSRPPSNWPDTGTICFKNLQIRYAEHLPSVLKNITCTFPGRKKVGVVGRTGSGKSTLIQAIFRIVEPREGSIIIDNVDICKIGLHDLRSRLSIIPQDPALFEGTVRGNLDPLQKYSDIEVWEALDKCQLGHLVRAKEEKLDSPVVENGDNWSVGQRQLFCLGRALLKRSSILVLDEATASVDSATDGVIQNIISQEFKDRTVVTIAHRIHTVIDSDLVLVLSDGLPRECLMQSYITGRVAEYDEPSKVT

SEQ ID NO: 230437 - protein, 223 aa, Glycine max
  Coding DNA Sequence Number=SeqID_113659
  Homolog annotation: Hit_ID=Q017M3; Match level="QueryCoverage=49%, HitCoverage=12%, E-value=2e-24, Identity=47%"; Hit description=[S] KOG1032 Uncharacterized conserved protein
  Pfam annotation: Domain name=GRAM; Domain location=60-126; Score =80.2; E_value=6.6e-21; Accession=PF02893.10; Description=GRAM domain
  Subcellular localization annotation: CTP_CleavageSite=23; ConfidenceScore=5.11e-01
MASTVVAAAVRSDVPPRQPVDPSASSSPDVADRSDSFNSSPNHFSDTEIQLQTPDVLKSEEYRQLFRLPLEEVLIEDFNCALQENLLIQGHMYLFVNFICFYSNIFGYETKKIIPFPEVTSVRRAKTAGLFPNAIEILAGNKKYFFASFLSRDEAFRIINEGWSRHGNGAIAIMEQKYQKYYKETKEIISPKTQEHNQQITNQQRTTMPNPTDHTLGKRQRHS

SEQ ID NO: 230438 - protein, 156 aa, Glycine max
  Coding DNA Sequence Number=SeqID_113660
  Gene Ontology: Mol. function=DNA binding; Cellular component=nucleus; Biological process=regulation of transcription, DNA-dependent
  Homolog annotation: Hit_ID=Q0PJC4; Match level="QueryCoverage=44%, HitCoverage=41%, E-value=5e-17, Identity=62%"; Hit description=MYB transcription factor MYB117
  Pfam annotation: Domain name=Myb_DNA-binding; Domain location=5-50; Score=26.7; E_value=8.1e-05; Accession=PF00249.21; Description=Myb -like DNA-binding domain
MALGIGANSQDLQEEIIRLLEKLGNKWSVIATHLPGRTDNEIKNHWHTPLRKRFGNNAVHSNKKVKATKSNSSESKQDKDSIENGGFFHSSSTTTSKASDSVPLSPQLSSSEFSSTTSDYTYATAATKENLLLGFSRCMLRVRGREREYLDRVICS

SEQ ID NO: 230439 - protein, 104 aa, Glycine max
  Coding DNA Sequence Number=SeqID_113661
MQCENLAGRDLVPVSWSNCLWRATCRWCRAIKFVEPPSPAQSHMNSETEERELALVIVIVKVVTQTNNDKPPNSIIRGGLHPCLICCGELSKKQMSMRFIYGYS

SEQ ID NO: 230440 - protein, 65 aa, Glycine max
  Coding DNA Sequence Number=SeqID_113662
MHGSKLVGGGRMNENAIHGSPKQGREWRIALSNHCAWLQTCGWRMHERKCNSWGSEKRGREWRIA

SEQ ID NO: 230441 - protein, 61 aa, Glycine max
  Coding DNA Sequence Number=SeqID_113663
MALGVMAARPRELLLQPEVTLLAHEVKIRTLILFELSCYLTGQLAKTKEVKPRKHEDIEVL

SEQ ID NO: 230442 - protein, 77 aa, Glycine max
  Coding DNA Sequence Number=SeqID_113664
MGLAGLLLVTGLATASGDKHMQREQIASETRDIGARWEPFPPTKRQVATAIDELRGNCHWRFRAKKIATGNGDSMPL

SEQ ID NO: 230443 - protein, 91 aa, Glycine max
  Coding DNA Sequence Number=SeqID_113665
MERVVLENCSEYAVITTDAAAAITNHENSVLEGDDYGLSFLDTYTEPDVCANFWTEPYLIDNSYVPPEGDVVELWSHNDLYMHEYCEGFFC

SEQ ID NO: 230444 - protein, 72 aa, Glycine max
  Coding DNA Sequence Number=SeqID_113666
MDIDAIKKEKGAMDIDAIRVMKKSKDGEAKRKNASSHEENVWSRHQRLFEENVRKTKMMKGVALAPTYPQVQ

SEQ ID NO: 230445 - protein, 89 aa, Glycine max
  Coding DNA Sequence Number=SeqID_113667
MEEVYESWVAQFTFLLPCTSSSFHHCRSLVKLFGAFVASGRESMGETEVGDEEVIRIRKNAILRTEDHSSLCSYGRRLFRKNIWKCSSV

SEQ ID NO: 230446 - protein, 222 aa, Glycine max
  Coding DNA Sequence Number=SeqID_113668
MVQKAIDEGRLKFEEKLMKVDTDSFYIQANYVEPMQIMMIGASMGTSKVSFPLSKEEVNQALEEFEKEEESVCLLAGESLVGFLLKKQKDGKEASQCVLEEVLCSSRKCSNKKWFRPRNEGSSSRFKEFEESSLALRRAKPLKRMRRDAILAMQHKNATRLSIFDRISEGPPLRFENSLEAICGVISILPTKYAKDYQNMNILSDYAREDYFNDPSLKPKAI

SEQ ID NO: 230447 - protein, 90 aa, Glycine max
  Coding DNA Sequence Number=SeqID_113669
  Gene Ontology: Mol. function=DNA binding; Cellular component=nucleus; Biological process=regulation of transcription
  Homolog annotation: Hit_ID=Q0PJC1; Match level="QueryCoverage=97%, HitCoverage=57%, E-value=1e-38, Identity=75%"; Hit description=MYB transcription factor MYB122
  Pfam annotation: Domain name=Myb_DNA-binding; Domain location=14-61; Score=51.1; E_value=3.6e-12; Accession=PF00249.21; Description=Myb -like DNA-binding domain
MVRTPCCDKNGLKKGPWTPEEDRKLIDYVTKYGHWNWRLLPKFAGLARCGKSCRLRWLNYLRPDVKRGNFSHEEEETIVRLHEKLGNRYV

SEQ ID NO: 230448 - protein, 232 aa, Glycine max
  Coding DNA Sequence Number=SeqID_113670
ALSQFLGHPLILEEDQRCKFYQRRDQASGFDEEAIAQLLCIPGQDFAQTAAGRREWIMCTSMTTLTQIWMTLLLSNILLSDHNFDLPLPKCQMVYTILTWMTVHVDQIIADAIYLFAGAAPTRHPLDPKRSNRALGFLALIMGLCQFYGVLVIPSKVIRPPITQAFIEKYCTPRQAKGDAQQAADAPPPQQPDPVIPLSVEQYLRHMVRQQMANHRGQVQLHECFYHFSLSQ

SEQ ID NO: 230449 - protein, 63 aa, Glycine max
  Coding DNA Sequence Number=SeqID_113671
MGAKYLEAVKQRMHAINNGPWTKLGKDPQRMYPPLFSLNLVDVPSTRTDPQEMYPLLFLVKPK

SEQ ID NO: 230450 - protein, 69 aa, Glycine max
  Coding DNA Sequence Number=SeqID_113672
RSRIVSGHDQKSRQVNGRNRPRYIGTDASGARVTTDQSLPLPGAKQAENVAAGQPSILCVRSFFYYCLF

SEQ ID NO: 230451 - protein, 130 aa, Glycine max
  Coding DNA Sequence Number=SeqID_113673
  Gene Ontology: Mol. function=unspecific monooxygenase activity
  Homolog annotation: Hit_ID=O04892; Match level="QueryCoverage=70%, HitCoverage=27%, E-value=2e-16, Identity=54%"; Hit description =Cytochrome P450 like_TBP
GPAAGRAPHVAWCPVRPRRPLKIRRTECLPRPVVLITASGLQGEQPLVDGTIPEPVGCRWTARAASAARAGRRVPVGGRIGNGPFGASSPGVEQSTQNCALNVKVKKFNQARVNGGSNYDSLKVAKCLVI

SEQ ID NO: 230452 - protein, 88 aa, Glycine max
  Coding DNA Sequence Number=SeqID_113674
MALFRSWKGSTTILIGSTSQRSVADSDDEGSTDLRTNHLQERGDDAILPRRGPITRAMARRLQEYWGRDAREDPRVLMRLRVDFGLIG

SEQ ID NO: 230453 - protein, 53 aa, Glycine max
  Coding DNA Sequence Number=SeqID_113675
  Gene Ontology: Mol. function=nucleic acid binding
  Homolog annotation: Hit_ID=Q9FNZ1; Match level="QueryCoverage=85%, HitCoverage=10%, E-value=2e-09, Identity=52%"; Hit description=Zfwd2 protein
MNGLRKFSERGRLFAKKDVALIELGPGGLFFTGDESGLLMVWKWLEVPKVASS

SEQ ID NO: 230454 - protein, 104 aa, Glycine max
  Coding DNA Sequence Number=SeqID_113676
  Subcellular localization annotation: CTP_CleavageSite=48; ConfidenceScore=5.39e-01
MSFPVFSMFSSNKCWWRLRAYSFLGRSIPRVTRRPPAEGQIPLPFLSRSMPTKKVELDSNLLDTFMMVEVNIPLLDVIKEIPKYAKFLKDLYTHKRKLKGNEDE

SEQ ID NO: 230455 - protein, 87 aa, Glycine max
  Coding DNA Sequence Number=SeqID_113677
IQRTNRLRILCPNTLEGTSFVVQVEERVHLLSIKVEGPSTWVFKENKGGDIPFGSLACKGFFKVERNLKNRKLLGDWMQARAVVEPV

SEQ ID NO: 230456 - protein, 226 aa, Glycine max
  Coding DNA Sequence Number=SeqID_113678
  Homolog annotation: Hit_ID=Q6CQE5; Match level="QueryCoverage=18%, HitCoverage=39%, E-value=7e-08, Identity=67%"; Hit description =Protein TAR1
MTTAPRAPGLLVLATNTNPGASCAKELKSVKCDSRGPGDGNPVNHRVFERKLRPKPLGRGARLPGCHTSFPQRKHVTMLLRGVYADLPRAPASWLVEIWVHGRLRRDKMVDEPRSRPITCEPVSSGPIDDPLRARTLPTRPQSGEASSVADRAQVPWKGAPERVRAPSCPDPVAPRGAVGESGCLGMQPQSGGKFRPRLNTGERPIANKYREGKMKRTLKRESKSA

SEQ ID NO: 230457 - protein, 124 aa, Glycine max
  Coding DNA Sequence Number=SeqID_113679
MQRLTLSFAPLSSIDGGSDDMRGRKYPSGYPYKHSFAISKTQRMITWSNEPVDAQRLTLSPTPFVVVTREVRVFALVVRKHSSPTTHEILLYWAETIGCNGEGKCCGSAGWDIDRPNDVPLERN

SEQ ID NO: 230458 - protein, 379 aa, Glycine max
  Coding DNA Sequence Number=SeqID_113680
  Gene Ontology: Mol. function=hydrolase activity, hydrolyzing O -glycosyl compounds; Cellular component=integral to membrane; Biological process=carbohydrate metabolic process
  Homolog annotation: Hit_ID=Q5H0B5; Match level="QueryCoverage=56%, HitCoverage=27%, E-value=7e-92, Identity=76%"; Hit description=Beta -glucosidase
  Pfam annotation: Domain name=Glyco_hydro_3; Domain location=217-379; Score=120.1; E_value=6.5e-33; Accession=PF00933.12; Description =Glycosyl hydrolase family 3 N terminal domain
VRQVQRGIGQVDPLQVLADGLGYEYRFIAAGSDDGQIQRGQAVLTRLPIAAESGPDQPGLSYLRLDDGRHTVAVYTDAGAGAAQLPALVTRSRLGAPAVLLGAVAGESAKAAGFDPARVALEADASYFSDGFQAASSAPFKLEGNTLRATLLTLAYAADKHGDRPWMDTTLNADARAALLLKAMTEDEKFQMLHSYFGLGKDGGPLPEGAVGSAGFVPAVPRLGIPSQQSADAGVGVTNPGGIRPGDFATAMPSGPSTASSWNRQVAFAGGATMGREAWQQRFNILLSGSVNLQRDPRNGRNFEYAGEDPLLAGSMVGALIQGVQSQHVISSMKHFALNDMETRRNFHDVRIGEQAMHESDLLAFEIALEAGRPGVAMC

SEQ ID NO: 230459 - protein, 205 aa, Glycine max
  Coding DNA Sequence Number=SeqID_113681
MGNQLLEQLLEQPANELRWQQKRLENELELAKVTLKEKEMEVLAAQRALTIKDEELKMTLARLDSKEEELKKVREEVTEDSNDLKRLYALAQERIGEKSLGDLAIEKLQLEAAQLEVEAATNALQKLAEMSRQLLNKAILSVEADNYISVMQNNANKTPDSITDTNNPECFEEVKARVARLSALSEQLVMEAGLHLQTSGTAVRV

SEQ ID NO: 230460 - protein, 542 aa, Glycine max
  Coding DNA Sequence Number=SeqID_113682
  Gene Ontology: Mol. function=protein transporter activity; Cellular component=cytoplasm; Biological process=intracellular protein transport
  Homolog annotation: Hit_ID=Q6ZIG6; Match level="QueryCoverage=88%, HitCoverage=63%, E-value=3e-63, Identity=31%"; Hit description =Putative ZipA
  Pfam annotation: Domain name=Tup_N; Domain location=319-396; Score= -13.0; E_value=0.06; Accession=PF08581.1; Description=Tup N-terminal
  Subcellular localization annotation: CTP_CleavageSite=67; ConfidenceScore=5.87e-01
MAFSALLRPSSSPSHSQLFCSVRFNRRHRSSSRVGFASNGRRRVRRLRNNNDVTVSVRSVLNDNRPSASVNDDYGAAESARVLFERLFTQNRMTGDEPDLRILESDLKAALAALKMKEDHLMEAERMVLLENSKLKLTKEELERQESEIEAARVRYEKLEEEMKETTVKLVSQAGQIEELKLRVRDRDSEINAVKYALGLKEGEVEKMRVELEERSREAVDFDNELREKGRILDEANEVMKKQEAELEELKRAVREKEKEIEVLLVEREVEREKLRVAEANLEKQAMDWMLAQEELKRLGEDATRHAEESSETLEDFRRVKKLLNDVRSELVSSQQALASSRSKMEEQERLLEQQLSELGEQRVSVMSYMENLKDAQIEVESERKKLRVAESRNRELERDLKMEKELISELEEELKKERTSLEQAVKEVAFLQEELEKKNAEFRETSAVLQVRESELVDAKLEIQRLKSEKASLQGILEEKDLELSNAKKMLGEINQEISDLKMLMNSKETQFIEATNMLREKDEQLKMIQNKLNNTNQKGF

SEQ ID NO: 230461 - protein, 67 aa, Glycine max
  Coding DNA Sequence Number=SeqID_113683
MAAIYTPFSMWDCYQNNLRDFLNVAGPMGVTHFFILSKTTTHMMQLKHCSILNLRQIKWNCTTDNFS

SEQ ID NO: 230462 - protein, 51 aa, Glycine max
  Coding DNA Sequence Number=SeqID_113684
MATVVPTSEEDAALSVVRFASELAWADAGPEVTFFLFLLSNPFLAFFLALT

SEQ ID NO: 230463 - protein, 925 aa, Glycine max
  Coding DNA Sequence Number=SeqID_113685
  Gene Ontology: Mol. function=isoleucine-tRNA ligase activity; Cellular component=mitochondrion; Biological process=tRNA aminoacylation for protein translation
  Homolog annotation: Hit_ID=Q9FI67; Match level="QueryCoverage=97%, HitCoverage=86%, E-value=0.0, Identity=70%"; Hit description =Isoleucyl-tRNA synthetase
  Pfam annotation: Domain name=Anticodon_1; Domain location=649-814; Score=140.3; E_value=5.2e-39; Accession=PF08264.3; Description =Anticodon-binding domain
  Pfam annotation: Domain name=tRNA-synt_1; Domain location=5-606; Score=458.3; E_value=9.8e-135; Accession=PF00133.12; Description =tRNA synthetases class I (I, L, M and V)
  Pfam annotation: Domain name=tRNA-synt_1g; Domain location=10-620; Score=-272.5; E_value=0.0029; Accession=PF09334.1; Description=tRNA synthetases class I (M)
  Pfam annotation: Domain name=zf-FPG_IleRS; Domain location=883-912; Score=51.7; E_value=2.5e-12; Accession=PF06827.4; Description=Zinc finger found in FPG and IleRS
  Pfam module annotation: Pfam domain module=Anticodon_1::tRNA-synt _1::tRNA-synt_1g::zf-FPG_IleRS; Domain location=649-814::5-606::10 -620::883-912
MLVLQSLDQNARNELTPLKLRAKAAKFAKETVKKQMSSFKRYGVWADWNDPYLTLNPEYEAAQIEVFGQMALKGYIYRGRKPVHWSPSSRTALAEAELEYPEKHVSRSIYAIFRVVSAPLTPSSLLQEFPNLYLAVWTTTPWTIPANAAVAVNPKLEYAVVEIKSLPEPDPSSGGNKKKGLGLVLKDEKLPFLIVASELVPSLEAKWGVKLVVKTRQLGSELENYRYIHPVDDRECPVVIGGDYITTETGTGLVHTAPGHGQEDYVTGQKYGLPILSPVDDDGRFTEEAGQFSGLDVLGEGNTAVVKYLDEHLSLIMEESYEHKYPYDWRTKKPTIFRATEQWFASVEGFRHTAMDAIGHVKWVPPQAANRISSMTSIRSDWCISRQRTWGVPIPVFYHLQSREPLMNEETIDHIKSIIAQKGSDAWWYMTVEDLLPTKYRDKAAEYEKGTDTMDVWFDSDLSNINLGPYSLTPDPQLPEIMLMICFGCLLLTSGSSWAAVLGKRDSLSYPADLYLEGTDQHRGWFQSSLLTSVATKGKAPYLSVLTHGFVLDEKGLKMSKSLGNVVDPRLVIEGSKNQRESPAYGADVLRLWVSSVDYTSDVMIGPQILRQMSEVYRKLRGTLRYLLANLHDWKTEYTVPYHELPRIDQHALFQLENVVKAIQGNYENYQFFKIFQILQRFVIVDLSNFYFDVAKDRLYVGGSTSYTRKSCQTVLAAHLLSIVRIIAPILPHLAEDVWQNLPFQYITQDGSIAEYVFESRWPISNERRLALPVEEINFWENILELRTEVNRVLEVARTGKLIGASLDARVHIYTSDARLASQLCELSAAKNDADTLRRLLITSQAEILPSLDDEQIVNIPYSGECLIQGKNKIWIGISRAVGSKCERCWNYSEQVGSFLDHPTLCSRCHDVVAVQMPPQVAAVS

SEQ ID NO: 230464 - protein, 869 aa, Glycine max
  Coding DNA Sequence Number=SeqID_113686
  Gene Ontology: Mol. function=protein binding
  Homolog annotation: Hit_ID=UPI0000E481D3; Match level="QueryCoverage =22%, HitCoverage=40%, E-value=1e-14, Identity=29%"; Hit description =PREDICTED: similar to Germ cell-less homolog 1 (Drosophila)
  Pfam annotation: Domain name=BTB; Domain location=45-155; Score=42.8; E_value=1.1e-09; Accession=PF00651.21; Description=BTBPOZ domain
  Pfam annotation: Domain name=MATH; Domain location=736-868; Score =8.3; E_value=0.016; Accession=PF00917.16; Description=MATH domain
  Pfam module annotation: Pfam domain module=BTB::MATH; Domain location= 45-155::736-868
MEEPQFREHPKAKIATIPPSQHSDGAAAELRGADCNLASLCEHVQIEGFNSGSFSDIVVNAMGSTYHLHRLILSRSSYFRNMLHGPWKEAGAPVVALHVDDKNVNDEAIAMALAYLYGHHPKLNDNNAFRVLAAASFLDLQDLCGICTDFIISELWTSNFLAYQVFAENQDYGMHGERVRTACWGYLCQSGGMELKEVLPKLSSQTLHALLTSNDLWILNEEKRFELALYTFLAKSAHCKVEHPAHGISGTESATGIHTDSGSSKGKIVTDSCTSNRLETDMGKIGLKTDLKDPSTPSLLVEVADPVADFKDGGVSVSNEQVPQASYVSSPNLNPRYSCDMEGPSLGNSLPDTDEVRTSCYVETPLGAGATSMGATGVGIEGTSEEGPFYHLDNNSWLVRDQSRYCFSSNSCNELTSNDWGRYGTPLFSWNGQVVGRRQLKSHPRGNFRGHGDEYDAFFNIFEGGSLLYCNMSFDALLNVRKQLEELGFPCKAVNDGLWLQMLLSQRVQEIAADTCKVCSLMNMACTCQKQFAFSHGASTSGSYVQEHNQNIMPGNVGNIYVAESSAGERNGLFRPVRVHVRGAIDGLAGIGRGTTFVPASASPPTRFVFSRVPFGVGNRNYPQSAANDDSEARADPNGDLAGDGLTALVGLSLGGSNGTNVHTELTQRGYEMGLQSSMSGTTAGGASTGGIPMQMLETPEHTIGIEWDNVNSTSISLDLKAPLSHFPPFRFGVRFEDVHRLGEGQVKHSPEVFYAGSLWKVSVQAFNDEDPQGRRTLGLFLHRRKAEITDIHRKVHMYVDSREKVTARYQLTVPSKREMTVFGSFKQTGTLLPKAPKGWGWRTALLFDELADLLQNGALRVIAVVQLV

SEQ ID NO: 230465 - protein, 757 aa, Glycine max
  Coding DNA Sequence Number=SeqID_113687
  Gene Ontology: Mol. function=protein translocase activity; Cellular component=chloroplast outer membrane; Biological process =intracellular protein transport
  Homolog annotation: Hit_ID=Q9LKR1; Match level="QueryCoverage=63%, HitCoverage=33%, E-value=3e-79, Identity=39%"; Hit description =Chloroplast protein import component Toc159
  Pfam annotation: Domain name=AIG1; Domain location=597-757; Score =25.0; E_value=1.1e-12; Accession=PF04548.7; Description=AIG1 family
  Pfam annotation: Domain name=MMR_HSR1; Domain location=597-701; Score= 28.1; E_value=2.7e-06; Accession=PF01926.13; Description=GTPase of unknown function
  Pfam module annotation: Pfam domain module=AIG1::MMR_HSR1; Domain location=597-757::597-701
MASSDSKSFFFMSAPPQIRAPLTLEADDSDLDVASNDTLSQSEEEEFFQDDECVQLSPMHAAPLRVTPFAHLSTFNDEVDEDEDEDEDEDDDNEEEEGEEEGAPRIKMLDSEEENHEASTFTNLLPVSQSLLANDFAFFSGSDEELDVDEHVLDPVLGIRVAYHEYSSAKDSDVTSEHSQDNFNNEEGFGVPRVVLNELESVELVETDTTMQGKLDGGASIVVGDTGLLKSSLEDCSNSILQEHHMSVHDLPEHNSQVHCITCEPESAENVQYSAATQTTEANGSGGVADDQVKGCENLVSITRSVVDSNAELCDSSAGFESNHDAYESNIIHSVESCEVLDPTHLQECYLEKDLSETSLGVSLEDELFSDYHSAEHVEALKVGFAAKEETTVELNTASQESDREGSASDGDVEGLTTVALEQFREQISAFSILLGSKGSGKDSQEKQTIRISHGSMNLPTRDDAKGQFIYADSDDESDGSSGTVTSADESSVICLEDPATFSSLQLPYYDARAGFQHNITEKEKGKIQNIQAISVKFLRLVLRISLSLEDSLVSKVLYRLVADIERRLNQEFIIKSAKTSAKKLEENCQDDLDFSLNILLLGRSGVGKSATINSIFGDMKVVTNAFEPATTSVKEVSGTIDGIKIRILDTPGLKSCIKEQAYNRKILSSVKRYMKKFPPDVILYVDRVDAQTRDLNDLPILRSITSSLGPSIWQHAILTLTHAASVPFDGPSGSPLSYEVFVAQKSYLVQQSITQA

SEQ ID NO: 230466 - protein, 444 aa, Glycine max
  Coding DNA Sequence Number=SeqID_113688
  Gene Ontology: Mol. function=cysteine-type peptidase activity; Cellular component=nuclear pore; Biological process=proteolysis
  Homolog annotation: Hit_ID=Q70G10; Match level="QueryCoverage=90%, HitCoverage=78%, E-value=1e-84, Identity=43%"; Hit description=SUMO protease
  Pfam annotation: Domain name=Peptidase_C48; Domain location=265-443; Score=105.2; E_value=2e-28; Accession=PF02902.9; Description=Ulp1 protease family, C-terminal catalytic domain
MSQNHAQSLLSSTSIISRISKYPETKPPLHREVHAPCRPRKFDSPAFNRSFHYPRKEEISYDKGNVLSKNYQRAKNSALASIRFGEKGKEVIEVDADSSKGMVSEDSSVEEDGREHKWQEGGDLVVTEVKDLDANKDMHGVPQQQSTSSVVSELTNGDLNVVNAEKMLDTLSLTPEHDLSSVQAYKKLLDALGQRNDTLERLKAEIQVNEKRMSTFELLRPKKELVEEVPLEPFIPLTKEEEVEVAHAFSADRKKILVSHEKSGIEISGEKFQCLRPGAWLNDEVINMYLELLKERERREPLKFLNCHFFNTFFYKKLISGKNGYDFKSVRRWTSQKKLGYGLHECDKIFVPIHKEIHWCLAVINKKDKKFQYLDSLRGTDARVMKILASYIVDEVKDKTGKDIDVSSWKKEFVEDLPEQQNGFVFFSYSLNEPSLAGGGARMF

SEQ ID NO: 230467 - protein, 552 aa, Glycine max
  Coding DNA Sequence Number=SeqID_113689
  Subcellular localization annotation: CTP_CleavageSite=12; ConfidenceScore=5.11e-01
MASAHYTLSSVLAPQATGRTTLRIPISSKRHRKNHLRPKILKILTKPYPLTLPLLPSPPPPPHPIVLPQENNNLCVELPAEETLAGEPDKLEELQVSEGTTKDNGVFQNVSAVDILKYGGMYFLGFFVLQTIYTVWIVGIFKFNQKDRDLEIDRDEKTVSWPVHGASNVFLSEEQVLMDKKIEEIKLMAREARRIESEKKGKEDEDEDFEVDDDDDDEGAVSSNRLGIEKEIGERLLKVQNRINGSAKDISAALQINSRGNSAAGVDRGVNKNVKNKGNEALVFKKKFKFKSPSTKDTKTPKGFPGNRDWKESKATKRGSESKKAAQDHGSDDVSDHAQMLHEDKRANQPELVTQKSVSSVPSEEGGKVVDDKSKVMQDSINGNSRHELAKKNSQANRVKVKQANTKTDVWWLNLHYVFPMSCIVGHKYTGTSVVILMQRDSEEGLEGLYYGLKFTSKEQEQSDDDSYTVAFEDHADANNFCFLLKSFFEDLGSFSAYAVPMPIQELNEEIISRAKKVVVVKKRQLQLYAGQPLADVEMHLRSIIEQDQIAP

SEQ ID NO: 230468 - protein, 187 aa, Glycine max
  Coding DNA Sequence Number=SeqID_113690
MESGLGIDAIGRKARWHETTTRPTAMRRGATTLEARGHGSGTRETHRHGGVTGKATHMPLDGGGGFDRGDFIGEGEGAGIGFLVVASKGIVVGGGIIALKGALQTHQLEKLWSRGNRLGSDFRDGMCDLIGSLLENMATYRGGYDRWKFLTTRMLSEALSCEDELGGSWWACNTLIKSHPNKRDPSL

SEQ ID NO: 230469 - protein, 88 aa, Glycine max
  Coding DNA Sequence Number=SeqID_113691
  Gene Ontology: Mol. function=GTPase activity; Cellular component =intracellular; Biological process=translation
  Homolog annotation: Hit_ID=Q41137; Match level="QueryCoverage=73%, HitCoverage=48%, E-value=1e-18, Identity=69%"; Hit description =Eukaryotic release factor 3
MVDSNMTAMLTLYICALWGFPFAANPIPTLTEFVTQLVILELLDNAILHMHSAVEECEIVELLQQIDTKTHKPLKKKVLFVKTGAAVL

SEQ ID NO: 230470 - protein, 79 aa, Glycine max
  Coding DNA Sequence Number=SeqID_113692
  Subcellular localization annotation: CTP_CleavageSite=35; ConfidenceScore=5.24e-01
MASIIVSICSFMASMWAFICSCTSSISLISLALARVRGKWTISNNASPKEENSISGFAIIKRVGDLAWPQIDLHSLWLI

SEQ ID NO: 230471 - protein, 74 aa, Glycine max
  Coding DNA Sequence Number=SeqID_113693
  Subcellular localization annotation: CTP_CleavageSite=60; ConfidenceScore=5.74e-01
MGVQIATRPTWTFQKIPPKGSCFWRKQPSSPGKSKPRHFRNVSMGDFAKIFNRSSTFFVRSSSFFGLQPISSRN

SEQ ID NO: 230472 - protein, 864 aa, Glycine max
  Coding DNA Sequence Number=SeqID_113694
  Gene Ontology: Mol. function=RNA-directed DNA polymerase activity; Biological process=RNA-dependent DNA replication
  Subcellular localization annotation: CTP_CleavageSite=32; ConfidenceScore=5.10e-01
MSAQDFSPTTNNMGATSLRKKPSDDSNDDDSSSTTRTSFRDRVMGGNPMKYMVHIDHSILEELCAPWEDALFSAGYDLMDISNGFYMAKFDIEPDRAHVMEDGPWMLFNHYLTVLRRSPEFASPTAKIDRTLSEWMQTREMSDKAECKKQVPTTPVTVSPTPETQVIPIVAVDKHMTMQPFPNNENDTQPNPNAGMNQGTMARDQGVNDDDPTHKEWMIVKGPPTASGLRKSISGFNAPKKSDMGPTGLMIVLVPTEPFPHAHPPRAEIRELGDGAKIALDIELLQHGRYAMQMDDGHSGLMSDMEISQPIDISILSWNIRGATMTGKWCHIKDIVRKLSSPIIMLYETHNLFSNSKIVGIKWPIVPCSFKKQLGILGVFGCLSGLLTLLFSCWTPLHKLLPSPFSEDTFSGIALLSMPPPTPWGIFTWRKNIQNGQRIWKKLDYCLSNATWLAHLGYQDIVALAWKKPNMNVVNCLSNVKEDSLVFNRETFRNIFRKKRQLEARIKAKLVTIEEVKGTLFSMDSYKAPGPDGFQPIFFSNFGTWWVDQPKCLKEFRPISLCNVLSKTILKVLVHKVRPLLDELISPLQSVFISGQGTSNNALITKEIVHHISFILGQGTSNNTLITQEIVHHMRKKTSREGYLMFKINFEKAYDKVDGDFLELTLTEFGFLALIIHLIMNNTRATSLSLKWDNEVSYPFFPTRSLRKGKGLKFPIFSLQMTIYYEDEDILGLAGFERSGGFCQGLKKVKKVDFGFILDRMTSKLTDWKANLLGRARRVHKHWANWKTMTKSKKERSLGIRSSREVNIAMLGKHTWDLIFETPKLWTRILKKKYLKRDFILHIKEYKGNSYTWKYIRKAIESLE

SEQ ID NO: 230473 - protein, 301 aa, Glycine max
  Coding DNA Sequence Number=SeqID_113695
  Homolog annotation: Hit_ID=Q6TKQ6; Match level="QueryCoverage=89%, HitCoverage=77%, E-value=1e-110, Identity=74%"; Hit description =Putative ankyrin-repeat protein
  Pfam annotation: Domain name=HrpJ; Domain location=81-236; Score= -59.0; E_value=0.1; Accession=PF07201.2; Description=Hypersensitivity response secretion p
  Subcellular localization annotation: CTP_CleavageSite=37; ConfidenceScore=5.03e-01
MASDSKKDFPADDKAGTAENKASKDETSSKDSPAAQRATTATSGPATGFPGNPFDFSAMSGLLNDPSIKELAEQIAKDPSFNQMAEQLQKTFQGAPQDAMPSFDNQQYFSTMQQVMQNPNFMTMAERLGNALMQDPSMSAMLESFSNPSNKDQLEERMTRIKEDPSLKHILEEIETGGPAAMMRYWNDEEVLRKLGQAMGLANSGDVGASAENSGADETEDLGNEDESIVHHTASVGDVEGLKNALAAGADKDEEDSEGRTALHFACGYGENVCLCCWVVVLTLEPWCEVNEGYIEAQGII

SEQ ID NO: 230474 - protein, 145 aa, Glycine max
  Coding DNA Sequence Number=SeqID_113696
MLKDNTIGIGSNNLSRRKCLKDWFVCTIEIKSMMLLFRIKDLSPNIYLVSLDFVVGMAHKHVSQTCRPLHLLSLPPQSEQLCHNHDFNIVAIDVDVDLHNLDLFLGLICVNFIPLILIDIKCWCINANFIISIKLVIIPTVESDC

SEQ ID NO: 230475 - protein, 58 aa, Glycine max
  Coding DNA Sequence Number=SeqID_113697
MAEIWDPIKKWQKTSDTTVTIVSAARMRHHWLALSLVMGVYMCKLREADYERSGDEMC

SEQ ID NO: 230476 - protein, 232 aa, Glycine max
  Coding DNA Sequence Number=SeqID_113698
MTQHSPTLYVGNPVLVLACPGSLFKHEFEVLKHKFGLTSLDGHVIQRFYRLQEYSSGLEPEEKPLVDAYHHEVGQCYQTLNHSCFTQETPFNMICSWQMDFYATSDRTFSFLVILLFSRFFFIHHVDLKIKEVDLDIDVASGSMVVQVYDPPPSHSYALAQALKDCALTKKKPRKWSLIGDFFYKKASGWKPPHSPTPLGSPLTISSDFEDFGDKFLRKLNEEVAKQRGRKM

SEQ ID NO: 230477 - protein, 276 aa, Glycine max
  Coding DNA Sequence Number=SeqID_113699
  Gene Ontology: Mol. function=microtubule motor activity; Cellular component=microtubule associated complex; Biological process =microtubule-based movement
  Homolog annotation: Hit_ID=Q6WJ05; Match level="QueryCoverage=97%, HitCoverage=30%, E-value=1e-109, Identity=76%"; Hit description =Central motor kinesin 1
MGGQMQQSNASATALYDHAGPGSLHNAAGPATDAGDAVMARWLQSAGLQHLASPLASTAIDQRLLPNLLMQGYGAQSAEEKQRLSKLMRNLNFNGESGSEPYTPTSQNLGVVSDGFYSPDFRGDFGAGLLDLHAMDDTELLSEHVISEPFEPSPFMPGGTRGFVDDFNSISRKQERGEADSDASLFLPTNEKENNTRENNVAKIKVVVRKRPLNKKELAKKEDDIVTVYDNAYLTVHEPKLKVDLTAYVEKHEFCFDAVLDENVTNDEVRLLLMKD

SEQ ID NO: 230478 - protein, 114 aa, Glycine max
  Coding DNA Sequence Number=SeqID_113700
  Gene Ontology: Cellular component=integral to membrane
  Homolog annotation: Hit_ID=Q1RSF3; Match level="QueryCoverage=71%, HitCoverage=41%, E-value=7e-14, Identity=47%"; Hit description =CD9/CD37/CD63 antigen
  Subcellular localization annotation: CTP_CleavageSite=91; ConfidenceScore=5.10e-01
MVGALNMSLLLGISTVGSSVYIHVHGGSDCQKGALRIPLVTFMVIVGLVFFTMFALFVTNSKVGQQVFARATTSTGSLTSLTAFAKHNTPRLSARKTLEEDELYRFAKRTASSH

SEQ ID NO: 230479 - protein, 338 aa, Glycine max
  Coding DNA Sequence Number=SeqID_113701
  Gene Ontology: Mol. function=DNA-directed DNA polymerase activity; Cellular component=mitochondrion; Biological process=nucleobase, nucleoside, nucleotide and nucleic acid metabolic process
  Homolog annotation: Hit_ID=Q6QZN8; Match level="QueryCoverage=98%, HitCoverage=44%, E-value=1e-55, Identity=36%"; Hit description=DNA -directed DNA polymerase
MESPFKDYINSLFESRSNAKKKGNNALSFVYKLLMNSLYGRFGINPQSTKTEMCNKSKRDRIFRRPEFIDDVFIREDLYMVSYLTNPGKGPSYWDPPKNSAVQLAAAITAGSRIYMYKYISREDCLYTDTDSIVLGKFKLEDKILEGFFLAPKCYSYTTEESDGNKKVYKYKGPGRNVITPEWYKEQYADPSQSLIKKVTYQFRPDWKELSVKKKESTTTLRTLSNSKRIPFFNEKGKYVSTDPLDINDLSSLNYIGTKLLESFKRKTAILEKENSALSQKLQKLEQERGIIAQRRVEEGNNTEDNNTLEQNNAKRAEDNINGDLLDPDTMPRDKKPP

SEQ ID NO: 230480 - protein, 530 aa, Glycine max
  Coding DNA Sequence Number=SeqID_113702
  Gene Ontology: Mol. function=microtubule motor activity; Cellular component=microtubule associated complex; Biological process =microtubule-based movement
  Homolog annotation: Hit_ID=Q9LUS1; Match level="QueryCoverage=99%, HitCoverage=65%, E-value=1e-172, Identity=62%"; Hit description =Similarity to kinesin protein
  Pfam annotation: Domain name=Kinesin; Domain location=1-254; Score =230.1; E_value=4.8e-66; Accession=PF00225.13; Description=Kinesin motor domain
VYRVTVEPIIPTIFEKTKATCFAYGQTGSGKTYTMQPLPLRAAEDLVRQLHRPIAEWLCLYTVNRKLCMREDGRQQVCIVGLQEFEVSDVQIVKEFIEKGNAARSTGSTGANEESSRSHAILQLVVKRHNEVKESRRNNNDVNEAKSGKVVGKISFIDLAGSERGADTTDNDRQTRIEGAEINKSLLALKECIRALDNDQIHIPFRGSKLTEVLRDSFVGNSKTVMISCISPNAGSCEHTLNTLRYADRVKSLSKSGNPRKDQAPNPIPPPAIKEVSSTSSLPGSVGAEDFNNGQRQEVKTMDMSRKVVEKESSLYSSAADVDKQSSFSSSCQFNGREEKSSASAPMDREKFEVKNSYGGDSTSQKMNSYSLNVTDEKVQRVSPPRRKGTKEEKSERSVNWVKRDVDGYDHSTTSSKQQSTGNYNITTGSGQSETESSSNVNISAILEEEEALIAAHRKEIEDTMEIVREEMKLLAEVDQPGSLIDNYVTQLSFVLSRKAASLVSLQARLARFQHRLKEQEILSRKRVPR

SEQ ID NO: 230481 - protein, 168 aa, Glycine max
  Coding DNA Sequence Number=SeqID_113703
  Gene Ontology: Mol. function=chlorophyll binding; Cellular component =integral to membrane; Biological process=photosynthetic electron transport
  Homolog annotation: Hit_ID=P56777; Match level="QueryCoverage=99%, HitCoverage=43%, E-value=7e-65, Identity=60%"; Hit description =Photosystem II P680 chlorophyll A apoprotein
  Pfam annotation: Domain name=PSII; Domain location=1-168; Score= -23.6; E_value=1.6e-09; Accession=PF00421.9; Description=Photosystem II protein
MALYELAVFDPSDPVLDPMWRQGMFVIPFMTRLGITNSWGGWNITGGTITNPGIWSYEGVACFGFGAFHVTGLYGPGIWVSDPYGLTGRIQSVNPAWGVEGFDPFVPGGVASHHIAAGTLGILAGLFHLSVRPPQRLYKGLRMGNIETVLSSSIAAVFFAAFVVAGTM

SEQ ID NO: 230482 - protein, 79 aa, Glycine max
  Coding DNA Sequence Number=SeqID_113704
  Gene Ontology: Mol. function=phosphoenolpyruvate carboxylase activity; Biological process=carbon utilization by fixation of carbon dioxide
  Homolog annotation: Hit_ID=Q6Q2Z9; Match level="QueryCoverage=93%, HitCoverage=5%, E-value=7e-22, Identity=73%"; Hit description =Phosphoenolpyruvate carboxylase
MGGDRDGNPNVTAKARIKEVGNFGQLIANVTKDVSLLSRWMAIDLYIREVDGLRFELSMNQCGDKLSELAHEILKGLSV

SEQ ID NO: 230483 - protein, 189 aa, Glycine max
  Coding DNA Sequence Number=SeqID_113705
  Homolog annotation: Hit_ID=Q9AVH2; Match level="QueryCoverage=24%, HitCoverage=16%, E-value=6e-20, Identity=97%"; Hit description =Putative senescence-associated protein
LGKPLVEILPPGQLRGFCPLLAWLGSAVLGYGPVLSFGLVGPLLPPVISFVARILPTLACAPLAKSGRIKATRAESQWIVAARPLCHLQYPVAYLSRLQRILPAARWELRFKASRRANPPHEGHQRHVPLGGRGPLLLVGKRTAGARVASSPDSDLEAFSHNPTHGSFAPLAFQPSAMTNCANQRFLSY

SEQ ID NO: 230484 - protein, 53 aa, Glycine max
  Coding DNA Sequence Number=SeqID_113706
MRKLIKERMENKVVNFVGLNKVVLGIKWMNGMGEDERKEKLTDIYHDHPFYKP

SEQ ID NO: 230485 - protein, 75 aa, Glycine max
  Coding DNA Sequence Number=SeqID_113707
MARECFPNEYMMWNCPSREMAPRKLASKRSRKDKAAEGTSSAPEYDSHHFRSAEHQQRFEAIIGMVISPRATRPA

SEQ ID NO: 230486 - protein, 91 aa, Glycine max
  Coding DNA Sequence Number=SeqID_113708
  Subcellular localization annotation: CTP_CleavageSite=41; ConfidenceScore=5.21e-01
MGKGWGPGTAGAVYTGRSCRSTAPSPYAWPPTDKPNAACTRASGAPSSACEPRWILGTMDDVEAVVVHLLPAAAAGPTPTIVPALGYNTSQ

SEQ ID NO: 230487 - protein, 91 aa, Glycine max
  Coding DNA Sequence Number=SeqID_113709
  Homolog annotation: Hit_ID=Q1SI76; Match level="QueryCoverage=55%, HitCoverage=13%, E-value=1e-07, Identity=54%"; Hit description =Cyclin-like F-box; F-box protein interaction domain
MPGIKDSVVDSLDITLVALFQKQTQYPFGISLTPQCNSLHEPTRCRFAKVQFDEIGFRNQGVSFLAHTLELDQRFHGKTRQDFLDDFVTEE

SEQ ID NO: 230488 - protein, 224 aa, Glycine max
  Coding DNA Sequence Number=SeqID_113710
  Gene Ontology: Mol. function=oxidoreductase activity; Cellular component=cytoplasm; Biological process=response to red or far red light
  Homolog annotation: Hit_ID=Q4W8C2; Match level="QueryCoverage=90%, HitCoverage=59%, E-value=1e-94, Identity=82%"; Hit description =Gibberellin 2-oxidase
  Pfam annotation: Domain name=2OG-FeII_Oxy; Domain location=55-159; Score=129.0; E_value=1.3e-35; Accession=PF03171.10; Description=2OG -Fe(II) oxygenase superfamily
MDIAPSVTVHEPSLERTANSEAVKEVTCEILDLVVEGLGVPDKFALSRLIRDVNSDSVLRINHYPPLNQKVKGNKNSIGFGAHSDPQILTIMRSNDVGGLQIYTRDGLWIPVPPDPNQFFVMVGDVFQVLTNGKFMSVRHRALTNTLKARMSMMYFAAPPLDWWITPLPKMVSPPQNPSLYKPFTWAQYKKATYSLRLGDSRLDLFKAQLDTHHVSASPSQIQC

SEQ ID NO: 230489 - protein, 61 aa, Glycine max
  Coding DNA Sequence Number=SeqID_113711
MEEITQFSGVIDTHGNLHKERKLCIPLNKRKTTPEITKELSFPPPTLAIGTTPWVVSFLFP

SEQ ID NO: 230490 - protein, 467 aa, Glycine max
  Coding DNA Sequence Number=SeqID_113712
  Gene Ontology: Mol. function=DNA binding; Cellular component=nucleus; Biological process=regulation of transcription, DNA-dependent
  Homolog annotation: Hit_ID=Q1SUU5; Match level="QueryCoverage=99%, HitCoverage=100%, E-value=0.0, Identity=78%"; Hit description =Homeodomain-related
  Pfam annotation: Domain name=DMAP1; Domain location=256-415; Score= -65.4; E_value=0.018; Accession=PF05499.2; Description=DNA methyltransferase 1-associated protein 1 (DMAP1)
  Pfam annotation: Domain name=Myb_DNA-binding; Domain location=160 -206; Score=36.9; E_value=6.9e-08; Accession=PF00249.21; Description =Myb-like DNA-binding domain
  Pfam module annotation: Pfam domain module=DMAP1::Myb_DNA-binding; Domain location=256-415::160-206
MDAKDILGLPKNSFPTLEKKSRPPKESQRKPDGISREVYALTGGLAPLMPATEASQLKKKPPPLEKITWQWLPFTSSARKDNLHLYHWVRVVNGVPPTGDYSFAKYNKSVDVIKYTDEEYDKYLTDPPYRGGVIFMYSGFLLASSFGRDSFLCGALALLGEMWTKEETDQLFDLCERFDLRFIVIADRFPSSRTVEELKDRYYSVSRAILIARAPSSGDVAAHPIVKETYNFAQEMERKRALSMVLSQTRQQERRDEEVLVEAKKIAEKRLPPKVAEQSQLVASNAGAEATERAVPGETISPSNVQIPMAVPDNASTLASLRMLRVYLRTYALEQMVQAANASAGLRTIKRVEQTLQDLGVNLKPRVPTKAVCAEHLELRKEILTWLNLQKQVQYKEAEGSSFRDGSYGETPGTPKHLHRVGDQDRTFVPDSTNFGVERVGKKDQKRKAPGAPSAHKRPRKLKASDL

SEQ ID NO: 230491 - protein, 131 aa, Glycine max
  Coding DNA Sequence Number=SeqID_113713
  Gene Ontology: Mol. function=oxidoreductase activity; Biological process=response to red or far red light
  Homolog annotation: Hit_ID=Q4W8C2; Match level="QueryCoverage=78%, HitCoverage=30%, E-value=2e-47, Identity=85%"; Hit description =Gibberellin 2-oxidase
MVVPSPSPTSIKTSYKKKKTIIKIPTIDLSMERTELSETVVKACEEYGFFKVVNHNVPKEVIARMEEEGAEFFGKATYEKRGAGPASPFGYGFSNIGPNGDMGDLEYLLLHANPLSVSERSKTIANDSTKF

SEQ ID NO: 230492 - protein, 136 aa, Glycine max
  Coding DNA Sequence Number=SeqID_113714
MASVHSAGFHVLKLCNSSLASGNRLPMLCNRLPEEKTLEIAMAAQLIHDRVEMECLEGVWETLEGNVRCRFWGTIRFTATSLVRPEEPARMLQRTVEWILPTPTPYRLVEPVQVIEVSSSEEDPEEDPEELPPEPV

SEQ ID NO: 230493 - protein, 176 aa, Glycine max
  Coding DNA Sequence Number=SeqID_113715
MASGNRLPRVCNRLPRVCNRLQGLKNEDRKLRWPLVSMFRSCVTRVWALITMAAQLIHDRVEMECLEGVWETLEGNERGPARTLQQTVEWILPTPTPYRLVEPVQVIEVSSSEEDPEEDREELPPEPAVDALDFPAGDEDPLPDVDSLEDVMSASMADSTEESGPGGTATSGDSSS

SEQ ID NO: 230494 - protein, 533 aa, Glycine max
  Coding DNA Sequence Number=SeqID_113716
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=42%, E-value=1e-169, Identity=50%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=1-85; Score=-10.3; E_value=0.043; Accession=PF00665.16; Description=Integrase core domain
  Pfam module annotation: Pfam domain module=RVT_2::rve; Domain location=234-491::1-85
YTSNEFDEFCELEGIVHDVTPPYTPQHNGAAERRNRTVMNMVRCMLNGKKLPKFLWAEAISTAVYVLNRSPTKRLNKITPEEAWSGHKPVVSHFKNFGSICYKHVPDQLRKKLDSKSEIMILLGYHATGGYKLFNPVTKEVLVSRDVVVDESKDWNWDKEMVEEPTKVVIEASIDEPSDSSAAVIDDSDQGGDYELIHDSAIREEGELVHLALFAESESVSLEEAMNDTKWTDAMKEELKAIEKNNTWKLVPLPAKKKPIAVKWVYKVKKNPKEEISKYKARLLAKGFLQKAGIEFKEVFAPIARMETVRIITTITSQKGWHMHHMDVKSTFLNGPLEEEVYVSQPPGFEIKGSEEKVYRLNKALYDLKQAPRAWNRRIDGFLMKLGFLKCTTEHGVYIKGSDTTNLIVVCLYVDDLLVTGNNETEIANFKGEMMREFEMTDLDLISYFLGIEFKRTDEGVIMHQGRYARDVLKKFRMVDCNSADTPTATGVNLVKDPNEEEVDVTLYRQMVGSLRYMENPKLSHFRAAKRIM

SEQ ID NO: 230495 - protein, 275 aa, Glycine max
  Coding DNA Sequence Number=SeqID_113717
  Gene Ontology: Mol. function=RNA-directed DNA polymerase activity
  Pfam annotation: Domain name=zf-CCHC; Domain location=92-109; Score =13.6; E_value=0.0057; Accession=PF00098.13; Description=Zinc knuckle
ATHGTIPFETWLKEEERTSIAKFVSGLNMEVRDKQQLKRKPTSKSYGSHSYPKKEQGKGILGAAPSKPKDDKGKTIEMESPKASMQVKTSSIKFFKCLGRGHIAFQCPTKKTMIMRGQDIYSSQDEVTTSPSSIESEEAKGEESSEEIYPQEEGDLLMVKRLLGGQSCKTPSLSYAKDQLTMKDKRDEEEKLEKQKKKKDSKALSSKAKGKEKEVKDSSKKIVKKKNHFATKGDIKRALLLKQSFYLLLSSETSPCTAIPLELEVIPQVKGLLDE

SEQ ID NO: 230496 - protein, 87 aa, Glycine max
  Coding DNA Sequence Number=SeqID_113718
MLVRMIHTRLFAAARVKSCPGMHSSCVIASLSRCARIVGVATCPFAGERGEAHGCAFQRRKDARSRHQCLFVENVGKTKGNRSKQKF

SEQ ID NO: 230497 - protein, 110 aa, Glycine max
  Coding DNA Sequence Number=SeqID_113719
  Homolog annotation: Hit_ID=Q1SK64; Match level="QueryCoverage=55%, HitCoverage=6%, E-value=2e-07, Identity=50%"; Hit description =Transposase
VEFAHWPLKRLLQNSLEDLCSVWKVMNNMITLQHTEIEASFGTSTHVVEHIFKVTLYKRLIGMLDVCGKVTLKSKLREIVYPNLNSMCAPPKKVTMDEYYQYGLCDCIKI

SEQ ID NO: 230498 - protein, 295 aa, Glycine max
  Coding DNA Sequence Number=SeqID_113720
  Gene Ontology: Mol. function=acyltransferase activity; Cellular component=integral to membrane; Biological process=metabolic process
  Homolog annotation: Hit_ID=Q1RU17; Match level="QueryCoverage=96%, HitCoverage=52%, E-value=3e-92, Identity=59%"; Hit description =Phospholipid/glycerol acyltransferase
  Pfam annotation: Domain name=Acyltransferase; Domain location=83-196; Score=32.1; E_value=1.9e-06; Accession=PF01553.11; Description =Acyltransferase
MVREVEKKNWQNLARDKYPKPLIFHDGRLALKPTALTTLAMLMWLPCGFIIALIRATSALSLPYNISTPILTFTGHHLTTSRPKTTEKEEKLLKKGHIYACNHRTLLDPLALSFMLNRDLVAVTYSLSRMSEILAPIKTVRLTRNRDEDAKTMKRLLKQGDLVVCPEGTTCREPYLLRFSPLFSEVCDEMVPVAIDCHVTMFHGTTAGGLKCLDPLFFLMNPTPHYSVQLLEKVSPSITTSNVINEDFARFEVANRVQTQIGKALGFECTQLNRKDKYLILAGNEGIVSTTKAGN

SEQ ID NO: 230499 - protein, 130 aa, Glycine max
  Coding DNA Sequence Number=SeqID_113721
  Gene Ontology: Mol. function=acyltransferase activity; Cellular component=integral to membrane; Biological process=metabolic process
  Homolog annotation: Hit_ID=Q1RU17; Match level="QueryCoverage=100%, HitCoverage=23%, E-value=2e-41, Identity=65%"; Hit description =Phospholipid/glycerol acyltransferase
MGLKIMVMVCFFGIKAERFRVGRTVLPKYLLEDVGLEMYEVVKRGGKKVGLSKLPRVMVESFLKEYLEIDFVVGRELKVFNGFYVGLMEETKTMHANLELLVREGKGNCSHMIGISGFHNLDHSFFSICK

SEQ ID NO: 230500 - protein, 155 aa, Glycine max
  Coding DNA Sequence Number=SeqID_113722
  Homolog annotation: Hit_ID=Q1RU17; Match level="QueryCoverage=42%, HitCoverage=17%, E-value=4e-15, Identity=48%"; Hit description =Phospholipid/glycerol acyltransferase
MALKSPPASNATSMKYGNTEEDFNNAPSTSKRRAWSLRFLSGLKKKRYQKMKIDLKKNVLIITILAISLNDYMNAAQNYSTFDQRTNKERCKSRQKCMNEIDHHASYYSTIGFSFLQLILWPVTCDLYGITDSQYIKGLPRKARLIMRVGLQASR

SEQ ID NO: 230501 - protein, 111 aa, Glycine max
  Coding DNA Sequence Number=SeqID_113723
  Homolog annotation: Hit_ID=Q9FGQ4; Match level="QueryCoverage=64%, HitCoverage=42%, E-value=3e-16, Identity=58%"; Hit description =Arabidopsis thaliana genomic DNA, chromosome 3, TAC clone:K5K13
  Subcellular localization annotation: CTP_CleavageSite=64; ConfidenceScore=5.02e-01
MKAVAGLPQPNNAKPIADSSFSKAKPEDSLNPQFKPPEASQLLCHSLEGNASALTNFEVLDFLRAKRASKDPTKVIAKVAQSEYKVHDYLVDTAASVQTRESINEFLTSVK

SEQ ID NO: 230502 - protein, 101 aa, Glycine max
  Coding DNA Sequence Number=SeqID_113724
MDNHLGISACHRTRRLWMTKGAEDDVSLCVSAGSLAPGWQKVQKTTLVSARQRARLPLVDERASLRADGLIGHDSERWGGQQKRGFCSYISSMCDEELRPT

SEQ ID NO: 230503 - protein, 133 aa, Glycine max
  Coding DNA Sequence Number=SeqID_113725
  Gene Ontology: Mol. function=ribonuclease H activity; Cellular component=mitochondrion; Biological process=DNA integration
MEAVLPFEVDVPSQKILAESGLQESKWAQTRYDQLNLIEGKHLTAMSHGCLYQQRIKNAFNKKVRPRKFNEGDLVLKKISHAVKDSRRKWAPNYEGPFVVKRAFFGGALVLTNMDGEELPSPVNSDVVKRYYA

SEQ ID NO: 230504 - protein, 374 aa, Glycine max
  Coding DNA Sequence Number=SeqID_113726
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=2e-52, Identity=31%"; Hit description= UPI00006A17C9 related cluster
CFRGLHVLAFRGLHALAFRGLHVLAFRGLHAHAIRTLHILTFRGLHALAFRGLQVLAFRRLHVLAFKGLHALYFRGPHSLPFRGLRTFTFRGLHVLALRGLHAITLRGLHVLPFRGLHIFAFRGLHVVTFRGLHVVAFRGLHALTFRGLHVLTFRGLHVLALRRLHVLAFRGLHILAFRGLHTLAFRRLHILAFRTLHALAFRGLHVLAFRGLHVLAFKGLHALYFRGPHSLPFRGLRTFTFRGLHVLAFRGLHAHAIRTLHILTFRGLHALAFRGLQVLAFRRLHVLAFKGLHALYFRGPHSLPFRGLRTFTFRGLHVLALRGLHAITLRGLHVLPFRGLHVFAFRGLHVVTFRGLHVVAFRGLHALTFRGLH

SEQ ID NO: 230505 - protein, 142 aa, Glycine max
  Coding DNA Sequence Number=SeqID_113727
  Subcellular localization annotation: CTP_CleavageSite=41; ConfidenceScore=5.20e-01
AVHVSSTFEFGAMFHDCLSADPQGNPPFSPFFGAPGMSLSSAVHVSSIIKRGASGDWEICSSVVFRIGSFAKHVHIRKKEGVETRVVIMERAGRTKSVSYLCFPLISDERYLAPFVAQYVKSRDVPKIKMKQAYAIRENSVM

SEQ ID NO: 230506 - protein, 113 aa, Glycine max
  Coding DNA Sequence Number=SeqID_113728
  Gene Ontology: Mol. function=fatty-acyl-CoA synthase activity; Cellular component=peroxisome; Biological process=jasmonic acid biosynthetic process
  Homolog annotation: Hit_ID=Q9M0X9; Match level="QueryCoverage=77%, HitCoverage=16%, E-value=5e-26, Identity=67%"; Hit description=4 -coumarate--CoA ligase-like protein
MVSHFIAFGALTISSGTYFQGWIGYVAPAELEGLLVSRSEILDAVVIPYPDAEVGEVPVAYVFRSPNSSLTEEGDQKFAKQVAPFKRLLRVTFINAVPKTASGKFFKGSLLRK

SEQ ID NO: 230507 - protein, 284 aa, Glycine max
  Coding DNA Sequence Number=SeqID_113729
  Gene Ontology: Cellular component=integral to membrane
  Homolog annotation: Hit_ID=Q222N5; Match level="QueryCoverage=97%, HitCoverage=24%, E-value=3e-73, Identity=51%"; Hit description =Hypothetical protein precursor
  Pfam annotation: Domain name=DUF748; Domain location=1-130; Score =58.2; E_value=2.7e-14; Accession=PF05359.2; Description=Domain of Unknown Function (DUF748)
FGTHINTLGGVINGISSNPSSTAQVELDGKVDDYGAARIRGSLQPFKTTEFTDIKLAFTNLEMNRLTPYSGKFAGRKIESGKLSVDLEYKIKQRKLAGENKFVINKLTLGERVDSKDAPNLPLDLAIAILEDSNGVIDLDLPVSGSLDDPKFSLGGIIWKAFTNVLTKIVTAPFSALGKLFGGGEKLEAIVFDPGNATLLPPEMEKLKSVATALGKRQQLKLGIVPGYAVVADTRAIQEATLRQQVAEEMGVRLKTGEAPGPIDLNNPKLQSAIQALHDRLTNK

SEQ ID NO: 230508 - protein, 105 aa, Glycine max
  Coding DNA Sequence Number=SeqID_113730
  Homolog annotation: Hit_ID=Q1SUH7; Match level="QueryCoverage=87%, HitCoverage=5%, E-value=2e-41, Identity=89%"; Hit description =WW/Rsp5/WWP; Synaptojanin, N-terminal; Galactose-binding like
MVVNSNVLKFYHENHSMVTIGQYRLPEARAGTPMYFDFSSQIQTRRICFKLVGDVAAFTDDPSEQDDSGTRISPLAVGLSLSNRIKVYYYADPYDLGKWASLGAV

SEQ ID NO: 230509 - protein, 59 aa, Glycine max
  Coding DNA Sequence Number=SeqID_113731
MVRSMDYKFHDLTLRSFFETGNARFLEKVEFGKEENIRNVVFEEEPVVDNAQVLIPINV

SEQ ID NO: 230510 - protein, 107 aa, Glycine max
  Coding DNA Sequence Number=SeqID_113732
  Subcellular localization annotation: CTP_CleavageSite=21; ConfidenceScore=5.06e-01
MVFDGYGVSKDMIFISANQVVTSLKEYCRNMPFCERARRGSRMRFPKKERCAESPPTFICGKRRKNRRKPVKMKILSSGVVFTFEEGRQKRGFCSYVPSIEEEIRPT

SEQ ID NO: 230511 - protein, 194 aa, Glycine max
  Coding DNA Sequence Number=SeqID_113733
  Gene Ontology: Mol. function=protein binding; Cellular component =membrane; Biological process=defense response
  Homolog annotation: Hit_ID=Q1RUK7; Match level="QueryCoverage=71%, HitCoverage=21%, E-value=6e-12, Identity=31%"; Hit description =Leucine-rich repeat
SAIPSWLNYSRRGPSLRFWFRNKFPAITLCVVGVFGSLLKCKMDPILTAMIQAPVITVFAATKYSIQTNHTILSDLLIEFGSNKFERFLIENKWYSAEISFEDIYGITDIEWMGVHVQEHKTNMADIQFTEPKLTMVDSKFWIHFITDVGKQLKCGDAYYCYLPPLRPNEGGEDYDWLQVYILILSVGLYCLLL

SEQ ID NO: 230512 - protein, 75 aa, Glycine max
  Coding DNA Sequence Number=SeqID_113734
MELRIRFEGGGYTNSARLDGGRCMNDHPFLGLPVRFEGGGNTNIARPSICGTPNALEPDESRKVGSWGSMNHFKK

SEQ ID NO: 230513 - protein, 109 aa, Glycine max
  Coding DNA Sequence Number=SeqID_113735
MVVTARPERVVQQFGYIQSIPPPSVSARLSHDDIYDRWMHFAEHVLPVGELCLVHGHDDYDGYEAIAQRLERVLNLRMVTAGTKLYEIMQDCLTIARGGASADGSVRAR

SEQ ID NO: 230514 - protein, 72 aa, Glycine max
  Coding DNA Sequence Number=SeqID_113736
MATLLCKSHVACKPPLVLAIQGSGAATVVLQGGAGSAEGQIATMQEQVLPSFVFLHCTALLLACVAIVLCFQ

SEQ ID NO: 230515 - protein, 37 aa, Glycine max
  Coding DNA Sequence Number=SeqID_113737
MGQKCSTVIGGIGPLAIAVYKIMDAVLHHVFFKGLRL

SEQ ID NO: 230516 - protein, 74 aa, Glycine max
  Coding DNA Sequence Number=SeqID_113738
  Gene Ontology: Cellular component=integral to membrane
  Homolog annotation: Hit_ID=Q2QLQ4; Match level="QueryCoverage=53%, HitCoverage=28%, E-value=3e-12, Identity=77%"; Hit description=Erg28 like protein, expressed
MRKEWKLLVVLEKTASRRAQMSKKPNHTEANRSVPTAISHHPNAFIFPPLFYGFLYHFTPFPETMSFQVTPTSG

SEQ ID NO: 230517 - protein, 364 aa, Glycine max
  Coding DNA Sequence Number=SeqID_113739
  Gene Ontology: Mol. function=inositol tetrakisphosphate 1-kinase activity; Biological process=inositol and derivative phosphorylation
  Homolog annotation: Hit_ID=Q9SUG3; Match level="QueryCoverage=87%, HitCoverage=87%, E-value=1e-123, Identity=70%"; Hit description =Inositol-tetrakisphosphate 1-kinase 2 (EC 2.7.1.134) (Inositol- triphosphate 5/6-kinase ...
  Homolog annotation: Hit description=2) (EC 2.7.1.159) (Inositol 1,3,4- trisphosphate 5/6-kinase 2) (Ins(1,3,4)P(3) 5/6-kinase 2)
  Pfam annotation: Domain name=Ins134_P3_kin; Domain location=41-355; Score=610.1; E_value=1.9e-180; Accession=PF05770.2; Description =Inositol 1, 3, 4-trisphosphate 56-kinase
MRLREDLPCKNDDVCEKEEVMIENDVTVAQNHWCPVVNAGFSSPKRVVVVGYALTTKKIKSFLQPKLEGLARNKGILFVAVDHNRPLSDQGPFDIVLHKLSGKEWRQVLELRSRPQGSCKGGCYYFHGLLADFVRLSHPEVTVLDPPDAIQHLRNRQYMLQAVADMNLSDSYGTVGVPRQLVIKRDALAIPELVNKAGLTLPLVAKPLVADGSAKSHELSLAYEHFSLQNLEPPLVLQEFVNHGGVLFKVYIVGDAIKVVRRFSLPDVSNWELSKDAASADDADLDPTVAELPPRPLLEKLAKELRWRLGLRLFNLDIIREYGTRDHFYVIDINYFPGYGKMPEYEHIFTDFLLSLGQGNYKKK

SEQ ID NO: 230518 - protein, 232 aa, Glycine max
  Coding DNA Sequence Number=SeqID_113740
  Homolog annotation: Hit_ID=Q1SU13; Match level="QueryCoverage=66%, HitCoverage=33%, E-value=4e-66, Identity=77%"; Hit description=IMP dehydrogenase/GMP reductase
MELSGRAFGVFSYPNPSIVEHCGFGYRSGEIQGNGNSAEESPGADAAGGAATAGVDRDFEAELGGEDGFAGELVEIGLAEVESSSDRMDQGVREEGIRRNEGNDGGLKRKILELDFAETGRRRRMNNGARGFGSDGNFEGEVANGESGERARIHGGRERRVGYSWVQLALFFAGLHSYNTFSYRQFLKVMERDERAEKEDVVGFKHVDGANGNWIEDSVFVDGASHEDAGMG

SEQ ID NO: 230519 - protein, 327 aa, Glycine max
  Coding DNA Sequence Number=SeqID_113741
  Gene Ontology: Mol. function=3'-5' exonuclease activity; Cellular component=intracellular
  Homolog annotation: Hit_ID=Q2V9B5; Match level="QueryCoverage=90%, HitCoverage=89%, E-value=6e-93, Identity=59%"; Hit description=3'-5' exonuclease domain-containing protein-like
  Pfam annotation: Domain name=3_5_exonuc; Domain location=22-211; Score=94.6; E_value=3e-25; Accession=PF01612.11; Description=3'-5' exonuclease
  Pfam annotation: Domain name=KH_1; Domain location=257-317; Score =31.3; E_value=3.4e-06; Accession=PF00013.19; Description=KH domain
  Pfam module annotation: Pfam domain module=3_5_exonuc::KH_1; Domain location=22-211::257-317
  Subcellular localization annotation: CTP_CleavageSite=27; ConfidenceScore=5.12e-01
MASSSSSSSSLPNLHPSHRAEVRIVTKASELPAAFLAPSPSSKLVIGFDNEGVKLGRDGTLCVMQLAFDDAIYIVDTIEGEENLVMKACKAALESEHVTKVIHDCKRDSEALYFQFGIRLNNVVDTQIAYSLIESQEQGKKVNDYISFVDLLADPRYCGVAYPEKEEVRLILKRNTEFWRERPLTEYKLNAAAADVRYLIHIYHKMMEKLSEKSLWYLAVRGGLYCRCFCGNAENWPPLAPEALKDENGKGPEEERIWVLDIPAGGWAREVIGDGGITIRNLRKASDAEIHIVERPPDDKAFIIGTEKEAKKAMAMVRGVWEHSEIS

SEQ ID NO: 230520 - protein, 650 aa, Glycine max
  Coding DNA Sequence Number=SeqID_113742
  Gene Ontology: Mol. function=two-component response regulator activity; Cellular component=intracellular; Biological process=two -component signal transduction system (phosphorelay)
  Homolog annotation: Hit_ID=Q35P70; Match level="QueryCoverage=58%, HitCoverage=49%, E-value=5e-49, Identity=29%"; Hit description =Transcriptional regulator
  Pfam annotation: Domain name=DUF6; Domain location=103-229; Score =2.3; E_value=0.049; Accession=PF00892.11; Description=Integral membrane protein DUF6
  Pfam annotation: Domain name=Multi_Drug_Res; Domain location=5-73; Score=-29.3; E_value=0.08; Accession=PF00893.10; Description=Small Multidrug Resistance protein
  Pfam annotation: Domain name=NB-ARC; Domain location=311-590; Score= -89.3; E_value=0.00013; Accession=PF00931.13; Description=NB-ARC domain
  Pfam module annotation: Pfam domain module=DUF6::Multi_Drug_Res::NB -ARC; Domain location=103-229::5-73::311-590
CASALLWVPISLILTVEGQQELDWRLAAGYERAELGVVYPIARGSGPVLTILFATLLMGERLSASALLGALLVIAGIFVVTGNPFRSGSRPLKGMIWGAATGTAIAGYTLWDGYSVISLHLDPVSYYASTLLLQSLILTPGAMRRRYRIPTAVRVDRVPILIIAVCSPLAYILVLTAMQSMPLALVAPLRETSIIVGSLLSYWLFRENHLARRIAGAVVVSSPLPLSVAVSAIEIRLYIPPSVLREFVMLKTEDLNTMISIDEIHFADWQIWPQLRILLHRGKPVRISARAFDVLVALAQISAIRRILGHDRHLLVTEFGCASILGRDKAVQELCALLDQYRLVTITGSGGVGKTRLAWEVVSLTHTHFPDGICVAELAHITEASSLLSVISQALHLPLAAIHNDADLRQQLARRRCLLLIDNCEHVALQVAGEQHYLLPPLQVPESEEADTHELLTFSSVRLFIERGQANRHDYHPSASELSLIGELCRHLDGLPLAIELAASRLPVMSVKEIYSRLEDRFQLLSNTHRSLEPRHQKILTALEWTYQLLNTREQRLFCSLGIYTDMFSVKSVSDLLLIKDKHRWQVVDDLQRLLSLSLIQVSTQVPETRFRLLETMRQFACDKLRQQGEYTVLEARFAGYYKVLVEEAQ

SEQ ID NO: 230521 - protein, 167 aa, Glycine max
  Coding DNA Sequence Number=SeqID_113743
  Gene Ontology: Mol. function=DNA binding; Biological process=DNA recombination
  Homolog annotation: Hit_ID=Q9RM39; Match level="QueryCoverage=100%, HitCoverage=39%, E-value=5e-73, Identity=81%"; Hit description =Integrase
MSLTDAKIRTLKATDKPYKVSDSHGLYLLVKPSGSRHWYLKYRINGKESRIALGAYPAVSLSDARQQREGIRKMLALNINPVMQRAAERGACPTEKVFKTVALAWHKSNKKWSQNTADRLLASLNNHVFPVIGYLSVTELKPRHFINLLKGIEEKGLLEVASRTRQH

SEQ ID NO: 230522 - protein, 68 aa, Glycine max
  Coding DNA Sequence Number=SeqID_113744
MGFRMWLVKQTVEKLIMIFYIMKLAKGGKRCGKHTCGMGFLYTPNDSIMAYPPTGILASLAFDSYTLV

SEQ ID NO: 230523 - protein, 66 aa, Glycine max
  Coding DNA Sequence Number=SeqID_113745
MKNTSNPHAAIVEASIKVDFHLRLPGIFLVKLVSSSKRSNCKSGAISYIRPNHTTYMPVLGLKNEI

SEQ ID NO: 230524 - protein, 181 aa, Glycine max
  Coding DNA Sequence Number=SeqID_113746
  Gene Ontology: Mol. function=DNA binding; Cellular component=beta -galactosidase complex; Biological process=DNA integration
  Homolog annotation: Hit_ID=Q1SXQ3; Match level="QueryCoverage=92%, HitCoverage=21%, E-value=6e-48, Identity=53%"; Hit description =Integrase, catalytic region
MLQNKLDEFGIILRNKARLVAKSYNQEERIDYDETYAPVARLFHMDVKSAFLNGLIEEVYVDQPLGFVDYEHPNHVYRLKRALYGLKQAPRSWYDRLSSFLIEQSFTRGQVEKTLFIKKKEFEMYMMEELNFFLGLQIKQMKHGIFLSQTKYCIEQIKKFGMEKCKEVSTPMETSRKSQDI

SEQ ID NO: 230525 - protein, 95 aa, Glycine max
  Coding DNA Sequence Number=SeqID_113747
MQVGSATFIIRVIKHSGIGNGDSKILQVASRFQDVKTSHVTSAFCSPCLHALTAVKQHLLSATSLFQDVKTSHVTSAFCSPCLHALAAASSISYS

SEQ ID NO: 230526 - protein, 83 aa, Glycine max
  Coding DNA Sequence Number=SeqID_113748
MVRWRTYSFKVDGEQREQESLDGEEDREKENTALRRRNIPRYGGEGEEAETCDDARVRQTRCSNVDRDLEGRRRLEEEESAKA

SEQ ID NO: 230527 - protein, 36 aa, Glycine max
  Coding DNA Sequence Number=SeqID_113749
MSVETALGTKGKCEVILELKKLELNVHYVTRIASCN

SEQ ID NO: 230528 - protein, 119 aa, Glycine max
  Coding DNA Sequence Number=SeqID_113750
  Subcellular localization annotation: CTP_CleavageSite=20; ConfidenceScore=5.00e-01
MNHFFRKVPGRGFPEVFRKKCSSGRRLVTSGRTLLPETFRKRFHCYANNVAYYKQRVGRETNLFAEKKKTLPWARLAEKKEVHEEDKKNQVHGRGREDEAVRTNSVFRELTQSGFSSLT

SEQ ID NO: 230529 - protein, 794 aa, Glycine max
  Coding DNA Sequence Number=SeqID_113751
  Gene Ontology: Mol. function=calmodulin binding
  Homolog annotation: Hit_ID=Q1S042; Match level="QueryCoverage=99%, HitCoverage=99%, E-value=1e-137, Identity=41%"; Hit description =Calmodulin-binding, plant
  Pfam annotation: Domain name=CaM_binding; Domain location=652-767; Score=170.2; E_value=5.1e-48; Accession=PF07839.2; Description=Plant calmodulin-binding domain
MVQRKVPSKLGIEAEHVKSEKRLANSKLSSSQHQDGKTRGADMKKKMKKSRSIKLSDLEALQSSSPSRRRLSQPGKPLPLHTPTTTASPQKQQPLFRTTHGSPNYMKPTSSSHAKKELFPVSHRNTQPGSDFRSLPRQFSSDSKASCAKKPAKVLTRTSSLSLVRTLTKTTSFKASRACSRKSTRAVMCADMGAPQRATCSSTLKDSKFPAYLMLSPGGTESEGTSAMKVCPYTYCSLNGHHHADLPPLKSFVSARRLLLKMQKRAKLEALSPRRLKVPLETQKEDSDAEQNVFDAKPSCDEIGIDIFIEIYANEKDAKPTAAEEMGRIDFLKEIEDHEDNKSTLEDNGIEASEGVMQITTSRSIGNCIPSPSISEIDLEEDLKKSLDNVAIEVDTKGSSLLEQNEGGADEDYQSIVWSHEEMSMGSYCSDGEQDMGDVDMDDSDSKTFDMEWEEERLHRFDHEEDADSSVYSEEDNDSKVESSSESSHDVSVTWLDDILGGYYEHFLVDETHKEANSEESTYFEEQPSGINSVLEDTNGSTETQEIGYDQPSFTEEIFEYLTNAQNNGEGDEKHKDDDAASCNTKARDEETIDNTQCQKMSETSKIEETNEDGYSSSLENNDESNKGERQIELVDVSKESNIASEDQDLLEKDQGKAIGLQQSTSCISAEEESTSKNWKDGIRRKKGVEDDDDEMRKFNPKEPNFLPLVPEPGQEKVDLRHQMMDERKNSEDWMLDCALRQVVTQLAPARKKKVALLVEAFETVLPAAAPKCETRVRNNSPAFGHSGIIQACS

SEQ ID NO: 230530 - protein, 146 aa, Glycine max
  Coding DNA Sequence Number=SeqID_113752
  Subcellular localization annotation: CTP_CleavageSite=16; ConfidenceScore=5.50e-01
MELPTQRSSSHHATVEADIKTTLTTPTFIVVNTSMFGTVQMAKRSPNVSSARTGVAYEARTFQSLIVFGVRYVSVSVFDTDTTSVLRSIFLDITGIHVSMSVSCPVFVSVLHRASLTLTAPIIRHRGIKTTNIWDITFHSIRYPKT

SEQ ID NO: 230531 - protein, 102 aa, Glycine max
  Coding DNA Sequence Number=SeqID_113753
  Gene Ontology: Mol. function=transferase activity, transferring glycosyl groups; Cellular component=endoplasmic reticulum; Biological process=dolichol-linked oligosaccharide biosynthetic process
  Homolog annotation: Hit_ID=O80505; Match level="QueryCoverage=87%, HitCoverage=23%, E-value=6e-35, Identity=72%"; Hit description =Probable dolichyl pyrophosphate Glc1Man9GlcNAc2 alpha-1,3- glucosyltransferase
MGGVVTAVFASAFGPFFHLGQTQQIIQRLFPFGRGLCHAYWAPNFWVFYIMSDKGLAFIFRKLGFNVQTPTGSFTAGLVGDSSPFSVLPQASYFNFQRATVQ

SEQ ID NO: 230532 - protein, 142 aa, Glycine max
  Coding DNA Sequence Number=SeqID_113754
MKRVIASSHLRFALSFSGRCYGWGQRLQSACGDDETMLCSPDLVVPTPQFSYSTFLLSIWLFCKSQTLRQKSIFRKLQCLEKPYGMWHLTMNDADVTDNKEDEEKRTTGESKKKIKNGGTKNQSRKGEEVGMEEERTIPMKS

SEQ ID NO: 230533 - protein, 119 aa, Glycine max
  Coding DNA Sequence Number=SeqID_113755
MLERGECTLQFVKSIFSKNYCLKISNWCIRLKQCKESDKLESCALVTCWSWVRIRKQPLCICKGKAAYNIPPPYLRITKSLWAMGYEVFYYSSADSSQSDVQALEVFLAHKSIIKCLTH

SEQ ID NO: 230534 - protein, 77 aa, Glycine max
  Coding DNA Sequence Number=SeqID_113756
  Gene Ontology: Mol. function=sugar porter activity; Cellular component=integral to membrane; Biological process=carbohydrate transport
  Homolog annotation: Hit_ID=Q2HSP6; Match level="QueryCoverage=98%, HitCoverage=13%, E-value=4e-29, Identity=79%"; Hit description=Sugar transporter superfamily; Major facilitator superfamily MFS_1
MEGGGVEVDASAFRECLSLSWKNPYVLRLAFSAGIGGLLFGYDTGVISGAILYIRDDFKAVDRKTWLQVLFISKAVS

SEQ ID NO: 230535 - protein, 139 aa, Glycine max
  Coding DNA Sequence Number=SeqID_113757
METQTGEIQSTSSLGIPRISSVARDSDLIENLQYTSLKDIICNTPARYYLTLYEGNEFDSTIAIRNELVKRAASVYLQSAALLVTRNQNCFVSFWERLKNRAASYSRWRVLDHANPFRACLDPIYQFLNHMFGSIRSLP

SEQ ID NO: 230536 - protein, 97 aa, Glycine max
  Coding DNA Sequence Number=SeqID_113758
  Subcellular localization annotation: CTP_CleavageSite=44; ConfidenceScore=5.43e-01
MATDPTSPSQSDGQSEATSKRSRTTTRLRTLTLRTVDQPRPAVYVDLATGRASGPMREKFHSYLGVVAREKVPIIHNNWKDVPETLKDIVWNDILLI

SEQ ID NO: 230537 - protein, 211 aa, Glycine max
  Coding DNA Sequence Number=SeqID_113759
  Homolog annotation: Hit_ID=Q2QYH0; Match level="QueryCoverage=56%, HitCoverage=17%, E-value=3e-18, Identity=42%"; Hit description =Expressed protein
  Pfam annotation: Domain name=DUF936; Domain location=1-209; Score= -73.4; E_value=2.1e-10; Accession=PF06075.3; Description=Plant protein of unknown function (DUF936)
MASLVQGVLLKLLQSMNSNVKVHGEYRSVLLQVISIVLALSGFELWPNQGFFIKVSDSSHSTYVSLSKEDNEFILNNKLQLGQFFYVDRIESGTLVPILVGVRPVPGRHPFEGNPKDLMQMLEQSDNVGVNGSKSMDLTEAKENPSSRQKIVIKEEKVGVASRTQSSLMLRSSSNTDSEGLVETVDRLKQKVYSCLLVHIDSATLALENRA

SEQ ID NO: 230538 - protein, 59 aa, Glycine max
  Coding DNA Sequence Number=SeqID_113760
MKVEEFQRYHTSQASDSEYSQDQSQGIELGAHKKKLYISHNYDPSLASYHYTTNKLTLK

SEQ ID NO: 230539 - protein, 138 aa, Glycine max
  Coding DNA Sequence Number=SeqID_113761
MLLLPLSLTELVIDADVWMEVAGLDMGGIRKFEETIDGEEFEEAPRCRWSDIRRQNAHVPHYLHSHSKRSSNHAQIVDFTKASSEITERHLKNLGMRLVEHEWIMVGEPPSARNMDQMDEEAKAEAPQELAHQWSPFK

SEQ ID NO: 230540 - protein, 132 aa, Glycine max
  Coding DNA Sequence Number=SeqID_113762
MGSYGGHSSTGEGGTTVWLYSEHPSAACICGLHGVVFPDISPIHDIDPADPEEFIQPPSPQVPVAFDPPPHAVDDYDGYEAIAQRLERVLNLRMVTTGTELYDIMQDCLTIAKGGASADGSVRVRQRRRTEH

SEQ ID NO: 230541 - protein, 79 aa, Glycine max
  Coding DNA Sequence Number=SeqID_113763
MIMRGQDIYISQDKATTSHSSSESEEAKGEESSEEIYPQEEGQPKLVFGAFGRYGICQQRQLKGKSLRLYLKKRMELIN

SEQ ID NO: 230542 - protein, 201 aa, Glycine max
  Coding DNA Sequence Number=SeqID_113764
  Gene Ontology: Mol. function=sugar porter activity; Cellular component=integral to membrane; Biological process=carbohydrate transport
  Homolog annotation: Hit_ID=Q9C757; Match level="QueryCoverage=96%, HitCoverage=34%, E-value=2e-69, Identity=64%"; Hit description =Probable inositol transporter 2
GKEEEAKAILRKIYPPNDVEEEIQALHDSVATELEQAGSSEKISIIKLLKTKAVRRGLVAGMGLQIFQQFTGINTVMYYSPTIVQLAGVASNQTAMLLSLITSGLNAFGSILSIYFIDKTGRKKLALLSLCGCVVALALLTFTFRQTETHSPMISAVETAHFNNTCPGFSQAVNANEWDCMKCLKAECGFCASDVSSNIKK

SEQ ID NO: 230543 - protein, 126 aa, Glycine max
  Coding DNA Sequence Number=SeqID_113765
MTIFVSACQRARLPLVDRWRMTIMCLRVSSDSLVSGWKRCADDHNLSPRTIGLDCLWISIGAQMTIISLRVPSELVVSRWETSIVSVKHKWQRTLSPMKARTLSPLKARTLSPMKDKGEDFESYER

SEQ ID NO: 230544 - protein, 127 aa, Glycine max
  Coding DNA Sequence Number=SeqID_113766
MVAFVRQYQYNSDMAPDRTQLQNMCKKEHESFKEYAQRWRDLAAQVAPPMTKKEMITMIVNTLLVFYYDKMVGYTPSSFVDLVFAENFWCEDPEGQQRLKRKLSSRVLDESLSDCEVSRGEGDILTT

SEQ ID NO: 230545 - protein, 172 aa, Glycine max
  Coding DNA Sequence Number=SeqID_113767
  Gene Ontology: Mol. function=sugar porter activity; Cellular component=integral to membrane; Biological process=carbohydrate transport
  Homolog annotation: Hit_ID=Q7XIZ0; Match level="QueryCoverage=89%, HitCoverage=24%, E-value=2e-23, Identity=47%"; Hit description =Putative proton myo-inositol transporter
MALCIEAVTTINDPALIKCDIWGTFVYQRRFQRCGQIDLASVKNLYILRETFGEAPRLEDVLKFVQIHSLIVTKQKAIVSRALVGVIIGASVGGWMNDRFGRKITILYADALFFAGSVIMSVAPNSAVLVFGRVFLGLGVGMASMTSPLYISEASLTRVRGAPGKGTWRWIL

SEQ ID NO: 230546 - protein, 390 aa, Glycine max
  Coding DNA Sequence Number=SeqID_113768
  Gene Ontology: Mol. function=sugar porter activity; Cellular component=integral to membrane; Biological process=carbohydrate transport
  Homolog annotation: Hit_ID=Q2HSP6; Match level="QueryCoverage=99%, HitCoverage=68%, E-value=1e-159, Identity=69%"; Hit description =Sugar transporter superfamily; Major facilitator superfamily MFS_1
  Pfam annotation: Domain name=Sugar_tr; Domain location=1-371; Score =14.4; E_value=2.5e-07; Accession=PF00083.14; Description=Sugar (and other) transporter
APGTWRWMLGVAAAPAIIQVVLMFTLPESPRWLFRRGKEEEAKAILRKIYQANEVEEEIQALHDSVAMELKQAESSDNMNIIKLFKTKAVRRGLVAGMGLQIFQQFTGINTVMYYSPTIVQLAGYASNQTALLLSLITSGLNAFGSVVSIYFIDKTGRKKLALLSLCGCVVALTLLTFTFRHTATHSPMISALETVHFNNTCPGFGHAVNANQWDCMMCLKAECGYCASGVSSKSLPGACLISNDATKGMCQKEHRAWYTQGCPSKIGWLAIVGLALYIIFFSPGMGTVPWVVNSEIYPLRYRGVCGGIASTTCWVSNLIVSQSFLTLTVAIGTAWTFMLFGFVALIGIFFVLIFVPETKGVPMEEVEQMLEERAVHLKFWEKASPPQKG

SEQ ID NO: 230547 - protein, 132 aa, Glycine max
  Coding DNA Sequence Number=SeqID_113769
DPTVNELDRRNCYCGLYVRKAVILVDVLSRVFCLCSVLLGCDSLCCLNVVLLGCCGSLRGLMGTRGWWVYARIVDEESLLCTIARPPPSTTCDGVVPGDMSRGSETLGTSGGVLLPKTKLDQSRPNPGIVGQ

SEQ ID NO: 230548 - protein, 232 aa, Glycine max
  Coding DNA Sequence Number=SeqID_113770
  Gene Ontology: Cellular component=mitochondrion
  Homolog annotation: Hit_ID=Q8TGM6; Match level="QueryCoverage=51%, HitCoverage=97%, E-value=1e-09, Identity=43%"; Hit description =Protein TAR1
GDPTNQLPCALRVNSPVDSHTGQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWARSATEDASPDYNSDAEGDRFSWWAFPGSLAVTKGILVSFFSSAY

SEQ ID NO: 230549 - protein, 117 aa, Glycine max
  Coding DNA Sequence Number=SeqID_113771
MGIAPARHPVDPETSNRALGFPALVTGLYKSYRAPVPPSSLCHRDLGIVPAKHSVDPEKSNRVLGLPALITGLCRFYGVPVAPSKVIRPPINQAFIKKYCAPRQAQGETPQQHWDGR

SEQ ID NO: 230550 - protein, 137 aa, Glycine max
  Coding DNA Sequence Number=SeqID_113772
MACLLEGCNLHGCIKQALNIIGKDFSGFIPKGTTWFQKKRKQGQQKPFQINDKDPNGKKGRGKHELAHGLAEIKKQHLERTQGRTMKLPGQIGQASGEERLAGVDRAFHGDPNPGLARENGGWRRRRQRMEPALMPS

SEQ ID NO: 230551 - protein, 78 aa, Glycine max
  Coding DNA Sequence Number=SeqID_113773
MGSPSAGDVLGQLIGARDESKGLDEGGDTGLGQACCCANNELMIEAGATKGIEETIRDGSSVGRVALFSAEGEGAGFE

SEQ ID NO: 230552 - protein, 492 aa, Glycine max
  Coding DNA Sequence Number=SeqID_113774
  Gene Ontology: Mol. function=ATP-dependent helicase activity; Cellular component=nucleus; Biological process=RNA-mediated posttranscriptional gene silencing
  Homolog annotation: Hit_ID=Q8VY00; Match level="QueryCoverage=90%, HitCoverage=42%, E-value=0.0, Identity=82%"; Hit description =Putative RNA helicase
  Pfam annotation: Domain name=DUF1605; Domain location=380-460; Score =55.3; E_value=2e-13; Accession=PF07717.6; Description=Domain of unknown function (DUF1605)
  Pfam annotation: Domain name=HA2; Domain location=254-346; Score =98.1; E_value=2.6e-26; Accession=PF04408.13; Description=Helicase associated domain (HA2)
  Pfam annotation: Domain name=Helicase_C; Domain location=99-193; Score=57.0; E_value=6.2e-14; Accession=PF00271.21; Description =Helicase conserved C-terminal domain
  Pfam module annotation: Pfam domain module=DUF1605::HA2::Helicase_C; Domain location=380-460::254-346::99-193
DIARFRPDLKLLISSATLDAEKFSDYFDSAPIFRIPGRRYPVEISYTKAPEADYLDAAIVTSLQIHVTQPPGDILVFLTGQEEIETAEEILKHRTRGLGTKISELIICPIYANLPTELQAKIFEPTPEGARKVVLATNIAETSLTIDGIKYVIDPGFCKMKSYNPRTGMESLLVTPISKASANQRAGRSGRTGPGKCFRLYTAYNYHNDLDDNTVPEIQRTNLANVVLTLKSLGIHDLLNFDFMDPPPAEALLKALELLFALSALNKLGELTKVGRRMAEFPLDPMLSKMIVASENYKCSDDIISIAAMLSVGNSIFYRPKDKQVHADNARLNFHTGNVGDHMALLKVYNSWKETNYSTQWCYENYIQVRSMKRARDIRDQLAGLLERVEIELTSNANDLDAIKKSITSGFFPHSARLQKNGSYRTVKHSQTVHIHPSSGLAQVMPTRSRYLLRSFNGSLTWKKVLDANLIIASDDNIVNIGNKCNGLQENE

SEQ ID NO: 230553 - protein, 74 aa, Glycine max
  Coding DNA Sequence Number=SeqID_113775
MVFLPVSSKKIKKKKVAAAGVSLSEAYALSEQHPLSEALSSLSELEESGRESTKHARAISSSSESFVSSDAKRA

SEQ ID NO: 230554 - protein, 131 aa, Glycine max
  Coding DNA Sequence Number=SeqID_113776
  Gene Ontology: Mol. function=ATP-dependent helicase activity; Cellular component=nucleus; Biological process=RNA-mediated posttranscriptional gene silencing
  Homolog annotation: Hit_ID=Q6YUI7; Match level="QueryCoverage=95%, HitCoverage=11%, E-value=9e-52, Identity=80%"; Hit description=RNA helicase-like
  Pfam annotation: Domain name=DEAD; Domain location=3-130; Score= -43.0; E_value=0.024; Accession=PF00270.19; Description=DEADDEAH box helicase
MKTKVLVIVGETGSGKTTQIPQYLHEAGYTKRGMIACTQPRRVAAMSVAARVSQEMGVKLGHEVGYSIRFEDCTSEKTILKYMTDGMLLREFLGEPDLASYSVVMVDEAHERTLSTDILFGLVKVDRKFLS

SEQ ID NO: 230555 - protein, 1471 aa, Glycine max
  Coding DNA Sequence Number=SeqID_113777
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=95%, HitCoverage=92%, E-value=0.0, Identity=37%"; Hit description=Chromo
  Pfam annotation: Domain name=Chromo; Domain location=1368-1422; Score= 48.4; E_value=2.4e-11; Accession=PF00385.14; Description='chromo' (CHRromatin Organisation MOdifier
  Pfam annotation: Domain name=RVP_2; Domain location=401-515; Score= -32.8; E_value=0.00036; Accession=PF08284.2; Description=Retroviral aspartyl protease
  Pfam annotation: Domain name=rve; Domain location=1065-1221; Score =119.3; E_value=1.1e-32; Accession=PF00665.16; Description=Integrase core domain
  Pfam annotation: Domain name=zf-H2C2; Domain location=1006-1047; Score=7.1; E_value=0.042; Accession=PF09337.1; Description=His(2) -Cys(2) zinc finger
  Pfam module annotation: Pfam domain module=Chromo::RVP_2::RVT _1::Retrotrans_gag::rve::zf-H2C2; Domain location=1368-1422::401 -515::634-800::108-198::1065-1221::1006-1047
MGERIEALETQMGNVTTTLHDLALQMQQHAQQMQQQSVILTELSKQISQKGVSPEGETSVGDSTQNESRLVEKKVKLPVFEGEDPVAWITRAEIYFDVQNTPDEMRVKLSRLSMEGSTIHWFNLLRETEDDLSWEILKRALIARYGGRRLENPFEELSTLRQTGTVEEFVEAFELLSSQVGRLPEEQYLGYFMSGLKQPIRWRVRTLNPQNRMQVMRMAKDVEEELKEEDDEGDRYYGKNRMGRSEPNRLLSKSRNGSNPIHKDFTRSNSGGYAPSQKTGSTGSNTNPTSSMNSTGRKGENDRRTLSSERWKGVRGVQSDEIAERRAKGLCFKCGGKYHPTLHKCPERAMRVLILGEGEELNEEGEIVSLEATETEGEGEETEAECNLIGVMGSMGEYNTMKICGKIASIDVMVLIDSGASHNFISPEITTALGLSVTPMAAKNIKLGDGHKVLSKGICEGVQIDLGPQVFHVDALVLELGGLDVVLGVSWLSTLGKVVMDWKDLSMQFMHEGRMVNLQAQGRIQEKQSCLHSFLEDKHRRGGEGWWWTQQEERDIAQAAGQMELTKLLSQFSEVFQEKITLPPERSQVHQIKLIPEHGPVNVRPYRYPHHQKKEIEKQVTELLAAGVIRTSMSAFSSPVILVKKKDGSWRMCVDYRALNKATVPDKYPIPIVDELLDELYGATIFSKIDLKAGYHQIRVHKDDIHKTAFRTHNGHYEYIVMPFGLMNAPATFQATMNDIFRPYLRNFVLVFFDDILVDYLGHVISGDGVAVDPDKIKCVLEWPEPKNVKGVRGFLGLTGYYRKFIKDYGKIAKPLTELTKKNNFVWGKEALVAFKLLKQIMTTPPVLGLPDFSVPFEVECDAAGRGIGAVLMQKRQPIAFFSKALSDGNLTKSVYEKELMALVLAIQHWRHYLLGKPFVAADALSRCHGDMELAVMLSYPTWLDGEQLLQEVRQDPVLKKTVEELKRNPGAKTGFTVRQDVLFYQGRLVLSSDSPSIPVLLKEFHETPMGGHSGFLRTYRRLAANLYWTGMQKRVRDFVRACDTCQRQKYAATAPGGLLQPLPIPNAIWEDLSLDFITGLPKSKGFEAVLVVVDRLSKYSHFLLLKHPYTAKSVAELFVREIVRLHGVPLSIISDRDPLFMSHFWLELFRLQGTKLKMSSAYHPETDGQTEVTNRCLESYLRCFAFEQPKTWSHWIPWAEFWYNSTFHVSIGKTPFEVVYGRQPPNIIRFLSNETKVAAVAMELCERDEALNQLKAHLLRAQQQMKKYADKKRREVQFAVGEWVFLKLRPHRQQSVAKRINPKLAARFYGPFQIIERLGEVAYKLQLPPQSRIHPVFHVSLLKKAIGDYSVQGDLPTELEVTDMDEFYPEKVIGSRTITQGGVSVPQSLVQWKHKSSDDVTWEDDAFIRGQFPDFNLEDKVVAKEDGIDRNLSKEVGLDENVNRPKVWRVYTRKNGKGKKNDEVAEDTSK

SEQ ID NO: 230556 - protein, 322 aa, Glycine max
  Coding DNA Sequence Number=SeqID_113778
MKHKVGLVMDKIAEDEQRQGKKETEHTFRNKGLLKQHPQRMQPPVSYATVVAKGNNNTKKRWFPRHAILTRSISHLTLQLNIPIEETKWYSNAWVGRLRNLVLFDKMEDEIMWVGGEDIMPKYLGDDMVLLTGLTDTRAEEMCKEGACWGIPLHAWDKENIKKIVWVVGEGVEVDDEEYTVHMAEETCHSPDTNKWRMRSMMGSSEEISSDESETGLPLSATYESSESKFPMNINNENGGKLGGAARDKQLSDGQCPTLGSKGNTLWVLTQRPQQPRHRDESCGQSETAGNADSGISKPIQQLQSGGKDTKQTATRGHKEET

SEQ ID NO: 230557 - protein, 143 aa, Glycine max
  Coding DNA Sequence Number=SeqID_113779
  Gene Ontology: Mol. function=ATP-dependent helicase activity; Cellular component=nucleus; Biological process=RNA-mediated posttranscriptional gene silencing
  Homolog annotation: Hit_ID=Q8VY00; Match level="QueryCoverage=98%, HitCoverage=13%, E-value=5e-47, Identity=65%"; Hit description =Putative RNA helicase
MSLQKGFKARILEEKGGKEIRRTEHGHCRDDIEDEQYLFEGVKLSEAEYRELRYKKEIYELVKKRSEEADNANEYRMPEAYDQEGGVNQEKRFSVAMQRYRDLNAEDKMNPFAEQEAWEEHQIGKATLKFGSKNKKQVSDDYQ

SEQ ID NO: 230558 - protein, 123 aa, Glycine max
  Coding DNA Sequence Number=SeqID_113780
MSKERESWMGSKKGEVITRLLFSVPASSSPSLLDYLFASYSGIDYYSSVHLDVFGLDMAMRRDEYGYCLPNFLPRLFNTSPYPYSIPDRFKFIVSSLYSSGIRRVSGIPDPVPYTIQIRKIFF

SEQ ID NO: 230559 - protein, 172 aa, Glycine max
  Coding DNA Sequence Number=SeqID_113781
  Gene Ontology: Mol. function=transcription factor activity; Cellular component=nucleus; Biological process=regulation of transcription, DNA-dependent
  Homolog annotation: Hit_ID=P93392; Match level="QueryCoverage=93%, HitCoverage=59%, E-value=6e-39, Identity=55%"; Hit description=S25 -XP1 DNA binding protein
  Pfam annotation: Domain name=AP2; Domain location=25-90; Score=133.4; E_value=6.3e-37; Accession=PF00847.10; Description=AP2 domain
MAPTEGNHGKAKQLVVKSEAQNNKERSYIGVRKRPWGKFAAEIRDTTRNGARVWLGTFDSIEAAALAYDQAAFTMRGDHAVLNFPVKTVKKSLQEIQYSCCNGSSPALALKERHCIQRKLSSKAKMCRGKETSSSEDSTQSVVVFEDLGVDYLEHLLSVSDQSESTSPSYFN

SEQ ID NO: 230560 - protein, 209 aa, Glycine max
  Coding DNA Sequence Number=SeqID_113782
  Gene Ontology: Mol. function=sugar porter activity; Cellular component=integral to membrane; Biological process=carbohydrate transport
  Homolog annotation: Hit_ID=Q2HSP6; Match level="QueryCoverage=68%, HitCoverage=25%, E-value=3e-42, Identity=53%"; Hit description=Sugar transporter superfamily; Major facilitator superfamily MFS_1
MEITEVEAGEGWVSLGKMLKITCEERFICWDGHSLFPTVCGYQHSHVLQPHTIVQLAGFASNQTKISSPLIDPTETTPFNGTCSGYTAATNRDQWDCKTCLKGSKKCGFCAASDKLKPGACWDYDNNSENHCTSQHRDWYSKGCPSKTGFVAIIGLALYIMFFSPGIGTVSYVINYEIYPLRFRGVCGGMASTAVWVSNLILFASPSYP

SEQ ID NO: 230561 - protein, 205 aa, Glycine max
  Coding DNA Sequence Number=SeqID_113783
  Gene Ontology: Mol. function=receptor activity; Cellular component =outer membrane-bounded periplasmic space
  Homolog annotation: Hit_ID=Q0K6F2; Match level="QueryCoverage=57%, HitCoverage=35%, E-value=7e-36, Identity=62%"; Hit description =Probable extra-cytoplasmic solute receptor precursor
  Pfam annotation: Domain name=Bug; Domain location=1-128; Score= -121.4; E_value=0.0021; Accession=PF03401.5; Description=Bordetella uptake gene (bug) product
MANDTQLMVDVISTSLPLVRENKIKALAVTGAQRLPVLPDVPTVAESGFAGFRAATWFGVAVPRGTPPAEADRLREAVAAVMRQADFRDRFQAQGLVIQAPRGQAEVDAYLAEDRERWNGEAPQGQGRAAAGGHDGVDACRRGAPGGQQLRQVAFGQGAGAQRRQVAAEAAGAEFDRFGLARRADEVPALRAVLGRMGQQRQRVQ

SEQ ID NO: 230562 - protein, 173 aa, Glycine max
  Coding DNA Sequence Number=SeqID_113784
MGRGPPVVLEKVKFDHIEERLRVIEGGGNYGFANMSELCLVPNVVIPSKFEVPNFDKYKGTTCLRNHLKMYCRKMEAYAKDEKLLMHFFQESLVKDLMDAFIMQYQYNSDMALDKMQLQNMCKRDENESFKECAKRWRDLTAQVASLFAHVTYAPELISKSAQSEIACLVGLL

SEQ ID NO: 230563 - protein, 107 aa, Glycine max
  Coding DNA Sequence Number=SeqID_113785
MEDESSEATILEPLVLGEEEGETQVRQVVAVTPERSLEATSEPPAPLVDLPSPQRTTNPSTPILEMPEDQTTLVLTMDTSPPATPVLHLTNEEDVQTQDTQDQSQEF

SEQ ID NO: 230564 - protein, 78 aa, Glycine max
  Coding DNA Sequence Number=SeqID_113786
MHIEARFRPDRHREMSADHAHHHNSDLPFPKCQLDHAHKTPSRPGKVQQGPGVSSSGYGPLSVLEGARPPQQGHVIVT

SEQ ID NO: 230565 - protein, 147 aa, Glycine max
  Coding DNA Sequence Number=SeqID_113787
MNLDRLHQIDMRDNHYIDGMEYHAEWINIWKNKRNDVLVGQWVEGIVTHTPAYMEWYRKNIDHNNISNISTFGAPYLSRTMFYLFVIIHHNNNPPTNQHGSTSNLEDLSDEYKTCLVKNYDSDTDSSSRPEGSNMSPSHETIFKRDW

SEQ ID NO: 230566 - protein, 69 aa, Glycine max
  Coding DNA Sequence Number=SeqID_113788
MGCFASKNADTKASRAARWRSTGIVALRDSKLKAIDIPVEISKLINVQRLVRTNYYSAFGTVSSIEHLL

SEQ ID NO: 230567 - protein, 203 aa, Glycine max
  Coding DNA Sequence Number=SeqID_113789
MWWKWVDVDYKSLRYLSNDQDAMDLARGELTGGEELFNDQQIVEFDHSVDDLFDWDNAMAFDDNNESSRKQNEPTVKSKVSNKGKYNASKYEDPSIENPGRCDEDLDGIDDDNMPNHPMRNLIQILRRCTIWRLAMKLMSCTMMLKVARNIVVAVGTETQVAEYEIPTAGNNVANARSAVGGLGSTIPIGNNVAMPTESDIPT

SEQ ID NO: 230568 - protein, 145 aa, Glycine max
  Coding DNA Sequence Number=SeqID_113790
  Homolog annotation: Hit_ID=Q10Q27; Match level="QueryCoverage=22%, HitCoverage=12%, E-value=2e-07, Identity=78%"; Hit description =Leucine Rich Repeat family protein, expressed
MEGFQEFEARRKKKFDKQIDSNVMIGSKGLDEGGLRLVDGVLSVVHLDELLDVAWNTGSTNKLGRHFWRCWNWVGPINVRGSNVDERQTVIVDPSQGIFHRIEQQLEQQLEEAQMKIIKLQKIVVGERMNVYLLMGLSVMCLSML

SEQ ID NO: 230569 - protein, 70 aa, Glycine max
  Coding DNA Sequence Number=SeqID_113791
MVISWAKRIPTAKRSFSALSAKENLEEHQHQGRALSARSGRQCPGHSSHRAYFRKRALEAAKRSNLCIET

SEQ ID NO: 230570 - protein, 145 aa, Glycine max
  Coding DNA Sequence Number=SeqID_113792
MEASKREEEENLLRMKKLKAAKAQNIMGFQPVQDDLNVEIITDVLAKLRTVESILEKEEDKLEEPFEMEEKVEVAAETAQNVPEVAVGERTPIVFMKDYLFNIENVQNLFNTPIFHTYVKIVCRLGPLHGEPSNFSIPFPQFPYD

SEQ ID NO: 230571 - protein, 79 aa, Glycine max
  Coding DNA Sequence Number=SeqID_113793
  Gene Ontology: Mol. function=DNA binding; Biological process=DNA integration
  Homolog annotation: Hit_ID=Q1SRA3; Match level="QueryCoverage=81%, HitCoverage=10%, E-value=3e-12, Identity=49%"; Hit description =Integrase, catalytic region
MPKTNEVIEGTRPQRDRHVLIKFDQFEMFPDNVVTDDGDLIHLALLADIEPVDFKEAAKEQTWKQAMIEELQSIEKNHT

SEQ ID NO: 230572 - protein, 180 aa, Glycine max
  Coding DNA Sequence Number=SeqID_113794
MVDIPTNNLLDANNLDTHSHSDIASPTVPIPLDNLGKSTIISQPFGGLPFGIGVILSHASDSLSDTISPIVGHVDDCALTSQHEGVSKDLRTMSKFWAYMLYSPIPTESLNPSYFGVIRLGCYKNTMQKDPDFEVVLSKSQKKKIKKKARDDDSAITHHTGSKGSLSARDQCKSSIGMLE

SEQ ID NO: 230573 - protein, 188 aa, Glycine max
  Coding DNA Sequence Number=SeqID_113795
  Gene Ontology: Mol. function=nucleic acid binding; Biological process= regulation of transcription, DNA-dependent
  Homolog annotation: Hit_ID=Q1T5Z8; Match level="QueryCoverage=72%, HitCoverage=44%, E-value=6e-19, Identity=48%"; Hit description=Zinc finger, CCHC-type
MILGVGPESGGRGPDGLFGGDTISVTIPEEEYLSGLESCKNHLHGRFLLPKGSKKGPFCRLLGNFTGLIASVLMEYWRPNILFSIPRGVGTPLLLDDAIIKRTFGHHAHVLVDLDLSGELRDQVLMERSGYAFFVTITYERLPHFYFNCKNIGHIVANYKSSIQHAKEPLGHWQGALKNNSKKLLVVY

SEQ ID NO: 230574 - protein, 195 aa, Glycine max
  Coding DNA Sequence Number=SeqID_113796
MVCAKNAVLTGRLLAGSFTFECRIMHYILCRVLLPHSTNLAQAFEEDLILLWALQTSRQIDWAHLVRYHMHKALQENAPLPYPYLVTLILQHFNIPLVNEPFVIVKRSFSIGVAAVASFGDRKDLDGQWICKQDLPPNDPDECTPSPPPRDPSSSLMCDVLTELWDLRAFVRDRYLKYLGKKKENHAREILCNNK

SEQ ID NO: 230575 - protein, 229 aa, Glycine max
  Coding DNA Sequence Number=SeqID_113797
  Gene Ontology: Mol. function=RNA-directed DNA polymerase activity; Biological process=RNA-dependent DNA replication
IKNIVVEVWKQPQVGCPMYILKLKIKSSKTAIKSWNVHVFSNVHNKAKSALEMVDNVQQHINLKGKNLGLIGSALGIEILPFFTRSPELEGIIPNLVSNEDKAMLSNLPSLEEVRNVVFSRSSTSATGPDGFGAVNMLNCKVYGGNLGIKFDVKKAFDTLEWKFLLNVLKSFGFCSTFCGWIKRIIESARLSLAVNEEVLSRGISSLVASNSLLPMASPKQFATPMHIL

SEQ ID NO: 230576 - protein, 90 aa, Glycine max
  Coding DNA Sequence Number=SeqID_113798
MKKIIWQKLKEGDIHHNINDDEPQVGESNIGGSTSDGPHVVIKQKNDDLGLVHRWIVVKFEHHVRNPISSLLTVENFNIMFELREILFAS

SEQ ID NO: 230577 - protein, 113 aa, Glycine max
  Coding DNA Sequence Number=SeqID_113799
VRAMRVLIEYSYSTFKNSQPEKSNGSNQLSAMADLQVLMKGLDPPPGSPILSSFLSTKNFQSKGEEGEGEAEAKVSAKGRVNDAVGHGGIGLDDGGGVGFFSVGEGKEGELNF

SEQ ID NO: 230578 - protein, 119 aa, Glycine max
  Coding DNA Sequence Number=SeqID_113800
MADTYSAPKEIHGLLSYLRIKSLPHLISSMHCMLVSSFVTGSRKNCHSLDYRVEPSSCFYKKVHQVKLKYGSNRLAKLGQKMNRVTSLLRLLPNIFRIVDVLVTSSFTLTKMSWIMLKI

SEQ ID NO: 230579 - protein, 78 aa, Glycine max
  Coding DNA Sequence Number=SeqID_113801
  Gene Ontology: Mol. function=nucleoside-triphosphatase activity; Cellular component=microtubule; Biological process=cell division
  Homolog annotation: Hit_ID=Q7XJI8; Match level="QueryCoverage=84%, HitCoverage=12%, E-value=5e-29, Identity=90%"; Hit description =Katanin
MDPIPHLAYCIQNGDAEDGKSKKPQYEGPDPELAAMLERDVLETSPGVRWDDVAGLTEAKRLLEEAVVLPLWMPEYFQ

SEQ ID NO: 230580 - protein, 81 aa, Glycine max
  Coding DNA Sequence Number=SeqID_113802
MEDADFGGEGRGTGRGFSVSAGAGVVVGGGRGGWTNGGNLCCINKFMLKSTESLKRGWLQSWLVEGITTLEGAPQTHLLEQ

SEQ ID NO: 230581 - protein, 149 aa, Glycine max
  Coding DNA Sequence Number=SeqID_113803
MIQCGLTNQWPSYPLGIHIQPTTTIKFMPDRIASRLPHWSLRKRKGRYFTKDATKKMVTPKPDTEFDQNDVMLFYFKDMYENSSPASTSQQEGDNEFYQHLIHGIHPLRSRFIFNLHEYPEVAMRREIVVAWARHLVLKERSFSPNQNP

SEQ ID NO: 230582 - protein, 83 aa, Glycine max
  Coding DNA Sequence Number=SeqID_113804
  Subcellular localization annotation: CTP_CleavageSite=32; ConfidenceScore=5.11e-01
MRLNLEVLKVVVALSSPFRLSVHPSLSTASVRLARQKNLAEHQYQGRAKREISVLSTALFSTLNLICVRVFLYDWLSTLVGNF

SEQ ID NO: 230583 - protein, 56 aa, Glycine max
  Coding DNA Sequence Number=SeqID_113805
MRLLLCRESGDHKYFLQHVFREYLRIEYVPLLLYCEPSAKALDFIGLVTRAVSSND

SEQ ID NO: 230584 - protein, 626 aa, Glycine max
  Coding DNA Sequence Number=SeqID_113806
  Gene Ontology: Mol. function=nucleic acid binding; Cellular component= intracellular; Biological process=regulation of transcription
  Homolog annotation: Hit_ID=O22091; Match level="QueryCoverage=88%, HitCoverage=98%, E-value=5e-70, Identity=34%"; Hit description=ZPT4-4
  Pfam annotation: Domain name=zf-C2H2; Domain location=10-32; Score =4.5; E_value=3.4; Accession=PF00096.16; Description=Zinc finger, C2H2 type
  Pfam annotation: Domain name=zf-C2H2; Domain location=370-392; Score =14.3; E_value=0.29; Accession=PF00096.16; Description=Zinc finger, C2H2 type
  Pfam annotation: Domain name=zf-C2H2; Domain location=466-488; Score =22.3; E_value=0.0017; Accession=PF00096.16; Description=Zinc finger, C2H2 type
  Pfam annotation: Domain name=zf-C2H2; Domain location=97-119; Score =12.0; E_value=0.52; Accession=PF00096.16; Description=Zinc finger, C2H2 type
  Pfam module annotation: Pfam domain module=zf-C2H2::zf-C2H2::zf -C2H2::zf-C2H2; Domain location=10-32::370-392::466-488::97-119
MEEDHQEVKHVCKFCCKSFPCGRSLGGHMRSHVTTNVSTEADKLSSFNNNGGGDSEGGTNNGGGGYGLRENPKKTWRFNDSSEDNNNNNTTLLVLDKLCKECGKGFQSWKALFGHMKCHSEKVYQNNNSSSSLLLEDQDSWNGNNTTNASQSQKMMVSMDDSHSENEATAPNRRRRSKRRRTRYMAPSTSSVSLVSEAHHEQVQQEEVAMSLLMLSRDVSPWCGLNSVNSMQFESPSLVPTYLDSKVEGKRVVISNGYEKKVTKPRDMMKGEFGNLDCSNLNSKGKTSSELLGTTQSPGSGFGVSKTMVSNSAFEDNGTDNNHNSNNKYTSIKAKFMDSELKSSPLKSWVNNNKNSEGEFSKSSNKRGKFECTTCKKIFHSYQALGGHRASHKRIKGCFASRNESSENSTELEAELSPDPTTESKLLKNEYVEEHEMVTNVTTATTTTQFDNEVETVRDSKKGKGHECPICHKVFPSGQALGGHKRSHHLAGGSESARNFQSQTIVLEEAAPEIRDFFDLNLPASTEEEGTSHGHAEHYRPWWVVGGNHKQEALGQLHGAAYKTALVGRARGFDNWHSMGEALIYLAVVAGNVALLCQLAQGHCIKARKRWFVCLFNTIFFYMTLH

SEQ ID NO: 230585 - protein, 103 aa, Glycine max
  Coding DNA Sequence Number=SeqID_113807
  Subcellular localization annotation: CTP_CleavageSite=38; ConfidenceScore=5.27e-01
MEPILSMSTLMSISSRFQVSTQSSLRPETPPENSNPLLTSMPSNDTFQQLQARIVKMEQHHEKELIKMKAGHDELKASVRRPQEDEHFAHTIHDHTQGESHPR

SEQ ID NO: 230586 - protein, 227 aa, Glycine max
  Coding DNA Sequence Number=SeqID_113808
  Gene Ontology: Mol. function=RNA-directed DNA polymerase activity; Biological process=RNA-dependent DNA replication
MVISVVIAHFMVSKVLIDQGSSMDILYWNTFQRLKVSPDTIQPYYGPLLDFTRKIVEIRGYIDLITNFGQGKLSWRFIVGYLIVEDASYFALIGRITLNELGAIVSTPHLKMKVPIFTGEIVTIKVDQKQTRQCYVESLKPHPTSGGSNQVMSVDEESPKKTLVIYKATTRDQDDIFDVDPHNDTIEKGSKPIKELVKLQLGPEPGQYTQLSRDLTSHKNKHITEVL

SEQ ID NO: 230587 - protein, 75 aa, Glycine max
  Coding DNA Sequence Number=SeqID_113809
  Gene Ontology: Mol. function=protein dimerization activity
  Homolog annotation: Hit_ID=Q2HTZ2; Match level="QueryCoverage=98%, HitCoverage=60%, E-value=4e-18, Identity=57%"; Hit description=HAT dimerisation
  Pfam annotation: Domain name=hATC; Domain location=1-41; Score=-4.9; E_value=0.1; Accession=PF05699.5; Description=hAT family dimerisation domain
MPMSIVASESAFSTRGRMLSCYRSSLTPKIVEALVCTQNWCQSSPLTMEDEFNNLKQEMEPIQQLTEDNSDVESD

SEQ ID NO: 230588 - protein, 170 aa, Glycine max
  Coding DNA Sequence Number=SeqID_113810
MEAMMSMRKMMEVNTATVVAASTTTEVDPTHPSGINQASHPVPDMVGQGGGALGSTSGPHFVQVPQPMGETYEAPRDHTLADSEPHLGYATEGQAFGGIPLPNTLGGPSVSATTTTLTFCGGKTTSYHGGRNYAFADMVELCLVPDVVIPLKFKVPDFDKYTGLLAPRIT

SEQ ID NO: 230589 - protein, 83 aa, Glycine max
  Coding DNA Sequence Number=SeqID_113811
MLRRTQGSRSSQDPNTNITQGCRILEWILALKIHFCQDPVVEKELGSPWWNNGSCTRILKISEDVTCLTDLGGKQQEKDAKEE

SEQ ID NO: 230590 - protein, 604 aa, Glycine max
  Coding DNA Sequence Number=SeqID_113812
  Gene Ontology: Mol. function=sequence-specific DNA binding; Cellular component=exocyst; Biological process=exocytosis
  Homolog annotation: Hit_ID=Q1SEU4; Match level="QueryCoverage=95%, HitCoverage=83%, E-value=2e-75, Identity=32%"; Hit description=Exo70 exocyst complex subunit
  Pfam annotation: Domain name=Exo70; Domain location=114-601; Score= -24.7; E_value=3.8e-10; Accession=PF03081.6; Description=Exo70 exocyst complex subunit
LEKEHGLHVDHDQYSELAAEAKEVKGKPDAYSLVSCAAFAIMSLALTRLSHFGFEVDLLHFFSGVLTIQLMKIKLWLVIVGGSFSYSLIILRSSLVAPRSGYHGLQDRDHDHVVIEFGSHSQSQRNRTSPSVTQVDSPQAIVSVAQEADSPPENEDQGLLVTQSQGNSDSEDNSNIVAQFMSCIGTLKKENQNLILTIFKHVDEYLKADYVIKDHNIQLLKLHKDDNLVADSLPSEIIKDLRESTRLMVTTGLKEECLHVYSTCRREFLSEILSALEELNMKDIDEVAKMRHAIKVMCVANRIVLPNERRLCEKVFEGFIHCEDLYPALRRIDVFQFWKNPVLPVIDAVRLWESIGIQPPIYRINESRFDDLLYLTYSVKEQASVPSGRNYRISIDVLDYIEILYQNWRGLFKTMLDKEGKLLYGHIAMITDLLDSSLEAISKNYNDPSLGYLFIINNRRFIEISAKRRGLSPIFGDDWLRKNTAKFQQNLELYQRSSWSKILNILKLDINESEPNVAAKLMKNKLCSFNEHLDDICNTQATWSVLNEELREQIIKSIENILLPAYGNFIARLQDFLGNHAFEYIEYGMFDIQDRLNNLFLVRM

SEQ ID NO: 230591 - protein, 93 aa, Glycine max
  Coding DNA Sequence Number=SeqID_113813
MRERNILTARLAVLREKELENEHYDILMKGTSTMSESQLQDHQAFCKIIRCKLVKNLVERPGVHDKTYHTLVIQVTLTRIKGALEPGVFIPKV

SEQ ID NO: 230592 - protein, 148 aa, Glycine max
  Coding DNA Sequence Number=SeqID_113814
  Gene Ontology: Mol. function=sequence-specific DNA binding; Cellular component=nucleus; Biological process=regulation of transcription
  Homolog annotation: Hit_ID=Q1SEU4; Match level="QueryCoverage=57%, HitCoverage=13%, E-value=3e-21, Identity=53%"; Hit description=Exo70 exocyst complex subunit
MTQLRQLSRGEYLSNLTYPLWVTKRVWTSWSGPNVAAELMKDKLHSFNEHFDEICSIQAMWFAYEELREQIIKSIENMLLPAYGNFIARLQDFLGNHAYEYIEYGIFDIQDQLNNLFLMGYSSKSVSITYMTVILRKGLPKGFSPRKG

SEQ ID NO: 230593 - protein, 52 aa, Glycine max
  Coding DNA Sequence Number=SeqID_113815
MKIGMFNASTSYHRGGMTNAVGNVYAGGMMNANFKEKGELELAQASRCFNLK

SEQ ID NO: 230594 - protein, 36 aa, Glycine max
  Coding DNA Sequence Number=SeqID_113816
MEDGVVTDQCSPLPGVGLAENVAARHPGSGRQNANP

SEQ ID NO: 230595 - protein, 442 aa, Glycine max
  Coding DNA Sequence Number=SeqID_113817
  Gene Ontology: Mol. function=heat shock protein binding; Cellular component=integral to membrane; Biological process=protein folding
  Homolog annotation: Hit_ID=O23230; Match level="QueryCoverage=46%, HitCoverage=14%, E-value=2e-47, Identity=51%"; Hit description =Trichohyalin like protein
  Pfam annotation: Domain name=TolA; Domain location=55-385; Score= -105.1; E_value=0.00068; Accession=PF06519.2; Description=TolA protein
MSQGEAEHSGKVACTATNFNGDEHSFSCEQTCTEKTKTAPQMKFDAQSGERKIGERGNTKQHLNVAINPEESRDQMSSSQGDYRRNTIADEPAAVQEVGNIQKPSQRAHRKMLRGSEEKESWKKMEEEMERERERQKDKMAVDSAMLEAEREKEKEKDRMAVDKATLEARDRTYVDARERAERAAFEREPTEARQRALAEARERLEKACTKARDKTYADKAAAEARLKAEQTAVERATTEARECAMDKVKVDRAAFESRDRLVRSVTDKFSVSFRYGRRQGSSSSNEKVNQLRGVELDWRGIAEQLSVQINEIDHEFFGNRLAETLDTEVRRWSSGKEGNLRALLSTLLYILGPDSGWQPIPLTDVITSAAVKKTYRKATLCVHPDKLQQRGASIQHKYICEKVFDLLKHMKVCKYSNMPINAHVLGEVGIWHLLPNLLPQA

SEQ ID NO: 230596 - protein, 105 aa, Glycine max
  Coding DNA Sequence Number=SeqID_113818
MYPEEILGTAGGSFGMRMLVTSGKSDSGSVFRKHFFRNRPWYNGIILNDLGVVNFWMWLYDNLNVLVYDAYVLKMDEDQWRYDFAMSQEVHMDYDYDNQEECGGE

SEQ ID NO: 230597 - protein, 159 aa, Glycine max
  Coding DNA Sequence Number=SeqID_113819
MAANGNNTFVANQIVPPLGQAANWFGMPAIGTLENEIPTTMVKIPCQMENLQKENVVLWEQYQKLPQDNNMHLISAVGTHQTHMPEIDEADKTIPDNPKGSNTSLVYLSTGKIDRLLVMQITRFGAQDATSHLYHLTVVALANIRQDEEESLYYFMEKT

SEQ ID NO: 230598 - protein, 578 aa, Glycine max
  Coding DNA Sequence Number=SeqID_113820
  Gene Ontology: Mol. function=RNA-directed DNA polymerase activity; Cellular component=chromatin; Biological process=chromatin assembly or disassembly
  Homolog annotation: Hit_ID=Q1T2D5; Match level="QueryCoverage=99%, HitCoverage=36%, E-value=1e-142, Identity=46%"; Hit description =Chromo
  Pfam annotation: Domain name=zf-H2C2; Domain location=419-460; Score =4.7; E_value=0.085; Accession=PF09337.1; Description=His(2)-Cys(2) zinc finger
MPTIDELLDEIGTTSCFSKLDLRQGFHQIHQIRMNEEDIPKTAFRTHHGHFEFKVVPFGLTNAPSTFQATMNDLLWPFLQKFIVVFFDGILVYSPSFHAHLQHLQAILVTLSQRSFYLRCSKCTFAEQQLNYLGHIVSSQGVAPDPEKIHAMTAWPTPTTPSDLRSFLGLTGFYRKFIRNYATTVAPLTALLCKDSFMWMPEAYTAFQHLKTLMTQALILASPDFTVPFILETDASGTAIGPVLLHKSRPIAFFSKQLCPRRGFDLPPIVACHHLCGAKMASLSARAQLHYHDRPSELKRADVTGYQTPEQQRYLAKLLGYDYTIQYKPGETNVVVDALSRVQAQPSLMLLSAPHSIFMEQLQHSCSQDMTYQELLLKVQQSPTDHPGFTVKHNRLLFWGKIWLPAGHDLSKVLLDEYHNTPLGGHMGVSKTLHRIQQHFWWPNMRQDIRQYIVACITCQQIKTETCKPAGLLQPLPPPSSLWSDLSMDFITGLPASQGYTTIMVVVDRYSKGTHFGPLPTHYTAHKVALLFMDIVCKHHGFPRSIISDRDPIFISGFWRELFCISGTKLHFSTAYHP

SEQ ID NO: 230599 - protein, 657 aa, Glycine max
  Coding DNA Sequence Number=SeqID_113821
  Gene Ontology: Mol. function=sequence-specific DNA binding; Cellular component=exocyst; Biological process=exocytosis
  Homolog annotation: Hit_ID=Q1SEU4; Match level="QueryCoverage=98%, HitCoverage=97%, E-value=1e-109, Identity=37%"; Hit description =Exo70 exocyst complex subunit
  Pfam annotation: Domain name=Exo70; Domain location=163-654; Score= -34.0; E_value=8.5e-10; Accession=PF03081.6; Description=Exo70 exocyst complex subunit
  Subcellular localization annotation: CTP_CleavageSite=33; ConfidenceScore=5.00e-01
MVFMLIMINIQSWLQKRKVWRFVCFFSSVVGLLCYAFSSSFNNLFGKWTWWKILLYIGFSFIICLTVLFAKVWECSTSPRVEAHMAFFILMITSVYAFFFDKEVKGKPDAYSLVSCAAFAIMSLALSRLSHFGFEVDLLHFFSGVLTIQLMKIKLWLVIVGGSFSYSLVILRSSLVAARSGYHGLQDQNHHHVVIEFGSHSESQGTRTSSSTTQVDTSQAIVIMAQEAISSPEIEDLGFQVTESQQRNNDSDNNSIVTQFMGCIEALKKEKEKVIFTIFKHAEEYLKASLVQTPVLQLHCDDNLVVDSLPSVIINDLRECVRLMVTAGLKEECIDVYITWRREFLGEMLSWLIKLKIARFYIKALCVADRILLPNERRLCECVFEGSIPHEDKYPALPGIHMFGFRKKLDSYPGLPETIHGRKFGELLSLTYGVKEKAIVPGGRVHQITLDVLDYAGIIDEQLTDLLDCSLEGKFPLNNIAMITNLLDSSLEANSQNYHDPILSYVFIINNRSYIRRRAMRGGLRHILGNDWIRKNTTSIKENLQLYLRSSWNKILDILKLDINESEPNVAAQLMKNKLRSFNEHFDDICNIQSTWFVFTKELRRKIIQSIEKILLPEYGNFIGRLQDFIGNQAYEHIEYGMFDIQDRLNNLFLVRE

SEQ ID NO: 230600 - protein, 265 aa, Glycine max
  Coding DNA Sequence Number=SeqID_113822
  Gene Ontology: Mol. function=chromatin binding; Cellular component =chromatin; Biological process=chromatin assembly or disassembly
  Homolog annotation: Hit_ID=Q1SAV4; Match level="QueryCoverage=64%, HitCoverage=52%, E-value=4e-36, Identity=43%"; Hit description =Integrase, catalytic region
  Pfam annotation: Domain name=Chromo; Domain location=124-174; Score =11.8; E_value=0.04; Accession=PF00385.14; Description='chromo' (CHRromatin Organisation MOdifier
GSGLSPFEIMYGTAPPAPPFYSAGTSTVEAVDAIRTFAGCHSPNPHTQATKTSLQPAYTKLSKRFYGPYRIQARVGNVAYCLQLPPTSKIHPVFHVSLLKAHHGPIPLDVPTLPPFSTANHPIVRPLQLLDWKMDESTQPPTPQVLVQWVGLAPEDTTWKYWPQLKDIYDLEDKELLGSFITEHEDLEFLVPQSQQGNRIVVQFLGQDSEEFGQFGGLVYLSYEKITVPCGRLHQISLDVLDYTDMTLRDWNGLFGTMVDKEEKF

SEQ ID NO: 230601 - protein, 108 aa, Glycine max
  Coding DNA Sequence Number=SeqID_113823
  Gene Ontology: Mol. function=oxidoreductase activity; Cellular component=chloroplast; Biological process=electron transport
  Homolog annotation: Hit_ID=Q2HXJ3; Match level="QueryCoverage=79%, HitCoverage=18%, E-value=3e-22, Identity=45%"; Hit description =Zeaxanthin epoxidase
MTPRSTATIVELEGKTVKLQIVRVILENGEQHDGDILIRADGIWSEVSVFLGLNQYFVASDVGHGKMQWYAFHGEPPSSDPFPKGKKNRLLDLFGNWCDEVIALISET

SEQ ID NO: 230602 - protein, 476 aa, Glycine max
  Coding DNA Sequence Number=SeqID_113824
  Gene Ontology: Mol. function=transmembrane receptor activity; Cellular component=exocyst; Biological process=exocytosis
  Homolog annotation: Hit_ID=Q9FGH9; Match level="QueryCoverage=78%, HitCoverage=69%, E-value=4e-54, Identity=35%"; Hit description =Leucine zipper protein
  Pfam annotation: Domain name=Exo70; Domain location=2-473; Score= -48.8; E_value=3e-09; Accession=PF03081.6; Description=Exo70 exocyst complex subunit
MFGSKKTPLRDAKPSSSVTQVDSPQAIVSVAQEADSPPQIEDLGLLVTESQQRINDSDNNSIVTQFMGCIEALKKENENVILTIFKHAEEYLKASLVQTPDLQLHCDDNLVVDSLPSVIINDLRECVRLMVTAGLREECIDVYITWRREFLSEILSALIELKIGNTIKTEFFIKALCLADRILLPNERRLCECVFEGSIPLEDKYPALPGIHRFGFRKSLASYPALRDKLLMDLNIYSALHGIRKFGELLTLTYGVKEKAIVPGGRVHQITLDVLDYADKIDKDWRGSLNPMTDEQRKFPLITDLLDSSLEANSQNYHDPILGYVFIINNRSYIQRRAMQRGLRHILGNDWIKKNTTSIKENLQLYLRNPWNKILDILKLDINESEPNVAAQLMKNKLRSFNGHFDDICNIQSTWFVFTEELRRKIIESIEKILLPAYGNFIGRLQDFLGNQAYEHIEYGMFDIQDRLNNLFLVRE

SEQ ID NO: 230603 - protein, 87 aa, Glycine max
  Coding DNA Sequence Number=SeqID_113825
  Subcellular localization annotation: CTP_CleavageSite=49; ConfidenceScore=5.15e-01
MNCVFVHVSSTFEFGAMRSDCLVQFSVLNLFRSPENCVFVHLSSTFEFRAMRNDCLVQFCILNPFSEPRELCFRSCVFHLRIWSHAQ

SEQ ID NO: 230604 - protein, 133 aa, Glycine max
  Coding DNA Sequence Number=SeqID_113826
  Gene Ontology: Mol. function=protein dimerization activity
  Homolog annotation: Hit_ID=O81190; Match level="QueryCoverage=85%, HitCoverage=14%, E-value=3e-14, Identity=36%"; Hit description =Putative transposase
MHKPYAYIIKAQWDKHLKLKLHATTYWFNHAFRYNEKFNNKRRVIDSVVDLLEKRGLCENLTQVISEMEMYQDRQESFDRPSALPISNTIRPIITFLDDQWWSLFGSSAPILKKLVESLQKDMLCPIDFEAID

SEQ ID NO: 230605 - protein, 191 aa, Glycine max
  Coding DNA Sequence Number=SeqID_113827
  Gene Ontology: Cellular component=integral to membrane
  Homolog annotation: Hit_ID=Q1MKU4; Match level="QueryCoverage=90%, HitCoverage=91%, E-value=4e-19, Identity=33%"; Hit description =Putative PRC family protein
  Pfam annotation: Domain name=PRC; Domain location=75-157; Score=68.0; E_value=3e-17; Accession=PF05239.7; Description=PRC-barrel domain
  Subcellular localization annotation: CTP_CleavageSite=50; ConfidenceScore=5.28e-01
MAKKLTILVTAALMGTTAFAPLAIAQGTTQPAPANPSAQTEPATPSATPMAPAAPSANDSAATTTGGAYLTEQGETQISANDYIGKSVYTAADESIGNVTNLIMEQDGGLVAAVIGVGGFLGIGAKDVAVPMDKVTMTRNAQDGTIRLTTTETAETLKAAPEFKTLEQKTSEQNAATPAAPDSTTTSATKP

SEQ ID NO: 230606 - protein, 47 aa, Glycine max
  Coding DNA Sequence Number=SeqID_113828
MATCNVKSPAMSALSSRACHLSHMHEVASSTGASHVGNNIIDPVKDK

SEQ ID NO: 230607 - protein, 354 aa, Glycine max
  Coding DNA Sequence Number=SeqID_113829
MADVQKSTSKLLLLSLAQLVRYDAQDWTVFASIEYLAKVTHLNRKTVIEALARLRQLGAIQDTLMRAGENRSSVVYRLCPNAVPRIDMATSAHQADFQPPVVGRQPRLEFDASSPHSSQASGNNTGMAANAVHPALSSEPATAPSVDVTADQDGALGASATAAQPGTTMPVAAPVAPEAHLPPPVVPTIAAASLTDPALLSPPNAGSAGPATSAQMQRACMHSQRRRSSSAMYGGAGASRLPAGWSLPAKWRLWAQRERPHWPAEKIDAMATTFSAYMRSRPGEAGMSEDWFESWRLWVFREWDKQSSSRKSWQSSWTGIVAKGKELGLEQAPNEPPPDFKARVFRAAGLAPPH

SEQ ID NO: 230608 - protein, 83 aa, Glycine max
  Coding DNA Sequence Number=SeqID_113830
MALGTLYSGSLMPIYSKKGDLVDLQLAQVDKSGAFAPTYPPLERKSDLRSSFFMRESSDSFYLKGDHFKALDLKNDPFYLVRN

SEQ ID NO: 230609 - protein, 123 aa, Glycine max
  Coding DNA Sequence Number=SeqID_113831
MRKQEVILHEIWRWNIDILGQSGFDWDDTKYMFTVENENAWNEYCTVNRATGHGAEAAMDADEAMSRETNEVEFMGLGATTTIDLEEPSSNTKEKRQGSTSSGTHSFSQDKYWRKRRNNSFFG

SEQ ID NO: 230610 - protein, 250 aa, Glycine max
  Coding DNA Sequence Number=SeqID_113832
MVVGISFSGVPMAGMPNKLAACPSGGSLWLATEVAHGEGGGNTYKDTLTLKLEAQRVDPKSKLVAIRFSVPECKPCLLEKEHGTHGHQMAAKAEHIAGGHTIPPKFLNNEDEVKDFVNPAYDNFEQQDNLLKYWLLESMDNQFRKHGSINEYLVQIKKIVKTLGAIGSPLTDEEHIDAIFDGLLEEYDGLISSCLTRSEPFTVPQIKASLMHQEERLEHHKQRDTTPIQAHTVHCQNQSRRGFPNTPCGR

SEQ ID NO: 230611 - protein, 87 aa, Glycine max
  Coding DNA Sequence Number=SeqID_113833
  Gene Ontology: Mol. function=DNA binding; Cellular component =mitochondrion; Biological process=DNA integration
  Homolog annotation: Hit_ID=Q1SZR1; Match level="QueryCoverage=98%, HitCoverage=72%, E-value=2e-19, Identity=52%"; Hit description =Hypothetical mitochondrial protein atmg00820 (Orf170).-related
MTTRAKSGVFKPKALLKKITPRCTKDAMQDPQWLAAMKDEYMALMQNKTWDLVPLPPHRKAIGSKWIYRLKYNVDGSVARHKARLVA

SEQ ID NO: 230612 - protein, 357 aa, Glycine max
  Coding DNA Sequence Number=SeqID_113834
  Gene Ontology: Mol. function=sequence-specific DNA binding; Cellular component=nucleus; Biological process=regulation of transcription
  Homolog annotation: Hit_ID=Q1SEX1; Match level="QueryCoverage=66%, HitCoverage=33%, E-value=3e-12, Identity=30%"; Hit description=Exo70 exocyst complex subunit
MKIKLWLVIVGGSFSYSLVILRSSLVAARSGYHGLQDQNHHHVVIEFGSHSESQGTRTSSSTTQVDTSQAIVIMAQEAISSPEIEDLGFKVTESQQRNNDSDNNSIVKQFMGCIEALKKDNQKVVLTIFKHDEEYLKASLVQTPVLQLHCYDNLVVDSLTSAIINDLREYVRVMVIAGLKEECIDMYITWRREFLCEILSWLIELKIDNTQFYIKALCVADRIFYPMKEDSVNASLKGPFPLRISTLQYQEYIGLGFGIVWIVILDCPKQYMDKTTLEVSQENDDIGSIPFTSNVLHNDQGLSWDRNDLARSIVDGKPVIPSEVVDRKEEESDDEIIDLAKDEENDFIDEANNSDHY

SEQ ID NO: 230613 - protein, 657 aa, Glycine max
  Coding DNA Sequence Number=SeqID_113835
  Gene Ontology: Mol. function=sequence-specific DNA binding; Cellular component=exocyst; Biological process=exocytosis
  Homolog annotation: Hit_ID=Q1SEU4; Match level="QueryCoverage=98%, HitCoverage=97%, E-value=1e-108, Identity=36%"; Hit description =Exo70 exocyst complex subunit
  Pfam annotation: Domain name=Exo70; Domain location=163-654; Score= -48.3; E_value=2.9e-09; Accession=PF03081.6; Description=Exo70 exocyst complex subunit
  Subcellular localization annotation: CTP_CleavageSite=33; ConfidenceScore=5.00e-01
MVFMLIMINIQSWLQKRKVWRFVCFFSSVVGLLCYAFSSSFNNLFGKWTWWKILLYIGFSFIICLTVLFAKVWECSTSPRVEAHMAFFILMITSVYAFFFDKEVKGKPDAYSLVSCAAFAIMSLALSRLSHFGFEVDLLHFFSGVLTIQLMKIKLWLVIVGGSFSYSLVILRSSLVAARSGYHGLQDQNHHHVVIEFGSHSESQGTRTSSSTTQVDTSQAIVIMAQETDSPPEIEDLGFQVTESQQRNNDSDNNSIVTQFMGCIEALKKEKEKVIFTIFKHAEEYLKASLVQTPVLQLHCDDNLVVDSLPSVIINDLRECVRLMVTAGLKEECIDVYITWRREFLGEMLSWLIKLKIARFYIKALCVADRILLPNERRLCECVFEGSIPFEDKYPALPGIHRFGFRKSLDSYPGLPETIHGRKFGELLSLTYGVKEKAIVPGGRVHQITLDVLDYAGIIDVQLTDLLDSSLEGKFPLNNIAMITNLLDSSLEANSQNYHDPILGYVFIINNRSYIRQRAMRGGLRHILGNDWIRKNTTSIKENLQLYLRSSWNKILDILKLDINESEPNVAAQLMKNKLLSFNEHFDDICNIQCTWFVFTKELRRKIIQSIEKILLPAYGNFIGRLQDFIGNQAYEHIEYGMFDIQDRLNNLFLVRE

SEQ ID NO: 230614 - protein, 151 aa, Glycine max
  Coding DNA Sequence Number=SeqID_113836
MRIRLIKEEKSITGRETQGTGTRETTRKPRQDFSVSKPPHFFRQLSLSLTLPFSSPSFSIEAPNKASTFGHHFCPKSRKEGIFGVVKCVATSRTSKFQLGRIDGDPVLRETRIWATWEYVSSDGGGQQGMVGLCAHCGCGKLVVHHRPTAT

SEQ ID NO: 230615 - protein, 114 aa, Glycine max
  Coding DNA Sequence Number=SeqID_113837
MIVHIISVRLLLQGISSNHCTTSLYAHEHWVLINSSNYFGLIKVEVSDVEYKCEASLCGGSWSTGVPLESPQQLVSEPMVQVDDRLRRVCKYRRWPEWLAAQRAPQVKRGGQNG

SEQ ID NO: 230616 - protein, 163 aa, Glycine max
  Coding DNA Sequence Number=SeqID_113838
MSIDDPLHDLVKVSFDLYQKPYQVAWDATLFGVYNDDSLLFIDYNDAQQIILGNQCLSITILQFWRTHKERRKIYLGAYLNNALKEFYGKSLKSKSNVDWIELKSHFQIGGFECDYYVMDWMQNIVKGTLKNQWDMWIINQTPLKPERMETIWTEWARYFFEC

SEQ ID NO: 230617 - protein, 509 aa, Glycine max
  Coding DNA Sequence Number=SeqID_113839
AFFEELAKRAYRAKRVHPLRMNTHPLAELPVAKRAKRASLAKLSTLSGIFEDLMPLSAAFKELSAYHCGRCQLSGPCLVKRPDPFERNVELYLSEFNKFKVELKRQNLHKRLANLQEGSIDVVVVKEFYANFYSPADQAPKCARIRGHLIKIDADNLNEFLQTPVLLKEGESLPTYSRFCRSRSDPREMEASLCIPGKGFILNTEGQPWKLLRKDFTTLAQTWSIFSYSNLAPTSHTSDLNTDRARLVYGLITRMDMNIGGFISGQMTMMAQSNSSHLGFPALITALCRSRGVGSDALTSYENLRPIIDLAYIIRNCWNTNDQIVNFPEVRKTKLRAADVPSSFAPIVGIPASSTSAPLPALELAQQRPIMSVEQFIEKVAWPGARPSFVGDNESFTAQAPQHHELEPENDHSFEAIIPGAGDFSKRRLETRSSEAAHPGPTPVLADEPFPGVDPSSPQHAADSSTPILEIPEGQTIAVLALDTSPPATPVLHLTDKEDVQTQDIQDQS

SEQ ID NO: 230618 - protein, 41 aa, Glycine max
  Coding DNA Sequence Number=SeqID_113840
MKDTKVVIGASSDFSHIKELRLQFSMGTTLIRFSISHLGGN

SEQ ID NO: 230619 - protein, 169 aa, Glycine max
  Coding DNA Sequence Number=SeqID_113841
MEKMNVHETTRGTAKVATRPGELKLSAKAMSLPRRVGFFTMKLFGGPGELEASLGTRMIAINRSCWDYTLMIANHKNMVVEVLAIKVSILANIGSNQAHAFKKRFSSSEGKNTLLLCPYRTRARARVMSEIEEVQEQMKADMEAMKEQMTTMMSMRSMMEVNAATVVAA

SEQ ID NO: 230620 - protein, 398 aa, Glycine max
  Coding DNA Sequence Number=SeqID_113842
  Gene Ontology: Mol. function=sequence-specific DNA binding; Cellular component=nucleus; Biological process=regulation of transcription
  Homolog annotation: Hit_ID=Q1SEX1; Match level="QueryCoverage=98%, HitCoverage=55%, E-value=7e-76, Identity=43%"; Hit description=Exo70 exocyst complex subunit
  Subcellular localization annotation: CTP_CleavageSite=33; ConfidenceScore=5.06e-01
MVFMLIMINIQSWLQKSKVWRFVCFFSSVVGLLCYAFSSSFNNLFGKWTWWKILLYIGFIFIICLTVLFANVWECSTSPRVEAHMAFFILMITSVYSFFFDKVVKGKPDAYSLASCAAFAIMSLALSRLSHFGFEVDLLVFFSGLLILQLMKIKLWLVIVGGSFSYSLIILRSSLVAPGSGYHHGLQDRDHDHVVIDFGSHAQSQGTRTSPSVTQVDSPQAIASVAQEADSPQEIEDLGLLVTESQQRINDSDNNSIVTQFMGCIEALKKENENVILTIFKHAEEYLKASLVQTPDLQLHCDDNLVVDSLPSVIINDLRECVRLMVTAGLREECIDVYITWRREFLSEILSGWIELKIGNTIKTEFFIKALCLADRILLPNERRLCECVFEGFIPLED

SEQ ID NO: 230621 - protein, 189 aa, Glycine max
  Coding DNA Sequence Number=SeqID_113843
  Homolog annotation: Hit_ID=Q84WN3; Match level="QueryCoverage=42%, HitCoverage=36%, E-value=1e-17, Identity=51%"; Hit description =Putative cytochrome c oxidoreductase
  Pfam annotation: Domain name=MtN3_slv; Domain location=109-188; Score= 52.5; E_value=1.4e-12; Accession=PF03083.6; Description=MtN3saliva family
MKVSVFLGLNQYFVASDVGHGKMRWYAFHGEPPSSDPFPKGDAAHPMQPNLGQGGCMAIEASDFVPKVVDLAARELIAIASPGQGLIWLDHAKTSTESAVVMNLESRCLGIRPGVMDGAISISAVQKHGSTEDFSSLPYICTLLNCSLWTYYGIIKAREYLVATADGFGIVVETIYVILFLIYAPKGIR

SEQ ID NO: 230622 - protein, 171 aa, Glycine max
  Coding DNA Sequence Number=SeqID_113844
  Gene Ontology: Mol. function=sequence-specific DNA binding; Cellular component=nucleus; Biological process=regulation of transcription
  Homolog annotation: Hit_ID=Q1SEU4; Match level="QueryCoverage=76%, HitCoverage=19%, E-value=5e-32, Identity=48%"; Hit description=Exo70 exocyst complex subunit
MQRELRYILGNDWIEKNTTSIQENLQLYLRNSWNKILDILKLDINESEPNVAAQLMKNKLRSFNGHFDDICNVQSTWFVSTEGLRRIMIESIEKILLPAYGNFIGRLQDFLGKEAYEHIEYGLFDVKDRLNNLFLIQYSNYLYDCYLVVRVNIGVFPSKGSTSPVVPLPFE

SEQ ID NO: 230623 - protein, 51 aa, Glycine max
  Coding DNA Sequence Number=SeqID_113845
SHVQTGNYECGYYVMQWIWCIISGGLKDDWIHGGGDKDYKEVPPPPLFKPA

SEQ ID NO: 230624 - protein, 72 aa, Glycine max
  Coding DNA Sequence Number=SeqID_113846
MSHSGPSSSRWTSLNEELEQLLANVPKLTIEEHGEWREMANMMQNVAAPPEAFFPDRSRLGPGHVHFDLINI

SEQ ID NO: 230625 - protein, 149 aa, Glycine max
  Coding DNA Sequence Number=SeqID_113847
  Gene Ontology: Mol. function=phosphoprotein phosphatase activity; Cellular component=membrane; Biological process=signal transduction
  Homolog annotation: Hit_ID=Q7VWI8; Match level="QueryCoverage=81%, HitCoverage=18%, E-value=2e-30, Identity=57%"; Hit description =Putative regulator
GLGQRPVLEVGQRRQVAVDQVRVAAGQHLEVGVIDEGVAAVVEFQAIDPGARHALGRAGRHDAALGHVGIGVQGRGHHRAALHQLPPAAAHRGNLVRQQGAPARLGIPQHQFHHVADGVALAVDHRARDIALGGQHHECRDRQEQRYDQ

SEQ ID NO: 230626 - protein, 334 aa, Glycine max
  Coding DNA Sequence Number=SeqID_113848
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q7W894; Match level="QueryCoverage=83%, HitCoverage=33%, E-value=2e-19, Identity=53%"; Hit description =Putative inner membrane transport protein
AAERRLDATQPVHFQPIAEHPVQVALQALGQEADVIARHVEPAAAESGNGVGRVHALCQHQRQQRHHETGPAAGGQRGQRHNVFEDRRQSQSDQHRNQQQHLQVGDDEPATGLAVLGGGQHHGAHHLAARGDQRHGHRHPVVGNADQGAGATVRQARRERAARIQRARQPRRAFGQLALRGQRLAIGQQHRGALHAARARGPIAQCVAQTEVLFKRLAKAQAVFDIAGDAARHHLDAVGGGIHHQPVQRGQAERADQCLRQQQHGQTGQRHFKHGATTQPIEHYLYWFATHGAPPPQSIYTRAPMVFTINANCILFHAFTSSAAYRPHVVALAP

SEQ ID NO: 230627 - protein, 52 aa, Glycine max
  Coding DNA Sequence Number=SeqID_113849
MKKEKETKSRDPRPRAHPHVFLEEEIHKLFAKVDLQVKPDMRFLMPGMRQLE

SEQ ID NO: 230628 - protein, 211 aa, Glycine max
  Coding DNA Sequence Number=SeqID_113850
  Gene Ontology: Mol. function=RNA-directed DNA polymerase activity; Biological process=RNA-dependent DNA replication
MGKASIENVVVIKSLLRCFEFATGLKVNFFKSRCGAIGVDEIDVRALAVRIASGVVKRLESNMRDFLWEKNKIWWVERPRGRFIEWRVIYLVERDLRKVCGGEDNYRWFDSLVRCEVGEGDKINFWKDPWLSGVSLATSHVRLFLNSKQKEESVNRTGRWEDDMWIWDFCWRRRWFVWKVDIVENINHLLANVKLLKKGRDAWRWKLSQMV

SEQ ID NO: 230629 - protein, 169 aa, Glycine max
  Coding DNA Sequence Number=SeqID_113851
MGPILPDSQRPFFGEQKLLAEKTKKKLEEAARSGSVDGVIDPPSPIRRHVKWKMARTKKTGEMTTEVAKKIAEKIVSHFQLTITIIFQYCRNMPFCGRARRGSRVRFPKEERCAESPPTFICGKRRKNRRKPFKTKILSLGVVFTFEEGRQKRGSCSYVPSIEEEIRPT

SEQ ID NO: 230630 - protein, 82 aa, Glycine max
  Coding DNA Sequence Number=SeqID_113852
MSLSKSDGEFLLSFSHGFQENVLATRKVFRNEYSFGDMSFRRRVMILKEELRGPPKDEDVGKIKQVDVLKEELGAWSFLEEV

SEQ ID NO: 230631 - protein, 95 aa, Glycine max
  Coding DNA Sequence Number=SeqID_113853
MRSATKSVSAPMYPTSPALEEEEGGWLVVTGGATDGSGTGDGGTGGASRATMALTHLDPRKVMERSTVFQQIFWMYAKLIMGLNDLKVKVSKVAP

SEQ ID NO: 230632 - protein, 163 aa, Glycine max
  Coding DNA Sequence Number=SeqID_113854
MAWHRYQNNIHLRKILSERNVELSPTMYDEFYRELQRRKWHCWLTRLLEKRINVALITQSSTSWLGFPALITTLCDVQGATLDTLTFKSLSPMINLAYIQKICWNTVDLSITFLGSRWVRAIVALDAPPVPPSPVPLPSVAPPVTTSQPPSSSSQPKSPVQMM

SEQ ID NO: 230633 - protein, 251 aa, Glycine max
  Coding DNA Sequence Number=SeqID_113855
  Gene Ontology: Mol. function=DNA binding; Biological process=DNA integration
  Homolog annotation: Hit_ID=Q1SKC8; Match level="QueryCoverage=72%, HitCoverage=46%, E-value=5e-50, Identity=53%"; Hit description =Integrase, catalytic region
MLEELDNFFSAQDRLSVRARLAQRRPKVYCGTVTAHLMEAITTEIGQLLEYFRMDFFGPPSSRMHMTIELKRILEKIVASSRKDWTAFKTPVGFSPFQMVCGKACHLPVELEHKAYWALKFLNFDGLLSREKQRLQLLELEEMRLNAYKSSRHYTQKMKMYHDKKLLKKTFQPGQQVLLYNSRLGHFPGKLKSKWSEPFMVKQVKPSGVVGLINPATYDPEKTWIANGHRLKIYNGGDIERLNTVIHLQDL

SEQ ID NO: 230634 - protein, 39 aa, Glycine max
  Coding DNA Sequence Number=SeqID_113856
MAIGLSAGVLLSPGAHEWKPMHQHLRRHNVRFMSGVKSV

SEQ ID NO: 230635 - protein, 74 aa, Glycine max
  Coding DNA Sequence Number=SeqID_113857
MFLLVWVRRQATAAHGDHRWSWVVKKKISLSQLVSLSRSPLFALSATIRAEHNSLVLSATIPTQCNSFSDWNCA

SEQ ID NO: 230636 - protein, 181 aa, Glycine max
  Coding DNA Sequence Number=SeqID_113858
  Gene Ontology: Mol. function=DNA-directed DNA polymerase activity; Biological process=DNA replication
  Homolog annotation: Hit_ID=Q8KQT1; Match level="QueryCoverage=82%, HitCoverage=56%, E-value=8e-37, Identity=86%"; Hit description=DNA polymerase III beta chain
  Pfam annotation: Domain name=DNA_pol3_beta_2; Domain location=104 -181; Score=62.9; E_value=1e-15; Accession=PF02767.7; Description=DNA polymerase III beta subunit, central domain
  Subcellular localization annotation: CTP_CleavageSite=73; ConfidenceScore=5.43e-01
MAFEIAPNLSTAFPTPWGSVIQRVSRGTEPHAFHTAARSLSQAVGTGRQRGRTPPDPSGSGQFPGPGAERPAVADRPVAIASPGPLPSNDFPSVDEVEATERVAIGEATLKELIERTAFAMAQQDVRYYLNGLLFDLRGDALRTVATDGHRLALCETDLAKPSGSKRQIIVPRKGVTELQR

SEQ ID NO: 230637 - protein, 50 aa, Glycine max
  Coding DNA Sequence Number=SeqID_113859
MAVLSFAKNKFPKVLSLSNTATPSAPAKHKAGTIAKQGMQLKCKTERYTK

SEQ ID NO: 230638 - protein, 464 aa, Glycine max
  Coding DNA Sequence Number=SeqID_113860
  Gene Ontology: Mol. function=amino acid-polyamine transporter activity; Cellular component=integral to membrane; Biological process=amino acid transport
  Homolog annotation: Hit_ID=Q6F765; Match level="QueryCoverage=63%, HitCoverage=62%, E-value=1e-104, Identity=62%"; Hit description =Gamma-aminobutyrate permease
MLQAARLVHVMLREIGLRSWLKTSGGKGLHVLVPLRRQYDWDTVKVFSQAIVQHLARTLPQVFVAKSGHEEPRRQDLRRLPAQRLRRHDGGSLVGARAAGHGRVGAAGLGRAGRGPGQRPVDHRQHPHPPGCGRRALGRLHAAGAGRSHEGDGLQAGFGRFRFGPGARTDAEHLRDDAHGDDDAGQDRGVDHFVAVGAFDHHGDERCDNADDHRVRQPRKQPHPEFQPHAARLQALAHAQLREGDGQVDEQRDGARGLHQDVIDVHLRGGHHPDRGEGEQAGDEHAHIRRAGLAPGDLHDAMGVAAPGERIEHARGGVQRRIEAAAYRGQHDEVDDKLRVRDAQRVERDVVGALGRLREARRVVRHQADHDEDRSHVEQADAPHHRARGLDDLAARVGRFGGGHGDDLGADEGEHHAQQGHHHGLRAVGHEALAGQVAPSLGVAPRPQVRQRQAAHDQEQRGIL

SEQ ID NO: 230639 - protein, 135 aa, Glycine max
  Coding DNA Sequence Number=SeqID_113861
LLSIFILLFPRKDGDVDLNVSPQALDRLLGCFLAFKVKVQPRFRNSVVLKYSDESDLINVVLDMIPDSEPCCKIENSILELTDPTELESQSVSVTADHDRSMLDSSEPTELESQSVFVTGDHDPLLRIPLTPTKR

SEQ ID NO: 230640 - protein, 95 aa, Glycine max
  Coding DNA Sequence Number=SeqID_113862
MRIHFLRWILPRKSCRHLRQTLRRIVAWGRWRSAEALYPSGQLFGLVWDATSQGSFVPHGRQDVLVVAIGRPKHPGRVRASGADVTIKQYFRSAP

SEQ ID NO: 230641 - protein, 175 aa, Glycine max
  Coding DNA Sequence Number=SeqID_113863
MAKFDPDIVLEFYANAWPTKEGVRDMRSWVRVLEEGQECEFSQRRNRADGFDEEVIAQLLCIPGQDFARTAAGRRVRIMRTSMTTLTQIWMTLLLSNVLPSDHNSDLPLSKCQLVYAILTRMSVHVASVDADAIYLFAGMPPTRHPLDPDKSKQGHGVSSIDYEPLPVIRGSRHT

SEQ ID NO: 230642 - protein, 110 aa, Glycine max
  Coding DNA Sequence Number=SeqID_113864
MEERSLLSEIARDVPSLVLSQTQVDVPSTCTTKDVPSNVLRQRSQAVKPLILCEWGYRRILRREKGDTKEFRRVVLCSFGKGRRETQKEFRRLVLGEFFLAKAEGNEKDE

SEQ ID NO: 230643 - protein, 42 aa, Glycine max
  Coding DNA Sequence Number=SeqID_113865
MEAQDLIQGIGGPMTRARAKKAQEALEHMVTILSVLQLVPSA

SEQ ID NO: 230644 - protein, 319 aa, Glycine max
  Coding DNA Sequence Number=SeqID_113866
MGSVLIPTVNKPTEGPCRLLKNVRWGILLPLDVVSKKGTNSPDPRIPRLHLCHMHSIMHSSIPPMRYRSFDLHQLLSHFSSTKSKSKVVSKENFEAPEEDAEVQALKSELGKAKLAKEKFKLAATHVRKECAGLREENTITARALEQETKRARKEEYGRNKFREALWGSNSELKLRREERDQSRAHSMVLKEELIACSRSKRSLSQRLCETETNMLAIIAKYEEELGLATAHEHRIADEYAQVYAEKEARGRVIDSLHQEATMWMDRFALTLNGSQELPRLLAKAKAMADTYSAPEEIHGLLGYCQHMIDLMAHIIRNR

SEQ ID NO: 230645 - protein, 90 aa, Glycine max
  Coding DNA Sequence Number=SeqID_113867
  Gene Ontology: Mol. function=nucleotidyltransferase activity; Biological process=metabolic process
  Homolog annotation: Hit_ID=Q09WE7; Match level="QueryCoverage=99%, HitCoverage=14%, E-value=2e-38, Identity=98%"; Hit description=UDP -sugar pyrophosphorylase
MGFSSRQFHQHWASVLPNSTMLTLLQYLEKQKKLLVELPDSLTLMGWSGRSMVINVEYNQLDPLLRASGYPDGDVHCETGYSPFPGNINQ

SEQ ID NO: 230646 - protein, 48 aa, Glycine max
  Coding DNA Sequence Number=SeqID_113868
MDERESFWHQLHHMHGDGIRFNFVTAQTQRSSRPKISQRRPAYLQDYN

SEQ ID NO: 230647 - protein, 129 aa, Glycine max
  Coding DNA Sequence Number=SeqID_113869
MVMAEVGSVVMDRGWDSAFVRGKAPPKKSHIGCLNPWSAAYISVGQLHLMPIDFKMKSNMVSEQVLTLGPRLRFCCDEYPPFVVHAPSPINTGREGGVLGNTQVTHRLPQSLECGLYICWTTSLNANWF

SEQ ID NO: 230648 - protein, 163 aa, Glycine max
  Coding DNA Sequence Number=SeqID_113870
  Gene Ontology: Mol. function=GTP binding; Cellular component =intracellular
  Homolog annotation: Hit_ID=Q5QN90; Match level="QueryCoverage=86%, HitCoverage=26%, E-value=1e-14, Identity=31%"; Hit description=Leaf protein-like
  Pfam annotation: Domain name=PPR; Domain location=11-45; Score=18.0; E_value=0.034; Accession=PF01535.11; Description=PPR repeat
  Pfam annotation: Domain name=PPR; Domain location=47-81; Score=17.2; E_value=0.061; Accession=PF01535.11; Description=PPR repeat
  Pfam annotation: Domain name=PPR; Domain location=82-116; Score=24.1; E_value=0.00048; Accession=PF01535.11; Description=PPR repeat
  Pfam module annotation: Pfam domain module=PPR::PPR::PPR; Domain location=11-45::47-81::82-116
MVRDGVSPCAATYNCFFKKFRGRKDGESALRMFKRMKVDGLCAPSSHTYVILIRMFLRFEMIKVVKEIWEDMKETGAGLDLDLYTVLIHGLCERQKWREACHYFVEMIENGFLLLKGTFDTLYRGLIQADMLRTWRRLMKMLDEELITFGSEFQNYQLKPYRR

SEQ ID NO: 230649 - protein, 138 aa, Glycine max
  Coding DNA Sequence Number=SeqID_113871
MVEVSTEAIASLAQYYDQSLRCFTFGDFQLTPTMERNFQTSQNLDTGIGPRKASRKWGGWSTKEMFGSKGENLDKSRRIGPVHGRPGTLDLQAINAFLAFYNRKESPIVTILAGLYDTFDRRCEKNSARIICCTPALY

SEQ ID NO: 230650 - protein, 101 aa, Glycine max
  Coding DNA Sequence Number=SeqID_113872
MPLWTRETEKSYLLTCAFGGTVPHVCSEEGDMDLSASRDKRRDQHTTHTKILDEDSLLSSKSETQHDHRFTSIPYVPMDPGVGPLFNSPCVQIVLVFVCIK

SEQ ID NO: 230651 - protein, 236 aa, Glycine max
  Coding DNA Sequence Number=SeqID_113873
  Pfam annotation: Domain name=DUF484; Domain location=36-222; Score= -21.9; E_value=6.3e-05; Accession=PF04340.3; Description=Protein of unknown function, DUF484
PARWRPAHPVAGRWPAGGDGRPDCIRLRRGVDRMTETVDKLGAHEVAAWLRRHPGFLKQFPDLALTLVVSLYDGPTASLASYQLEVLREKNRELARRKADLGATAQVNERGGGAHAPADPGADEAGQRCRYPACYGCLAAGRFRWRPGAAGGAHAGGRAGTGRLAAAGKECRVVWRAQRGSADHRIAAATGRGPDCGRKPRPEPLLSGHGHAVPAHDGRCAGHRPEALPGLSRTRR

SEQ ID NO: 230652 - protein, 102 aa, Glycine max
  Coding DNA Sequence Number=SeqID_113874
  Gene Ontology: Mol. function=[protein-PII] uridylyltransferase activity; Biological process=nitrogen compound metabolic process
  Homolog annotation: Hit_ID=P41393; Match level="QueryCoverage=94%, HitCoverage=10%, E-value=3e-38, Identity=77%"; Hit description =[Protein-PII] uridylyltransferase
MEAGSHFIVWIKYLCQPLLQHGAHFGIQRTSFAVGKDEQILHPFANGTDAGAVQRNTEVSKHFADARQQTWLVQRHQLQIAAAVGMGGQKVDFGIDAEVFQT

SEQ ID NO: 230653 - protein, 125 aa, Glycine max
  Coding DNA Sequence Number=SeqID_113875
  Gene Ontology: Mol. function=[protein-PII] uridylyltransferase activity; Biological process=nitrogen compound metabolic process
  Homolog annotation: Hit_ID=Q6D8E5; Match level="QueryCoverage=85%, HitCoverage=11%, E-value=2e-54, Identity=90%"; Hit description =[Protein-PII] uridylyltransferase
MAIRCQRTAVRLQYNKGVHGHAVAAGKDLRIVHAQITAVELSGYGGKQVRAIRAPDEDLGAAARGLRAYQHQRFAEVMIDQMPRVPRQLVGRMAQEVVGAAAAPDMVQALFVKILHAQQRQRLQP

SEQ ID NO: 230654 - protein, 115 aa, Glycine max
  Coding DNA Sequence Number=SeqID_113876
RHAFVKWWSQFDTSKAAPEQVKNWFQSNPEFLRPADPETSLFLNQKSQLAAFLASSKSKESLAQNLKEVLQLLQQEEEEEPPKKEAESSENNDDQEDYPFYQNEDDCFGISLDDD

SEQ ID NO: 230655 - protein, 101 aa, Glycine max
  Coding DNA Sequence Number=SeqID_113877
  Pfam annotation: Domain name=Transposase_23; Domain location=37-96; Score=-11.8; E_value=0.022; Accession=PF03017.5; Description =TNP1ENSPM transposase
MQSQGLALPPDPEVGLSDARVNKKESCVDPLGQDPYTRNSEKCQLYVDENPPRLVALGRLYEGSTTVHNVPLGNDQVKVGVEEVRDADTDADACVLVPTQE

SEQ ID NO: 230656 - protein, 154 aa, Glycine max
  Coding DNA Sequence Number=SeqID_113878
  Subcellular localization annotation: CTP_CleavageSite=39; ConfidenceScore=5.21e-01
RSSWLLNHNDADAKRACAISINAKRQLAALSACVNFIRRAKMASRKRKAPSTPTQARFDRSRFTSQEAWERYTDIVDEELTDFADGNIDVAIVKEFFLNLYDPKDKSPKQVRVRGHQIKFDEDTLNTFLKTLVVVEEGETLCAYSRFALLRPDP

SEQ ID NO: 230657 - protein, 139 aa, Glycine max
  Coding DNA Sequence Number=SeqID_113879
  Homolog annotation: Hit_ID=Q1SWX1; Match level="QueryCoverage=66%, HitCoverage=17%, E-value=1e-07, Identity=35%"; Hit description=IMP dehydrogenase/GMP reductase
MGSRKVWITFLIASVGHHEFSFSQTWGRTKAPSFKKRFYHVKVKNLELASLQELGQRMDQVRRQAFSKAYRKIWDLAMIEVSVEAITSLAQYYEQSLRCFMFRDFQLVPTIEEFEGILGCSQEEGSHIFFLDSTLPWQK

SEQ ID NO: 230658 - protein, 85 aa, Glycine max
  Coding DNA Sequence Number=SeqID_113880
MAYGHGLYLLLTDADAPIPVPTDEVSLVGQALHTFLAWPTHLVKSLSQQVAVSSPKPPPKPDPEVNDPLYLMTLTIPELFLRPYQ

SEQ ID NO: 230659 - protein, 136 aa, Glycine max
  Coding DNA Sequence Number=SeqID_113881
MISEVDSDDGGHINLTEFIELKTKLRNIRGRYHLLYNIKGNGCNEEERSTFPFRENYNLAYPSRGDDLAIEAKPCLRSALFSRALASPWLSSYDVKNLEKVCSVLVGVANGKCLRVKAAVRSHVKSGHHFQEVPIW

SEQ ID NO: 230660 - protein, 56 aa, Glycine max
  Coding DNA Sequence Number=SeqID_113882
MDIEEDVDIPLILGRPFMLTASCVVDAGRRKLEMGINDQKISFDLFHEEKQLLDQN

SEQ ID NO: 230661 - protein, 53 aa, Glycine max
  Coding DNA Sequence Number=SeqID_113883
MAGLPARIRLQPTDVKAAALWGVTAVTGALYLVQDLCPMPCLAPRIRRRNMLI

SEQ ID NO: 230662 - protein, 38 aa, Glycine max
  Coding DNA Sequence Number=SeqID_113884
MCNRATTSKGVPPRNGEYHHRVMVYMSSNVDFQASKGY

SEQ ID NO: 230663 - protein, 275 aa, Glycine max
  Coding DNA Sequence Number=SeqID_113885
  Gene Ontology: Mol. function=RNA-directed DNA polymerase activity; Biological process=RNA-dependent DNA replication
MVPKSSLTLCLLLQKGINRRPRKVARRILHKPTRIYNTRANRKRMDIVEQENQSLREEVATLREGMDRLTTMMSALLSAQNSQAAAATVEQPLVSTTPLSTVTSPPLFLPPGCTWGMPPPVCGGPQPAVSEVPPPFAQQSAPVPQPSTSFPQAAMTYSAPLIHTIQQEVEPIFQAENVVAFEKMEELQERFDGMQREVEALRGRDLFGKDACELCLVPNVTIPHKFKVPDFEKYKGNSCPRSHLVMYARKMSMYTDNHKLLIHFFQDSLTGAALK

SEQ ID NO: 230664 - protein, 690 aa, Glycine max
  Coding DNA Sequence Number=SeqID_113886
  Gene Ontology: Mol. function=porin activity; Cellular component =nuclear pore; Biological process=transport
  Homolog annotation: Hit_ID=UPI000016318A; Match level="QueryCoverage =62%, HitCoverage=42%, E-value=7e-62, Identity=39%"; Hit description =transporter
  Pfam annotation: Domain name=Cornifin; Domain location=187-415; Score= -46.3; E_value=0.047; Accession=PF02389.6; Description=Cornifin (SPRR) family
MEAVEAKSSSGYGKPPWVFRGRQVAWYQLDLVKAEKARAYIPKEFKLVEAFGASDSRKEDPAPDLVRKIVESFEFAIQISIFYYLASQEGCSVQTSSSSPFGSQSVFGQTNSSSNPFAPKPFGSTAPFGSQTGGSIFGGTSTGVFGTAQPASPFGASSSPAFGSSQPAFGSSSTPAFGSSSSSFGGSSVFGQKPAFGGFGSTPTQTSPFGAAQPSQPAFGSSIFGSSTPFGASSQPAFGATSTPAFGATSTPAFGATSTPAFGATSTPAFGATSTPAFGATSSPAFGATSTPAFGSTSSPTFGSTGSAFGVSSTPVFGSGGAFGASSNPMFGSSSTSAFGTSSSPFGASSTPAFGASSTPAFSFGSTPQAFGQSSSAFGNSSPFGSTASPFGGQSSAFGSQTPTSTFGNTGGQSGFGGQQRGGSRVASYTATTEADSGTSGQTAKLESISAMPIYKDKSHEELRWEDYQLGDKGGPLPSALSTGLTGFGSSTTPTNAFSPSPVFGQSSANPFSSTTPNSNPFAPKSSPFSSGFGTSATPAFSSSAFGSSTSAAAPSLFGSTPSPFGANSSSTPSFGQSPSLFNTAPAQATSSPFGNTQSSSLFSSAAPKIEQTGSAFGQFTSHFGQTTPLSQSSLFSSPSWLVASILSSIAASVALQAYLVRIILDSRNISSEACVAPPDRTSSKDKDKE

SEQ ID NO: 230665 - protein, 68 aa, Glycine max
  Coding DNA Sequence Number=SeqID_113887
  Subcellular localization annotation: CTP_CleavageSite=59; ConfidenceScore=5.11e-01
MPTSSRRLGGSSSESYSLHPANVILLPRTMFTIITGNSLSVSTRYSHLGNHAEFVETTRVVHVTAPLP

SEQ ID NO: 230666 - protein, 87 aa, Glycine max
  Coding DNA Sequence Number=SeqID_113888
  Gene Ontology: Mol. function=catalytic activity
  Homolog annotation: Hit_ID=Q6AV57; Match level="QueryCoverage=70%, HitCoverage=37%, E-value=2e-17, Identity=69%"; Hit description =Putative thioesterase family protein
  Pfam annotation: Domain name=4HBT; Domain location=26-87; Score=10.2; E_value=0.029; Accession=PF03061.12; Description=Thioesterase superfamily
MEDQPSSSSSSKNDALDPPLSFNWPFKVLHGGVSALIAESLESMGAHMASRYKRMAGIQLSINHLKRAKIGDLVHAKATPLNVGKTI

SEQ ID NO: 230667 - protein, 38 aa, Glycine max
  Coding DNA Sequence Number=SeqID_113889
MTSLCKSRRKRFLTMQTISPNEKFAFHGEWSESSSGNS

SEQ ID NO: 230668 - protein, 82 aa, Glycine max
  Coding DNA Sequence Number=SeqID_113890
MSCPVIITPTFLCRSVSWCMPPTWHPLDPDKSNRALGFPALITGLCQAFGVPVTPSKVIRLPITWAFVEKYCTPRQAHGDAP

SEQ ID NO: 230669 - protein, 71 aa, Glycine max
  Coding DNA Sequence Number=SeqID_113891
MQCSSRPPGCARNCPPPIGDQPGSPKEFPASYEHGQKQVPKTMDQLKRLSIPSEILRFFNHANHPRLGHPT

SEQ ID NO: 230670 - protein, 127 aa, Glycine max
  Coding DNA Sequence Number=SeqID_113892
  Subcellular localization annotation: CTP_CleavageSite=71; ConfidenceScore=5.15e-01
MCPPPTSLEQCVVIAQCNSPFSIFFRSPMIYVFVHVSSTFEFGAMRSDGLVQFSILNLFGCPMNCVFVHVSSTHEFAAMRSDCLVQFSILNLFRSPMNCVFVHVSSTFEFKTMRSDCLVQFSILNLF

SEQ ID NO: 230671 - protein, 72 aa, Glycine max
  Coding DNA Sequence Number=SeqID_113893
MTTGDPPQQKTSQGNEKKNEDENITQAEFYAFKRYFSLLEEELKNITKGDPPQWERSRKISIKKKFKNIAQG

SEQ ID NO: 230672 - protein, 98 aa, Glycine max
  Coding DNA Sequence Number=SeqID_113894
  Gene Ontology: Mol. function=electron transporter, transferring electrons within the cyclic electron transport pathway of photosynthesis activity; Cellular component=plasma membrane light -harvesting complex; Biological ...
  Gene Ontology: Cellular component=process=photosynthesis, light reaction
  Homolog annotation: Hit_ID=P56761; Match level="QueryCoverage=44%, HitCoverage=12%, E-value=3e-19, Identity=100%"; Hit description =Photosystem II D2 protein (Photosystem Q(A) protein)
MIKASRVRPIPENAMRCWEMVEVGPVYYSSLAPISPWGVGFTGTTFVTSWYTHGLASSYLEGCNFLTAAVSTPANSLAHSLLLLWGPEAQGDLPVGVN

SEQ ID NO: 230673 - protein, 176 aa, Glycine max
  Coding DNA Sequence Number=SeqID_113895
  Pfam annotation: Domain name=Transposase_23; Domain location=69-141; Score=-12.2; E_value=0.025; Accession=PF03017.5; Description =TNP1ENSPM transposase
MRRVEEEKQRTMDTFKGQIQEAIKLELSQIASQHSAPLQPNDIQVLAARVSTKGSCAAVETNALAKKPSKLNGDNVGLHVTVENSNKLVAVGKRCDSFGTIHNVPYADDVVRVSVVEVIFGDAEVPILTSEIKFVKEALGSFVPWPTHLVKPILPEEAEKDVSSPLKTVEEEKADE

SEQ ID NO: 230674 - protein, 52 aa, Glycine max
  Coding DNA Sequence Number=SeqID_113896
PKVDTLVSPSAGNFVVAENANGSEKIQDEVGVEESTDPSFDDSVHHALLVGD

SEQ ID NO: 230675 - protein, 61 aa, Glycine max
  Coding DNA Sequence Number=SeqID_113897
MNFEGSDHNKLSERHYYKEDAGYYLPSTSGDAWNQNENEDIDHAISLSLVEESESKQQCKW

SEQ ID NO: 230676 - protein, 200 aa, Glycine max
  Coding DNA Sequence Number=SeqID_113898
  Homolog annotation: Hit_ID=Q1LHX4; Match level="QueryCoverage=44%, HitCoverage=44%, E-value=2e-08, Identity=36%"; Hit description =Putative signal transduction protein with EFhand domain precursor
  Pfam annotation: Domain name=efhand; Domain location=28-56; Score =17.0; E_value=0.067; Accession=PF00036.22; Description=EF hand
  Pfam annotation: Domain name=efhand; Domain location=63-87; Score =11.9; E_value=0.66; Accession=PF00036.22; Description=EF hand
  Pfam annotation: Domain name=efhand; Domain location=89-117; Score =26.3; E_value=0.00011; Accession=PF00036.22; Description=EF hand
  Pfam module annotation: Pfam domain module=efhand::efhand::efhand; Domain location=28-56::63-87::89-117
MTRTALLIALGAAPLLAEAAPADPKQAYIDSTFTAMDTNKDGRVDKSEYADFQQGRFNKQADSINAAFTAMDKNKDGRISKEEAVVVPEIAKYFTGLDTDGDGYLSLKEMQQAMVAAQTADAPTKCPWRAINGVKHEDWIQAVCCYCGCCTDPGNRQCLRAVPLYPVLHRLRGLSGGGQWRERLLPGVCPLPAEQRLHHP

SEQ ID NO: 230677 - protein, 95 aa, Glycine max
  Coding DNA Sequence Number=SeqID_113899
MKKILGLQAPMELTPLLDLARNLRNHLGVGGITVVNRMLVYLITYIFTSRSSNHAQIKGFTKASGEIIKRHLKKIGIRFVDHEWTMVGEPAVGNL

SEQ ID NO: 230678 - protein, 75 aa, Glycine max
  Coding DNA Sequence Number=SeqID_113900
MKGTFYSELVKVFYTCACVDLKGNLFTTVNGVEIFNDTVTYRGMLLDAILPPQGHWIEDSKKIVPKMQEKALGFS

SEQ ID NO: 230679 - protein, 70 aa, Glycine max
  Coding DNA Sequence Number=SeqID_113901
LGPENQAPCCFKVFGEVFHVFREANRPADELAKRGEGEGSGVERCGGRWRQTRYTEGGGSIEDVRMTYGS

SEQ ID NO: 230680 - protein, 41 aa, Glycine max
  Coding DNA Sequence Number=SeqID_113902
  Gene Ontology: Mol. function=transferase activity, transferring hexosyl groups; Biological process=carbohydrate biosynthetic process
  Homolog annotation: Hit_ID=Q9LSG3; Match level="QueryCoverage=78%, HitCoverage=5%, E-value=6e-10, Identity=87%"; Hit description =Glycosyltransferase QUASIMODO1
MDEIRNAAVVHFNGNMKPWLDIAMTQFKPLRSKFHCSLFDV

SEQ ID NO: 230681 - protein, 155 aa, Glycine max
  Coding DNA Sequence Number=SeqID_113903
  Subcellular localization annotation: CTP_CleavageSite=87; ConfidenceScore=5.03e-01
MAAQRHLDQRTGLWLPGPAVAGAPSADRPGTAQARAPAPQALPASAPAGPAAAAHRPPFRRPARCRHTPAGLAAGPAPCRRKPRRPRAGPGRTPVRRLQNGARRVACARRHVRVDAATRAAHRPGPLPGLCAPGGRWKRANSCASCACCKPSGIL

SEQ ID NO: 230682 - protein, 62 aa, Glycine max
  Coding DNA Sequence Number=SeqID_113904
MDKLLFLGTHIRYHKKDNDIPSTPIGHRKDLEDPQRTKARDLSENGFLFEPGGGMDKLTLTR

SEQ ID NO: 230683 - protein, 200 aa, Glycine max
  Coding DNA Sequence Number=SeqID_113905
  Homolog annotation: Hit_ID=Q1SRJ5; Match level="QueryCoverage=32%, HitCoverage=7%, E-value=2e-13, Identity=58%"; Hit description =Probable helicase [imported]-Arabidopsis thaliana-related
MDEIKQYHGCNYISPFEACWRIFSFPILGRKPVVERLFFHLPGEQAVYFKDDDCIDDVISKPRLCDEDIKNLTLEIEKILEKSKKSLKDYPMMPYPKGYVRSMCGNRLIMSELDYDVNLLKAEYQRHLNSLTVVPVKLSCGRQRYLSYPNFVRELSFVDLLTHANRLTVLNANYSAKEMIIQCFDQECERYLKRRAKGSF

SEQ ID NO: 230684 - protein, 155 aa, Glycine max
  Coding DNA Sequence Number=SeqID_113906
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=99%, E-value=2e-16, Identity=27%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHVLAFRGLHALALRKLHVLAFRGLHAFAFRGQHVLAFRGLYIISFRGLHVVPFIGLHVLEFRGLRVLALRGLGQHVLAFRGLEFLAFRGLHVLAFRGLHVLAFRGLHVLAFRGLHVLGIGGLHLHDFRELHVLSFIGLYLLFFRGLHVLPFKGL

SEQ ID NO: 230685 - protein, 181 aa, Glycine max
  Coding DNA Sequence Number=SeqID_113907
GMTSSDGVAFEGALDDDWKFDFSVHNARLLVCTNQAGITRRLLAGLLAIESHILHYLIVRILLPRSLNLAQALRLNAPLPYPHVVTLFLQHFNIPLDSEPYVPIKRSFLIGAVVVASFVYHKERDGSWVKKDAQPNDDEGYLPVEEDSSLLLSFLDRIAKVEEDVTFIRDCFDLPPPPPSV

SEQ ID NO: 230686 - protein, 83 aa, Glycine max
  Coding DNA Sequence Number=SeqID_113908
MEEKVDFDEDTSHDSIKKRATNNLQPGVVLMLAKDSAIIDGPKRLSPGEKTSGVATNVYLRETLENQKRSANFENEGSGVVYT

SEQ ID NO: 230687 - protein, 72 aa, Glycine max
  Coding DNA Sequence Number=SeqID_113909
MGILKRDFIQHQKGLLKGLKNQGRSLRVELGARIAKSGGVDSGLANMITIVHIEKSDLELKIIAQDLRLKML

SEQ ID NO: 230688 - protein, 38 aa, Glycine max
  Coding DNA Sequence Number=SeqID_113910
MKLCFYTRKFNEGDLVLKKLGQLEESIHVCAPKTHQDP

SEQ ID NO: 230689 - protein, 95 aa, Glycine max
  Coding DNA Sequence Number=SeqID_113911
MCILSSCELEDKSRFVLSDGRYHNKIKTKNVKSVSIARGGVKPQASMRRLSPSCHVMQSYPARALDRRLQEDWARDAREGPRVLMSLRELMKHWA

SEQ ID NO: 230690 - protein, 313 aa, Glycine max
  Coding DNA Sequence Number=SeqID_113912
  Gene Ontology: Mol. function=DNA binding; Cellular component=nucleus; Biological process=regulation of transcription, DNA-dependent
  Homolog annotation: Hit_ID=Q84PP4; Match level="QueryCoverage=48%, HitCoverage=44%, E-value=2e-74, Identity=85%"; Hit description =Transcription factor MYB102
  Pfam annotation: Domain name=Myb_DNA-binding; Domain location=14-61; Score=54.7; E_value=3.1e-13; Accession=PF00249.21; Description=Myb -like DNA-binding domain
  Pfam annotation: Domain name=Myb_DNA-binding; Domain location=67-112; Score=53.0; E_value=9.9e-13; Accession=PF00249.21; Description=Myb -like DNA-binding domain
  Pfam module annotation: Pfam domain module=Myb_DNA-binding::Myb_DNA -binding; Domain location=14-61::67-112
MGRSPCCDEIGLKKGPWTPEEDQKLIDHIQKHGHASWRALPKLAGLNRCGKSCRLRWTNYLRPDIKRGKFSQEEEQTILDLHAILGNKWSAIASHLPGRTDNEIKNFWNTHLKKKLIQMGYDPMTHQPRIDDIFTGLSHLIALANLKELLDQPLEQNLARLQELAKLQCLQQHLLQPQASLNIDADPNYTINSTINSTFMMNKGTINVSNDQFENIIMSSNCTMPFSDMPELKTPPSCSYEAPLSNKDMIQLSQGEIYPDSPWLLSCSSTTPSSPSSLVAPPVTEVSLSTNVEDNCTIWPELLLEDPLFKMIS

SEQ ID NO: 230691 - protein, 175 aa, Glycine max
  Coding DNA Sequence Number=SeqID_113913
  Gene Ontology: Mol. function=protein binding; Cellular component =nuclear envelope; Biological process=regulation of progression through mitotic cell cycle
  Homolog annotation: Hit_ID=Q38942; Match level="QueryCoverage=93%, HitCoverage=59%, E-value=1e-77, Identity=69%"; Hit description=Rae1 -like protein At1g80670
YWDTRQSNPVHTQQLPDRCYAITVKHPLMVVGTADRNLIVFNLQNPQTEYKRIVSPLKYQTRSVAAFPDQQGFLVHHTFATAGSDGAFNFWDKDSKQRLKAMQRCSQPIPCSTFNNDGSIFAYAVCYDWSKGAENHNPATAKNYIYLHLPQESEVKGKPRAGATDFETGIKRSVI

SEQ ID NO: 230692 - protein, 229 aa, Glycine max
  Coding DNA Sequence Number=SeqID_113914
  Gene Ontology: Mol. function=unfolded protein binding; Cellular component=mitochondrion; Biological process=protein folding
  Homolog annotation: Hit_ID=Q43638; Match level="QueryCoverage=93%, HitCoverage=27%, E-value=2e-95, Identity=81%"; Hit description=Heat -shock protein precursor
  Pfam annotation: Domain name=HATPase_c; Domain location=15-176; Score= 57.7; E_value=3.7e-14; Accession=PF02518.16; Description=Histidine kinase-, DNA gyrase B-, and HSP90-like ATPase
VSRLLDLIVHSLYSHKEVFLRELVSNASDALDKLRFLSVTEPSLLGDAGDLEIRIKSDPDNGTITITDTGIGMTKEELIDCLGTIAQSGTSKFLKALKENKDLGADNGLIGQFGVGFYSAFLVAERVVVSTKSPRSDKQYVWEAEADSSSYVIKEETDPEKVLRRGTQITLYLREDDKYEFSEPSRIQGLVKNYSQFVSFPIYTWQEKSRTVEISRFWALIYSNGDGDE

SEQ ID NO: 230693 - protein, 103 aa, Glycine max
  Coding DNA Sequence Number=SeqID_113915
MGIAPTRHPVDPEKSNRALGFPALVTGLYQSYRVPVPPRQGHVIIGIATARHLVDPKKSNRVLELSSSNYGKGIRPPTNRAFIKKYCAPDRRKAKHHSSIGMA

SEQ ID NO: 230694 - protein, 298 aa, Glycine max
  Coding DNA Sequence Number=SeqID_113916
  Gene Ontology: Mol. function=unfolded protein binding; Cellular component=mitochondrion; Biological process=protein folding
  Homolog annotation: Hit_ID=Q6ZCV7; Match level="QueryCoverage=91%, HitCoverage=34%, E-value=1e-131, Identity=85%"; Hit description =Putative heat-shock protein
  Pfam annotation: Domain name=HSP90; Domain location=1-298; Score =131.7; E_value=2.1e-36; Accession=PF00183.9; Description=Hsp90 protein
FPRYLSFVKGVVDSDDLPLNVSREILQESRIVRIMRKRLVRKAFDMIQDLAESENKEDYKKFWENFGRFIKLGCIEDTGNHKRITPLLRFYTSKSEEELKSLDDYVENMGENQKAIFYLATDSLKSAKTAPFLEKLVQKDIEVLYLVEPIDEVAIQNLQTYKEKKFVDISKEDLELGDEDEVKERENKQEYNLLCDWIKQQLGDKVAKVQISNRLSSSPCVLVSGKFGWSANMERLMKAQALGDTASLEFMRGRRILEINADHPIIKDLSFAHKMFTFSIDNAMVGKGVLTVKIENHI

SEQ ID NO: 230695 - protein, 393 aa, Glycine max
  Coding DNA Sequence Number=SeqID_113917
  Homolog annotation: Hit_ID=Q9BRX8; Match level="QueryCoverage=44%, HitCoverage=75%, E-value=2e-15, Identity=34%"; Hit description =Protein C10orf58 precursor
MASFSVEEFIGNGILKELLQKLLEEGWDDVPTLKIMSSEDMDLLQMTQEQKDALGIRSYLHDRGLMQYADKMEDCGKALSELINLSTTDLSTQFEMKRGHIARFINRTTSDDSVKLRALAARRRSSTMHRDDSIPKSVGSNSSNSLTRSHIRSNAASDALEQSMADMKIKEGYVFKGIVAAEPAEPRACGCVNPPPPISDQVAPYGTVENISVQKLTPEYKIGMEPLVKTKAPPLKVSELWRDKPAVFLCLRRPGAEAHQLYSRKAIFDALGVQLFAVLHEQIDSEVKDFWPRYWGGVVLLDRGRDFFKALGGGKLLKEKFLSGFLLNPRSLSNYKRAKAMHIDYNFKGEGEIKGGLFIIGMGKSGIAYQFIERNFGDWAPIAEVIEICTQMQ

SEQ ID NO: 230696 - protein, 369 aa, Glycine max
  Coding DNA Sequence Number=SeqID_113918
  Gene Ontology: Mol. function=pectinesterase activity; Cellular component=cell wall; Biological process=cell wall modification
  Homolog annotation: Hit_ID=Q9FKF3; Match level="QueryCoverage=95%, HitCoverage=97%, E-value=1e-117, Identity=56%"; Hit description =Pectin methylesterase-like protein
  Pfam annotation: Domain name=Pectinesterase; Domain location=69-358; Score=161.6; E_value=2e-45; Accession=PF01095.10; Description =Pectinesterase
MASKTICTTIQVTLIVAFLTTQVVFSDDTVPIPAHKAQLGTWFSTNVGPLDQRKSTMDPALVAAEEGAKVVKVMQDGSGEFKTITDAINSIPSGNTKRVIVYIGAGNYNEKIKIEKTKPFITLYGVPEKMPNLTFGGTALKYGTVDSATLIVESDYFVAANIIISNSAPRPDGKIQGGQAVALRISGDKAAFYNCKFFGFQDTICDDRNRHFFKDCLIQGTMDYIFGSGKSLYLSTELRTLGDTGITVIVAQARKSPTEDNAYSFVHCDVTGTGNGTFLGRAWMPHPRVVFAYSTMSAVVKKEGWSNNNHPEHDKNVRFGEYQNTGPGADPKGRAAITTQLNEMQVKPYITLGMIEGSKWLLPPPTPKV

SEQ ID NO: 230697 - protein, 49 aa, Glycine max
  Coding DNA Sequence Number=SeqID_113919
MTMTGIGKEACTWPVGHWPLPEAIIRGVGSFSPSVEFVVNLLFVSYTEY

SEQ ID NO: 230698 - protein, 358 aa, Glycine max
  Coding DNA Sequence Number=SeqID_113920
  Gene Ontology: Mol. function=oxidoreductase activity; Cellular component=proton-transporting two-sector ATPase complex; Biological process=flavonoid biosynthetic process
  Homolog annotation: Hit_ID=Q39224; Match level="QueryCoverage=95%, HitCoverage=97%, E-value=1e-108, Identity=53%"; Hit description=SRG1 protein
  Pfam annotation: Domain name=2OG-FeII_Oxy; Domain location=205-305; Score=152.9; E_value=8.5e-43; Accession=PF03171.10; Description=2OG -Fe(II) oxygenase superfamily
MDPEIVKKLGSSLLVPSVQELAKQGITKVPERYVRPNEDPCVEYDTTSLPQVPVIDLSKLLSEDDAAELEKLDHACKEWGFFQLINHGVNPCLVEYMKKNVQELFNLPHEEKKLLWQKPGEMEGFGQMFVVSEEHKLEWADLFYISTLPSYARHPHLFPNIPRQFRDNLEKYSLELKKLCILIFEFMTKALKIQPNELLDFFEEGGQAMRMNYYPPCPQPEQVIGLNPHSDAGALTILLQVNEMDGLQIRKDGMWIPIKPLSNAFVINVGDMLEIMTNGIYRSIEHKATVNSEKERISVATFHSPRLTAVIGPAQSLITPERPATFNSISVEDFFKGYFSRELQGKSYIDVMRIQNGL

SEQ ID NO: 230699 - protein, 340 aa, Glycine max
  Coding DNA Sequence Number=SeqID_113921
  Gene Ontology: Mol. function=oxidoreductase activity; Cellular component=proton-transporting two-sector ATPase complex; Biological process=flavonoid biosynthetic process
  Homolog annotation: Hit_ID=Q39224; Match level="QueryCoverage=95%, HitCoverage=97%, E-value=1e-103, Identity=53%"; Hit description=SRG1 protein
  Pfam annotation: Domain name=2OG-FeII_Oxy; Domain location=188-288; Score=149.4; E_value=9.6e-42; Accession=PF03171.10; Description=2OG -Fe(II) oxygenase superfamily
MDPQIANKLGTSLLLVPSVHELAKQPMTIVPERYIHPNQDPPSVEFATSHQVPVIDLNKLLSEDENELEKFDLACKEWGFFQLINHGINPSTLEKVKISVEEFFSLPMKEKKKFWQNQGDLEGYGQNFVVSEEQKLEWADLFYIFTLPSEAVESYSLELEKLCMTIIKLMAKTLKIKPNELLELFEDVSQAMRMNCYPPCPQPEHVIGLNPHSDAGALTILLQVNDTEGLEIRKDGMWVPIKPFSNAFVINIGDILEILTNGIYRSIEHRATINSEKQRISIATFHGPQMNKIIGPTPSLVTPDRPALFKRIGVADYYKGYFSRELNGKSYLDVVRIQNA

SEQ ID NO: 230700 - protein, 54 aa, Glycine max
  Coding DNA Sequence Number=SeqID_113922
LSAITISETSRGRDSMAFRQWDWQNRHGISPLGLAKQAPITSWQQWVSPVVLAK

SEQ ID NO: 230701 - protein, 55 aa, Glycine max
  Coding DNA Sequence Number=SeqID_113923
LHSHLLETAELPASSLSHSFYCIFAFFCIKASTIQENAMNSLSEHVALSKFIDIH

SEQ ID NO: 230702 - protein, 217 aa, Glycine max
  Coding DNA Sequence Number=SeqID_113924
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=6e-35, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LQVLAFRGLHVLTFRGLHVLNFRGLHILTFRGLHVLPIRGLHAFAFRELHVLLSRGLHVLPFRGLHSFAFRGIHVIAFGGLHILTFRGLHVLAFGGLHVLAFIGLHVLAFRGLHTLAMRGLHNLAFRGLHALTCRGLQVLAFKGLHVLTFRGLQVLPFRGLHIPIIRGVHVLPIRGIHALTFRGLHVLLFRGLHALPSRGLASSPSEGYTLSPSEGY

SEQ ID NO: 230703 - protein, 77 aa, Glycine max
  Coding DNA Sequence Number=SeqID_113925
MPRAQKSTAYHSAYFEKRALEAARGVAFAEIPRASSSRSRAKREISALSARVLSSNPLTRAKHEGGAKYNVANSKPI

SEQ ID NO: 230704 - protein, 79 aa, Glycine max
  Coding DNA Sequence Number=SeqID_113926
  Subcellular localization annotation: CTP_CleavageSite=41; ConfidenceScore=5.49e-01
MVKAVSRISPLDLMMNYVQFQRVSTAKRSFNALTVIEESVKASSSRSRTKREISALSAIFVFSQAQRTTGTKLKSTYSR

SEQ ID NO: 230705 - protein, 91 aa, Glycine max
  Coding DNA Sequence Number=SeqID_113927
  Gene Ontology: Mol. function=DNA binding; Cellular component=nucleus; Biological process=regulation of transcription, DNA-dependent
  Homolog annotation: Hit_ID=Q8H220; Match level="QueryCoverage=85%, HitCoverage=21%, E-value=3e-32, Identity=85%"; Hit description =Putative MYB transcription factor
MWKELPASLGKLLEARYKEREILIRRRRSHHSVTQCFGKKWSTIAANLPGRTDNEIKNYWNTHIKKKLLKMGIDPMTHTHLYAIYHPNVRK

SEQ ID NO: 230706 - protein, 101 aa, Glycine max
  Coding DNA Sequence Number=SeqID_113928
  Subcellular localization annotation: CTP_CleavageSite=53; ConfidenceScore=5.46e-01
MSLPGAVHASSTYESGAPQSYCVALFANSPLSTFFRSPMNVIAWRCSCILHLRAWSPAKLLRSAVLQFSILHFFSEPHECHCLALFMHPPPSSLEPCEVIA

SEQ ID NO: 230707 - protein, 123 aa, Glycine max
  Coding DNA Sequence Number=SeqID_113929
NSGVSVEADFEHFCRASNNNLIRVSMPYFGFIEEIWELDLNKVGYKDKPFIMVEQDRQVFYVQEPCDSRLLVVLRQRPIGINDHNDYSTLDICETPTFFTKMPSIIEENEVDDICANHNDHDE

SEQ ID NO: 230708 - protein, 97 aa, Glycine max
  Coding DNA Sequence Number=SeqID_113930
PQIASVAGSTRRVLAVELGVNWIVGVGHTTPISLLKHHCCGTLAAARNGNDDDGRNNVDDSCGDDSSDNNNSGGNGGDYDGSNNDDDGDNNNDNGDD

SEQ ID NO: 230709 - protein, 455 aa, Glycine max
  Coding DNA Sequence Number=SeqID_113931
VDYAGKSTAATAHGREAVLKILRGLGWTLAGLLVLAIVVWCASRMWPVPESRLQAQQRLEARLPATGHNGYALLWTLPFDDLDAQQREQALAEDVRRWEADPHGGGGGRTHLVANHAELHSRPGASCGPAASGCLVQVRADPQRFVEAHAGHQQLHARLDQLAEADYFMSPFPPKGEGILVPLPAYGVVMDATSARALAYVQGDIDGALRGACRGLQLGRRLVPGSSYLVESIIGASLVQANAQLLADMLVELPADHPLPRECEQALQPLRAEEQSLCRAMQGEYAMSRAAIESSAQEFGGVLVLDRSSTLARAAGNLGWACGAAATAALEVDRPLPVPAPPQHDFGCLSNVMGCVLTDIAAPIYPAYSSRPQDAAAMVRLLGAQRWLRQQTDDPVHALQRLPAQFRSPVRSPQLSADGHHLQVPRRSPPRGNAESPWLSVPLVAGAGATAAARD

SEQ ID NO: 230710 - protein, 272 aa, Glycine max
  Coding DNA Sequence Number=SeqID_113932
  Homolog annotation: Hit_ID=Q1SKD7; Match level="QueryCoverage=60%, HitCoverage=42%, E-value=6e-08, Identity=25%"; Hit description =Ankyrin
MNALSAFIPTDESLSLTCQAKRHFASLLPERNVVVYYTEFDKFKEELERRHWDEKLTDFADGCIDIAIVKEFYMNLYDPKDKSPKQVRVRGHLVKFDKDTLNTFLKTPVVLEEGENLCTYSMFALLRPNPQELAAKLCIPGRGFKLNADGQSLKILRKNMTTLARTWSVLSFSNLIPTSHTSDVTLDRAKLIYGIIMKMDMNAGYLISHQISLIAQHDTSRLGFPALIIVLCKAIRVQSDSRSLENFSQEPNLLLLEGVGPPQPRNLSQSSQ

SEQ ID NO: 230711 - protein, 237 aa, Glycine max
  Coding DNA Sequence Number=SeqID_113933
KIGEKVAAQLAQASKVASSRSNNLLEESSGGPKWAWLLFTPPSFEEVTETYGLRKNTSFRLPPHYGISRIAQACFLSISETSRDFIYCMSSNNNPRTKLGVLINGSKQFSSSCKYIFLTWDPIHWCDLQCKAEAIFSEHEWNEVEILSELKPTHMFGREIVNWTLFGVYEEGNNKEDIEFKNPMSIFLFHNREPFSSLPSCLYYYVSYWRNDSEGLHDTLIEAVPESNKHENAVTRK

SEQ ID NO: 230712 - protein, 73 aa, Glycine max
  Coding DNA Sequence Number=SeqID_113934
MSLSLQSQGFTPFPCPTPDQFRAEVAWPGDWPEAQAAEVPAGVPAEAPDEADEAREDEEMTDLLDFLGGSGTA

SEQ ID NO: 230713 - protein, 65 aa, Glycine max
  Coding DNA Sequence Number=SeqID_113935
MEDNELGKGKVLKEGPKPFRVLNFWFQVKSFHEVVKEVWKDLMVQGWGAFVLKEKLKGVKVALKK

SEQ ID NO: 230714 - protein, 70 aa, Glycine max
  Coding DNA Sequence Number=SeqID_113936
DDVAWEREKKVISAEERVKTGQNARRRLTCDAGEREEGVMVSSQPQAWPLAKSVARAAEAKRPAKQTSLA

SEQ ID NO: 230715 - protein, 494 aa, Glycine max
  Coding DNA Sequence Number=SeqID_113937
  Gene Ontology: Mol. function=guanosine-5'-triphosphate,3'-diphosphate diphosphatase activity; Cellular component=membrane; Biological process=DNA integration
  Homolog annotation: Hit_ID=Q74R94; Match level="QueryCoverage=99%, HitCoverage=98%, E-value=0.0, Identity=76%"; Hit description =Guanosine-5'-triphosphate,3'-diphosphate pyrophosphatase
  Pfam annotation: Domain name=Ppx-GppA; Domain location=21-303; Score =428.4; E_value=9.5e-126; Accession=PF02541.6; Description=PpxGppA phosphatase family
MLSASSLYAAIDLGSNSFHMLVVREVSGSIQTVARIKRKVRLAAGLDAANHLSAEAMQRGWQCLRLFSEQLQDIPPEQIRVVATATLRIASNAQDFLTQAEQILGCAVNVISGEEEARLIYQGVAHTTGGSDQRLVVDIGGGSTELVTGEGAHATTLFSLSMGCVTWLERFFSDRHLAKENFAQAEQAAREMIRPIAPALREKGWQICVGASGTVQALQEIMVAQGMDERITLSKLQQLKQRAIQCGKLEELEIEGLTLERALVFPSGLSILIAIFHELSIESMTLAGGALREGLVYGMLHLPIDRDIRSRTLQNVQRRFAIDVEQAGRVRQLAESFFRQVSSSWKLDQRCRDLLLSACSIHEIGLSVDFRQAPQHAAYLIRHLDLPGFTPAQKKMLACLLQNQSGSIDLALLTQQNAVPPRMAERLSRLLRLAIIFSSRRRDDTLPAVRLQADDDALHLTLPAGWLAAHPLRAELLEQESHYQSYVHWLLTIS

SEQ ID NO: 230716 - protein, 51 aa, Glycine max
  Coding DNA Sequence Number=SeqID_113938
MQQGQADILIARFPDPNYGVKRFFKGSIRHATAVPKSEKMQRQDETNKKQA

SEQ ID NO: 230717 - protein, 138 aa, Glycine max
  Coding DNA Sequence Number=SeqID_113939
  Subcellular localization annotation: CTP_CleavageSite=61; ConfidenceScore=5.28e-01
MDFLTSVVDDLLLFSIFFDVKCSSYFSKRINALSVMLMLNALSVMLMLNMLSVMLMLNALSAMLALVQLDCKYAVERYMKILIGYSKNLHRLKASIVERYIVEEAIEFCSKYIEKAKPVGLPESWHDERVGVRVQEDY

SEQ ID NO: 230718 - protein, 124 aa, Glycine max
  Coding DNA Sequence Number=SeqID_113940
METFLLLRAMVVKKLGDLNDPIDNVDVVEVGNLKLHVRAITLRWRGFWDSFHVGVMMERFHGFQTIKDIIEFGMEGALVIGQSPSGKTVNGSLGLGCKGCLWVRNTIRWGNQKAHVWRLAIGKD

SEQ ID NO: 230719 - protein, 247 aa, Glycine max
  Coding DNA Sequence Number=SeqID_113941
MVVMGMEIFIKKGVLTKIQNWHRVVLVVAVKMLGRILECDVAIALGRHGKGQRFEIQVLSHLDCECDYSSTPASSNPPFYFKYRYLFEVLGLTLPLIAFQCTLLEYLNMASSQLHQTIGQWFKFFDEDLLTLVERVDKAILDGIPPSFIAAATIGEEGQPIGEVGLIAIVAKVTLSAPSSVLAKMKRDDGVGSSGRKKETAPMSPHALSVLTTLAGSILASSSTVVAPLLTISVATTSALTVLPPSS

SEQ ID NO: 230720 - protein, 48 aa, Glycine max
  Coding DNA Sequence Number=SeqID_113942
MARMKKSGQMMSKAANETTNRINSLEEQASQLSFVAHGRQDLLTTAIG

SEQ ID NO: 230721 - protein, 78 aa, Glycine max
  Coding DNA Sequence Number=SeqID_113943
MYMGIVARDKVDITFVNWKEVLATQKDLIWENIQAEFDILEGYDKRTKKNILKTDVQKKAQALKKQNIAPHMLSRRGL

SEQ ID NO: 230722 - protein, 87 aa, Glycine max
  Coding DNA Sequence Number=SeqID_113944
MEKALVLFKPSLLSKTAASGSLIAVVQVELVAVLKICGNLLNCGSGKGYSKVNNLAPFAGEPMSISILLAFVSLPLCWDRVVTIFFI

SEQ ID NO: 230723 - protein, 71 aa, Glycine max
  Coding DNA Sequence Number=SeqID_113945
LKHDIKIPNSENARKWVANMVLKFNNDLTLNESEIIIFLRQVWWTAGRRKNFERKMGKNENEGKKRYHHSN

SEQ ID NO: 230724 - protein, 89 aa, Glycine max
  Coding DNA Sequence Number=SeqID_113946
MEGIIDLRISLSLHGNEGDTRRMMCTKALKQEVGELNTFLASKVILEATQEESEVKGFMNMIHRQKNLKYKLEMGVLLAQAGVPMYFDL

SEQ ID NO: 230725 - protein, 58 aa, Glycine max
  Coding DNA Sequence Number=SeqID_113947
MWVQAIGQFAQATCALEFGLPRPFNQRLLILHVGGERSELSRIGCWTNGLSYLKKKEG

SEQ ID NO: 230726 - protein, 78 aa, Glycine max
  Coding DNA Sequence Number=SeqID_113948
MVGAFSQNIVTLTGLPMILLSESDLTNPLCGVSCYVLLSAAVVRNVITHSRWLGEVLKGTLCGRTLGHNALIGCDSGT

SEQ ID NO: 230727 - protein, 86 aa, Glycine max
  Coding DNA Sequence Number=SeqID_113949
MVSDLAVLLPSLTQLVVLHSAQQPILKLAHPWPEWFQLMKCLLDKGYFCREEGKMLCNAGMGMKDFNVIRTKFGSASELCQTVIFN

SEQ ID NO: 230728 - protein, 71 aa, Glycine max
  Coding DNA Sequence Number=SeqID_113950
MEYDTASTKMPPAKAESVYGSNIFQVYFDDVKDSSQESKVKQVSRITELFNQSKFQESKSHSIKASFKSQD

SEQ ID NO: 230729 - protein, 143 aa, Glycine max
  Coding DNA Sequence Number=SeqID_113951
  Gene Ontology: Mol. function=DNA binding; Cellular component=oxygen evolving complex; Biological process=DNA integration
  Homolog annotation: Hit_ID=Q1SD84; Match level="QueryCoverage=97%, HitCoverage=14%, E-value=2e-42, Identity=46%"; Hit description =Integrase, catalytic region
MEDDEVKLARLKNNLIVEFEIKDLGSLRYILGMEKYILDLLEETRMSGCRPADTPIDPNGKLWEKGSVLVDIGRYQRYLKSNPGKGMFFKKNSDLEKNKKQGVVAKSSAEANFRAMAQGICEGLWIYRVLEELEMAIELPLKL

SEQ ID NO: 230730 - protein, 35 aa, Glycine max
  Coding DNA Sequence Number=SeqID_113952
MDYCCMRFMLPEDLGNVNPGHEFICMGCGDHVGYP

SEQ ID NO: 230731 - protein, 79 aa, Glycine max
  Coding DNA Sequence Number=SeqID_113953
MVMRLGGDGAVWGEVNDATRSRTRRTCGAGETVPILVVPVGKYLFPFPSSRGNIPRLWGPEQDSPFGDPCLWYKLIPLL

SEQ ID NO: 230732 - protein, 89 aa, Glycine max
  Coding DNA Sequence Number=SeqID_113954
MFDTRFLPFYTTCAIRCTCRKPNKFLASLLGNFFLYGKSPTGNLVPLDLEIEATLRRNRAERRRKLLQDITVASILEEETYFSDLLSPD

SEQ ID NO: 230733 - protein, 92 aa, Glycine max
  Coding DNA Sequence Number=SeqID_113955
MPSLTPHLPMIADLHWHLAYIVLLINHQIKMTWEESLQIGLSKLIVLLEGDVLSITNSMDHHTRKSVVPSKLGLALPKPVQVPMPASKQTMP

SEQ ID NO: 230734 - protein, 98 aa, Glycine max
  Coding DNA Sequence Number=SeqID_113956
MCVRITLGCLRMSPDSHKSGINKCCLYTDNHLGIDEDKTKSKGKDPVEGLGGPMIRDRARKAKEALQQVLSILFEYKPKFQGEKSKVVSCIMAQMEEN

SEQ ID NO: 230735 - protein, 189 aa, Glycine max
  Coding DNA Sequence Number=SeqID_113957
  Homolog annotation: Hit_ID=Q9FFY5; Match level="QueryCoverage=98%, HitCoverage=70%, E-value=2e-27, Identity=39%"; Hit description =Arabidopsis thaliana genomic DNA, chromosome 5, P1 clone:MAC12
  Subcellular localization annotation: CTP_CleavageSite=42; ConfidenceScore=5.22e-01
MKNRTSGFLKEIIANLSSMAKSKTMALKSKTNAIRARLIIFSLMKNKKFLMSSLSEKFHSVWGQSSSQQKEDHCLLEDGSNDHQSKAIVLYNSNAHSYEALPNPSETQLVVEEEQDQDGYDGYYNYHCDDDEKYPDLTHTLFESEDLDLGGSVIDLMKNSKEEAGKEFKLEDEIDLAADLFIMKFRRQM

SEQ ID NO: 230736 - protein, 124 aa, Glycine max
  Coding DNA Sequence Number=SeqID_113958
  Gene Ontology: Mol. function=transferase activity; Biological process= DNA integration
  Homolog annotation: Hit_ID=Q1T010; Match level="QueryCoverage=58%, HitCoverage=5%, E-value=9e-20, Identity=58%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MVDNKSAINLAKNPVSHGRSKHIETKYHFLRDQVSKEKIKLQHCGTDLQVADILTKPLKIERFKSLRDKMNVEMWKIHYVHVYRGANSCPDALTDLACNLSEDIVIFEHCLAVVSNMLLPDASV

SEQ ID NO: 230737 - protein, 872 aa, Glycine max
  Coding DNA Sequence Number=SeqID_113959
  Gene Ontology: Mol. function=nucleic acid binding; Cellular component= intracellular; Biological process=DNA integration
  Homolog annotation: Hit_ID=Q1T010; Match level="QueryCoverage=99%, HitCoverage=71%, E-value=0.0, Identity=44%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=504-667; Score =173.0; E_value=7.3e-49; Accession=PF00665.16; Description=Integrase core domain
  Pfam annotation: Domain name=zf-CCHC; Domain location=257-274; Score =30.3; E_value=6.9e-06; Accession=PF00098.13; Description=Zinc knuckle
  Pfam module annotation: Pfam domain module=RVT_2::rve::zf-CCHC; Domain location=794-872::504-667::257-274
MKVIFAYQEVQEVVDEGYPALVEGATEAQRAVHRENKKKDNKALFFIHQCIDNAHFEKIALAKTSHEAWKILEKCNEGADQLKKVRLQTLRRQYELMQMNVTEKVAEFFNRVIALTNSMKVAGETVTDQMIVEKILRTLIPKFDHVVVAIEESKNLATLKVEELQGSLEAYKQRMLERQSDRSQDQALQAQTWKRGGLSGKKGNRGRGRSREYRSNHGSSGKQSQNNEENDQSESSSRRGGSQNWQGGKKKVDPRFLRCFNCNKLGHFSSECKAPADSRGKFSNEANLVSEKLDQDEEPATLMMMTKERSSNSGIWYIDSGCTNHMTGHKEWLVNLDLSKKSRVRFADDRHIRAEGIGDVYVKKEDGKDAVITEVLYVPGLKSNLISMGQLLEKGFSLYMISGHLGVYDTHQRRILKVTLTRNRTFQIKVNALESHCLSAEVDKDGSWLWHLRFGHLNFKSLSLLNSKGMVPGMTPIKLPSKVCESCLVSKQSRNSFGSYTLERSTAVLDVIYSDVCGPIDTVSLGGNKYFVSFIDEFSRKLWVYLLKAKSEVFSVFKVFKSMAEKQSGKYIKVLRTDGGGEFCSHEMENFCTENGILHEIVAPYTPQHNGITERRNKTILNMVRSMLKGKNMSHTFWGEAVMTAAYVLNLCLTKKLGSKVPEEIWTGKKPSVKHFKVFGCLCHKHIPDQKRKKLDDKMAEIDLDLDQTAPDLDNGEELGEELNLPLAPPVESNAPQNERPKRHAEVPVRLHDYELFQDSEIGNDGELIHMALLADVSPVSFDEAIVNKTWRKAMKEELVSIEKNETWELVELPANKRPISVKLVFKVKLNPNEEVYITQPPGFELKGSEDKVLKLKKALYGLKQAPRAWNK

SEQ ID NO: 230738 - protein, 64 aa, Glycine max
  Coding DNA Sequence Number=SeqID_113960
MVKLGYLRLTMIEKVDTKCGRLSMMANENKHIEWIDAKILMQSSQGGDPPTPWLGDSKKIGPEM

SEQ ID NO: 230739 - protein, 120 aa, Glycine max
  Coding DNA Sequence Number=SeqID_113961
MVLHSNAAEMPQVGGKYLQKFEIWVIFLTKLKVFQGNIILFKITNDLEDAKKKVIILTVENTNLQPRNRKVQQDLTTSTKALSLEIDLKLTNELLMVCLEYVIIRHDLIKKYEEKREALV

SEQ ID NO: 230740 - protein, 626 aa, Glycine max
  Coding DNA Sequence Number=SeqID_113962
  Gene Ontology: Mol. function=nucleic acid binding; Cellular component= chromatin; Biological process=DNA integration
  Homolog annotation: Hit_ID=Q1RWN2; Match level="QueryCoverage=99%, HitCoverage=47%, E-value=0.0, Identity=53%"; Hit description =Peptidase S8 and S53, subtilisin, kexin, sedolisin; Integrase, catalytic region; Zinc finger, CCHC-type
  Pfam annotation: Domain name=rve; Domain location=487-626; Score =124.9; E_value=2.2e-34; Accession=PF00665.16; Description=Integrase core domain
  Pfam annotation: Domain name=zf-CCHC; Domain location=251-268; Score =19.3; E_value=0.00066; Accession=PF00098.13; Description=Zinc knuckle
  Pfam module annotation: Pfam domain module=rve::zf-CCHC; Domain location=487-626::251-268
MASESSFVQPAIPKFDGHYDHWALLMENFLRSKEYWGLVENGIPELVEGTPLTEVERKHIDDQKLKDLKAKNYLFQALDRSVLETILNKDTSKNIWDSLKQKYQGTSRVKRAQLQALRKEFEILHMKEGESVNDYFARTLAIANKMKANGENKGDVAVVEKILRSMTPKFDYVVCSIEESKDTDTLTIDELQSSLLVHELRMTSHVEEAQALQIAHTGQHAEQGRGRGGFGRRGRGRGRGRGRQAFEKSTVECYTCHQLGHFSWECLNQRKEANYVENDDEMLLMACIDVTKANEEVVWFLDSGRSNHMCGKKEYFSDLDENYKDSVKLGNNSSMAVTGKGNVRINMNDNTYTVTGVFFVPDLRNNLLSIGQLQEKGLSILFQHGKCKVFHPENGLIMETRISSNRMFMLHAISQPTKSTCFHTVTEDIVHLWHCRYGHLSFRGLNTLYQQSMVYGFPTMKAPTKLCQDCLVGKQSRASFPKKSTWRATQVLQLIHADICGPITPISNSKKRHLLTFIDDFSRKTWIYFLTEKSEALSVFKKFKILVEKEADSLIRSLRTDRGGEFTSQDFTNFCCDNGIRRQLTAAYTPQQNGIAERKNRTIMNMVRSMLSEKKMPKTFWAEAAT

SEQ ID NO: 230741 - protein, 75 aa, Glycine max
  Coding DNA Sequence Number=SeqID_113963
  Gene Ontology: Mol. function=uridylate kinase activity; Biological process=pyrimidine nucleotide biosynthetic process
  Homolog annotation: Hit_ID=Q5JJV9; Match level="QueryCoverage=86%, HitCoverage=17%, E-value=1e-15, Identity=84%"; Hit description =Putative UMP-kinase
MAASPEPINFKVLLKVSREALAGDHSQNIDPKITMAIAREVAAVTRLGIEVTTMDSFMLVGVTSSVDPPELEVAD

SEQ ID NO: 230742 - protein, 147 aa, Glycine max
  Coding DNA Sequence Number=SeqID_113964
  Homolog annotation: Hit_ID=Q1SGY6; Match level="QueryCoverage=28%, HitCoverage=4%, E-value=2e-15, Identity=88%"; Hit description =Transcriptional factor B3; Auxin response factor; Aux/IAA_ARF _dimerisation
MFGLEGKLEDPVRSDWQLVFVDQGNDILLLGDGPWPEFVNSVGPKKFKHWDNNCGKFANVKGCQGVISLNMEDGTLHRFKAASTILATRKIKVHQREVPMEKGTSLPMEKGFKILLFPIIDSLGNPLKIYMWYQSMCYEIYDSPRMI

SEQ ID NO: 230743 - protein, 45 aa, Glycine max
  Coding DNA Sequence Number=SeqID_113965
MQDSGSLEAKEAKAYALLRAIKGAQELNISKNKDDSYSKLNGEFC

SEQ ID NO: 230744 - protein, 90 aa, Glycine max
  Coding DNA Sequence Number=SeqID_113966
MVSDLAVLLPSLTQLVVLHSAQQPILKLAHPWPEWFQLMKCLLDKGYFCREEGKMLCNAGMGMKDFNVIRTKFGRASELCQTVIFNWTRT

SEQ ID NO: 230745 - protein, 85 aa, Glycine max
  Coding DNA Sequence Number=SeqID_113967
MQSWQLAFNWEQGLNTQVQDVRARILTDMAWLCDEWGCGPDDCAWIIVRDDDTVLCLKLVTEGRSHFAGIPMFRPSRLVKSKAEQ

SEQ ID NO: 230746 - protein, 65 aa, Glycine max
  Coding DNA Sequence Number=SeqID_113968
MQDFNVNCQYHQESVSVSHHVRVGHLFAGHLHGVGVDPDAAGEEVRTEGQLIEKHTSSLIDAAPP

SEQ ID NO: 230747 - protein, 237 aa, Glycine max
  Coding DNA Sequence Number=SeqID_113969
  Gene Ontology: Mol. function=heat shock protein binding; Cellular component=nucleus; Biological process=protein folding
  Homolog annotation: Hit_ID=Q6EIX7; Match level="QueryCoverage=95%, HitCoverage=97%, E-value=9e-65, Identity=47%"; Hit description =Potyviral capsid protein interacting protein 2b
  Pfam annotation: Domain name=DnaJ; Domain location=5-54; Score=43.7; E_value=6.3e-10; Accession=PF00226.21; Description=DnaJ domain
  Pfam annotation: Domain name=DnaJ_C; Domain location=111-232; Score =8.3; E_value=3.9e-07; Accession=PF01556.9; Description=DnaJ C terminal region
  Pfam module annotation: Pfam domain module=DnaJ::DnaJ_C; Domain location=5-54::111-232
MGAGDYYKILKVKHDATDEELKNHERKEEFEAKLKQLSEAYDVLSDPNKRQMYDFYGDNYLLDSNTKDAVVDQCSFLCSLEELYNGCKEKVLKSVEEILKIDIKPGWENGTKITFPGKGNKEQGAPADLVFVLGERPHAIFKRDRNDLVVIQKILLADALTGTSLNLTTSDGRDLTIQVTDIVKSGYELVVPNEGMPISKKPGKKENLRIKFDVICPSRLTTQQKCDLRRIQSDADY

SEQ ID NO: 230748 - protein, 362 aa, Glycine max
  Coding DNA Sequence Number=SeqID_113970
  Gene Ontology: Mol. function=3-oxoacyl-[acyl-carrier-protein] synthase activity; Cellular component=chloroplast; Biological process=fatty acid biosynthetic process
  Homolog annotation: Hit_ID=O82520; Match level="QueryCoverage=71%, HitCoverage=53%, E-value=1e-123, Identity=83%"; Hit description=3 -oxoacyl-[acyl-carrier-protein] synthase
  Pfam annotation: Domain name=ketoacyl-synt; Domain location=121-362; Score=233.9; E_value=3.4e-67; Accession=PF00109.16; Description=Beta- ketoacyl synthase, N-terminal domain
MASIAGTCPLGALLRNISENNGKISVVHYEGLRLQQRLQMHSPSHYISASSYWMDSPIGSDPLTSLLPPLLPFLLPSPLGQPYVSLPSFTLALAAAPRCRTIKVMASPTVAAPKREKDPKKRVVITGMGLVSVFGSDIDGFYNKLLEGESGISLIDRFDASNFPVRFGGQIRDFSSEGYIDGKNDRRLDDCWRYCIVAGKRALDDANLGQQVLDTMDKTRIGVLVGSGMGGITAFSTGVEALVQKGYKKITPFFIPYSITNMGSALLAIDTGLMGPNYSISTACATANYCFCSAANHIRKGEADIMVVGGTEAAIMPSGLGGFIACRALSHRNEGPKKASRPWDKDRDGFVMGEGSGVLVEP

SEQ ID NO: 230749 - protein, 145 aa, Glycine max
  Coding DNA Sequence Number=SeqID_113971
  Subcellular localization annotation: CTP_CleavageSite=49; ConfidenceScore=5.32e-01
MTWMPPLLPAGKLVPPLTTAGTRIPPLATAALSLNRQYQRRDRRERGCTANSNGGTGEREAVPLFLLAGHANVAVPPLPPAEHLDGTRASVHMHAESFLCRLGMLNHFYAVYARLGLVHMHAPLALTLLDWIGHAPLALTLLDWI

SEQ ID NO: 230750 - protein, 130 aa, Glycine max
  Coding DNA Sequence Number=SeqID_113972
MDVDAVIVAGGKACTAIDNCGNKDPAIGNCGTQPKPPVRTAGQEREAVPLIATAGQERERLYRCSSWRDMPTWQSRHCHLRNTLTFQACSNEKLGRCSLLCLRVLVVEISLVLVAVLPFVPLLLFSHKFL

SEQ ID NO: 230751 - protein, 131 aa, Glycine max
  Coding DNA Sequence Number=SeqID_113973
  Gene Ontology: Mol. function=calcium-dependent phospholipid binding; Cellular component=plasma membrane; Biological process=cell differentiation
  Homolog annotation: Hit_ID=Q1SAQ6; Match level="QueryCoverage=97%, HitCoverage=39%, E-value=9e-43, Identity=78%"; Hit description =Annexin, putative
  Pfam annotation: Domain name=Annexin; Domain location=60-126; Score =70.3; E_value=6.1e-18; Accession=PF00191.10; Description=Annexin
MKKLSASLVQGARPNLWQLSTASKMKMVVLLVRNCMLEETSDDFNKAVNVAIHCINDHKYYEKVLRNAIKGVGTDEDGLTRVFVTRITEKDLKDIKELYYKKNSGHLEDAVAKEISGYYKKFLLTLLGKEG

SEQ ID NO: 230752 - protein, 63 aa, Glycine max
  Coding DNA Sequence Number=SeqID_113974
MASPMTSGGTLRDGKSDDMQGYLMVIRTFCHPETASRMTCGGTLWLFTPFVNQRQASPLTCSD

SEQ ID NO: 230753 - protein, 55 aa, Glycine max
  Coding DNA Sequence Number=SeqID_113975
MAFKLKSISVRLFPYKNHTLMPLRHFTEHLAGARLGINSKRTGTMWHVPLLQNAL

SEQ ID NO: 230754 - protein, 46 aa, Glycine max
  Coding DNA Sequence Number=SeqID_113976
MTVKKRLSHEVQKVIVELSSVIGQSAMENLVEHQHQGRTLSMRLVR

SEQ ID NO: 230755 - protein, 58 aa, Glycine max
  Coding DNA Sequence Number=SeqID_113977
EKLAGPRSFKVKRLKGGTQINEHASFVVCVRSHRERLHDDVPNYLMDGGVGVGVDGRR

SEQ ID NO: 230756 - protein, 112 aa, Glycine max
  Coding DNA Sequence Number=SeqID_113978
  Gene Ontology: Mol. function=unfolded protein binding; Biological process=protein folding
  Homolog annotation: Hit_ID=P55737; Match level="QueryCoverage=63%, HitCoverage=10%, E-value=4e-12, Identity=54%"; Hit description=Heat shock protein 81-2
MSTSLCWGHHKFVCRILGSSIFVRAGSNYFLVYCAMHNVNNFNIKEMKRCPLRNKEDRLTGISVPHLRSASQANALPVIGVNLVESIILLLCDLLRLCHPNGLMLVHERAFM

SEQ ID NO: 230757 - protein, 212 aa, Glycine max
  Coding DNA Sequence Number=SeqID_113979
MAGHMGRGVIEEQVWRKGPWTAEEDRLLVEYVSGGGSSGSQGQVLHGDNLNLRLASKGAGALLREYINSKIYDVSQTLSPEQLTTVTHDCPPWSPPSLVLCNIVITVFRRPPSLTLVLIVHHCHSHLSSKSPKPFHQSSSPLSLTIVLLGHRRHLVWFSFVTTATHFGSHCSPTSLRDWDSSLQHCHHRLPSATVTHFGSYCSPLSLAPVLQ

SEQ ID NO: 230758 - protein, 93 aa, Glycine max
  Coding DNA Sequence Number=SeqID_113980
MSNSFTEQVMIIWAALKHTTILNCVVQRVLFVHSHAYHLQRHMQSPLELVGLGSSSSMDSFASWKINGSGMEKEEREETPLQGEDESRRSSPP

SEQ ID NO: 230759 - protein, 118 aa, Glycine max
  Coding DNA Sequence Number=SeqID_113981
MEGQSRDTMNEQQCLETKLTNMLQNVKPPEMYGFDMQCIYRVPPDIRETNPKAYTPRIVSIGHFHKACYAGNEDSIFESMEELKVNYLKAFLNRTQVPVGTFVVTLHALEDKIRSCYA

SEQ ID NO: 230760 - protein, 61 aa, Glycine max
  Coding DNA Sequence Number=SeqID_113982
ITIGDGGSDDDDSDSDGGSCSDDRNSSDDGSGGNNGGGCRDENDSNDGCDGDNGDEWWQRR

SEQ ID NO: 230761 - protein, 89 aa, Glycine max
  Coding DNA Sequence Number=SeqID_113983
MSQNFMDYATIPSSASGMLRNFTDCAIMFPFDSRHVTELHVLLNDGCQVPQSGQVKVTCHQTMEFKNPVICPGYPVSEHPPHLLSEAQG

SEQ ID NO: 230762 - protein, 82 aa, Glycine max
  Coding DNA Sequence Number=SeqID_113984
MMDSNVELFNMFVLNWNLKTYKHRWQYVEFWFGIWMKNVTKCKEMNEHAVRFGFRLTLLEVVDEAEALMNDLSNAEVDNDQA

SEQ ID NO: 230763 - protein, 129 aa, Glycine max
  Coding DNA Sequence Number=SeqID_113985
  Gene Ontology: Mol. function=ATPase activity, coupled to transmembrane movement of substances; Cellular component=integral to membrane; Biological process=transport
  Homolog annotation: Hit_ID=Q1T1V6; Match level="QueryCoverage=91%, HitCoverage=10%, E-value=2e-40, Identity=65%"; Hit description=AAA ATPase
MEEHFCANVLAMGTSCITISHRPTLVAFHDVVLSLDSEGGWSVHHRREDLCTELGNDTMKALETKRQSDAKAIQQAFDMNKKDSAFSNSNMKHNISPSVVPQLHGNTRALLMRVAAMCKDYDGGACWKG

SEQ ID NO: 230764 - protein, 81 aa, Glycine max
  Coding DNA Sequence Number=SeqID_113986
MSISKTVQNQRRMLLITNVEGTFYTSDDSMHYCWFASLLAILYKKQMNYLLAWGSCVITVLRYFLQTTIRLFVDDQQQSKS

SEQ ID NO: 230765 - protein, 61 aa, Glycine max
  Coding DNA Sequence Number=SeqID_113987
  Subcellular localization annotation: CTP_CleavageSite=21; ConfidenceScore=5.33e-01
MQFNKLLDQQVQLIQLHSSVVASLPTSNGSHIPTVSSLPNSNRSHIPVVEVFFLTGHFMGS

SEQ ID NO: 230766 - protein, 220 aa, Glycine max
  Coding DNA Sequence Number=SeqID_113988
MIQLSHFLPLHEGFDPPRNARGVVAGDTEGPPKCFAWVYQQLLALQWHIRGKARSRLDCGCWLSMGIGMELLTFSLGVPDGGVGFTLATAPVAATATALASIIFFMLIMAYIIGAICSFKASVSAFICSCTSSTSPITLALARVRRNEGGGYRLAHPGELRSPRRAGLLPPEGTTFCWNPWKAQIDYPFERGGNSCNFILSFANLFGNSLRVYVLFDLVT

SEQ ID NO: 230767 - protein, 83 aa, Glycine max
  Coding DNA Sequence Number=SeqID_113989
MWSSAPFSEMLASSGRDRDKVSLLLSWLEGLIACGDTLQLFAPLSSRDNKFDDTWRQHMIYLCHPETFRLDDAQGSSMLTRDD

SEQ ID NO: 230768 - protein, 82 aa, Glycine max
  Coding DNA Sequence Number=SeqID_113990
MTTLVSACQWARLPLVDKGADNHEVSPHAIGPSSHGSRIETLSRSRPEDADISGNGRRRPHRSPLVNQTWGVSACHRTHKSR

SEQ ID NO: 230769 - protein, 360 aa, Glycine max
  Coding DNA Sequence Number=SeqID_113991
MTRTKKSGQITSEATKEITDRIASQKSFVAHGRQDLLTVAIGGSRTSLSMAPEDLEKLTQKIRDQLKELITQKGLALPIEAEVGPSTARGLLIVHNVPLGNDQVKVGVEEIRDVDARISIPTQEDKHEVEGPVKPIDKPNPDVDPLYLMTLTTRNFSSNRCRCRHISDLTPIGEKKERKPQEANINLPYFHGKDNVEAYLDWEIKVEQQLKRKSTSKSYGSHSYPKKDQGQGILGAAPSKPIDDKGKTIEKKPPKAIAKMRLLLHLPLVKVKRQKGKNLVKKSTPMKEGQPLIVKETPRGLARAVKEGPRVLMNLRGVCVAKALASHLKEVSLAIRGEASQGSFLRKFLKEASQGGDLSY

SEQ ID NO: 230770 - protein, 115 aa, Glycine max
  Coding DNA Sequence Number=SeqID_113992
MALKKKHKQVMACLTLLGKMSRIAMANTEGKYIFSPSNLGCNWSRIPISASIQTFHCLALNVKKHAVVTYPSAGGRRETHGCVFQERKTRGVATNVYSRKMSEKLRCGLRTLSVK

SEQ ID NO: 230771 - protein, 100 aa, Glycine max
  Coding DNA Sequence Number=SeqID_113993
MGNRKLELGFEDQKIDFDLFVEDKPTVEYNVCLQVMEGGQEVLKGFNFLEKGLKNNLENFFFLKNSPFAKRKPLAKRISVHALSPESQALSTQPLHLRLI

SEQ ID NO: 230772 - protein, 205 aa, Glycine max
  Coding DNA Sequence Number=SeqID_113994
  Homolog annotation: Hit_ID=Q3IVY3; Match level="QueryCoverage=83%, HitCoverage=77%, E-value=6e-34, Identity=41%"; Hit description =Putative cytoplasmic protein
MTGARHGGQQRAFRLHLYFVVTEQPRPVAGKIGQTAHRQHFLHQRIAIACAAVNPLKTVIAAYHHQCATRGNIVVNQRQAIGRTPAFQPGVRMQQQGIGTDIGQNNHVPALQILQRLRKISGGGVSRHMRDGIGAILQRSEKIRRTAVPGGGSKLIKAFYVHCGTGPGFTDQQDVLLHANFSVYPPNTRCGLVIMRVSSCSPLTP

SEQ ID NO: 230773 - protein, 207 aa, Glycine max
  Coding DNA Sequence Number=SeqID_113995
  Gene Ontology: Mol. function=protein dimerization activity; Cellular component=cytoplasm; Biological process=proteolysis
  Homolog annotation: Hit_ID=Q4ZYE3; Match level="QueryCoverage=96%, HitCoverage=53%, E-value=4e-65, Identity=60%"; Hit description =Peptidase M20:Peptidase M20
  Pfam annotation: Domain name=Peptidase_M20; Domain location=68-206; Score=32.9; E_value=1.1e-06; Accession=PF01546.18; Description =Peptidase family M20M25M40
  Pfam annotation: Domain name=Peptidase_M28; Domain location=65-206; Score=-51.8; E_value=0.028; Accession=PF04389.7; Description =Peptidase family M28
  Pfam module annotation: Pfam domain module=Peptidase_M20::Peptidase _M28; Domain location=68-206::65-206
MPARSLPLAQQLLSFNTINPPGNELACVQFLAAWLQEQGFVVKLTAFGEQRANLIARLPGQMPGKPLAFTGHLDTVPLGNQPWQFDPFGHDIDGDRLYGRGASDMKAAVAAFVLACVQHKAAIAAGRGVVLLLTGGEETGCHGAQALIAAGQLPEIGALIVGEPTANQPVIGHKGALWLRCETRGKTAHGAMPELGINAIYLAADAL

SEQ ID NO: 230774 - protein, 309 aa, Glycine max
  Coding DNA Sequence Number=SeqID_113996
  Homolog annotation: Hit_ID=Q365Z9; Match level="QueryCoverage=44%, HitCoverage=87%, E-value=5e-50, Identity=71%"; Hit description =Arsenate reductase
  Pfam annotation: Domain name=ArsC; Domain location=7-117; Score =159.0; E_value=1.2e-44; Accession=PF03960.6; Description=ArsC family
MTNITIYHNPDCGTSRNTLALIRNSGVEPTIVLYLVTPPTRETLQQLIDAMGIGLRALVRQNTDAWQALGPAREALSDEQLLDVMLAQPILINRPIVVTPLGTRLCRPSEQVLDILPDAQRGPFTKEDGEVVIDAQGRRAIAIAGNQVVDQISEPVRQITQNAAGAPRPGQRQLFAALALDRRKVIIARQAVAQQKNHPGITQLALSIIKDDRLAGLGYKKTGEATRPTGSIICHLSEADFHARHRAGVAVAVVAQLLRHAAPQVDVRIQPRVHAQLHLGGVTRACLLDVDAVQRGAERPAVVQPVGLG

SEQ ID NO: 230775 - protein, 159 aa, Glycine max
  Coding DNA Sequence Number=SeqID_113997
  Homolog annotation: Hit_ID=Q10AB4; Match level="QueryCoverage=82%, HitCoverage=27%, E-value=8e-19, Identity=42%"; Hit description =Expressed protein
MDLKILLVKVKTAISNSIDSIPPKLLKKKPFFNAKQNVGVLAFEIDGVMSKLLHLCYSLSDATIVRVQNDTVNLKGVWKIISNDESFLLRLDCTESLRVVANSVTRLNTRCEDPALHSFHWAFLEFADSGRDLNPLWPNGNVETASWFCRLVPSVAAVI

SEQ ID NO: 230776 - protein, 97 aa, Glycine max
  Coding DNA Sequence Number=SeqID_113998
MTIFATTVMIVTATTAYYHHHRDHHNDHHHRHLYDFVIATATTYEGQVGDDYYGHGGDYGGGVGGSNGNYNHDGGDGNNHDSGSVMKVIGLRYFRMT

SEQ ID NO: 230777 - protein, 68 aa, Glycine max
  Coding DNA Sequence Number=SeqID_113999
  Subcellular localization annotation: CTP_CleavageSite=35; ConfidenceScore=5.54e-01
MCDFSSQWAKRASTAKRSFSALSTTEESGRASISRSRAKREISALSTAVVFRQAQRMTGAKLKSTYSH

SEQ ID NO: 230778 - protein, 49 aa, Glycine max
  Coding DNA Sequence Number=SeqID_114000
MQAQLHWVKVVETLQYMVSPQSSRRKNLRNLRELLEMSLSLPEYTCEPA

SEQ ID NO: 230779 - protein, 166 aa, Glycine max
  Coding DNA Sequence Number=SeqID_114001
  Pfam annotation: Domain name=zf-CCHC; Domain location=95-112; Score =22.7; E_value=0.00018; Accession=PF00098.13; Description=Zinc knuckle
MSFATLFGKLQEHEMELMRLHQHEENDIKRKGITLRASSSSIQEETDKEDLTKIEEDDGFRFFVKRFNKLLRNKRNKRKSNINPKKKEEDSSLAPKCYECDQPEHIRFDCPVFKRRMKKSNKRNFKEKKAYITWEDNDINSSSDSENKIINLGLMLKDYESGEGQS

SEQ ID NO: 230780 - protein, 220 aa, Glycine max
  Coding DNA Sequence Number=SeqID_114002
  Gene Ontology: Mol. function=oxidoreductase activity; Cellular component=cytoplasm; Biological process=metabolic process
  Homolog annotation: Hit_ID=Q8ABI0; Match level="QueryCoverage=99%, HitCoverage=81%, E-value=7e-79, Identity=65%"; Hit description =Putative oxidoreductase
  Pfam annotation: Domain name=KR; Domain location=11-193; Score=-54.4; E_value=0.00034; Accession=PF08659.1; Description=KR domain
  Pfam annotation: Domain name=adh_short; Domain location=10-184; Score= 88.6; E_value=1.9e-23; Accession=PF00106.15; Description=short chain dehydrogenase
  Pfam module annotation: Pfam domain module=KR::adh_short; Domain location=11-193::10-184
MKDLFSIKNKVAVITGASGVLGGSLAKSFIEAGAKVVALGRNQETLDARVKELTDLGGDAFAVEANVMDIKSLEAAAEKIKEKYGSIDVLLNIAGGNIPSATLSPEQSFFDMDMKGWAEVTDLNINGTVYPSYVFGKAMAEQGSGNIINISSMAAYSAITRVAGYSAAKSAITNFTQWLASDLALKFGDKIRVNAVAPGFFIGDQNRAILLNPDGSLTER

SEQ ID NO: 230781 - protein, 79 aa, Glycine max
  Coding DNA Sequence Number=SeqID_114003
MTPQPSCMKFFRSYEASTPILLNALIPWMIVSMPLMLALKEWIPASLSLRRMGRETGIRSGAKKSRDHKLQNIGGVWDK

SEQ ID NO: 230782 - protein, 151 aa, Glycine max
  Coding DNA Sequence Number=SeqID_114004
MAYLEPYLEVESGAGVAGDVEHLESDSANDVSVDKNHDSEQRVLWHGAAEVAVQVTGERRQGVHDGGRRRSTKKLEGATSRPRGVSGREAIGLQIELVACEGATSKPLTTIGMLWSSISRSQETFGFCLKREVQWTELRSKDETVECRPEK

SEQ ID NO: 230783 - protein, 43 aa, Glycine max
  Coding DNA Sequence Number=SeqID_114005
MENGNSREEGKTVRGTKNGLSKTMISTSQEWIAQNQMQRHQAH

SEQ ID NO: 230784 - protein, 179 aa, Glycine max
  Coding DNA Sequence Number=SeqID_114006
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=85%, HitCoverage=31%, E-value=2e-69, Identity=94%"; Hit description=NADH -plastoquinone oxidoreductase subunit 2
  Pfam annotation: Domain name=Oxidored_q1; Domain location=23-179; Score=-113.1; E_value=0.044; Accession=PF00361.10; Description=NADH -Ubiquinoneplastoquinone (comple
MAITEFLLFILTATLGGMFLCGANDLITIFVALECFSLCSYLLSGYTKKDVRSNEATTKYLLMGGASSSILVHGFSWLYGSSGGRDRASRNSERSYQYTNELGSSFPQPLLINGLLTYTKECGSFDKFLSLYLFLRCLDFSKLHGHAEEKCYSHSDQDITLLVQITIKVKQSQEQRIPL

SEQ ID NO: 230785 - protein, 110 aa, Glycine max
  Coding DNA Sequence Number=SeqID_114007
  Subcellular localization annotation: CTP_CleavageSite=31; ConfidenceScore=5.56e-01
MALITSWSILCQAKSRKFCIVILSSPKRNVRKANMTSLQNKPRMFHLFSRTNEKNSIARRYISLGFSGQQIEVGGLFATSSVSLLDSVDVILQILRYDLIEIRADEDIFR

SEQ ID NO: 230786 - protein, 116 aa, Glycine max
  Coding DNA Sequence Number=SeqID_114008
MAKMILMQADQTVNFKLMMVQPMACPWWQGGKNGIYLIYIKIATTTTTISAATTTIIVAMTIVVATNLIVVAATGRGDSHVGGNDGGHGGDHSSGGSGSGDDDGDNSHVGGGGDDS

SEQ ID NO: 230787 - protein, 240 aa, Glycine max
  Coding DNA Sequence Number=SeqID_114009
  Gene Ontology: Cellular component=outer membrane
  Homolog annotation: Hit_ID=Q1XP69; Match level="QueryCoverage=93%, HitCoverage=29%, E-value=4e-55, Identity=47%"; Hit description =Surface antigen (D15) precursor
MGNTFKIYLTSLCASGFAAISLSCSNTKFLKEGQMLYTGGEVKIENDTISKKEKKELQAALEENLVPKPNSTILGLRPRLYFYNIAKEPKKEKGFNYWLKYKVGEKPVLLGDVDREFNKDIIVNYSENKGYFNAKATYDTISKNKKAKVIYTLRPGAQYLISNVKFQKDSTLVNREIQNLKDKSLLKNGNPFDLGVIKSERDRIDNGLKEKGFYYFHPDNIIVQADSTVAKNHKVELNVN

SEQ ID NO: 230788 - protein, 302 aa, Glycine max
  Coding DNA Sequence Number=SeqID_114010
  Gene Ontology: Mol. function=ferredoxin-NAD+ reductase activity; Cellular component=cytoplasm; Biological process=cell redox homeostasis
  Homolog annotation: Hit_ID=Q1I8Y5; Match level="QueryCoverage=99%, HitCoverage=58%, E-value=1e-66, Identity=43%"; Hit description =Putative ferredoxin reductase component
  Pfam annotation: Domain name=Pyr_redox; Domain location=232-301; Score=8.4; E_value=0.0031; Accession=PF00070.17; Description =Pyridine nucleotide-disulphide oxidor
  Pfam annotation: Domain name=Pyr_redox_2; Domain location=92-264; Score=38.2; E_value=2.9e-08; Accession=PF07992.4; Description =Pyridine nucleotide-disulphide oxidor
  Pfam annotation: Domain name=Rieske; Domain location=1-69; Score=7.0; E_value=0.00063; Accession=PF00355.16; Description=Rieske [2Fe-2S] domain
  Pfam module annotation: Pfam domain module=Pyr_redox::Pyr_redox _2::Rieske; Domain location=232-301::92-264::1-69
MVLIRDGDRVQALQAKCPHAGAPLEQGALCGDKLVCPWHKAVFELRDGKMCEPLALANLKRYPVRIEQGQVLINPQAMSPASAPVAQGEAPVCVILGSGAAGSAAIWTLRDEGFSGRIVRIERESDAPYDRTTLSKFVPSGKMAIDEVPRLLKQDVLGPVVWLQGEVVQLKAQEQTLVLKDGQQVKFDQLLIATGGVPQPLDIPGKDLDGVHLLRSLRQADTLISRVDEAQQLVIIGNSFIGMEVAGALRNRDIDVTVVARHPLPFASQFGEEIGRHFYELHRSNGVKFVEGEPEALSGEGA

SEQ ID NO: 230789 - protein, 34 aa, Glycine max
  Coding DNA Sequence Number=SeqID_114011
MNKVPNLMDKETNSFGTNQSELCKNSGKSSVKFY

SEQ ID NO: 230790 - protein, 80 aa, Glycine max
  Coding DNA Sequence Number=SeqID_114012
MATADALERETKKAQKEEHVPAKAIIDKCKEKLNLAATHEQRLEDEYARIFSRKGSKGKGNLIHCIKRQQCGRTDCSYFE

SEQ ID NO: 230791 - protein, 151 aa, Glycine max
  Coding DNA Sequence Number=SeqID_114013
LELPRSEFLITNGGYAGAKAPLLSTTPPFAFMTCESGVMRRHPMVICPHIVAIQGPQVRLTSGDQMWSSAPFPEMSTSSGRDFLVSLTTSVNPDPQVAGEYIQVIIRTKTTSVDLDPCVMWQADVPQVIIRTKTTSVDPDSCVRWQADIPK

SEQ ID NO: 230792 - protein, 76 aa, Glycine max
  Coding DNA Sequence Number=SeqID_114014
MGWCIDLVGRPLCGKLKWLKNLSISEGMLRSFNSSMVIVHDGGVSPGRELLEALDTLRAIFLVLDTLCTALHLRVE

SEQ ID NO: 230793 - protein, 134 aa, Glycine max
  Coding DNA Sequence Number=SeqID_114015
  Gene Ontology: Mol. function=protein binding
  Homolog annotation: Hit_ID=Q2HVB4; Match level="QueryCoverage=65%, HitCoverage=20%, E-value=4e-33, Identity=80%"; Hit description =BTB/POZ; MATH
MAKLLAAGEKYGLPRLMLMCESVLCKDISVDSVAYIFALADRYRATHLKSICQKFSAENFDAMMHSDGFEYLKKNCPLLQSELLKTGVGCFTSATTGYNAAASGMSMVARWEKWDMYENVRYREERKDIREPRT

SEQ ID NO: 230794 - protein, 98 aa, Glycine max
  Coding DNA Sequence Number=SeqID_114016
MAKYRLKAQVEKDEGPSREGQSPRVEKDEGPSSLFNESQTYQDNPCGVYPDLSSFTGSGVIQNLRSLYQTFRPMRFTSSGIRASVLDIGSILSYYFSL

SEQ ID NO: 230795 - protein, 87 aa, Glycine max
  Coding DNA Sequence Number=SeqID_114017
MFGEGTDRENNKKPYFPVTEGSALDNGGHMNSARQSIHGAPNRTVEDTRTALVLGNQFVGLQTRWCGRMNSARQSIRGAPYSMVEDA

SEQ ID NO: 230796 - protein, 253 aa, Glycine max
  Coding DNA Sequence Number=SeqID_114018
  Homolog annotation: Hit_ID=Q1SN44; Match level="QueryCoverage=62%, HitCoverage=28%, E-value=4e-09, Identity=24%"; Hit description =Nucleic acid-binding, OB-fold
MLFRMSRSGRWIDVNPELEHLLANAPKPEEQMEWKELARKIQDTTAPPEAIFMTASARDQIFEEVGKIYAIKFKDVRGSLWHLVDRDDTYHTIVYNQDLDQPDIVAGWTTLCQFYPLIEDHLVLLQHYGKSVFFIEIFRVPCLLKSFPKCHSLYHQVPGLVTFKVFLTKKKISCSSLDVPSAMYYFLKDKGWYNLHLENIAECRLVFNHYRKSLKIGARWKQLCETLSLAAGTKIVFEFINPRINRVLYWLYL

SEQ ID NO: 230797 - protein, 206 aa, Glycine max
  Coding DNA Sequence Number=SeqID_114019
  Gene Ontology: Mol. function=monooxygenase activity; Cellular component=membrane; Biological process=aromatic compound metabolic process
  Homolog annotation: Hit_ID=Q9I1K8; Match level="QueryCoverage=87%, HitCoverage=30%, E-value=1e-49, Identity=50%"; Hit description =Gluconate dehydrogenase
ATGTPIGTALPKGTPSWGMGYKEGLEQWYNHSMKISITTTCQSYRDIYLDLDPHYTDHRGQPLLRMTFNWKQNELKLQQHLKGIVGDIAKELNPDSMSMSFLPMGADFDLTKYVSTHNVGGAVMGDNPKTSALNKYLQSWDVHNVFVPGGNAFPQNFQANPTDTIGAITLMAAQAIKEHYLQNPGPLAADDASLIKKGEYLARLGD

SEQ ID NO: 230798 - protein, 205 aa, Glycine max
  Coding DNA Sequence Number=SeqID_114020
MRKKVFPLDHMEETSSADTHGRIIFHQTQTKCLSRAEEAYGHAEEVRLQPHAKNSSQMSSNLRPAYAIQREMRDQVVNVFKELQEILIKFLTLLIALISVTNTESGKLLFTEQHKLMMSLILTIVLYFLFASIGTILQIYKGNFLQLVIWVMLIVGGVVSVLSLSFISATVAWITLAMWVGIFAVVAYDYGVPQRIINWIKGPSS

SEQ ID NO: 230799 - protein, 158 aa, Glycine max
  Coding DNA Sequence Number=SeqID_114021
AALGAPEDGIMTTKLLERLYLEIRNKDTSSATHMKSPSFGDSHFSFSTATHSPLAFSAMAKVFVKGSVHQNGVVVITLDHLKAFSAMAEEFVKGSVHQNGVAVITLDRPKAFSIMAEEFVEGSVHQNNVAVMTLDRPKVTERAVKTWQAALGAPEDGI

SEQ ID NO: 230800 - protein, 84 aa, Glycine max
  Coding DNA Sequence Number=SeqID_114022
MMIWKQRAKLVMATARWVLKHPIYGIVILRLGIYTKYKSGDPTVMWLRMPPDSWVTVTKGGVVYKSQGFCSYVSSICDEELRPT

SEQ ID NO: 230801 - protein, 118 aa, Glycine max
  Coding DNA Sequence Number=SeqID_114023
PFELATGQQPLTPHTIAAGGGLPISLLFCQDVAGAQRPSPNLLKLKAWPGLKEEESRPCREVDRRDQTDPERNVPSPRGHHQMLANLRARQAGNGQKLTILRPSQRLLDVSQSDSQRG

SEQ ID NO: 230802 - protein, 248 aa, Glycine max
  Coding DNA Sequence Number=SeqID_114024
  Homolog annotation: Hit_ID=Q1SKD7; Match level="QueryCoverage=39%, HitCoverage=26%, E-value=3e-08, Identity=33%"; Hit description =Ankyrin
MAPKKLFTKRSRRDAAAEGSSAAPEFDSHRFRSTEHQQRFEAIRGWSFHRERRVQLREDEYTNFQKEIAHRRWTPLVTPMAKFDPEIVLDFYANAWPTEEGMRHMHSWVRGRPVVRVQPEEEQGRRVRRGGHCPAVMHTTGRRVRIMRTSSVLPSNHNSDLPLPKCQLVYAILTRMSVHVAQVIVDAIYLFAGMPPTRHPRDYLIITRTFRQPGANEPVDAKRLTSSEVAGGDTLWSSAPFVNRGERL

SEQ ID NO: 230803 - protein, 139 aa, Glycine max
  Coding DNA Sequence Number=SeqID_114025
GVRKKAQAIQKQNIAPHVLSRGGYEYLEQKLMTEKTKKRLEEAAQSESTEGVIDTPSPIGCHMKWKMACTKKIGQMTSKATKNIAEKIDSLEEQASQGWFVPHGCQDVLTAVIGRPEHPGRVRAARAGVTIKQYFGSAP

SEQ ID NO: 230804 - protein, 117 aa, Glycine max
  Coding DNA Sequence Number=SeqID_114026
  Gene Ontology: Mol. function=S-adenosylmethionine-dependent methyltransferase activity; Biological process=chemotaxis
  Homolog annotation: Hit_ID=Q6D6I8; Match level="QueryCoverage=91%, HitCoverage=44%, E-value=9e-47, Identity=72%"; Hit description =Chemotaxis protein methyltransferase
  Pfam annotation: Domain name=CheR_N; Domain location=8-59; Score =23.2; E_value=0.00092; Accession=PF03705.6; Description=CheR methyltransferase, all-alpha domain
MVQRLPLSDTHFRRISQLIYQRAGIVLADHKREMVYNRLDPNSAEWQAFINALTTNLTSFFREAHHFPILAEHARKRSGNYSVWSTAASTGEEPYSIAMTLAETRGHRTREIFRPRQ

SEQ ID NO: 230805 - protein, 185 aa, Glycine max; identical to SEQ ID NO: 213459
  Coding DNA Sequence Number=SeqID_114027
  Gene Ontology: Mol. function=transmembrane receptor activity; Cellular component=membrane; Biological process=signal transduction
  Homolog annotation: Hit_ID=Q5PM58; Match level="QueryCoverage=87%, HitCoverage=28%, E-value=3e-39, Identity=61%"; Hit description =Methyl-accepting chemotaxis protein I, serine sensor receptor
  Pfam annotation: Domain name=MCPsignal; Domain location=1-144; Score =145.9; E_value=1.1e-40; Accession=PF00015.11; Description=Methyl -accepting chemotaxis protein (MCP) signaling domain

SEQ ID NO: 230806 - protein, 68 aa, Glycine max
  Coding DNA Sequence Number=SeqID_114028
MTFNAVLDPNSESLWWSTLLQESEIAQTEQSRCDRKWLWQAIGLAGCGGKPAVRVERVQVKQNRTIDR

SEQ ID NO: 230807 - protein, 58 aa, Glycine max
  Coding DNA Sequence Number=SeqID_114029
MRETITKLNAKLLEKTNKEMILESIMSAPSPLTTLADGTDHHVDDAQVDCPHYMSKDH

SEQ ID NO: 230808 - protein, 70 aa, Glycine max
  Coding DNA Sequence Number=SeqID_114030
MADTTVGWRTPMSVWVEVLVGGGTKDMNEKGHRFPIHPNPKEKMGRGTRRFTRVEHERVQGRFVSFHGNI

SEQ ID NO: 230809 - protein, 123 aa, Glycine max
  Coding DNA Sequence Number=SeqID_114031
MWYHGRAKGYPSSDLIGLVVSKNGVHWESGGGPARSSSDVGFVISCGNDWWGFDTGGIRPSEMTSTVEVEAYPTLDELTSELSTLNLERVRQIKSRLVTLSGCVQKLILNVDGTENSLNNEER

SEQ ID NO: 230810 - protein, 127 aa, Glycine max
  Coding DNA Sequence Number=SeqID_114032
  Subcellular localization annotation: CTP_CleavageSite=22; ConfidenceScore=5.01e-01
MASPPASPPPPSPPPPAPSDASASLPPDAERPVVHVDPTTDKANDPHRKKLRTYLGIVVRDKDDVTYENWKEVPTAQKDLIWEDIQEEFEILEAFDSRTKRKLLQIVGKRWRQFKSDLMRKWALAAD

SEQ ID NO: 230811 - protein, 92 aa, Glycine max
  Coding DNA Sequence Number=SeqID_114033
MIIDAHEGEEHCCGKGTNARSVSFLPRSQEKIGDSAKVVIKQDMKGGEHKYGFNNNKREKPEKVRVVDDETGDKHELYEVLRMPSRCVFFKI

SEQ ID NO: 230812 - protein, 99 aa, Glycine max
  Coding DNA Sequence Number=SeqID_114034
MVGIDVIREPTSQGEILFRICKTDGTEEGLRFLKILRPSTMDTTGYLPRLNGFMCKEHSKVNLNSQIDATLGIVSHNDDFQGGVGPKFRVSLVEHAVAV

SEQ ID NO: 230813 - protein, 101 aa, Glycine max
  Coding DNA Sequence Number=SeqID_114035
  Gene Ontology: Mol. function=methionyl aminopeptidase activity; Biological process=proteolysis
  Homolog annotation: Hit_ID=A0EVX1; Match level="QueryCoverage=57%, HitCoverage=14%, E-value=4e-22, Identity=89%"; Hit description=Cold -induced cell cycle-related nuclear protein
MRKFQFLLPPVDKKAPILLPSFLDTVIPNRLTSSQGLKSCATMSDDEREEKELDLSSAEVVTKYKISVEIVNKALKLVISESKPKAKIVDICEKGDSYIRE

SEQ ID NO: 230814 - protein, 93 aa, Glycine max
  Coding DNA Sequence Number=SeqID_114036
MFNITEKNIDVAVANNNTTTTTKVGFEGVKWNNHNLEKKHSNLNGEEHMTKQMEAEEEEDREVDEGEGEQARCRQPSRTLFTNLSQVDAKLLD

SEQ ID NO: 230815 - protein, 106 aa, Glycine max
  Coding DNA Sequence Number=SeqID_114037
  Gene Ontology: Mol. function=3-dehydroquinate synthase activity; Biological process=aromatic amino acid family biosynthetic process, shikimate pathway
  Homolog annotation: Hit_ID=Q6CZQ9; Match level="QueryCoverage=96%, HitCoverage=28%, E-value=7e-33, Identity=67%"; Hit description=3 -dehydroquinate synthase
MGYGNWLHGEAVAAGMVMAARTAERLGQFSAADTDRIIALLQRAGLPVNGPASMTAEAYLPHMMRDKKVLGGELRLVLPLAIGRSEVRGGVAHDMVLAAINDCKVS

SEQ ID NO: 230816 - protein, 189 aa, Glycine max
  Coding DNA Sequence Number=SeqID_114038
  Gene Ontology: Cellular component=integral to membrane; Biological process=cell division
  Homolog annotation: Hit_ID=Q6CZR0; Match level="QueryCoverage=100%, HitCoverage=55%, E-value=3e-31, Identity=42%"; Hit description=DamX protein
MDEFKPEDELKPDASDRRPTRPRKSSSAPKAKVPVSRQHMMMGIGILVLLILVLGIGSALTGPDEKKPASNSASTGSAAPAGGGSEKNIDLSGSTAMSGQQNATPSAEGSAPQNTAGNAAPASSDGQSISMPSVSSTPTQAAPVDTPANQQRVTLPGDLNTALNNQQGSVDAAAQGAQGNSSLPTAPAT

SEQ ID NO: 230817 - protein, 1203 aa, Glycine max
  Coding DNA Sequence Number=SeqID_114039
  Gene Ontology: Mol. function=protein-tyrosine kinase activity; Cellular component=integral to membrane; Biological process=protein amino acid phosphorylation
  Homolog annotation: Hit_ID=Q1RXR7; Match level="QueryCoverage=95%, HitCoverage=95%, E-value=0.0, Identity=54%"; Hit description =Tyrosine protein kinase, active site
  Pfam annotation: Domain name=LRRNT_2; Domain location=33-72; Score =46.2; E_value=1.1e-10; Accession=PF08263.3; Description=Leucine rich repeat N-terminal domain
  Pfam annotation: Domain name=LRR_1; Domain location=101-123; Score =13.9; E_value=0.6; Accession=PF00560.23; Description=Leucine Rich Repeat
  Pfam annotation: Domain name=LRR_1; Domain location=125-147; Score =14.0; E_value=0.54; Accession=PF00560.23; Description=Leucine Rich Repeat
  Pfam annotation: Domain name=LRR_1; Domain location=149-171; Score =15.0; E_value=0.28; Accession=PF00560.23; Description=Leucine Rich Repeat
  Pfam annotation: Domain name=LRR_1; Domain location=173-195; Score =13.3; E_value=0.86; Accession=PF00560.23; Description=Leucine Rich Repeat
  Pfam annotation: Domain name=LRR_1; Domain location=197-219; Score =12.9; E_value=1.1; Accession=PF00560.23; Description=Leucine Rich Repeat
  Pfam annotation: Domain name=LRR_1; Domain location=221-243; Score =12.2; E_value=1.5; Accession=PF00560.23; Description=Leucine Rich Repeat
  Pfam annotation: Domain name=LRR_1; Domain location=244-266; Score =15.2; E_value=0.25; Accession=PF00560.23; Description=Leucine Rich Repeat
  Pfam annotation: Domain name=LRR_1; Domain location=268-290; Score =6.9; E_value=15; Accession=PF00560.23; Description=Leucine Rich Repeat
  Pfam annotation: Domain name=LRR_1; Domain location=292-314; Score =14.8; E_value=0.32; Accession=PF00560.23; Description=Leucine Rich Repeat
  Pfam annotation: Domain name=LRR_1; Domain location=316-338; Score =8.7; E_value=6.8; Accession=PF00560.23; Description=Leucine Rich Repeat
  Pfam annotation: Domain name=LRR_1; Domain location=340-362; Score =18.9; E_value=0.018; Accession=PF00560.23; Description=Leucine Rich Repeat
  Pfam annotation: Domain name=LRR_1; Domain location=364-386; Score =12.6; E_value=1.3; Accession=PF00560.23; Description=Leucine Rich Repeat
  Pfam annotation: Domain name=LRR_1; Domain location=388-410; Score =12.4; E_value=1.4; Accession=PF00560.23; Description=Leucine Rich Repeat
  Pfam annotation: Domain name=LRR_1; Domain location=412-434; Score =16.0; E_value=0.13; Accession=PF00560.23; Description=Leucine Rich Repeat
  Pfam annotation: Domain name=LRR_1; Domain location=436-458; Score =9.7; E_value=4.4; Accession=PF00560.23; Description=Leucine Rich Repeat
  Pfam annotation: Domain name=LRR_1; Domain location=460-482; Score =14.5; E_value=0.38; Accession=PF00560.23; Description=Leucine Rich Repeat
  Pfam annotation: Domain name=LRR_1; Domain location=484-506; Score =11.9; E_value=1.7; Accession=PF00560.23; Description=Leucine Rich Repeat
  Pfam annotation: Domain name=LRR_1; Domain location=508-530; Score =4.7; E_value=37; Accession=PF00560.23; Description=Leucine Rich Repeat
  Pfam annotation: Domain name=LRR_1; Domain location=532-551; Score =3.4; E_value=67; Accession=PF00560.23; Description=Leucine Rich Repeat
  Pfam annotation: Domain name=LRR_1; Domain location=556-578; Score =8.1; E_value=8.8; Accession=PF00560.23; Description=Leucine Rich Repeat
  Pfam annotation: Domain name=LRR_1; Domain location=580-602; Score =10.6; E_value=3; Accession=PF00560.23; Description=Leucine Rich Repeat
  Pfam annotation: Domain name=LRR_1; Domain location=604-626; Score =10.2; E_value=3.6; Accession=PF00560.23; Description=Leucine Rich Repeat
  Pfam annotation: Domain name=LRR_1; Domain location=628-650; Score =16.1; E_value=0.12; Accession=PF00560.23; Description=Leucine Rich Repeat
  Pfam annotation: Domain name=LRR_1; Domain location=652-674; Score =18.4; E_value=0.026; Accession=PF00560.23; Description=Leucine Rich Repeat
  Pfam annotation: Domain name=LRR_1; Domain location=675-697; Score =10.3; E_value=3.3; Accession=PF00560.23; Description=Leucine Rich Repeat
  Pfam annotation: Domain name=LRR_1; Domain location=699-721; Score =16.6; E_value=0.089; Accession=PF00560.23; Description=Leucine Rich Repeat
  Pfam annotation: Domain name=LRR_1; Domain location=723-745; Score =7.8; E_value=9.9; Accession=PF00560.23; Description=Leucine Rich Repeat
  Pfam annotation: Domain name=LRR_1; Domain location=747-769; Score =15.5; E_value=0.19; Accession=PF00560.23; Description=Leucine Rich Repeat
  Pfam annotation: Domain name=LRR_1; Domain location=771-792; Score =19.1; E_value=0.016; Accession=PF00560.23; Description=Leucine Rich Repeat
  Pfam annotation: Domain name=LRR_1; Domain location=794-816; Score =11.6; E_value=1.9; Accession=PF00560.23; Description=Leucine Rich Repeat
  Pfam annotation: Domain name=Pkinase; Domain location=920-1194; Score= 152.4; E_value=1.2e-42; Accession=PF00069.15; Description=Protein kinase domain
  Pfam annotation: Domain name=Pkinase_Tyr; Domain location=920-1194; Score=85.1; E_value=2.1e-22; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR_1::LRR_1::LRR_ 1::LRR_1::...
  Pfam module annotation: Pfam domain module=LRR_1::LRR_1::LRR_1::LRR _1::LRR_1::LRR_1::Pkinase::Pkinase_Tyr; Domain location=33-72::101 -123::125-147::149-171::173-195::197-219::221-243::244-266::268 -290::292-314::316-338::...
  Pfam module annotation: Domain location=340-362::364-386::388 -410::412-434::436-458::460-482::484-506::508-530::532-551::556 -578::580-602::604-626::628-650::652-674::675-697::699-721::723 -745::747-769::771-792::794-816::920-1194::920-1194
MVFIFPTLLSMKLQPLLLLLVMYFCAFAASSEIASEANALLKWKSSLDNQSHASLSSWSGNNPCIWLGIACDEFNSVSNINLTYVGLRGTLQSLNFSLLPNILTLNMSHNSLNGTIPPQIGSLSNLNTLDLSTNNLFGSIPNTIGNLSKLLFLNLSDNDLSGTIPSEIVHLVGLHTLRIGDNNFTGSLPQEIGRLMNLRILDIPRSNISGTIPISIEKLCNLSHLDVESNDLSGNIPLRIWHMNLKHLSFAGNNFNGSIPEEIVNLRSIETLWLWKSGLSGSIPKEIWMLRNLTWLDMSQSSFSGSIPRDIGKLRNLKILRMSKSGLSGYMPEEIGKLVNLQILDLGYNNLSGFIPPEIGFLKQLGQLDLSDNFLSGEIPSTIGNLSNLYYLYLYKNSLYGSIPDGVGNLHSLSTIQLSGNSLSGAIPASIGNLAHLDTLFLDVNELSGSIPFTIGNLSKLNELYINSNELTGSIPFTIGNLSKLSALSISLNELTGSIPSTIRNLSNVRQLSVFGNELGGKIPIEMSMLTALEGLHLDDNDFIGHLPQNICIGGTLQNFTAGNNNFIGPIPVSLKNCSSLIRVRLQRNQLTGDITDAFGVLPNLDYIELSDNNFYGQLSPNWGKFRSLTSLKISNNNLSGVIPPELAGATKLELLHLSSNHLTGNIPQDLCNLTLFDLSLNNNNLTGNVPKEIASMQKLRTLKLGSNNLSGLIPKQLGNLLYLLDMSLSQNKFQGNIPSELGKLKFLTSLDLSGNSLRGTIPSTFGELKSLETLNLSHNNLSGDLSSFDDMISLTSIDISYNQFEGPLPKTVAFNNAKIEALRNNKGLCGNVTGLERCPTSSGKSHNHMRKKVITVILPITLGILIMALFVFGVSYYLCQASTKKEEQATNLQTPNIFAIWSFDGKMIFENIIEATENFDSKHLIGVGGQGCVYKAVLPTGLVVAVKKLHSVPNGEMLNQKAFTSEIQALTEIRHRNIVKLYGFCSHSQFSFLVCEFLEKGSVEKILKDDDQAVAFDWNKRVNVVKCVANALFYMHHDCSPPIVHRDISSKNVLLDSEYVAHVSDFGTAKFLNPDSSNRTSFVGTFGYAAPELAYTMEVNEKCDVYSFGVLAWEILIGKHPGDVISCLLGSSPSTLVASTLDHMALMDKLDPRLPHPTKPIGKEVASIAKIAMACLTESPRSRPTMEQVANELEMSSSSLMD

SEQ ID NO: 230818 - protein, 200 aa, Glycine max
  Coding DNA Sequence Number=SeqID_114040
  Gene Ontology: Mol. function=protein phosphatase type 2C activity; Cellular component=protein serine/threonine phosphatase complex; Biological process=protein amino acid dephosphorylation
  Homolog annotation: Hit_ID=Q9LUS8; Match level="QueryCoverage=92%, HitCoverage=37%, E-value=3e-74, Identity=72%"; Hit description =Similarity to protein phosphatase-2c
VLATCITDNSLNANERLKAIQLTESHTVDNEAERARLLADHPDDPKTIVAGKVKGKLKVTRALGVGYLKKKILNDALMGILRVRDLKSPPYVSTDPSLNVHKISDSDQFVIVGSDGLFDFFSNDEAVQLVESYILRNPFGDPAKFLIEQLVARAADSAGFSMEELMNVPDGRRRKYHDDVTVMVIILGMNQRTSKASICL

SEQ ID NO: 230819 - protein, 293 aa, Glycine max
  Coding DNA Sequence Number=SeqID_114041
  Gene Ontology: Mol. function=protein phosphatase type 2C activity
  Homolog annotation: Hit_ID=Q9LUS8; Match level="QueryCoverage=95%, HitCoverage=53%, E-value=2e-40, Identity=40%"; Hit description =Similarity to protein phosphatase-2c
MNFLNQEMSMLSPEGELKISFGYQCNSDRAISCNEIQRTSSFSWLSGAALSANATLANTNICNGVIGEEILPSLDSPKSFRRVPSSPSFPKLDMLSSSVNSSLSNLSCSPSTPSNMLEYDPFTLRSISAPSRSEGFLNGMEVQVAGGAAGEDRVQAVCSEEDGWLFCAIYDGFNGRDAADFLAGTLYDSIISYFNMLYWDLEPDSLKASNNESMGGSFQYNFNDSLNLQERQSLSKIKGNNSSLDCFANNIPHSKSKASPKSFSQTTVLDGLQHVLSQAENDFLYMVEQEMEE

SEQ ID NO: 230820 - protein, 116 aa, Glycine max
  Coding DNA Sequence Number=SeqID_114042
  Homolog annotation: Hit_ID=Q1SMK1; Match level="QueryCoverage=88%, HitCoverage=6%, E-value=4e-26, Identity=56%"; Hit description =Integrase, catalytic region; Peptidase aspartic, active site; Ribonuclease H
MVVRAFDGTRQEVRGEIDLPVQIGPHTCQVTFQIMDINPTYNCLLGRPWIHSVGVVPSTLHQKLKFVVEGHLVIVSGEEDILCRGKKPRVSRTSGFEVKSFQGGGDDAILPPKGIG

SEQ ID NO: 230821 - protein, 189 aa, Glycine max
  Coding DNA Sequence Number=SeqID_114043
  Gene Ontology: Mol. function=nucleic acid binding; Cellular component= signal recognition particle, endoplasmic reticulum targeting; Biological process=SRP-dependent cotranslational protein targeting to membrane
MTHGDPPVEYWNDLKSALRKRHIPSYYKRELMDKLQRLGQGSMSVEESRKQTELLLLRAGLREEEKTSIARFLSGLNMEVKDKVELVPYRNLDVLVQLYIRVEQQLKRKATSKSYGSHSYPKKDKGQGILGAATSKKKDDKGKNRKGKEEQSLMVKEQCKETISASSPCKGTLVSTAIPLKLEVIPQVF

SEQ ID NO: 230822 - protein, 296 aa, Glycine max
  Coding DNA Sequence Number=SeqID_114044
MKEDSSKSTPSDHQPYDQGNPTHQDEPKDDEFKFDLTSKWALAVGKVGVDDTVCEKYEINKEKWNQFCQSRRDPSWEDLRKKARPFRNKTLPLTCCLMMKMVRTKKTGQMTLETVKEIADKIASHGSFVAHGHQDVLTSAIGQLEHPSRVHAAEVGVTINNTLDRLQSPPGLALLPKPEIGPSTARVSTKESCVGPSGHNPKMDANARIPVPSEEVQLVGQTLNTFLAWPTHLVRCFSEHDKQGAERPEEPIDKLDPDVDPLYLLTLTIPQLFLKPLQVMWDAIVFGVHNENFPCT

SEQ ID NO: 230823 - protein, 239 aa, Glycine max
  Coding DNA Sequence Number=SeqID_114045
  Gene Ontology: Cellular component=extracellular region; Biological process=cellulose and pectin-containing cell wall organization and biogenesis
  Homolog annotation: Hit_ID=Q8LKJ9; Match level="QueryCoverage=99%, HitCoverage=100%, E-value=1e-102, Identity=68%"; Hit description =Alpha-expansin precursor
  Pfam annotation: Domain name=DPBB_1; Domain location=51-134; Score =89.0; E_value=1.4e-23; Accession=PF03330.8; Description=Rare lipoprotein A (RlpA)-like double
  Pfam annotation: Domain name=Pollen_allerg_1; Domain location=145 -223; Score=141.3; E_value=2.6e-39; Accession=PF01357.11; Description= Pollen allergen
  Pfam module annotation: Pfam domain module=DPBB_1::Pollen_allerg_1; Domain location=51-134::145-223
MGPLVISSRFLWYFCFVLSAVRVVHVQANNGWLNAHATFYGANQNPTTLGGACGYDDTFHAGFGVNTAAVMCDYRADPKWCLISRGVTVTATNFCPPNNHGGWCDPPYHHFDMSMPAFFRIARQGNEGIVPVLYRRVACKRRGGVRFTLKGQSNFNMVMISNVGGSGDVKVVWIRGSRSGAWLPMHRNWGANWQSSADLRNQRLSFKMTLVDGKTLVFLNVVPSTWRFGQTFSSKSQFF

SEQ ID NO: 230824 - protein, 167 aa, Glycine max
  Coding DNA Sequence Number=SeqID_114046
  Gene Ontology: Mol. function=receptor activity; Cellular component =integral to membrane
  Homolog annotation: Hit_ID=Q6A151; Match level="QueryCoverage=88%, HitCoverage=76%, E-value=1e-35, Identity=47%"; Hit description =Peripheral-type benzodiazepine receptor
  Pfam annotation: Domain name=TspO_MBR; Domain location=18-166; Score=- 18.2; E_value=0.0001; Accession=PF03073.6; Description=TspOMBR family
MASQTLHDTKKSQARRALRSLAIGIAVPFTLTLTIIILFGSGRKYNQIISKPFWFAPLWFIHLSILGSSFFMGLAAWLVWADGGFQGETDAMSLYIAHVSLSIVWHPLVLVMGAYWLALISCLVNFVTLFLCYLRFRKVNPFAKDLAKPCLAWAAYLCLVSFKLIFI

SEQ ID NO: 230825 - protein, 68 aa, Glycine max
  Coding DNA Sequence Number=SeqID_114047
  Gene Ontology: Mol. function=transferase activity, transferring hexosyl groups; Cellular component=integral to membrane
  Homolog annotation: Hit_ID=Q5TIN5; Match level="QueryCoverage=82%, HitCoverage=12%, E-value=1e-10, Identity=59%"; Hit description=Alpha- 1,6-xylosyltransferase
DAAGAGGGEVVTDLIEVLLRRAELAGADGAAEDDQREEEAEEGHGAVAAGAMNLPDAPCSKAALQHCC

SEQ ID NO: 230826 - protein, 40 aa, Glycine max
  Coding DNA Sequence Number=SeqID_114048
MGCLALHDYEGLNYTKKFKVPTAQKFRKCLNSNVSHKKKE

SEQ ID NO: 230827 - protein, 694 aa, Glycine max
  Coding DNA Sequence Number=SeqID_114049
  Gene Ontology: Mol. function=binding; Cellular component=thylakoid; Biological process=photosynthesis
  Homolog annotation: Hit_ID=Q1T1X0; Match level="QueryCoverage=53%, HitCoverage=64%, E-value=1e-113, Identity=55%"; Hit description=IMP dehydrogenase/GMP reductase
  Pfam annotation: Domain name=TPR_1; Domain location=229-262; Score =29.4; E_value=1.2e-05; Accession=PF00515.18; Description =Tetratricopeptide repeat
  Pfam annotation: Domain name=TPR_1; Domain location=263-296; Score =23.1; E_value=0.001; Accession=PF00515.18; Description =Tetratricopeptide repeat
  Pfam annotation: Domain name=TPR_1; Domain location=297-330; Score =7.0; E_value=0.78; Accession=PF00515.18; Description=Tetratricopeptid e repeat
  Pfam annotation: Domain name=TPR_1; Domain location=415-449; Score =14.2; E_value=0.11; Accession=PF00515.18; Description=Tetratricopepti de repeat
  Pfam annotation: Domain name=TPR_1; Domain location=462-495; Score =9.3; E_value=0.41; Accession=PF00515.18; Description=Tetratricopeptid e repeat
  Pfam annotation: Domain name=TPR_1; Domain location=496-529; Score =33.6; E_value=6.8e-07; Accession=PF00515.18; Description =Tetratricopeptide repeat
  Pfam annotation: Domain name=TPR_1; Domain location=530-563; Score =22.8; E_value=0.0012; Accession=PF00515.18; Description =Tetratricopeptide repeat
  Pfam annotation: Domain name=TPR_2; Domain location=229-262; Score =30.9; E_value=4.4e-06; Accession=PF07719.7; Description =Tetratricopeptide repeat
  Pfam annotation: Domain name=TPR_2; Domain location=263-296; Score =25.5; E_value=0.00018; Accession=PF07719.7; Description =Tetratricopeptide repeat
  Pfam annotation: Domain name=TPR_2; Domain location=297-326; Score =0.1; E_value=32; Accession=PF07719.7; Description=Tetratricopeptide repeat
  Pfam annotation: Domain name=TPR_2; Domain location=416-449; Score =21.6; E_value=0.0029; Accession=PF07719.7; Description =Tetratricopeptide repeat
  Pfam annotation: Domain name=TPR_2; Domain location=462-495; Score =17.5; E_value=0.047; Accession=PF07719.7; Description=Tetratricopepti de repeat
  Pfam annotation: Domain name=TPR_2; Domain location=496-529; Score =20.9; E_value=0.0045; Accession=PF07719.7; Description =Tetratricopeptide repeat
  Pfam annotation: Domain name=TPR_2; Domain location=530-563; Score =20.3; E_value=0.0069; Accession=PF07719.7; Description =Tetratricopeptide repeat
  Pfam annotation: Domain name=TPR_4; Domain location=229-254; Score =9.4; E_value=2.8; Accession=PF07721.5; Description=Tetratricopeptide repeat
  Pfam annotation: Domain name=TPR_4; Domain location=263-288; Score =5.2; E_value=8.9; Accession=PF07721.5; Description=Tetratricopeptide repeat
  Pfam annotation: Domain name=TPR_4; Domain location=416-441; Score =8.6; E_value=3.5; Accession=PF07721.5; Description=Tetratricopeptide repeat
  Pfam annotation: Domain name=Thioredoxin; Domain location=614-692; Score=2.9; E_value=9.6e-05; Accession=PF00085.10; Description =Thioredoxin
  Pfam module annotation: Pfam domain module=TPR_1::TPR_1::TPR_1::TPR _1::TPR_1::TPR_1::TPR_1::TPR_2::TPR_2::TPR_2::TPR_2::TPR_2::TPR _2::TPR_2::TPR_4::TPR_4::TPR_4::Thioredoxin; Domain location=229 -262::263-296::297-330::...
  Pfam module annotation: Domain location=415-449::462-495::496 -529::530-563::229-262::263-296::297-326::416-449::462-495::496 -529::530-563::229-254::263-288::416-441::614-692
MEMKAKNNKKVGSELGCGLMGRILHLKSHKMRKASVHSLPFKNAQSDDDVKSEESKVSRKRSTGTEPPHKPSGVEQKPARKSASIHQQPCTNRNNQHQRHSDVAARSSTSSSSSTSISTKVVQQNKDKSHERKPQGQPTGNSLVLARISTSNENNENNKSQLKLTGNLLVNNTPRRKSVEYMPKSAELNSVPSSYTNASKGLMGNILNRNSDGNKVAQFLSPRMKKVDPEVSKSMGNDAYKQGRFEEALALYDRAIALDSNKAIYHCNKSAALIGLGRLQEAIVECEESIKLDPSYVRAHNRLATIYFRLGEAEKALNCNQITPYVDSILTFQAQALQNHLKKCIEARKVNAWSDILKETQSAISLGSDSAPQVYALQIEALLKLLRYQEAYTIYNKMPKFSIDWCTKIFGPACSAYLLMIGSMIYLASGRFEEAVTAAQQAVKVDPGNRELNAMVKKARAATSARMSGNLLFKASKFIEACAVYNEGLEHDPHNSVLLCNRAACRSKLGQNEKAIEDCNAALMVQPSYSKAKLRRANCNAKLERWEAAIQDYEMLLRERPGDEEVARALFEAQLQLKMLRGEDIKDLKFGSNLVSISSNDRFRHYVTSPGMAVALFTNKATHKKVLLVLEQISKRFPSVNFLKVEIEDHPYLAKSESVSSIPAFKIYKNGSSVKEISGNNHELLERSVKLYSS

SEQ ID NO: 230828 - protein, 86 aa, Glycine max
  Coding DNA Sequence Number=SeqID_114050
GRPRSVLATRRHIFTADVTEHMMQQSFPLITMHDGVPSVAQPWFQYLSENSLIAGDEVIFFFRFDEHVWEVLFRKEVVWDDEDLSN

SEQ ID NO: 230829 - protein, 38 aa, Glycine max
  Coding DNA Sequence Number=SeqID_114051
MVTAGMIIIVEVGNWAANLNPVVPRCERESSYIEFLMG

SEQ ID NO: 230830 - protein, 209 aa, Glycine max
  Coding DNA Sequence Number=SeqID_114052
  Homolog annotation: Hit_ID=Q1SDX7; Match level="QueryCoverage=81%, HitCoverage=26%, E-value=2e-16, Identity=29%"; Hit description =Cyclin-like F-box
MGGKSEKGEVMEWPAANTKAFIEKIYERVKNGQLQTFKTTTWEEINKDLFEMIQTNYGVDKLKSKFNRLRQIHRDFSTLLARTGVTWEMESNKVNALDEVWDELIKKGRHYKNFKKHGFEYDYDILGDIFNSSTTTGKLSHAYTQDPPNFDEERAMEGDFLTKGIHINVSDDEKDDIKGLRHKRKEIFLQDVIVYIMLGIMVRYAIEFI

SEQ ID NO: 230831 - protein, 41 aa, Glycine max
  Coding DNA Sequence Number=SeqID_114053
MYEVGLGTHESWHRLNQQGQLVIESYNTSKQGLEAYCHNGS

SEQ ID NO: 230832 - protein, 56 aa, Glycine max
  Coding DNA Sequence Number=SeqID_114054
MSTIKSNVITKDSEVGALQEKVVQLGITEGINMLKASLESNMVLTTVFLKNNTCII

SEQ ID NO: 230833 - protein, 649 aa, Glycine max
  Coding DNA Sequence Number=SeqID_114055
  Gene Ontology: Mol. function=oxidoreductase activity; Cellular component=integral to membrane; Biological process=electron transport
  Homolog annotation: Hit_ID=Q5XMI8; Match level="QueryCoverage=99%, HitCoverage=100%, E-value=1e-178, Identity=48%"; Hit description =Iron reductase
  Pfam annotation: Domain name=FAD_binding_8; Domain location=261-362; Score=108.6; E_value=1.8e-29; Accession=PF08022.2; Description=FAD -binding domain
  Pfam annotation: Domain name=Ferric_reduct; Domain location=110-231; Score=108.3; E_value=2.2e-29; Accession=PF01794.9; Description =Ferric reductase like transmembrane component
  Pfam annotation: Domain name=NAD_binding_6; Domain location=368-633; Score=133.2; E_value=7.2e-37; Accession=PF08030.2; Description =Ferric reductase NAD binding domain
  Pfam module annotation: Pfam domain module=FAD_binding_8::Ferric _reduct::NAD_binding_6; Domain location=261-362::110-231::368-633
MDSETSRGASLTVKYLQMGIWWFSVMIFVGYLMVWIVMPTNIFFPHWFPDIQAKADSIYFGRQGTTILIYTFPILLIATLASLYFHLEQKRSNHNTERWEVKLEYSALALGIVGYICLALLFFPVTRGSSILRFIGLTSEGSIKYHIWLGHIAMTLFTAHGLGYIIFWGKTHQILEIFKWNKIGVSNVAGAVSLLAGLILWAATLPSIRRKAFELFFYTHYLYIVFVIFFVFHVGFSNSCIVLPGFYLFMIDRYLRFLQSQQKVRLVSARVLPCETVELNFAKNIGLCYAPTSTIFINVPSISKLQWHPFTISSCSDTDSDTLSIVIKSSGTWSNTLYQKLSSSIPISHLDVSVEGPYGPASTFYSRHELLVLVSGGSGITPFISIIRSLIFKANTEGSKTPRVLLVCAFKKSIDLTTIDLILPVSATCTAFDISRLQLQIEAYVTREKQPDMNDKKLIQTLWFKPNALDEPVSAVLGQNSWLYLSIIISSSFMLFLLLIAILTRYYIYPIDHNTDMIYPYFSRSSLSMLFICISIAFVATSAFLWNKKQNKDLGQIKNIYTSNSSTSPGSGYYNADRELGSLPLQSLVQTAKVHYGERPNIKKILSGCNGSSIGVLVSGPRKMRHEVASLCTSCSTDDLHFESLSFSW

SEQ ID NO: 230834 - protein, 256 aa, Glycine max
  Coding DNA Sequence Number=SeqID_114056
  Gene Ontology: Mol. function=translation elongation factor activity
  Homolog annotation: Hit_ID=Q1T636; Match level="QueryCoverage=91%, HitCoverage=45%, E-value=4e-44, Identity=47%"; Hit description =Prokaryotic transcription elongation factor GreA/GreB region
MATRTGRLFQNQNLNVHVNGGGAVSGKADLTGQRKVGAGGRKPLGDLSNAGNLINQFDGKKALDGSLNTGKPSASVSQAPKLHKSKNLESDKRIPASEKLLTRGRKVLSDISNSGKPQVPEIKNKKTLKPIEESLPPSAIAEEQILHDHKKCIQSQFETADVHQFFKTVGLDDDSDDHMEISFDLSAISKLKSESAYLELEEVTEWLPEVHSLSALHGGSPAVVHCKTPGLSSYRTMWNDSTVNFKLIETPKLSKK

SEQ ID NO: 230835 - protein, 207 aa, Glycine max
  Coding DNA Sequence Number=SeqID_114057
  Gene Ontology: Mol. function=oxidoreductase activity; Cellular component=integral to membrane; Biological process=electron transport
  Homolog annotation: Hit_ID=Q1T639; Match level="QueryCoverage=99%, HitCoverage=42%, E-value=8e-93, Identity=81%"; Hit description =Phenol hydroxylase reductase; Ferric reductase-like transmembrane component
  Pfam annotation: Domain name=FAD_binding_8; Domain location=50-150; Score=102.4; E_value=1.3e-27; Accession=PF08022.2; Description=FAD -binding domain
MYEVFFYTHHLYTLYILFYAMHVGVEWMCMISPGIFLFLIDRHLRFLQSRQCAPLLSARLLPCGALELNFSKNPSLYYNPTSMVFINVPKISKLQWHPFTVISSCNMETDILSVAVKTGGSWSNKLYQELSSSALDHLNVSVEGPYGPTTTSQFLRYKQLVLVSGGSGITPFISIIRDLIFQNRQEQESHVPKVLLVCAFKNSADLT

SEQ ID NO: 230836 - protein, 180 aa, Glycine max
  Coding DNA Sequence Number=SeqID_114058
  Gene Ontology: Mol. function=oxidoreductase activity; Cellular component=integral to membrane; Biological process=electron transport
  Homolog annotation: Hit_ID=Q1T637; Match level="QueryCoverage=99%, HitCoverage=27%, E-value=2e-75, Identity=79%"; Hit description =Phenol hydroxylase reductase; Ferric reductase-like transmembrane component
MRSHTFLRITSLLVFIGWLTVWILLPTKVYKNTWTPKLKTKNKSLAFHIPRYAHRGPELHLSPSSRKRNGKATFQKRRSCKQMVMFLETSISCDVSNRNCHIYGDYFCTHVCRTLDMVPFQLLTYQLWTPPYAQGGRESVASKVQECIPETWVHRKHMLGISILSSDKRILYSSPCWTHI

SEQ ID NO: 230837 - protein, 382 aa, Glycine max
  Coding DNA Sequence Number=SeqID_114059
  Gene Ontology: Mol. function=nucleic acid binding; Cellular component= chromatin; Biological process=DNA integration
  Pfam annotation: Domain name=zf-CCHC; Domain location=142-159; Score =23.7; E_value=0.00012; Accession=PF00098.13; Description=Zinc knuckle
MDYKAKHYLFRTIDRSIFEQILDKNTSKIVWDSLKRKFGGNERVKKSLLNALRREFKVLEMKEAETIIEYFARVMVVANKIRSNGENMPDSKVVEKILRTLTERFTYVVVSIEESNDTATMSINELQSSLVVHEQKFKRAAVECFKCHNLGHFQYECPQWNKEANYAKLDEEEELLLMVVVQENEATRQDAWFLDSGCSNHMCGDKGMFTNMVEGHKHSVKCGNNSRMPVAGKGSVRLVFDGTTFLVRDGLITHTNMSANCMFVLFNKSSEVTAPIEECLHTSSDLTYLWHQRYGHLSYKGLKTLQTKKMVRGLPQLEVSSVTCTDCFTDKQHRNPIPKKSEWRATKVLELIHADIYGPIEPISNSGKWNILCFVDDCSRKG

SEQ ID NO: 230838 - protein, 465 aa, Glycine max
  Coding DNA Sequence Number=SeqID_114060
  Gene Ontology: Mol. function=nucleic acid binding; Cellular component= chromatin; Biological process=DNA integration
  Homolog annotation: Hit_ID=Q1RWN2; Match level="QueryCoverage=95%, HitCoverage=38%, E-value=1e-111, Identity=45%"; Hit description =Peptidase S8 and S53, subtilisin, kexin, sedolisin; Integrase, catalytic region; Zinc finger, CCHC-type
MVPKPFWTKAVNWTRTPSSLRLCSTRAHTRGKMSDESKAYNLFDPKTKRIVISKDVMFEEEKSDDDFNSEKSEGKHKDEGNSDRFVEDMEFNSEGESDGNNARGSEARNEAGSSQENVIQGRERRQLAWMREFVSGEGLSEKEEAEAYAVQDVVGDDPTQFKEAVKHEKWRKAMDSEINSIEKNQTWELMDLLAKLNELGEIDKYKARLVAKGYSRQHGIDFTEVFAPVARMDTIRMIVALAACRGWNIFQLDVKSTFLHGELSEDVYIEQPKGYMKKGKEHKVYKLHKALYGLRQAPRAWFSHIESHFVKKGFQKCPNEQTLFIKRGTRDNILIVSIYIDDLIYTGNDKGMMIEFKQSMMQAFDMTDLGKMRFFLGIEVLQKQEGIFLCQRKYATDILKKFAMYESNHVKSSIVPGFKINRDVDGATVDDTYFKQIVGSLMYLTTTRSSVIDVQEATNYYSLNY

SEQ ID NO: 230839 - protein, 299 aa, Glycine max
  Coding DNA Sequence Number=SeqID_114061
  Gene Ontology: Mol. function=transferase activity, transferring hexosyl groups; Cellular component=integral to membrane; Biological process=electron transport
  Homolog annotation: Hit_ID=Q5TIN3; Match level="QueryCoverage=99%, HitCoverage=78%, E-value=1e-168, Identity=93%"; Hit description =Alpha-1,6-xylosyltransferase
  Pfam annotation: Domain name=Glyco_transf_34; Domain location=10-232; Score=330.6; E_value=2.6e-96; Accession=PF05637.3; Description =galactosyl transferase GMA12MNN10 family
MAIQQPGLPQLHRTQQTPRPPRNRVHGIEIFYNMALLDAEMAGFWAKLPLIRKLLLSHPEVEFLWWMDSDAMFTDMAFEVPWERYKDSNFVMHGWNEMVYDEKNWIGLNTGSFLLRNCQWSLDILDAWAPMGPKGKIRDEAGKVLTRELKNRPVFEADDQSAMVYLLATGKEKWGDKVYLENHYYLHGYWGILVDRYEEMIENYHPGLGDHRWPLVTHFVGCKPCGKFGDYPVERCLKQMDRAYNFGDNQILQMYGFTHKSLGSRKVKRVRNDTSNPLEVKDELGLLHPAFKAIKLSSS

SEQ ID NO: 230840 - protein, 133 aa, Glycine max
  Coding DNA Sequence Number=SeqID_114062
MARRVEAATVKLQGPLLVDENDFRLRGRLSCERDSHLRERLLKYKCEATTTYGMMDNMPWACIIKVGKGAILGHTWSENMKRNKVGPKVDHPDQISPVEPGSSQFDDIIIDPTTSDPIVNLTYLSLQLIRAKF

SEQ ID NO: 230841 - protein, 298 aa, Glycine max
  Coding DNA Sequence Number=SeqID_114063
  Homolog annotation: Hit_ID=UPI000061052C; Match level="QueryCoverage =60%, HitCoverage=34%, E-value=1e-08, Identity=25%"; Hit description =UPI000061052C related cluster
MALRPIDNALPTTTPERPKKQPKIAVATQKQQDRASVNGENVVPLPSSEDATVDYVSSDNLKPLADPEVKIQSLVEDLDSKNWIKVCESLNDVRRFSLLHSSLLFPILGKIVLVVAKTMRNPRSALCKTAIMAAADIFSAFGDKLLEPETSDAFDGLLLQLLLKASQDKRFVCEEADRALGIMVGSMTPLPLLKKLRVYVSHKNLRVRAKAAVSLSNCVSKMGLEEMEQFGLAELIEVAADLLNDRLPEARDAARSIATSMYEALTKDSEEMMELWQSFCQSKLPPIHALSILKIVKP

SEQ ID NO: 230842 - protein, 68 aa, Glycine max
  Coding DNA Sequence Number=SeqID_114064
MQSNEMNREMRVIERFDGFKKWKETLGGYVCNGNISKWEALFESETLPAESDNAIEFSSKLSQIYNVI

SEQ ID NO: 230843 - protein, 328 aa, Glycine max
  Coding DNA Sequence Number=SeqID_114065
  Gene Ontology: Mol. function=protochlorophyllide reductase activity; Cellular component=chloroplast; Biological process=chlorophyll biosynthetic process
  Homolog annotation: Hit_ID=Q9LKH8; Match level="QueryCoverage=97%, HitCoverage=87%, E-value=1e-109, Identity=82%"; Hit description =NADPH-protochlorophyllide oxidoreductase
  Pfam annotation: Domain name=adh_short; Domain location=42-193; Score= -32.4; E_value=0.00075; Accession=PF00106.15; Description=short chain dehydrogenase
GIPTKNWPFEGSVSGNNHSRSHQGFTRRQENFEERQCYCHWASSGLGLATAKALAETGKWHVIMTCRDFLKAERAAKSAGIAKEIVSLDSVRQFVDNFRQSGRPLDVLVCNAAVYLPTAREPTYTADGFELSVGTNHLGHFLLSRLLLEDLNKSDYPSKWLIIVGSITGNTNTLAGNVPPKANLGDLRGLAGGLNGLNTSAMIDGGSFDGTKAYKDSKVCNMFTMQEFHRRYHEETGITFASLYPGCIATTGLFREHMFYPFTCDFEESLFLMFELLCSCVFTGAGMQPLLRLKTNCPKRPAMQIRLARFGRLVRNLLVWLKWHYGSF

SEQ ID NO: 230844 - protein, 392 aa, Glycine max
  Coding DNA Sequence Number=SeqID_114066
  Gene Ontology: Mol. function=cysteine-type peptidase activity; Cellular component=nuclear envelope; Biological process=proteolysis
  Homolog annotation: Hit_ID=Q70G10; Match level="QueryCoverage=99%, HitCoverage=84%, E-value=1e-78, Identity=43%"; Hit description=SUMO protease
  Pfam annotation: Domain name=Peptidase_C48; Domain location=266-392; Score=33.8; E_value=6.1e-07; Accession=PF02902.9; Description=Ulp1 protease family, C-terminal catalytic domain
MGAMTANRKRSEECMNVNHTNSDSPRKRAKFSIKPVPSATSAVARLSRYPEVHAPLAREVHAPCRSRKFERSRVIVSAGNVMGNFLATKFKEAKRSASAKCRNLVEKGKEVIEVDAETESEERYVDSSVEEARGDGDKVVRVQQQSQSTLSFDSEMMNAELKMVSGGKVWGYETQRDLENVHMYKKLLEDVGRRSGTLQRLNFEIDLNEKRREHYNLLRPKKELVEEQEVPQEPFVALTSEEEDEVECAFSSNWRRILVTHENSNIVITGEKFQCLRPTGWLNDEVINLYLELLKEREQREPQKFLKCHFFNTFFYKKLISGPKGYDFKSVRRWTTQRKLGYSLLECDKIFVPIHQEIHWCLAVINKKDKKFQYLDSMKGEDSFVLEKLSKI

SEQ ID NO: 230845 - protein, 535 aa, Glycine max
  Coding DNA Sequence Number=SeqID_114067
  Gene Ontology: Mol. function=microtubule motor activity; Cellular component=microtubule associated complex; Biological process =microtubule-based movement
  Homolog annotation: Hit_ID=Q6WJ05; Match level="QueryCoverage=86%, HitCoverage=46%, E-value=1e-178, Identity=75%"; Hit description =Central motor kinesin 1
  Pfam annotation: Domain name=Kinesin; Domain location=263-535; Score =41.6; E_value=1.1e-16; Accession=PF00225.13; Description=Kinesin motor domain
NSVSDLNRNRLGDPQWLHSPFNSRTFHALLHVRTDLENWRLNDVRSATRVARCRRAMPPPQLRCWTTAAMLATPSWRGGCSPPACSISPLPSLPPPSIIDSSPTFSCRVYYSMNFELSCSLRDEFGTGYGAQSAEEKQRLLKLMRNLNFNGESGSEPYTPTAQSLGGVAGSDGFYSPEFRGDFGAGLLDLHAMDDTELLSEHVVSEPFEPSPFMRGDTRVFEDDFDPINSKLESGEADTDASISLPMNSTRENNVAKIKVVVRKRPLNKKELAKKEDDVVTVADNAYLTVHEPKLKVDLTAYVEKHEFCFDAVLDEHVTNDEGKAAYNIPPPYLRIAKSLWAMGHSTCIHYYDANNALLSGSGKTYTMQPLPLRAAEDLVRQLHQPVYRNQRFKLWLSYFEIYGGKLYDLLSDRKWVFNLLYHYVGKLCMREDGRQQVCIVGLQEFEVCDVQIVKEFIEKGSAARSTGSTGANEESSRSHAILQLAVKKHSEVKASKRNNDGNEARSGKVVGKISFIDLAGSERGADTTDNDRQT

SEQ ID NO: 230846 - protein, 126 aa, Glycine max
  Coding DNA Sequence Number=SeqID_114068
MNVEERKIGEELATQLAQASKVASSRSNNLLEEESGRPKWAGLLFLSKKLRKLTDCAKTPLFYFCHITEFHGSPMEKEKMHVVTSESTDNLVARHEHSDEGSEKQTVSQCFLQICHNLFAVRNSKP

SEQ ID NO: 230847 - protein, 124 aa, Glycine max
  Coding DNA Sequence Number=SeqID_114069
MHTTHQVKNIKNNLAIIINATITIARKRYPPTPNLTKDKESRQVHLKPDVATCPFVGERRRGSRVRFPKEERCAESPPTFICGKRRENRRRPVKMKILSSGVVFTFEEGISSSHVCLKGQQPIF

SEQ ID NO: 230848 - protein, 92 aa, Glycine max
  Coding DNA Sequence Number=SeqID_114070
  Subcellular localization annotation: CTP_CleavageSite=63; ConfidenceScore=5.50e-01
MGVQIATRPTWAFQDVPPKTTAFWRKQPRSPGRAGWQASPSFSYKYGKEGRTKKFNPPENPCRGASVTFPWVISRRFSTVLRLFFVVLRSST

SEQ ID NO: 230849 - protein, 46 aa, Glycine max
  Coding DNA Sequence Number=SeqID_114071
MLQPRQQLLKYTGNSNTKIRNPLKKPNLFGSLIFHPLFLLHLTGGR

SEQ ID NO: 230850 - protein, 358 aa, Glycine max
  Coding DNA Sequence Number=SeqID_114072
  Gene Ontology: Mol. function=heat shock protein binding; Cellular component=integral to membrane; Biological process=protein folding
  Homolog annotation: Hit_ID=Q9FH28; Match level="QueryCoverage=98%, HitCoverage=97%, E-value=2e-78, Identity=45%"; Hit description =Chaperone protein dnaJ 49
  Pfam annotation: Domain name=DUF1977; Domain location=261-354; Score =94.4; E_value=3.5e-25; Accession=PF09320.1; Description=Domain of unknown function (DUF1977)
  Pfam annotation: Domain name=DnaJ; Domain location=99-160; Score =117.0; E_value=5.5e-32; Accession=PF00226.21; Description=DnaJ domain
  Pfam module annotation: Pfam domain module=DUF1977::DnaJ; Domain location=261-354::99-160
MEGNKDEALRCVRIAEEAIASRNKDRALKFLKIAQRLNRDLPLQSLLDKCNRLDSHTASTAGGSGASLANGHSPRREGLDVERNYTDVHLIREIKGKSDYYAILGLEKSCSVEEIRKAYRKLSLKVHPDKNKAPGSEDAFKKVSKAFKCLSDDGSRRMYDQTGTAADDFESTEVNTFRRRRRRTATTRDFFEDEFDPDEIFRAFFGHSDVFGRNNHVYRTRGGMGNPNHQHRHEFNAGGSGGRHHNVMLLIQLLPFLIIVLLAYLPFSEPEYSLHKHYSYQIPKTTDRHGVQFFVKSAAFDVNYPPGSDAREAVEESVMKDYRSMLRRYCQVEMQRRSWNRNLPAPHCDKLHNFAVMA

SEQ ID NO: 230851 - protein, 1143 aa, Glycine max
  Coding DNA Sequence Number=SeqID_114073
  Gene Ontology: Mol. function=binding; Cellular component=nuclear condensin complex; Biological process=mitotic chromosome condensation
  Homolog annotation: Hit_ID=Q2QP00; Match level="QueryCoverage=90%, HitCoverage=76%, E-value=0.0, Identity=45%"; Hit description=G14587 -6, putative, expressed
  Pfam annotation: Domain name=HEAT; Domain location=357-389; Score =7.9; E_value=4.7; Accession=PF02985.12; Description=HEAT repeat
  Pfam annotation: Domain name=HEAT; Domain location=411-447; Score =9.2; E_value=3.2; Accession=PF02985.12; Description=HEAT repeat
  Pfam annotation: Domain name=HEAT; Domain location=449-485; Score =6.3; E_value=7.3; Accession=PF02985.12; Description=HEAT repeat
  Pfam annotation: Domain name=HEAT; Domain location=935-970; Score =5.8; E_value=8.5; Accession=PF02985.12; Description=HEAT repeat
  Pfam annotation: Domain name=HEAT; Domain location=972-1008; Score =4.1; E_value=14; Accession=PF02985.12; Description=HEAT repeat
  Pfam module annotation: Pfam domain module=HEAT::HEAT::HEAT::HEAT::HEA T; Domain location=357-389::411-447::449-485::935-970::972-1008
MEETVSRVISELEDLRGNPQPPPLSEQTLTNLLFLLKHSLSESLYDELSSKNLSPSSLIPPIASAMDSSPPHHSLLASDVFLSLLLAPNAPVFTLFTPMSFLSFLRSLRRSCKAHSHPGPAQDNSQNGKRKRPGRGRAKNPQNEDDSPDTSSQHDPRVLLRVLEKLVEVMGLIHLNRFPETLKSLIQTVAEIPVTSLNTCGNAAVYSRLLSLCSHVLKEVLKSEHGEPSNTAAEVLKSLCSLVLMAKSQARTFALGFVTSLGNQCDDVKKALVNFPRYLAKKAPEKAEPRALAVESIMEVVKVMGFDDQIAFVKYVVQMAQGKSSLRLLAVDLILNLVMSLKDPLGVESEESEVWGIWCLEVLLKRCSDVSGAIRARALSNLAQLVGFLSRGERTSVVLKEFMGFGKVGDGNVEGGMNDMLRRRCMDDKAAVRKAALLLVTNLTSLLGGAIDEVVLKTMGMACSDPLISMRKAAITALSEAFRTFSAETVITEWLHSVPRLISDNESSIQEECENMFKELVLDRIIRAATATSSYSEPLSNRKMKGKGLDNEMEMFFPNGTLYLLREICHGEVSPWVKKICTNLGKKNRINHKIVTALQNIIRVSESIWLSHSMPIEKWTAPPGAWFLLSEVSTFLSKVVDWEFLHHHWQLLDKHEVEGEFKSPFVQRNASEEEESIECNHVAWASDRVFLLQTISNVSVELPPVPAADLAHNLLKRVEQFNMHSTEVDAHLKALKTLCKRKASNLEEAEALVLKWVHQVLSRASGIIEKFISENSEQNAEGSFFTPPRSGTSKGRKSVAKSKSLSKAVTAIYTVGSVVIVCPSADMSNLVPLLHTIITSGSSGPKLNNLPSPSTSLQQEAPSFYIQGWLAMGKLCLADGKLAKNYIPLFVQELEKSKSAALRNNIVVMMADFCVRFTALVDCKYSPCYSNFFFMEVISYITKITRCLLDPCELVRRQTFILLSRLLQRDYVKWRGVLFLRFLLSLVDESEKIRQLADFLFGNILKVKSPLLAYNSFVEAVLVLNDCHVHNGHRESQGSRKESQIFSIRGTDEESRSKRMHIYVSLLKQMAPEHLLATFAKLCAEILAAASDGMLNIEDATGQSVLQIERLVGVGSNNSTGLAQASETRCDLGKFMVRPANSG

SEQ ID NO: 230852 - protein, 141 aa, Glycine max
  Coding DNA Sequence Number=SeqID_114074
MAQNGVSHLTKISYFEHSPDPFQLQKVVLCEMPKPLATILCDGNISLSLTKCTKSSTFLLFIASLESRIRNSWVLIVGTFEKVQTMQRGGDHGHAMEHTVAGIKVRGPTGVHGGEGGGGFTMRGRASSNLEGVGGHEEVAD

SEQ ID NO: 230853 - protein, 84 aa, Glycine max
  Coding DNA Sequence Number=SeqID_114075
MMITILPNGVVHALQLSKALKSLLDLDAVVEGCYHFIVVVLITTTMVMRILKLAKYMLNAQVEKDEGPEAETLLRLLIVVEDLD

SEQ ID NO: 230854 - protein, 177 aa, Glycine max
  Coding DNA Sequence Number=SeqID_114076
  Homolog annotation: Hit_ID=Q1T1W2; Match level="QueryCoverage=30%, HitCoverage=10%, E-value=6e-09, Identity=57%"; Hit description=VQ
MDSGNSGSISSSGDEEYDSRADHTVLPSTFINNHHHHPPSQFGSISQHPLVASSHYQQHQPHPSLFDLSPSYLHALSQPNSFLNLDTTTSSSQPRRSEPDCTLNVTSSPPPPTTTNIDQCLLGSQGGLNVDNARRDTILFESGKTSNLGRNSKKRTRASRRAPTTVLTTDTSNFRAM

SEQ ID NO: 230855 - protein, 276 aa, Glycine max
  Coding DNA Sequence Number=SeqID_114077
  Homolog annotation: Hit_ID=Q1SBV5; Match level="QueryCoverage=29%, HitCoverage=12%, E-value=1e-07, Identity=36%"; Hit description=RNA -directed DNA polymerase homolog F21E10.5-Arabidopsis thaliana
MGFFISRSTLKVMSLITSKRCMPLPMYVQDNIPLLVSSQDNDCLTKPSSLDEVRQIVFSMNGKGAPGSDVVLNPKFSEAAAISDYPPIVLANFHFKIIADRVSGVRRSILSATFLTGGRHSYLSLLSLGLLGATSSNTKHYNKFSRSTRKPLGNAFIYPNVDSLLAFKLLKSLLLPIVDKIKAKLCSWKGKLLSVMGRVQTMGWIKGNSDGATQGSLGFALVSVIFRDDKGAAISCLTSFIGVAVVFEAQLLATILAIETTKSKNWHSFWLECLCW

SEQ ID NO: 230856 - protein, 42 aa, Glycine max
  Coding DNA Sequence Number=SeqID_114078
MAWIEVGFYLRLFHIRISCLGLGLEDDVRDRGSNKNNMWTKA

SEQ ID NO: 230857 - protein, 93 aa, Glycine max
  Coding DNA Sequence Number=SeqID_114079
MPHPLVLPDDTTNMPYPPVAAPVDAEMPQHAVVVCQKIAKSLQRMLDMRMVTAGTDAYTIIDQYITLARGHENVYVRSRRRIDTQGRDGGGRG

SEQ ID NO: 230858 - protein, 387 aa, Glycine max
  Coding DNA Sequence Number=SeqID_114080
  Gene Ontology: Mol. function=protein phosphatase type 2A regulator activity; Cellular component=protein phosphatase type 2A complex; Biological process=signal transduction
  Homolog annotation: Hit_ID=Q9LDG7; Match level="QueryCoverage=99%, HitCoverage=40%, E-value=1e-127, Identity=62%"; Hit description=WD -40 repeat protein-like
  Pfam annotation: Domain name=WD40; Domain location=113-151; Score =6.5; E_value=6.3; Accession=PF00400.22; Description=WD domain, G -beta repeat
  Pfam annotation: Domain name=WD40; Domain location=185-222; Score =13.3; E_value=0.89; Accession=PF00400.22; Description=WD domain, G -beta repeat
  Pfam annotation: Domain name=WD40; Domain location=20-58; Score=37.6; E_value=4.4e-08; Accession=PF00400.22; Description=WD domain, G-beta repeat
  Pfam module annotation: Pfam domain module=WD40::WD40::WD40; Domain location=113-151::185-222::20-58
MRLLSSSMDKTVRLWHLSSKSCLKIFSHSDYVTCIQFNPVDDRYFISGSLDAKVRIWSIPDRQVVDWTDLHEMVTAACYTPDGQGVLIGTYKGRCHLYYSSENKLQQKSQINLQNRKKRSNHKKITGFQFVPGSSSEVLITSSDSRIRLVDGVDLVHKFKECVLSESPREFNFHNTHKWSRLILLKNHPWFRNANSQISACLTANGKYVVSASEDSHVYIWKNEADCRPNRSKGVAVTSTYEHFHCKDVSVAIPWPGMDDTWEMHDPYFAEEPELDDDGDEVFSANHPPTPVEENLCSEGSQFASGCNSSPLHGTIASATDSYFLDRISATWPEEKLLTTRDRSPQVSVDLSKGVNQNMSAWGMVIVTAGLQGEIKIFQNFGLPLGI

SEQ ID NO: 230859 - protein, 187 aa, Glycine max
  Coding DNA Sequence Number=SeqID_114081
MGIDPIGWIARAGKFFEVQEIPSFHKLQYAFMSMEGAATYWLYIWSQNNPDSDWESFFTALIKRFGDRHGNLIFERLSILKEEKPTETKIHIKKWETSTEFLKGRTNILERKHMLRKILNEEVDSHASQQDKNSMEGNLIKKEVEAGDSTKPRCFQDSDFHKKIVMVKQKSFMKVVGTTMVLESWNV

SEQ ID NO: 230860 - protein, 944 aa, Glycine max
  Coding DNA Sequence Number=SeqID_114082
  Gene Ontology: Mol. function=ubiquitin-protein ligase activity; Cellular component=ubiquitin ligase complex; Biological process =protein ubiquitination
  Homolog annotation: Hit_ID=Q6H6D6; Match level="QueryCoverage=54%, HitCoverage=54%, E-value=5e-31, Identity=25%"; Hit description =Transducin-like
  Pfam annotation: Domain name=WD40; Domain location=667-705; Score =33.8; E_value=5.9e-07; Accession=PF00400.22; Description=WD domain, G-beta repeat
  Pfam annotation: Domain name=WD40; Domain location=720-783; Score =1.7; E_value=23; Accession=PF00400.22; Description=WD domain, G-beta repeat
  Pfam annotation: Domain name=WD40; Domain location=836-874; Score =3.5; E_value=14; Accession=PF00400.22; Description=WD domain, G-beta repeat
  Pfam module annotation: Pfam domain module=WD40::WD40::WD40; Domain location=667-705::720-783::836-874
MEFRIFDLHRKLQQHSGLPQAHQHPMQEQLDKRNIIKFDSSRFNRSIEDFTLSISKYRDKTGNTLLNCRVEDELNEDASQPKKLFDHVTFTSACKHRPSQKNHEESSEIQRLYSLGKFDEVCCSNSRRYSLQDLSELTERRISELHYSEVLGKCDEEYTVDIASIYESLISSSGATYASLKDVILDELLIAISTSKEERKIRASVSILTTIISRNKSIIEDVKKKGLRLCDLASALKQNVHEAAILIYLINPSPIDIKTLELLPILVEIVCTSNSYKNKQESLLLTPHAASLMIIEELVTSFDYATNNMHLATISSPHVLSGFLEVARNDNLEEFFSLTTILIKCMQYDAQCRKYVSQFTPLAPFIHLLQSENTRAKCTALEFFHEILCIPRSSAISLLQRIQQESSINIMQILLHCAHQLQPDHQLLAANILLQLDILNFPDKGIFREEAVQILLRAMTSEESSEQILSTSILSNLAGTYAWTGEPYTAAWLLRKTGLTSPYHQNMIRNFNWLDQSLQDTSTDLWCSKISKCIISHGDSVFHTLERVLRSKIKRVSRDCLIAISWLGFQISKSPDSISYSASEVILSGIEQFLHPGIESEERLLACMCMFNYASGKGKQKLMHFSEGVKESLRRLSNVIWMAEELHRVADFLLPNISVWDIRGHSASLVWDIKEHKKSVTCFSLHEPSDSLLSGSTDKTIRVWKMIQRKLECVEVIALKEPIHHLRAHGETIFAISESHGLKLVNESRVTKDILKGKHVKCMTVAQGKLYIGCTDSSIQEYSTTHNRELEIKPPTRSWRKQSKPINAVVAYRDWLYSANKYVEGTTFKEWKRTKKPKVSIFTDKGDNVAAMEVVEDFLYLISSSSPNNIQIWLRGAPKKLGRISAGSKITSILAANDIIFCGTETGLIKEMLYIKYQGDIIPFNHEFANLKQDNIPKHIISIY

SEQ ID NO: 230861 - protein, 51 aa, Glycine max
  Coding DNA Sequence Number=SeqID_114083
MWLGYFKFNNYNSILHRYSKSEAHYLDDGLHGAKEIGEQHEQHGEQAKAKA

SEQ ID NO: 230862 - protein, 176 aa, Glycine max
  Coding DNA Sequence Number=SeqID_114084
  Gene Ontology: Mol. function=protein serine/threonine kinase activity; Cellular component=cytoplasm; Biological process=protein amino acid phosphorylation
  Homolog annotation: Hit_ID=Q2PET0; Match level="QueryCoverage=79%, HitCoverage=41%, E-value=4e-32, Identity=45%"; Hit description =Putative serine/threonine protein kinase-like protein
MKDDISRKCFQQLISAVDFCHDRDVTHHDLKSEEILLTLCDTSAYVAPKVLKKKGYDGSKACDTSAYVAPKVLKKKGYDGSKANIWSSEGQKLISNLLTMDPRKRYSIPDIMKDPRFQIGFMRPIAFSVKESVVEDNIDFNRDDVPNVNCNSNGGGNSNNNDDEEVIMVYHCWKLS

SEQ ID NO: 230863 - protein, 115 aa, Glycine max
  Coding DNA Sequence Number=SeqID_114085
  Subcellular localization annotation: CTP_CleavageSite=84; ConfidenceScore=5.26e-01
MTRLNGLWIVVSAFKVSVEYGGIKSTANQPPPRQVSSATQDPGSSNTLALPASCGIAIVFITSVHMLTLSLGSWGNSFVRKKICRGQGPGDSKDSQKGGPQNALVVGPTIPSTTP

SEQ ID NO: 230864 - protein, 278 aa, Glycine max
  Coding DNA Sequence Number=SeqID_114086
  Gene Ontology: Mol. function=protein binding; Cellular component =cytosol; Biological process=Golgi organization and biogenesis
  Homolog annotation: Hit_ID=Q42384; Match level="QueryCoverage=93%, HitCoverage=54%, E-value=1e-144, Identity=64%"; Hit description =PP1/PP2A phosphatases pleiotropic regulator PRL1
  Pfam annotation: Domain name=WD40; Domain location=1-34; Score=5.5; E_ value=8.3; Accession=PF00400.22; Description=WD domain, G-beta repeat
  Pfam annotation: Domain name=WD40; Domain location=122-160; Score =36.2; E_value=1.1e-07; Accession=PF00400.22; Description=WD domain, G-beta repeat
  Pfam annotation: Domain name=WD40; Domain location=164-201; Score =15.5; E_value=0.19; Accession=PF00400.22; Description=WD domain, G -beta repeat
  Pfam annotation: Domain name=WD40; Domain location=206-243; Score =7.9; E_value=4.4; Accession=PF00400.22; Description=WD domain, G -beta repeat
  Pfam annotation: Domain name=WD40; Domain location=38-76; Score=33.3; E_value=8.5e-07; Accession=PF00400.22; Description=WD domain, G-beta repeat
  Pfam annotation: Domain name=WD40; Domain location=80-118; Score =41.0; E_value=4.2e-09; Accession=PF00400.22; Description=WD domain, G-beta repeat
  Pfam module annotation: Pfam domain module=WD40::WD40::WD40::WD40::WD4 0::WD40; Domain location=1-34::122-160::164-201::206-243::38-76::80 -118
VISGHLGWVRSVAVDPSNTWFCTGSADRTIKIWDLASGVLKLTLTGHIEQVRGLAVSNRHTYMFSAGDDKQVKCWDLEQNKVIRSYHGHLSGVYCLALHPTIDVLLTGGRDSVCRVWDIRSKMQIHALSGHDNTVCSVFTRPTDPQVVTGSHDTTIKMWDLRYGKTMSTLTNHKKSVRAMAQHPKEQAFASASADNIKKFTLPKGEFCHNMLSQQKTIINAMAVNEEGVMVTGGDNGSMWFWDWKSGHNFQQSQTIVQPGMLLGCLVICHLVLSYPRD

SEQ ID NO: 230865 - protein, 217 aa, Glycine max
  Coding DNA Sequence Number=SeqID_114087
  Gene Ontology: Mol. function=acyltransferase activity; Cellular component=integral to membrane
  Homolog annotation: Hit_ID=Q9FH27; Match level="QueryCoverage=100%, HitCoverage=46%, E-value=2e-72, Identity=60%"; Hit description =Probable 3-ketoacyl-CoA synthase 20
  Pfam annotation: Domain name=ACP_syn_III_C; Domain location=112-194; Score=6.8; E_value=2.8e-06; Accession=PF08541.1; Description=3 -Oxoacyl-[acyl-carrier-protein (ACP)
  Pfam annotation: Domain name=Chal_sti_synt_C; Domain location=50-196; Score=12.4; E_value=0.00016; Accession=PF02797.6; Description =Chalcone and stilbene synthases, C-te
  Pfam annotation: Domain name=FAE1_CUT1_RppA; Domain location=1-95; Score=-119.6; E_value=1.8e-08; Accession=PF08392.2; Description =FAE1Type III polyketide synthase-lik
  Pfam module annotation: Pfam domain module=ACP_syn_III_C::Chal_sti _synt_C::FAE1_CUT1_RppA; Domain location=112-194::50-196::1-95
MGGSAILMSSRVQDMHKAKYKLQHIVRTITAQDDQSHGCVYQQVDPENKEGISISKNIVNVSGDALKKNIASLGPLVLPLKEQFLYLFSIIRNKIWSARKISMYTPNFNHAFEHFCIHSGGRAIIQAVERNLRLRKQDVEPSTMTLYRFGNISSSSIWYELSYIEAKGRMKCGDRVWQIAFGSGFKCNSAVWKCVCDVKPDTATAWRDTIHSYPVDI

SEQ ID NO: 230866 - protein, 76 aa, Glycine max
  Coding DNA Sequence Number=SeqID_114088
MVSGGQLDREPLWGVSWSGRTQGPSAHCTIACMLMALEFHIAYVPGDGPEQVEKEVVVVMIDDGERRTKNQTHVGV

SEQ ID NO: 230867 - protein, 184 aa, Glycine max
  Coding DNA Sequence Number=SeqID_114089
  Gene Ontology: Mol. function=DNA binding; Biological process=DNA integration
  Homolog annotation: Hit_ID=Q0ZCB6; Match level="QueryCoverage=61%, HitCoverage=29%, E-value=6e-16, Identity=33%"; Hit description =Integrase
AFNLLKEKLVNAFVVIAPDWSLPFKLMCDASDLAVGTILGQRKNKPAEDGIIKETFLDESLLIVVAISRAPWYADIVDYLACKVFPMDTNYQGKKRHMSEDRKYFWDNPYIFRFLNFNSKLSGKNRLRQLNELDELTLIVYENETLYKERRKRWHNTRIKQRQFQVKEKVLVYNSCLHLFPGKL

SEQ ID NO: 230868 - protein, 542 aa, Glycine max
  Coding DNA Sequence Number=SeqID_114090
  Gene Ontology: Mol. function=binding; Cellular component =intracellular; Biological process=protein kinase C activation
  Homolog annotation: Hit_ID=Q9FI49; Match level="QueryCoverage=92%, HitCoverage=99%, E-value=1e-174, Identity=57%"; Hit description =Similarity to selenium-binding protein
  Pfam annotation: Domain name=PPR; Domain location=139-173; Score =44.4; E_value=3.9e-10; Accession=PF01535.11; Description=PPR repeat
  Pfam annotation: Domain name=PPR; Domain location=174-208; Score =15.5; E_value=0.11; Accession=PF01535.11; Description=PPR repeat
  Pfam annotation: Domain name=PPR; Domain location=240-274; Score =31.6; E_value=2.7e-06; Accession=PF01535.11; Description=PPR repeat
  Pfam annotation: Domain name=PPR; Domain location=275-309; Score=7.9; E_value=0.86; Accession=PF01535.11; Description=PPR repeat
  Pfam annotation: Domain name=PPR; Domain location=311-345; Score =19.7; E_value=0.011; Accession=PF01535.11; Description=PPR repeat
  Pfam annotation: Domain name=PPR; Domain location=374-408; Score=9.6; E_value=0.55; Accession=PF01535.11; Description=PPR repeat
  Pfam module annotation: Pfam domain module=PPR::PPR::PPR::PPR::PPR::PP R; Domain location=139-173::174-208::240-274::275-309::311-345::374 -408
  Subcellular localization annotation: CTP_CleavageSite=81; ConfidenceScore=5.24e-01
MKCDARMIRLRHGANKFGCFGKSWTNVRPSFHSLSYSFPATDPTVLHRVLERCRVSTDLKTATKTHARVVVLGFATYPSLVASLISTYAQCHRPHIALHVFSRILDLFSMNLVIESLVKGGQCDIAKKVFGKMSVRDVVTWNSMIGGYVRNLRFFDALSIFRRMLSAKVEPDGFTFASVVTACARLGALGNAKWVHGLMVEKRVELNYILSAALIDMYAKCGRIDVSRQVFEEVARDHVSVWNAMISGLAIHGLAMDATLVFSRMEMEHVLPDSITFIGILTACSHCGLVEEGRKYFGMMQNRFMIQPQLEHYGTMVDLLGRAGLMEEAYAVIKEMRMEPDIVIWRALLSACRIHRKKELGEVAIANISRLESGDFVLLSNMYCSLNNWDGAERVRRMMKTRGVRKSRGKSWVELGDGIHQFNAAYQSHPEMKSIYRVLEGLIQRAKLEGFTPLTDLVLMDVSEEEKEENLMFHSEKLAMAYAVLKTSPGTKIRISKNLRICLDCHNWIKIVSKILNRKIIVRDRIRFHQFEGGVCSCKDYW

SEQ ID NO: 230869 - protein, 106 aa, Glycine max
  Coding DNA Sequence Number=SeqID_114091
  Gene Ontology: Biological process=response to stress
  Homolog annotation: Hit_ID=Q39644; Match level="QueryCoverage=71%, HitCoverage=75%, E-value=3e-14, Identity=54%"; Hit description=Late embryogenesis abundant protein Lea5
  Pfam annotation: Domain name=LEA_3; Domain location=6-97; Score=85.3; E_value=1.9e-22; Accession=PF03242.4; Description=Late embryogenesis abundant protein
MYKLHSEKYRRTRSQNNRYISCTPRSERGYAAASDASPSMRGGLDSISVMEKGVTKNSSGPSGTSSAWAPDPITGYYRPINHTNEIDPVELRKMLLKHKVRSSPSS

SEQ ID NO: 230870 - protein, 80 aa, Glycine max
  Coding DNA Sequence Number=SeqID_114092
  Homolog annotation: Hit_ID=Q8H3G8; Match level="QueryCoverage=59%, HitCoverage=6%, E-value=2e-09, Identity=60%"; Hit description=Myosin heavy chain-like protein
MAIAEDINDMSFISAQSAEVTSHTTDKGHDGWEKAENEVTSLQKQVQALTLRNSKLEDRVTYLDRALKELVRQLRQTRYL

SEQ ID NO: 230871 - protein, 298 aa, Glycine max
  Coding DNA Sequence Number=SeqID_114093
  Gene Ontology: Mol. function=chromatin binding; Cellular component =chromatin; Biological process=chromatin assembly or disassembly
  Homolog annotation: Hit_ID=Q1SAV4; Match level="QueryCoverage=82%, HitCoverage=68%, E-value=2e-70, Identity=52%"; Hit description =Integrase, catalytic region
  Pfam annotation: Domain name=Chromo; Domain location=205-253; Score =18.0; E_value=0.0073; Accession=PF00385.14; Description='chromo' (CHRromatin Organisation MOdifier
MDFLIGLPPSHGGTKLHFSTAYHPQSDGQAEAINRVLEQYLRAFVHDQPRHWFKYLSLAEWSYNSSVHSGTGDSPVEAVDTLLTSRHNIHLTLQCCLQKYQTLMKRMADNHRRDLTFDVGDWVYVKLCPYRQTSLQHTYSKLSKRFYGPFCILERIGAVAYRLQLPTTSKIHDVFLISLLKPHHGTDPTDSQALPPSSWDNHPVIHPLHILDWKLDDSVAPPIQFVLVQWHSSPPEDATWEHWSELQAAYDLKDKVGFQGEEIDSNIGTIPPGPGTIEPATCRPTRATNKLKYLEDYA

SEQ ID NO: 230872 - protein, 312 aa, Glycine max
  Coding DNA Sequence Number=SeqID_114094
  Gene Ontology: Mol. function=RNA-directed DNA polymerase activity; Cellular component=chromatin; Biological process=chromatin assembly or disassembly
MPRIDGLLDEIGDASWFSKLDLRQGFHQIRMHEDNIPKIAFRTHQGHYEFTVMPFGLFNAPSTFQATMNNLLWPFLRQIAAVFFDDILRIFAEQRLNYLGHIISPQGVAPPKQDPGLDCMANTRHYDKFVWSPAAQATFEQLKIMMTQAPVLTTPDFSVPFTLETDASGTSIGAVLLQQSRPIAFFSKQLCPRLQKASTYVRELHAITTTVRKWRHYLLGHHFVIMTDHRSLKEIMTQVIQTPEQQIYLSKLLGFDYTIQYKPGPSNVVADALSRISAPTSSLLIISIPHNLFLDQLKQTLTHDEAYQTLLH

SEQ ID NO: 230873 - protein, 47 aa, Glycine max
  Coding DNA Sequence Number=SeqID_114095
  Gene Ontology: Mol. function=nucleic acid binding
  Homolog annotation: Hit_ID=Q6YUI7; Match level="QueryCoverage=96%, HitCoverage=4%, E-value=4e-14, Identity=82%"; Hit description=RNA helicase-like
TYLNFRSFKDITRFRPDLKLLISSATLDAEKFSDYFDSAPIFRIPGR

SEQ ID NO: 230874 - protein, 110 aa, Glycine max
  Coding DNA Sequence Number=SeqID_114096
  Gene Ontology: Mol. function=RNA binding; Cellular component=cytosol
  Homolog annotation: Hit_ID=Q2QQH7; Match level="QueryCoverage=96%, HitCoverage=20%, E-value=1e-25, Identity=55%"; Hit description =Pumilio-family RNA binding repeat containing protein, expressed
  Pfam annotation: Domain name=PUF; Domain location=13-46; Score=27.4; E_value=5e-05; Accession=PF00806.9; Description=Pumilio-family RNA binding repeat
  Pfam annotation: Domain name=PUF; Domain location=50-80; Score=24.4; E_value=0.00042; Accession=PF00806.9; Description=Pumilio-family RNA binding repeat
  Pfam module annotation: Pfam domain module=PUF::PUF; Domain location =13-46::50-80
MENPTASFKLHSQFKGNYTNLSMQKYSSHVVEKCLVHLAEIKSRIVQEFLSFPHFEQLLQDLYGNYVVQRALGVTKGFLHASLAEAVRPYKMLRTSPYCKRVFSRNLLNK

SEQ ID NO: 230875 - protein, 459 aa, Glycine max
  Coding DNA Sequence Number=SeqID_114097
  Gene Ontology: Mol. function=transporter activity; Cellular component= integral to membrane; Biological process=transport
  Homolog annotation: Hit_ID=Q9C9R9; Match level="QueryCoverage=93%, HitCoverage=97%, E-value=1e-111, Identity=50%"; Hit description =Putative transporter; 34935-36578
  Pfam annotation: Domain name=MFS_1; Domain location=11-394; Score =48.4; E_value=2.3e-11; Accession=PF07690.6; Description=Major Facilitator Superfamily
MKAETVTLLLVNLAGIMERADESLLPGVYKEVGTALHTDPTGLGYLTLFRSIVQSSCYPVAAYLAVRHNRAHVIAVGAFLWAAATFLVAFSSTFFQVTAVSYQQQGRGSGDWEGELEGEMEVVDKSSYVVLEDGNMEEEKAFNGIGLALVTPAIQSLVADSTDDSNRGMAFGWLQLTGNVGSIIGGLFSVLIAPITVFGIPDNGTNSRRQAPNKTFWSEVKDLVQESKSVLKISSFQIIVAQGVTGSFPWSALSFAPMWLELTGFSHEKTAFLMGLFVVASSIGGLFGGKMGDILSKRYPNSGRIILAQISSGSAIPLAALLLIGLPDDPSTIISHVGILAQHVYGYKPIPEGSSESQEILTDRENAASLAKSLYTAIGIPMALCCIIYTFLYRTYPRDRERAKMEALIESEMQLIESGGLAMDREFESEELSIVDYDDGDIDDDENTLLYRQLTLSKE

SEQ ID NO: 230876 - protein, 491 aa, Glycine max
  Coding DNA Sequence Number=SeqID_114098
  Gene Ontology: Mol. function=RNA binding
  Homolog annotation: Hit_ID=Q9C9R6; Match level="QueryCoverage=28%, HitCoverage=22%, E-value=5e-45, Identity=63%"; Hit description =Putative RNA-binding protein; 42664-44784
  Pfam annotation: Domain name=PUF; Domain location=305-339; Score =30.7; E_value=5.2e-06; Accession=PF00806.9; Description=Pumilio -family RNA binding repeat
  Pfam annotation: Domain name=PUF; Domain location=341-375; Score =33.2; E_value=9e-07; Accession=PF00806.9; Description=Pumilio-family RNA binding repeat
  Pfam annotation: Domain name=PUF; Domain location=380-415; Score =14.6; E_value=0.079; Accession=PF00806.9; Description=Pumilio-family RNA binding repeat
  Pfam annotation: Domain name=PUF; Domain location=417-451; Score =24.6; E_value=0.00034; Accession=PF00806.9; Description=Pumilio -family RNA binding repeat
  Pfam module annotation: Pfam domain module=PUF::PUF::PUF::PUF; Domain location=305-339::341-375::380-415::417-451
MRNEELGTWLNGFSNNNSILHRGHVTSPPQPQPSSSVFSMIHDDGVDIDAMLCSDFARMSVFHELGNVGAKTRGYGANVMDSSYPHAFLNSHSPCSFDAHAHVHEEMGTPLPTWGVSVPSDVKGHTFGPPMESSSHTQRSNTCYGHVPLQNPFHATRPFVVDCDVKKPIVFSQSQTMMQPKIAMNVNTPSSHCFPAAKERGTTSVAVTTNGDFSHSRGNTLGFQFDGGFVLQEKNVKCYAGRGCHSLWGCKESLPLLVQQAVGEELPQLIPPRVAPTRHEKNGILASDVSLSLRPLLYNFSPLSKFHGYIYYLAKHQNGCRFLQRMIDEGTSEHVLIVFNGVIDDVVELMVDPFGNYLVQKLLDVGGDDERLQVVSMLTKEPGQLIKTSLNIHGTRVVQKLITTVDSRKQIAMLMSAIQSGFLALIKDLNGNHVIQRCLQYFSCKDNEQFLNLLDTSSLGFSYFQAYVYLWSLQKFLKGKPTVEGTKFTIY

SEQ ID NO: 230877 - protein, 123 aa, Glycine max
  Coding DNA Sequence Number=SeqID_114099
  Gene Ontology: Mol. function=nucleic acid binding; Biological process= RNA-dependent DNA replication
MGCPLKMPQRRFSLKRTWSQTKRWRKERYWHLPRLYIDIPFIEKIGLRELEPTNISLHLAGRFMVYPRGVIEDVLVKVDKFIFPVDFMVLDMKEDQNVPIILGHLFLNTCDLIVEVRLGRLTL

SEQ ID NO: 230878 - protein, 62 aa, Glycine max
  Coding DNA Sequence Number=SeqID_114100
MGSRPITALEKAIKIQFGVVRESVGDDEGVVLPCRYDAGLPMLSEGERGRASLSQSVGCSVE

SEQ ID NO: 230879 - protein, 108 aa, Glycine max
  Coding DNA Sequence Number=SeqID_114101
MYIETTKQHKSKKEIEVEQHILALKIEVEQLAIPNNSNFSLARKHVTLRPQHEAQLRVVRQGLLSWKTVIKGSFKNSDRGYMVRNGFVQWKGIRLSTVEAFNLQQSGQ

SEQ ID NO: 230880 - protein, 130 aa, Glycine max
  Coding DNA Sequence Number=SeqID_114102
MVMWKPKLEDRISRNFHTKVSHGLSDKFWRCSKDLLEAKMAWRWRVEPSATKFGRSIHIDEVFQQTHIRKDTGEFVDERSMGTNLLVEKPRDDSMGLETLLVIIKVEIVASHKKGRHQVIVHLIQKRLSS

SEQ ID NO: 230881 - protein, 104 aa, Glycine max
  Coding DNA Sequence Number=SeqID_114103
MQPSVSPLFKDHDPLQFLQLQQRQTRLRKYLLVQELVLDSVQSQLVLIPLDLCKPKLIAPTPVVAKAPKADKENCSTQDQDQAQPAKDSSSATSFDQPTATMSF

SEQ ID NO: 230882 - protein, 248 aa, Glycine max
  Coding DNA Sequence Number=SeqID_114104
  Gene Ontology: Mol. function=transcription factor activity; Cellular component=nucleus; Biological process=regulation of transcription, DNA-dependent
  Homolog annotation: Hit_ID=Q45EZ4; Match level="QueryCoverage=59%, HitCoverage=45%, E-value=3e-41, Identity=61%"; Hit description=RAV -like DNA-binding protein
  Pfam annotation: Domain name=AP2; Domain location=27-92; Score=65.7; E_value=1.5e-16; Accession=PF00847.10; Description=AP2 domain
  Subcellular localization annotation: CTP_CleavageSite=24; ConfidenceScore=5.52e-01
MSATAQAPSSTPTVVSFLARPSPRNSSSKYKGVVPQSNGHSGAQIYKKHQRVWVGTFNEEDKAARAYNIVAQHFRGRDAVTNLKPFAAIAESEFLNSHSKFEILLHKHTYDNKLQHNTRGGRRRHNADTALSGVCDTKARFLHKLFTKGLDLSIIIRWCTVTVKSSVQADLGDINVKVLIWVSGTIVLLDGEVLLVGKEGGFHDTEEKASSPLRISQSSPLHGLLQANDSQVGFCCYVGSCACDCHNS

SEQ ID NO: 230883 - protein, 160 aa, Glycine max
  Coding DNA Sequence Number=SeqID_114105
  Gene Ontology: Mol. function=cation transporter activity; Cellular component=integral to membrane; Biological process=cation transport
  Homolog annotation: Hit_ID=Q2HRV5; Match level="QueryCoverage=46%, HitCoverage=14%, E-value=2e-32, Identity=88%"; Hit description=DNA repair metallo-beta-lactamase
MQAYHLLVNQRVNVLYLDTTYCNPKYRFPSKEEVLNYVVKITKNHLKIHPRTLVVVGAYSIGKECVYLAISKALGCFFIVTIYFLMLKCSLSVKHNFANQVLLAYGLSSSRRAPDAIHPYGYSKERFVWSLISAVGIFCLGSGATIVNGVQNLWIAQCYD

SEQ ID NO: 230884 - protein, 239 aa, Glycine max
  Coding DNA Sequence Number=SeqID_114106
  Homolog annotation: Hit_ID=Q8H042; Match level="QueryCoverage=77%, HitCoverage=76%, E-value=6e-51, Identity=53%"; Hit description =Putative disease resistance response protein
  Pfam annotation: Domain name=Dirigent; Domain location=87-239; Score =81.2; E_value=3.1e-21; Accession=PF03018.5; Description=Dirigent -like protein
MASTSETLGNKMAMGMGSLTAASLAMLVAFANLATTMATVDPTAATRKEHVIELYMHDILGGSNPIARSMTGLLGSIYDGQVPFAMPIGFNTQGTTIPNANGANPTVNGVFGIPLGTGLAGTSFAPNSSNNNNQNNAPLQLGPHGLRLSFGTIIVIDDILTSQPELGSQIVRKAQGVYMASSVDGTRQMMAFTALFEGGEYGKFNNARGFVELIALIPPGQIATDGAETLLRITIYLKH

SEQ ID NO: 230885 - protein, 141 aa, Glycine max
  Coding DNA Sequence Number=SeqID_114107
  Gene Ontology: Mol. function=nucleic acid binding; Biological process= DNA integration
MDDSNPFLIQTNDNPSLSLITHPLSDENYNSWKKAIKMALLGKNKFGFVDGSILEPPLEHFSHALWQRNDSIVASWLLNSLTKEIQVSIIHCCTAQAIWNDLNERFEQKNGPLIFQLKHELANLQQGSMSVSSYYSKLRSI

SEQ ID NO: 230886 - protein, 97 aa, Glycine max
  Coding DNA Sequence Number=SeqID_114108
MACVRLINSVNALQFAEWLLDGLAGFLIDFFIKKHLGNNEARLTYHALACKEITNLFYLLLYKNVVAAMLQWKWRTGSGGGSSYQKKLSKRVLKESS

SEQ ID NO: 230887 - protein, 61 aa, Glycine max
  Coding DNA Sequence Number=SeqID_114109
  Gene Ontology: Mol. function=structural constituent of ribosome; Cellular component=ribonucleoprotein complex; Biological process =translation
  Homolog annotation: Hit_ID=P30707; Match level="QueryCoverage=91%, HitCoverage=29%, E-value=6e-19, Identity=84%"; Hit description=60S ribosomal protein L9
MKSVEYLLLAEEISDLDGLVVANASFDRKMSVHESHFVSVSLGDAGDQILNVAEGGADGGG

SEQ ID NO: 230888 - protein, 192 aa, Glycine max
  Coding DNA Sequence Number=SeqID_114110
  Gene Ontology: Mol. function=carboxypeptidase activity; Cellular component=proton-transporting two-sector ATPase complex; Biological process=ATP synthesis coupled proton transport
  Homolog annotation: Hit_ID=Q1S5R9; Match level="QueryCoverage=82%, HitCoverage=34%, E-value=5e-33, Identity=48%"; Hit description =Peptidase M14, carboxypeptidase A
MLRNFTDCATMFLFYFRNVAELYGLPNDRVKYLEAFYPLPFPPSPKTELPHSIPTTTIPQSSFLLPHHLLRQEKAYETPCDYFDGKWIRDRRGLLNNSTTCGTIKEGQNCITCGRPDSGYLYWRWKPSQCSLPRFEPQTFLQLISNKNVAFVGDSMPGNQLESLLCMISTGSTPNLVYRNGDDNITVLSIGH

SEQ ID NO: 230889 - protein, 281 aa, Glycine max
  Coding DNA Sequence Number=SeqID_114111
  Gene Ontology: Mol. function=DNA binding; Cellular component=beta -galactosidase complex; Biological process=DNA integration
  Homolog annotation: Hit_ID=Q1RSZ9; Match level="QueryCoverage=64%, HitCoverage=13%, E-value=8e-45, Identity=48%"; Hit description =Polynucleotidyl transferase, Ribonuclease H fold
MQHPRIPHLDIVHNLLQYIKGTPGQGLYFPASNSFNLSAYADADWGGCLDTCRSTSGSCVFLGDVLISWKSKKQTTVSKYSAKTEYRALSSVSSEVIWLRRLLLHFEISIKSTMLFCDSKFAISLASNPAHHERSKHIDIDYHFICELVQSNTLKLVHVKYQHQVADIFTKPLMLLAFSSFTRGKQMNAKRREDMVGVLPKRKILMRYGESQGNQDTTAYTIIPDHDIRSTAQGMTQALRASEHLYRLIGSDSYSLDWRVQFCVCPTPAPDRCSVSLDGVS

SEQ ID NO: 230890 - protein, 118 aa, Glycine max
  Coding DNA Sequence Number=SeqID_114112
MPFIGLRSFWERQGYARDGECRRGTRALGGFFKMRCWIISRSSFAQKRGNDSMERNMNALPYEAKVALVNLVTKEDEVGDEVCHFGAKAFATGTFDATVIETLLALIPKGDVSKTFIL

SEQ ID NO: 230891 - protein, 134 aa, Glycine max
  Coding DNA Sequence Number=SeqID_114113
  Gene Ontology: Mol. function=microtubule motor activity; Cellular component=microtubule associated complex; Biological process =microtubule-based process
  Homolog annotation: Hit_ID=Q9SDK0; Match level="QueryCoverage=39%, HitCoverage=40%, E-value=2e-16, Identity=73%"; Hit description =Putative dynein 8 kDa light chain, flagellar outer arm
  Pfam annotation: Domain name=Dynein_light; Domain location=72-130; Score=51.9; E_value=2.2e-12; Accession=PF01221.9; Description=Dynein light chain type 1
MLLRRRRFDKTTPLATALPQKLTHHQSSFRETERKMSEDAKKNIAGALTARPNSDDQKPSPLPSPAPAVPPKKVIIKSADMIPDMQKEAVDIAVAAFEKYNVEKDVAEQIKKEFDKRHGPTWHCIVGRNFVEIE

SEQ ID NO: 230892 - protein, 186 aa, Glycine max
  Coding DNA Sequence Number=SeqID_114114
  Pfam annotation: Domain name=DUF590; Domain location=1-139; Score =16.0; E_value=4.4e-10; Accession=PF04547.3; Description=Protein of unknown function, DUF590
MSQNFTNCLTMSAKYLEVVKRGSHPNNRWFLDEIRNNLMEIRTDALKLLVILRRHVPRAAATVGVWLNIFQFLILMSICTNCAILAWLYDEEGKWKIEPGLASILIMEHVLLLTKFGFSRFFPEMYHITTIEQIETIDLKPIFLLVFGPQEQNLRSQGGSGNMIFKSGPFFISSKAKGRGEMNVVD

SEQ ID NO: 230893 - protein, 478 aa, Glycine max
  Coding DNA Sequence Number=SeqID_114115
MDHNMVCEATLVSWLLPSQDLVAMNVDGRVLGDPSRLGFGGLGMEHSSKHRNKIEWGCSIESDDRDDVDKWSRTLAGNQASPIQAVPSLLGQGGKIQDSLITTGQLNMAPMSNIQMAMPSTRKSLSAIGQIGLPPLRQPAETMRKYFGIQLKPMEGLVYRKPYLEWVDKKLRKKLVAQECSYMNQLASRAIGMKHFNRGKEQKWASKGQGLHLVPFVDTDEYDAITIPKKAEIMANEIVKGKPYYSSVLKVAKTKKSTTVSAVGRLKSLIPRPAWTPHEMVKGHNSSKCLCQLGLVLNPGVRMSIIDDEPILDGGKQMTKFKVENGIRILEINVKNSDYPSGQIFKPFASFQEGEWIVNREKERLIPTRTFTKMQKRRFKRKKPSNKMKQALSLIGEVKGKGSNDVSSSEVIKALQKAFSLEEGSLVASFNKEQHIEEEGELNKVYQKDKEEELCVDLTDKMVHPIDSLSQLIDPVLD

SEQ ID NO: 230894 - protein, 126 aa, Glycine max
  Coding DNA Sequence Number=SeqID_114116
  Gene Ontology: Mol. function=aspartic-type endopeptidase activity; Biological process=proteolysis
MGRHLKPFYIRAHINNKTLSQVIVDGGDVLNAMPTNTLKKIGKGMENLTTTNMKMINFTAGDTHALGVLVIDITVGTKTKKTILFVVDAKPMYTCYDTIASVGSLDDTALASSPKKTSALALGLQY

SEQ ID NO: 230895 - protein, 189 aa, Glycine max
  Coding DNA Sequence Number=SeqID_114117
MSPTKGRGEELTIGDRRRWAYVKRVWPVNNRNTLGNKWIRSNDPKEMNGARSCGLGCGSYFIISYPGILSRCKGIKPEVIKEYTVEEEVEIKGDPSLSRTVASLKAMLKELKRGNEAYYVELGMLTLYDLDLQRTVEGLEGVLEEYAELFQEAIELPPTRRCNHAVEIRAGSQIPYIRPYSYPHHQKEE

SEQ ID NO: 230896 - protein, 116 aa, Glycine max
  Coding DNA Sequence Number=SeqID_114118
  Gene Ontology: Mol. function=microtubule motor activity; Cellular component=microtubule associated complex; Biological process =microtubule-based process
  Homolog annotation: Hit_ID=Q96FJ2; Match level="QueryCoverage=48%, HitCoverage=64%, E-value=4e-18, Identity=70%"; Hit description =Dynein light chain 2, cytoplasmic
  Pfam annotation: Domain name=Dynein_light; Domain location=33-113; Score=76.7; E_value=7.2e-20; Accession=PF01221.9; Description=Dynein light chain type 1
MSEEAKKNFAGALTARPNSDEPKPAPVPAVPPKKVIIKSADMIPDMQKEAVDIAVAAFEKYNVEKDVAEQIKKEFDKRHGPTWHCIVGRNFGWSLFALKSVIDSVSWLEFRSDAET

SEQ ID NO: 230897 - protein, 149 aa, Glycine max
  Coding DNA Sequence Number=SeqID_114119
  Homolog annotation: Hit_ID=Q9LUQ4; Match level="QueryCoverage=79%, HitCoverage=17%, E-value=9e-57, Identity=84%"; Hit description =Arabidopsis thaliana genomic DNA, chromosome 3, P1 clone: MJK13
  Pfam annotation: Domain name=DUF580; Domain location=1-149; Score= -125.6; E_value=0.018; Accession=PF04515.3; Description=Protein of unknown function, DUF580
VAAKVIGEVQALIIFPLIPYAILAVFYMFWISAALHLFSSGEVVQNNCNSNCCTYDLIAKRVKCDRCCGYSIHYTPHIGVAILFHLFGCYWATQFFIACSSTVIAGSVASYYWARGETSNCVYTWVKWSCLVKLLNKQALIREENKNVK

SEQ ID NO: 230898 - protein, 72 aa, Glycine max
  Coding DNA Sequence Number=SeqID_114120
  Pfam annotation: Domain name=DUF581; Domain location=36-72; Score =21.9; E_value=4e-05; Accession=PF04570.5; Description=Protein of unknown function (DUF581)
  Subcellular localization annotation: CTP_CleavageSite=43; ConfidenceScore=5.46e-01
MVGLSVVLEAQKGSVSKKTPQVINKTTMLSSSNINNNKHSSSSSSEAAAKFLDQCFLCRKRLLPGKDIYMYK

SEQ ID NO: 230899 - protein, 253 aa, Glycine max
  Coding DNA Sequence Number=SeqID_114121
  Gene Ontology: Mol. function=nucleic acid binding; Cellular component= membrane; Biological process=DNA integration
  Homolog annotation: Hit_ID=Q1T010; Match level="QueryCoverage=93%, HitCoverage=22%, E-value=1e-59, Identity=41%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
MSSLSVQLSMACNDAEEIEEFKALMKTEFEMIDLGKLAYFLGMEFVTVLSRIILHKKKYAMEVLKRFNMTNCNASITLAGVGVKLDNTSKDDELVDPTLFKQLIGSLRYMCNNKPDISFIIGLLLAAPISWCSKKRLVVSLSTYKAEHIAGSFVACQAIWLDSLLTELRIKLKKPIKLFVDNKFAIDLAKNPVSHERSKHIETKFHFLKEQVNQSVIIVVYCPTESRVIYVMTKAAKIERFEKLRKALGVVAF

SEQ ID NO: 230900 - protein, 105 aa, Glycine max
  Coding DNA Sequence Number=SeqID_114122
  Homolog annotation: Hit_ID=Q9LUQ4; Match level="QueryCoverage=71%, HitCoverage=11%, E-value=3e-16, Identity=63%"; Hit description =Arabidopsis thaliana genomic DNA, chromosome 3, P1 clone: MJK13
MQPEIPFLSVFSSMKRLMRYSLGSVALGSLIVSFVESIRFLLEVIRRKLKVSSHRHDSCLGKAAYQSSQCFLSMCFVIVVQVRPMEVKADSLVPVAFMIDVFLRG

SEQ ID NO: 230901 - protein, 593 aa, Glycine max
  Coding DNA Sequence Number=SeqID_114123
  Homolog annotation: Hit_ID=Q9FJ23; Match level="QueryCoverage=99%, HitCoverage=63%, E-value=1e-171, Identity=52%"; Hit description =Arabidopsis thaliana genomic DNA, chromosome 5, TAC clone:K21P3
  Pfam annotation: Domain name=Filamin; Domain location=407-471; Score=- 18.9; E_value=0.06; Accession=PF00630.9; Description=FilaminABP280 repeat
MYPSLCVASWKGVRHEFEAGSKATIMVLLKDAFGNSISQTSEVSYLPDFKLYVLHENGSVASAPDISNIGWNEFDYVVIEFVVTIAGKFFLSLEGGNQTLNGSPLPLKLDISLPQITGTIDVSNCIAKWNIESHAWQLASKMEIFIHQLDQYGNLVSGLYPFDSEVVERDTNLSIPISDLHFEEVDAGIQLFSFSNLEPGNFLLTIYDSKHDKSISNMPYVYTVFIGYCDGVKSVVNGSGLNDSVAGVKAEFSVYLNDIYQYPSPIEANILQVQILRENDSYSASPIIYPMLNNNASTIASRVRYDGISHMETAPSPSIELGNNPNGSGSFVMASAFHVKYIPEKSGFYDINIHCGNVLLNEGHSFRKEVKAGEVNVSLSSVVRFSSKVPKLSKNEIVVQLVDSYLNPVLSQQSRLKLEIAASTNSSGFLTLDIKDNKDGSYSCSYMAKDVGTYEICASFDGKRFLSCPFSINVYSCEYFPKANNDTISIWEDQSIALDALANDYFAGDKASIVEFSKPDHGSLMQNGRIFRYTPYKGYYGNDSFWYTISDINGNLATAFMYISVLNVPPQFVSVPNQLQATEDLISPRFGYV

SEQ ID NO: 230902 - protein, 528 aa, Glycine max
  Coding DNA Sequence Number=SeqID_114124
  Gene Ontology: Mol. function=drug transporter activity; Cellular component=membrane; Biological process=multidrug transport
  Homolog annotation: Hit_ID=Q1S7F1; Match level="QueryCoverage=92%, HitCoverage=82%, E-value=1e-109, Identity=41%"; Hit description =Multi antimicrobial extrusion protein MatE
  Pfam annotation: Domain name=MatE; Domain location=282-444; Score =148.7; E_value=1.6e-41; Accession=PF01554.9; Description=MatE
  Pfam annotation: Domain name=MatE; Domain location=30-190; Score =109.8; E_value=8.1e-30; Accession=PF01554.9; Description=MatE
  Pfam module annotation: Pfam domain module=MatE::MatE; Domain location=282-444::30-190
MVAEGKSQKPYPTAAEVVEELKRMGDIGVPIAAMSLAGYIKNMVLVVCMGRLGSLELAGGALAIGFTNITGFSVLSGLAMGMEPLCTQAFGSRNFSLVSLTLQRTILMLLAASLPISLLWLKLEPLMLWLHQNPEITKVASVYCFFSIPDLIANSFLHPIRIYLRSKGTTWPLLWCTLLSILIHIPIVAFFTFKLHLGVPGIAMSAFVANFNTLFFLLSYMLYMRVSKGSLSMPLLLSSTCQLPSPSPQQQQQQHHHQDQTSLKTTTLGKEWGMLIRFSIQSCLGVCLEWWWYEFMTILAGYLYNPRVALATAGIVIQTTSLMYTLPTALSASVSTRVGNELGAGQPERAKLSTIVAIGLSLASSILGLLWTTIGRERWGRVFTSDSEVLELTMSVLPIIGVCELANCPQTTSCGILRGSARPGVGAGINFYSFYLVGAPVAIVIAFVWKLGLVGLCYGLLAAQIACVVSILVVVYNTDWERESMKAKSLVGIFKSSCDHDHHYGDQTVKCEEGLLSFSMRKNSDQKK

SEQ ID NO: 230903 - protein, 131 aa, Glycine max
  Coding DNA Sequence Number=SeqID_114125
  Gene Ontology: Mol. function=protein serine/threonine kinase activity; Cellular component=cytoplasm; Biological process=protein amino acid phosphorylation
  Homolog annotation: Hit_ID=Q7XZK5; Match level="QueryCoverage=87%, HitCoverage=30%, E-value=3e-35, Identity=49%"; Hit description =Calcium-dependent calmodulin-independent protein kinase isoform 1
MDSEPWPSISEAAKDLVRKMLTCDPKERITAADALEHPWLKEGGEASDKLPDSAVLIRMKRFRAMNQMKKLALKADIDQSKTIDYFEFIAATMDRHKVEKEESLFKAFQYFDKDNNGLLFSSLDRSSIYTA

SEQ ID NO: 230904 - protein, 346 aa, Glycine max
  Coding DNA Sequence Number=SeqID_114126
  Gene Ontology: Mol. function=sugar porter activity; Cellular component=integral to membrane; Biological process=carbohydrate transport
  Homolog annotation: Hit_ID=Q6BDD4; Match level="QueryCoverage=83%, HitCoverage=53%, E-value=1e-80, Identity=54%"; Hit description =Hexose transporter HT2
  Pfam annotation: Domain name=MFS_1; Domain location=59-327; Score= -29.7; E_value=0.0072; Accession=PF07690.6; Description=Major Facilitator Superfamily
  Pfam annotation: Domain name=Sugar_tr; Domain location=28-335; Score=- 42.3; E_value=1.5e-05; Accession=PF00083.14; Description=Sugar (and other) transporter
  Pfam module annotation: Pfam domain module=MFS_1::Sugar_tr; Domain location=59-327::28-335
MAVGGFSLDASSANNGFDGKITLSVVITCIVAASSGLIFGYDIGITAINGPTRNPNRQAVVITVPVTGGVTTMKPFLEKFFPAILKKAASAKTNVYCVYDNQLLTLFTSSLHLAGLVSSLLASRVTTALGRRNTMIFGGCIFFAGGAINGAAENIAMLILGRILLGLGVGFTNQATPVYLSEIAPPKWRGAFSTGFQFFVGMGVVAANCINYGTARHPWGWRVSLGLATVPATIITIGAFLIPDTPSSLVERNQIPQARNALRKVRGPTADVELELQHVIQSSQTFKKYNERNNIWVDRSHNRLNPRCWPRPSPCPCQPLIVAPCTNPKHPDPEEKSSHQSTCTIT

SEQ ID NO: 230905 - protein, 1141 aa, Glycine max
  Coding DNA Sequence Number=SeqID_114127
  Gene Ontology: Mol. function=RNA-directed DNA polymerase activity; Cellular component=chromatin; Biological process=RNA-dependent DNA replication
  Pfam annotation: Domain name=Chromo; Domain location=982-1030; Score =13.6; E_value=0.024; Accession=PF00385.14; Description='chromo' (CHRromatin Organisation MOdifier
  Pfam annotation: Domain name=RVP_2; Domain location=221-329; Score= -31.4; E_value=0.00028; Accession=PF08284.2; Description=Retroviral aspartyl protease
  Pfam annotation: Domain name=rve; Domain location=792-970; Score= -0.1; E_value=0.0061; Accession=PF00665.16; Description=Integrase core domain
  Pfam module annotation: Pfam domain module=Chromo::RVP_2::RVT_1::rve; Domain location=982-1030::221-329::455-631::792-970
MADHAIRKTTTDRLEDAIARLSNSQASLTDKYTELSGKVDSILDHLRLNHVKLDIPRFDGRDPLGWIFKITQLFDYQNTPEEERITVACFYLDGAALSWLSNPGLPSPFMLSCFISGLSSEIRREVLALQPISLPQATALAKLQEDKLKDRRHSSNRPNNFPPPPNHTNHPSSKPKPPFVQRTTEEIAFRREKGLCYNCDEKWSATHRCFPSSETFRLFGVINLACLTILIDSGSTHNFLQPRIAQFLHLPVQSTPPLRVLVGNGSVLDCNQLCPDTSLSLQGHHFNVTFHLLPISGADAILGIEWLKQFGPVITDYTSFIMKFNHLGQAIELHTDVMNGLEPVSAPQVKHLIRTGSTSALFHLSLLPTNHPDPPQHHLPHPVPAIEALLHHYQHIFQTPPTLPPLREVTHRINLLPSTSPVNVWPYRYLHFQKTEIERQVSDLLSAGLIRPSTSLYSSPVLLVKKKDDTWRMCVDYRTLNAVTIRDHFLIPTIDELLDELGQASWFSKLDLRQGFHQILMHEPDIEKTTFRTHQGHYEYCVMPFGLSNAPSTFQAAMNNLLTPFLNYASIATPLTTLLCKDAFEWTEDSQAAFDQLKMAMTCAPVLALPNFSEPFVVETDASRTTMGAVLMQKGHPIAFFSKVFGPRLTHASTYIRELYAIVVVVRKWRLYLLGRSFTILIDHKSLQELMTQVIQTPEQHYYLSKLLGFDYTIHYKAGVSNIIADALSRLPSTLGQLLLLLVPHLEFIEDLQRMLHAEPEFQALLSKSSFFWHGLKDDVKRFIRECKPLPIPTGIWEDISMDFVTNFPPSHGFTVILVIVDRYSKGVHLGALPTHFSAFKVATLFLDLVCKHHGFPRSIVSDRDPQTVAGVTTLYPWDDQQRGDAKRDDITYAAGQWVYVKLRPFRQRSVAGTTHPKLSKRFFKPFQITARIGQVAYRLQLPDNARIHPVFHCSLLRAHHDPPPLSLDTWPLHVVGHKPVPRPLCFLDSKIDNSTSPPTRLVLTQWVGQPLDDTTWEPWPKLRDAYHLEDKVVFGDGSNDSSIVHKSEAPRPRREIITPKYLHDYVILDFGVMRSMRSSVTGLYCIMIAIGSYAGTVVVTLMHKYSGSKERNWLSDRNLNRGRLENYYLLVSGIQVLRDY

SEQ ID NO: 230906 - protein, 89 aa, Glycine max
  Coding DNA Sequence Number=SeqID_114128
MRCSPKRTKEEKKTQWEVGTNTQRCFCICCKLKAKVPRGWGKDISRFLVARVLRTTCRLEHVFQACQAWNVDYGGDKHQAVLYGTPDII

SEQ ID NO: 230907 - protein, 158 aa, Glycine max
  Coding DNA Sequence Number=SeqID_114129
MGKDWGPGTADAGYTDKSSLSTALGPYGWPPVGQPNATCRVPSPACEQRWILEMMAGVKVAVMSFVGVTDTRENWQRPVIKAGVATYPSAGGQRVTRGCVFQERNTREVATNVYLRKTSEKSEKGAEFVSARLSLNLPADERMSSGPPTLMTKGVEDD

SEQ ID NO: 230908 - protein, 119 aa, Glycine max
  Coding DNA Sequence Number=SeqID_114130
MIEIEEVQEQMKADMEAMKEQMTTMMEAIFSMRKMMEVNTATAIVASTATKMDPTQPSGLNQVGAPLGSTGGPHFVQVQSKHSFPPYGLPPNYTPPNVAHPLDENVDNSTPVPIESQQP

SEQ ID NO: 230909 - protein, 193 aa, Glycine max
  Coding DNA Sequence Number=SeqID_114131
  Homolog annotation: Hit_ID=Q9FJ23; Match level="QueryCoverage=69%, HitCoverage=15%, E-value=2e-40, Identity=59%"; Hit description =Arabidopsis thaliana genomic DNA, chromosome 5, TAC clone:K21P3
MEVNDGFLVTNLPVHLINTTELKHRYNYQWQPLQTYVTISKHFIVKAHGIRFLGTVNDCNSVMQQLFYHGGERGAVLTLTLNDMGNYGCYPDCAEGMSMPLYTEAIVNLMRKQPMSSFLAHTLGSIIVIEFVIMSSLGVLLLYFTCKCAILLAQERRNREKRSSELSTSQSSHRETEIVKKINSIVLAQIHLT

SEQ ID NO: 230910 - protein, 407 aa, Glycine max
  Coding DNA Sequence Number=SeqID_114132
  Gene Ontology: Mol. function=nucleic acid binding; Biological process= proteolysis
  Homolog annotation: Hit_ID=Q8H6Q8; Match level="QueryCoverage=66%, HitCoverage=47%, E-value=1e-31, Identity=37%"; Hit description=CTV.20
  Pfam annotation: Domain name=zf-CCHC; Domain location=301-318; Score =20.8; E_value=0.00036; Accession=PF00098.13; Description=Zinc knuckle
MPSKLYFQRPTAPNLLLDEKGKCNFKIFSANNIYEWNIDAQMEYNIMNTLQHMTMVAMAYQTSHECSEETIIDILVAGFSGQLKGCTVKMDLNGKVITNDDNKEIPDAINTYIFTIAQHFIGDPSLWKDRSIELLSNLKCRTLVDFRWYRDTFLTRVYTREDSQQPIWKEKFLAGLPRSLGDKVRDIIRIQSVNGDIPYESLSYGQLISYVQKVALKICQDDKIQRQIAKKKAQKKRDLGSFCEQFGLPACPKQKKKQNHRKESHENKTFNKKRFPRRRYWHKPSTSKENDTPKPKIKPKITCYNYGKQGHIRKYCRLKRKLRNLNLEPKIEEQINNLLIETLEEEIETSSSTFSEDNLNIIQQDDQPSSRDDDEREINTLTREQDLLLEAINSILDPQEKKVFRKN

SEQ ID NO: 230911 - protein, 90 aa, Glycine max
  Coding DNA Sequence Number=SeqID_114133
MRITFTASVRQDLCPLRWGPHLTLERDPKQFAWEWGVWDRNGNVWRCKGCEYWRGKWVIILKKVAYMICLILLMNMEGGGKKEGRRKKPN

SEQ ID NO: 230912 - protein, 75 aa, Glycine max
  Coding DNA Sequence Number=SeqID_114134
MENGEEKERERGKAKKAKGKLVIAAIPSTHGKMRKIYNQIGQTNENSAIVKIFLSVDTYPPSYLVTFGTRIDVCE

SEQ ID NO: 230913 - protein, 209 aa, Glycine max
  Coding DNA Sequence Number=SeqID_114135
MQATSTPSWRHLWYWLRKNTYLLTPDTVGCPLISERLRLLCVFPIEGALISSQITSMAQSNSSRLGFLALITALCRSKGVASVRLVFERLSPVINLAYIRKNYWNPDDLIVTIRGAKRARARPVEAPSTSAAPPPARTSAAPSTPPSADFQRLEDMLRSIHQGQIVLLQSLQLVAPPDFIPSVEQFNEWVAWPGTQPPLHREDEGPTTQ

SEQ ID NO: 230914 - protein, 58 aa, Glycine max
  Coding DNA Sequence Number=SeqID_114136
MALNILLSSMLSPQWFFFDMFHFADLPCCCCCTMLKRHVKRIHPHVGDLHGVESTYMA

SEQ ID NO: 230915 - protein, 130 aa, Glycine max
  Coding DNA Sequence Number=SeqID_114137
  Homolog annotation: Hit_ID=Q1RVN6; Match level="QueryCoverage=67%, HitCoverage=15%, E-value=2e-07, Identity=30%"; Hit description =Integrase, catalytic region
MARTMLNDNSTPKHLWAEAGFKVYNSRTLVVEEAIHIKFDKNKLDKDLSELDKSFVDLRLDDNYIETSSSRKNPKTEASTQQEVQEEARAMQEELDQFQKNDVWKLVELPKGKKVVEVKKGLLQQTGQKW

SEQ ID NO: 230916 - protein, 158 aa, Glycine max
  Coding DNA Sequence Number=SeqID_114138
  Gene Ontology: Mol. function=DNA binding
  Homolog annotation: Hit_ID=Q1SWX1; Match level="QueryCoverage=86%, HitCoverage=30%, E-value=1e-10, Identity=31%"; Hit description=IMP dehydrogenase/GMP reductase
GAIKWVNFNGKPFAKPMDFQLVSTVKEFEEILGCPLGGRKPYLFSGFYPSTTRVAKYQESVLRKGQRPWQIKANGLSFIDILALLIFGVVLFPNMEGLVDLAAIDAFLAFHHGKESPIVAILAMYDTFDRGCEKSSARIVCCALALYVWLVSHLFLQE

SEQ ID NO: 230917 - protein, 262 aa, Glycine max
  Coding DNA Sequence Number=SeqID_114139
  Gene Ontology: Mol. function=RNA-directed DNA polymerase activity; Cellular component=signal recognition particle, endoplasmic reticulum targeting; Biological process=RNA-dependent DNA replication
MGVKHFEVFKRRSHADKQWSLDEIRECVIHLIIEVIEVVGKMKEKEGLRDLGQQSMKEEIKRKKNNREDNMEGENLKILNFQMKCDSKAYIEWEMKVKQIFACHEYSEEKKIMLATMGFDDKALTWSKLEENARERIRKPKIATWKEIKEFIRKIFLPPYYEKYVYDRLQNLTKGSKSLEEYHKEMIMTIRKANVQEPKTSITRFLCGLNKDIRCIVKLQHYKSLEDMVHQAKKVERRLERKHSYKKTYHHDSSRGKDKSKK

SEQ ID NO: 230918 - protein, 145 aa, Glycine max
  Coding DNA Sequence Number=SeqID_114140
  Gene Ontology: Mol. function=ATP binding; Cellular component =membrane; Biological process=cellular response to phosphate starvation
  Homolog annotation: Hit_ID=UPI000068D371; Match level="QueryCoverage =95%, HitCoverage=43%, E-value=3e-59, Identity=80%"; Hit description =phosphate starvation-inducible protein, PhoH
  Pfam annotation: Domain name=PhoH; Domain location=1-145; Score =222.3; E_value=1.1e-63; Accession=PF02562.7; Description=PhoH-like protein
MALRDKEVKRIILTRPAVEAGESLGFLPGDLKEKLDPYLQPLYDALRDMIPHEKLEGFMEKKVIEVAPLAFMRGRTLDDAFVILDEAQNTTHAQMKMFLTRMGMNAKFIITGDPTQIDLPRNQQSGLKEAMRILHGVNEIVLWIL

SEQ ID NO: 230919 - protein, 160 aa, Glycine max
  Coding DNA Sequence Number=SeqID_114141
  Homolog annotation: Hit_ID=Q0PEL6; Match level="QueryCoverage=47%, HitCoverage=5%, E-value=5e-12, Identity=49%"; Hit description =Putative integrase
MVQPTNPRSSPRFSTKCGKMSLIAGCKRLSWYLDSGYLWYMTEERFMFQCLTPYHGGTVTFGGNKKGRITEVGLKHNLLSISQLCGNDMVCPSIRMIMSFYVKMGLLYVDKGGDCRQRIKLNVLMMPKVHMRLKALFKTKKLKIFKMNDQDKSLVLERVY

SEQ ID NO: 230920 - protein, 82 aa, Glycine max
  Coding DNA Sequence Number=SeqID_114142
MIRDLGKKSFQQAHALMYDTLENDSKKPLYLRCKKSLTLLLAVLSLVNVKARYGYSDISFTLLLQVVQEMLPEENTLPKIYY

SEQ ID NO: 230921 - protein, 51 aa, Glycine max
  Coding DNA Sequence Number=SeqID_114143
MHEWKSNNGALGWRIDEQLKAINSWGARLDGGGCMNDNQFMWLGIRFEGGG

SEQ ID NO: 230922 - protein, 321 aa, Glycine max
  Coding DNA Sequence Number=SeqID_114144
  Gene Ontology: Mol. function=chitin binding; Cellular component =extracellular region; Biological process=chitin metabolic process
  Homolog annotation: Hit_ID=UPI00006A17C9; Match level="QueryCoverage =98%, HitCoverage=100%, E-value=9e-38, Identity=28%"; Hit description= UPI00006A17C9 related cluster
HALPFRGQDALTFRGITVLTFRGQHAFTLKGLHALAFRGQHTLTFRGLLVLTFRGQHALNLKCLHVLAFKALHVLPFSGVHVLTFRGLHILAFRGLHMLTFRGLHLLAFRGLDSLTLRVLHVLAFRGLYALAFVWLHALPFRGLHRVHALTLKGLQVLAFRGLHTLAFRGVHALAFRGLHVLTFRGLHVLTFRGQHALTLKGLHALAFRGLHTLTFIGLLVPAFKGLHVLTFRGLNVLTLRVLHALTFRGLHVPAFRGLHVLTFRRLHVHAFTGIDALTFRVLHVLAFMGLHALPFRGLHALTFRGLHVPAFRGLHVLTFK

SEQ ID NO: 230923 - protein, 175 aa, Glycine max
  Coding DNA Sequence Number=SeqID_114145
  Gene Ontology: Mol. function=exopolyphosphatase activity; Cellular component=membrane; Biological process=SRP-dependent cotranslational protein targeting to membrane
  Homolog annotation: Hit_ID=Q0XES4; Match level="QueryCoverage=83%, HitCoverage=28%, E-value=2e-39, Identity=57%"; Hit description =Exopolyphosphatase
  Subcellular localization annotation: CTP_CleavageSite=4; ConfidenceScore=5.06e-01
MALAAANLPQPCRRPPFAHALFQSPRKPPGRHRHWLQQLPAGHGPQRRRKGTAVQPPQGSHTPGQRPGRTGSPESGGHAAWLGLPGALCAGAGRPAPPPRSCRGHADAERGIEPTGLPGRGPAHPGLRHRSHRRRGRSTPDLSRRRPVAPTRSPAAAGGGHRWPIDRAVPWPAAA

SEQ ID NO: 230924 - protein, 258 aa, Glycine max
  Coding DNA Sequence Number=SeqID_114146
  Gene Ontology: Mol. function=protein binding; Cellular component =cytoplasm
  Homolog annotation: Hit_ID=UPI00005F72AB; Match level="QueryCoverage =61%, HitCoverage=96%, E-value=5e-62, Identity=74%"; Hit description =COG1956: GAF domain-containing protein
  Pfam annotation: Domain name=GAF; Domain location=122-250; Score =19.0; E_value=0.011; Accession=PF01590.16; Description=GAF domain
QTGVDARAEQADADQRFGEGERHQQQHGDRHGGQARHRPVAAVHYLGVAARAIGGLVAAERRQHEQQIALAAALVARFGKGGGPKLWASGHLHCFNGYHMTKEQFYAELKRDLSALLGGETNFIAALSNASALLNERLDDVNWVGFYLMDGGQLVLGPFQGKIACVRIPVGKGVCGTAVAENRVQRVGDVHAFPGHIACDAASNAEIVLPLAVGGRAIGVLDIDSTVYQRFDEQDEAGLKAVVAGLCEQLEQCDSAKY

SEQ ID NO: 230925 - protein, 102 aa, Glycine max
  Coding DNA Sequence Number=SeqID_114147
STLEDPTKMDGILISSGVVLAEVLLADSRFTRPDMGFHPTKLNFVPSDADEAPLDVSICLHAFGIVGCGSFSGVKSCEREDPFHPGLFVGDAGGFQSPPREP

SEQ ID NO: 230926 - protein, 488 aa, Glycine max
  Coding DNA Sequence Number=SeqID_114148
  Gene Ontology: Mol. function=acid phosphatase activity; Cellular component=dynein complex; Biological process=chitin metabolic process
  Homolog annotation: Hit_ID=UPI00006A17C9; Match level="QueryCoverage =99%, HitCoverage=100%, E-value=2e-43, Identity=31%"; Hit description= UPI00006A17C9 related cluster
HSNLQRTTRPHYERATWSYLQRTTRPRLQKDSGSHLKRTVGPHLRGLRTLTFRGLHILTFRGLHALTDRGLHVLAFRGLHALTFRGLHVLTFRGLRALTFRGLHVLTLRGLHALTFRAINILTFRGLHALIFRGLHVLAFKRLHALSVKGLHVLTFRGLHTLTFRGLHILTFRGVHALTIRALHVLPFRVLHALTFRVLYALTFRGLHILTFKSLLTLNFQGLHVPTLIGLHAVTFKRLHALDFRVGLRNLTFRGLHILTFRGLHALTNRGLHVLAFRGLHALTFRGLHVLTFRGPRALTFRGLHVLTLRGLHALTFRAINILTFRGLHALTFRGLHVLAFKRLHALSVKGLHVLTFRGLRTLTFRGLHILTFRGVHALTIRGLHVLPFRVLHALTFTVLYALTFRGLHVLTFKALRALNFQGLHVPTLIGLHAVTFKRLHALDFRVLHAFTFNGLHVVTFRGLRAFTFRGLHVLTFIRLHVLTLRGL

SEQ ID NO: 230927 - protein, 109 aa, Glycine max
  Coding DNA Sequence Number=SeqID_114149
MEDARTALGNQFVGLGTRRWYLKLPQKHKAPIHWIPPYFLHQKLENIFIYEFSSLPTLMQAPLELVGLGSSSSMDSFASWKINGSGMGKEEREETPLQGEDESRRSSPP

SEQ ID NO: 230928 - protein, 181 aa, Glycine max
  Coding DNA Sequence Number=SeqID_114150
MARTKKTGQMTYETVKEIANKIDVLTVAIGRLEHPGRVRAAGAGITIKQYFGPAPRTSRMSSSVALEDLEQIQSQFQSQMQSQGLALPPEPEVGHSTAHVSTKESCVDSLGNNPDMSDLETYGLYIKENPLCLVTLGKLYEESTTVHNIPLRHDQVKVGVEEVRDADASIPVPNEEVQLVR

SEQ ID NO: 230929 - protein, 133 aa, Glycine max
  Coding DNA Sequence Number=SeqID_114151
ISPSAPTSRLPNRNGIKPNRIPTPSPIQYAGDAQQNKKRVGNVTAGILAAAGVSLYQIAGVVMKLTDKIRRVAILCRRSGDVGRELLAGGICYSPPSGRRGVISPARRGSPGKARAVGGVAFQRQLDQAAYQA

SEQ ID NO: 230930 - protein, 118 aa, Glycine max
  Coding DNA Sequence Number=SeqID_114152
MDGIDGENKCTTIGMERKTQTGALVDKKTQTGELASCNTGEKMNIHLKISMQQGQANILIARFPDPNYGVKTKPLPCQNEGDLVWISENKASNSALGQTPTSLHERAESISGFTRNVI

SEQ ID NO: 230931 - protein, 105 aa, Glycine max
  Coding DNA Sequence Number=SeqID_114153
GINCLIEFISSYPIAVANVGRGAVGALVPQLLPETESWQRLQTRSPAQGQFIFEFPAQVKAMQYSGDKEEAVPGLRSRPDLRTFEMASPGSVKGLVLDLLDQVLK

SEQ ID NO: 230932 - protein, 173 aa, Glycine max
  Coding DNA Sequence Number=SeqID_114154
GTLVDDWKFDYSIHDARRMVYNDQADMTGRLLVGSLTFDCRIMHFIIVRILLPAHLIRYRMHKALRTNAPLPYPHLVTLFLHHFKIPLEDEPFVQVKRSFVISAGAVISFGYRKDDDGQWVRKQDLPQPIPDEYTLSPPPQRVDSSSLLNDVLSELHSLRAFVGDRFDAMDTR

SEQ ID NO: 230933 - protein, 41 aa, Glycine max
  Coding DNA Sequence Number=SeqID_114155
MDSSSDSENEIINLGLMAKDYESGEEMHSMICIKNLSNLPN

SEQ ID NO: 230934 - protein, 241 aa, Glycine max
  Coding DNA Sequence Number=SeqID_114156
  Gene Ontology: Mol. function=electron carrier activity; Cellular component=periplasmic space; Biological process=electron transport
  Homolog annotation: Hit_ID=Q5GVY5; Match level="QueryCoverage=93%, HitCoverage=85%, E-value=1e-95, Identity=70%"; Hit description =Cytochrome C2
  Pfam annotation: Domain name=Cytochrom_C; Domain location=29-108; Score=30.9; E_value=4.4e-06; Accession=PF00034.11; Description =Cytochrome c
TTLTPLPDNGPIRTASLEVDFSKTTWGDAKAGQTKASACAACHGADGNSTVEMYPSIAGQSERYVAQQMALIANGQRSSGAAVAMVPFVQNLTPQDMRDIGAFFATQKATAGIADDTAVTDGPYKGMKFYEIGQQLYRGGDAKRGLPACMACHGPSGAGNPGPAYPHIGGQHASYVARRLQEYQAGQTNETDKAHFQIMATVAQKLSEQEVQALSSYLQGLHNKADDVAVATTPAQPAAAP

SEQ ID NO: 230935 - protein, 117 aa, Glycine max
  Coding DNA Sequence Number=SeqID_114157
  Gene Ontology: Mol. function=protein disulfide oxidoreductase activity; Cellular component=outer membrane-bounded periplasmic space; Biological process=cell redox homeostasis
  Homolog annotation: Hit_ID=Q8PPG3; Match level="QueryCoverage=84%, HitCoverage=45%, E-value=3e-24, Identity=60%"; Hit description =Disulfide oxidoreductase
MRLISRLLLSVLVLLPLVACAATPANAPLVEGKDYERIAQPGPFQPLAGKIEVVEVFGYTCPHCARFEPQLEAWAAKLPADVRFTPVPAAFGGAWDAWALAYYAADEVGVAKRSHGA

SEQ ID NO: 230936 - protein, 140 aa, Glycine max
  Coding DNA Sequence Number=SeqID_114158
  Homolog annotation: Hit_ID=Q2QYH0; Match level="QueryCoverage=61%, HitCoverage=12%, E-value=4e-09, Identity=42%"; Hit description =Expressed protein
MLFWFFRVRVGVRIRDWRFIIVEGEVGEGVKFGIEEGLDEEVARGGGDAGDEGLRGAEEGVAAGEGAKVGDEGERGVEVEAVDVDELAELEAVGEDEIGVGVGEEDVGGVEGVREVLVFMACSIFRRMPGMREAIAIALS

SEQ ID NO: 230937 - protein, 47 aa, Glycine max
  Coding DNA Sequence Number=SeqID_114159
MRGGSLRKDQTLKDEMEPGVVVAGERWNRNDCGTVDQRVMMNRIHHR

SEQ ID NO: 230938 - protein, 341 aa, Glycine max
  Coding DNA Sequence Number=SeqID_114160
  Pfam annotation: Domain name=VQ; Domain location=140-166; Score=31.3; E_value=3.3e-06; Accession=PF05678.4; Description=VQ motif
MDSGNSGSISSSDDEYDSSHADPSFLNHFGSISHPQQPSLVPSHPSMFDLSSSYFHAVVSQSHQNPHNHLFNLDCQDQRSEPNRTLPESLPSSTSATPTTTNQCLLGHDNINDNSIQQLPSSPQTNNLVRNSKKRSRSSRRAPTTDTNNFRSMVQEFTGIPAPPFSSSFSRRIPLCPNPLLSTTSSRTSLLHNKNNINVSPNNNYQLLPDLSLPYQPPPQNLIQDIHSIPLFHPSPSLHSLVPSGLAAKSLSTMPTLDAHDLLGAHEHVVSEGMFLRSDGDAGGIRDPFWCLDHGNNSNYGGCKLNMSVSASSSLNREKNLENVGNANGNSPREGTVEAWI

SEQ ID NO: 230939 - protein, 191 aa, Glycine max
  Coding DNA Sequence Number=SeqID_114161
  Subcellular localization annotation: CTP_CleavageSite=28; ConfidenceScore=5.65e-01
MVQEFTGISAPPFSSSFSRRIPLRPNPLLSTTSSRTSLLHNNNNINVSPNNNYQLLPDLSLPYQPPPQNLIQDIHSIPSFHPSPSLHSLVPAGLAAKSLSTMPTLDAHDLLGAHEHVSEGMFLRSDGDAGGRKDPFRCLDLGNNNSYGGCKLNMSVSASSSLNHEKNLENVGNGNSPREGAVEAWICSSEQ

SEQ ID NO: 230940 - protein, 508 aa, Glycine max
  Coding DNA Sequence Number=SeqID_114162
  Gene Ontology: Mol. function=structural molecule activity; Cellular component=protein complex; Biological process=microtubule-based movement
  Homolog annotation: Hit_ID=P14641; Match level="QueryCoverage=86%, HitCoverage=97%, E-value=0.0, Identity=94%"; Hit description=Tubulin alpha-2 chain
  Pfam annotation: Domain name=Tubulin; Domain location=105-302; Score =340.4; E_value=3e-99; Accession=PF00091.15; Description=TubulinFtsZ family, GTPase domain
  Pfam annotation: Domain name=Tubulin_C; Domain location=304-449; Score=269.1; E_value=8.9e-78; Accession=PF03953.7; Description =TubulinFtsZ family, C-terminal domain
  Pfam module annotation: Pfam domain module=Tubulin::Tubulin_C; Domain location=105-302::304-449
MNLKKAKQWHSWNFWDTDESEIKIQNGATDSIVVREKQESRLGKWAIKGFLFFAEKMRECISIHIGQAGIQVGNACWELYCLEHGIQPDGQMPSDKTVGGGDDAFNTFFSETGAGKHVPRAVFVDLEPTVIDEVRTGAYRQLFHPEQLISGKEDAANNFARGHYTIGKEIVDLCLDRIRKLADNCTGLQGFLVFNAVGGGTGSGLGSLLLERLSVDYGKKSKLGFTVYPSPQVSTSVVEPYNSVLSTHSLLEHTDVAVLLDNEAIYDICRRSLDIERPTYTNLNRLVSQVISSLTASLRFDGALNVDVTEFQTNLVPYPRIHFMLSSYAPVISAEKAYHEQLSVAEITNSAFEPSSMMAKCDPRHGKYMACCLMYRGDVVPKDVNAAVATIKTKRTIQFVDWCPTGFKCGINYQPPTVVPGGDLAKVQRAVCMISNSTSVAEVFSRIDHKFDLMYAKRAFVHWYVGEGMEEGEFSEAREDLAALEKDYEEVGAESGDGDDDGEGDDDY

SEQ ID NO: 230941 - protein, 134 aa, Glycine max
  Coding DNA Sequence Number=SeqID_114163
MGNHACHKTKQTTRERERASWDGREQKILTGKKEAAGRGGVFAASEGSEGEGVRSIAPEGLAQHPHVRTCTTVPCTAPAPYPVPMLMTKSGCATAAVTTHCAKLLAQQLNTTCQLLVELRPCLWRNANKYRPSW

SEQ ID NO: 230942 - protein, 439 aa, Glycine max
  Coding DNA Sequence Number=SeqID_114164
  Homolog annotation: Hit_ID=Q9C9R6; Match level="QueryCoverage=20%, HitCoverage=14%, E-value=5e-25, Identity=61%"; Hit description =Putative RNA-binding protein; 42664-44784
  Pfam annotation: Domain name=PUF; Domain location=351-382; Score =12.6; E_value=0.15; Accession=PF00806.9; Description=Pumilio-family RNA binding repeat
  Pfam annotation: Domain name=PUF; Domain location=387-421; Score =45.7; E_value=1.6e-10; Accession=PF00806.9; Description=Pumilio -family RNA binding repeat
  Pfam module annotation: Pfam domain module=PUF::PUF; Domain location =351-382::387-421
MDSPMTARMLKMSDDNNKRNAETRFVGIANAPTTPSPFLHPDHVAVGSPISRVPLSPSPAPPPPPPPSPRFRLDPADPMWAHDFSLANDFSRINLFDHATQTDHNMPFQPYASYFNETGPLPYHRHHVNNTQTNMGLDPYASCFNETGTFRTLPYHPHVNNAGLFDKGYTFPIPDDHVYHHLVDQRRRQPQGTSDNNYQILGDRYAVASQSLGGGGGRVKSPIRFSQITPPYQYPPNANITPSHYYVAAKEKAELSPFLSPRRIIGEDPAAAFRCDNNGVFLQGRDAKHYFENEYGSYRRSPRYDDDAIHGVGRSVVRKNFYSSAAAPSGQRSGGDFSSVPMLQDFYSVPDAQCYIYNMAKDQNGCRFLQRMVAEGTYQDICMVFEGIIGNVVELMIDSFGNYLVQKLLDVCTDDQRLQIVLMLTNHPAQLVRVSLNTH

SEQ ID NO: 230943 - protein, 197 aa, Glycine max
  Coding DNA Sequence Number=SeqID_114165
  Gene Ontology: Mol. function=chromatin binding; Cellular component =chromatin; Biological process=chromatin assembly or disassembly
  Homolog annotation: Hit_ID=Q1SAV4; Match level="QueryCoverage=55%, HitCoverage=28%, E-value=4e-23, Identity=49%"; Hit description =Integrase, catalytic region
MSHFEVVYGKPPPTVVQYLQGSTVVAVYDLLSSRESIHASLQRRLRKVQEAMKVAADKHRRDLAFQVGDWVYVRLRPFRQTSVAPSYSKLAKRFYGPFEVVERVGPVAYRSWSNGRDMPLKIPLGNAGRSCVASTTLRTRSFSGTGVLIATRSRATHRQETMQKIADQRESGQGLLTCVIMLRVGSNSKSRKSSSEQ

SEQ ID NO: 230944 - protein, 305 aa, Glycine max
  Coding DNA Sequence Number=SeqID_114166
  Gene Ontology: Mol. function=catalytic activity; Cellular component =intracellular; Biological process=superoxide metabolic process
  Homolog annotation: Hit_ID=Q9SLU9; Match level="QueryCoverage=78%, HitCoverage=32%, E-value=1e-100, Identity=71%"; Hit description=ZW18 protein
  Pfam annotation: Domain name=DUF676; Domain location=1-172; Score =182.7; E_value=8.7e-52; Accession=PF05057.5; Description=Protein of unknown function (DUF676)
MGHHLDLRLVRNQWLLIDPKVEFLMSEANEDKTFGDFREMGHRLAKEVIAFLKSKMDKASRYGSLGDIRLSFVGHSIGNLIIRTAIADSIMEPFLCHLHTYVSVSGPHLGYLYSSNSLFNSGLWFLKKLKGTQCIHQLTFTDDPDFQNTFLYKLCKDGYVPYHSARIESCQAASRDTSKKGKLFLEMLNACLDQIRANSMQHRVFMRCDVNFDASTQGKNLDSIIGRAAHIEFLDSDIFASCCGFPSLHSVLKPSGVISHPSDTNSAQISVTGCSKKRCVISDEKLTCCQGRMHMNSYAVIILVK

SEQ ID NO: 230945 - protein, 438 aa, Glycine max
  Coding DNA Sequence Number=SeqID_114167
  Gene Ontology: Mol. function=RNA-directed DNA polymerase activity; Cellular component=chromatin; Biological process=chromatin assembly or disassembly
  Pfam annotation: Domain name=RVP_2; Domain location=54-174; Score= -52.2; E_value=0.012; Accession=PF08284.2; Description=Retroviral aspartyl protease
MAVRRDQGLCYHCVDKWSQGHRCKPRLHLLIADEDLEPSSSLSTSESLSHVAPDPIQAPQISLNAMEGTPAPQTFRLLGSLHHHQVVILVDGGSTHNFIQTRVAKFLALPTAPTAALRVMVGNGHTLDCDTMSSQVSLSIQGHEFRLDLYHLLICGVDIVLGVQWLKLLGPITTDYLNLTMTFLHMGLPITLHADAPPTPSHASAHQLKRLAQTQSISALFHITTTTTPVLSSPPPSTSPIPSQIASVLDKFPHIFAEPTQLPPNRNIQHHIHLPQTTLVNVRPYRYPHFQKAEIERQISAMLAANLIQPSHSPFSSPILLVKKKDGSWRCCVDYRALNAVTVKDRFPMPTIDELLDDLGQASWFSKLDLHQGFHQIRMAEDDVHKTAFRTHQGHYEFRVMPFGLCNAPSTFQAAMNDTLKPFLRKYVAVFFDDIFGV

SEQ ID NO: 230946 - protein, 189 aa, Glycine max
  Coding DNA Sequence Number=SeqID_114168
  Gene Ontology: Mol. function=RNA-directed DNA polymerase activity; Cellular component=chromatin; Biological process=chromatin assembly or disassembly
KWEPNTTIVDNEVLVEREVRMRLWPNPDICHEVNITRVLPQGPAQLVQEGEMGHDQGQTSRVRRNDSGKRICHDIGGAWLVFDNIVEAKELREIRLLLRGLNNLGHQVLQTPMVRQDRERRAEEVVTPLPNRGGDGVEFADIRRGPLQTWTKHFAKIGDRGPRPWLVEEYGRLVGPLGTNGIGLCAIAM

SEQ ID NO: 230947 - protein, 141 aa, Glycine max
  Coding DNA Sequence Number=SeqID_114169
MLPPRRAGLLPEKATLLRKYSRSPKFKISKIAICTPLILISSPPSFVIYRKGYENFTEALRKSRKPFFKKTGEILFRNVTELYRLRNDTCFLSVMSQNFTDYATMPSLTSRMYRTLRICAQCFLFDSRHVAGPSRIALRWV

SEQ ID NO: 230948 - protein, 65 aa, Glycine max
  Coding DNA Sequence Number=SeqID_114170
MKATFLPKKSEYVIYGDNKQRPLDQQPQQLEVGSSYWKLKVKNGSWKLEVEVTGSWKLEMKVIGS

SEQ ID NO: 230949 - protein, 53 aa, Glycine max
  Coding DNA Sequence Number=SeqID_114171
MVTWPQFVARCRFLLSEMAPKKISAKRSRRDAMAEGTSAAPEFDSLRFRSAMH

SEQ ID NO: 230950 - protein, 91 aa, Glycine max
  Coding DNA Sequence Number=SeqID_114172
  Gene Ontology: Mol. function=RNA binding
  Homolog annotation: Hit_ID=UPI0000162FBB; Match level="QueryCoverage =97%, HitCoverage=17%, E-value=2e-24, Identity=63%"; Hit description =RNA binding
  Pfam annotation: Domain name=PUF; Domain location=2-27; Score=5.4; E _value=1.4; Accession=PF00806.9; Description=Pumilio-family RNA binding repeat
  Pfam annotation: Domain name=PUF; Domain location=31-61; Score=16.7; E_value=0.042; Accession=PF00806.9; Description=Pumilio-family RNA binding repeat
  Pfam module annotation: Pfam domain module=PUF::PUF; Domain location =2-27::31-61
MLSTQKFSSHVVEKCLQHIGDSRSRIVRELLSVPRFEQLLQDQYANYVIQSALLFTKGPLHASLAEAVRLHKTLCTSPYCKRIFSGNLLKK

SEQ ID NO: 230951 - protein, 381 aa, Glycine max
  Coding DNA Sequence Number=SeqID_114173
  Homolog annotation: Hit_ID=Q9SLU9; Match level="QueryCoverage=92%, HitCoverage=50%, E-value=2e-89, Identity=46%"; Hit description=ZW18 protein
KTFGSAAPDLDPSSVYGVWRIDDTDNSFSTQSFRIKYARQDVHLYMMIVFNLSRSEFVDLATTAVILKFELIYAPATEDGVNMQASLDDSSAAIHEFRIPPKALIGLHSYCPVHFDALHAVLVDGFGGVAFLDTGNVSLVKALLTSRDILVEELQKISKAINEALDISEFVSIMSNMKLLNSVLQVNQFAIDVEVVGQGKPQNGLKGGNEALDFLDVEKLHSLSQNELDNKSRILGFLRDAWVKDRKAEWSIWMLYSKVEMPHHYINSKSEESSHRGVHRRVSSLWKLPDDPLQTAATRAELHRRSIEQMRINNRSVQDMQIFGDLLHTPIVIVEHVMNVPRRCPSANSLLRHIGSIDSDGLPIGLSSDTIGKKFATQSNA

SEQ ID NO: 230952 - protein, 155 aa, Glycine max
  Coding DNA Sequence Number=SeqID_114174
  Gene Ontology: Mol. function=sugar porter activity; Cellular component=integral to membrane; Biological process=carbohydrate transport
  Homolog annotation: Hit_ID=Q6BDD4; Match level="QueryCoverage=51%, HitCoverage=27%, E-value=2e-18, Identity=68%"; Hit description =Hexose transporter HT2
MARRFEHGLPIFPRSRSACRRLHKLRHRESAVGADRETLFMRKVRGSHMDVESELEELINAKSMIAVSALLAMVTGVHGTKDISKGNAMLNQNHWTKHSSWGAVYITICVIPDIFDNAMPLQTKGIPLESMYTIWGKQWFWRRFVEGAVKQDNFP

SEQ ID NO: 230953 - protein, 77 aa, Glycine max
  Coding DNA Sequence Number=SeqID_114175
  Gene Ontology: Mol. function=sugar porter activity; Cellular component=integral to membrane; Biological process=carbohydrate transport
  Homolog annotation: Hit_ID=Q84N02; Match level="QueryCoverage=98%, HitCoverage=17%, E-value=5e-17, Identity=62%"; Hit description =Putative monosaccharide-H+ symporter
  Subcellular localization annotation: CTP_CleavageSite=36; ConfidenceScore=5.52e-01
MSIAIFSAAPLSAPPAKKVTPPNMMVFLPPNAAVTRLAAKDDTNVNTWLPYTQYMFFAPAAFLSIDGRTFQETVPSL

SEQ ID NO: 230954 - protein, 102 aa, Glycine max
  Coding DNA Sequence Number=SeqID_114176
  Homolog annotation: Hit_ID=Q9SLU9; Match level="QueryCoverage=60%, HitCoverage=7%, E-value=2e-18, Identity=66%"; Hit description=ZW18 protein
MPRTVKVKSVATLETVQEIGVYIHRFHNLDLFKQGWYRIKITVRWEDSESLSFGIPASVVQYEGSSMWYPSHETLLASGLVLYEVEVERRSNEASSSPFIFK

SEQ ID NO: 230955 - protein, 316 aa, Glycine max
  Coding DNA Sequence Number=SeqID_114177
  Gene Ontology: Mol. function=inorganic diphosphatase activity; Cellular component=cytoplasm; Biological process=phosphate metabolic process
  Homolog annotation: Hit_ID=Q1SYF3; Match level="QueryCoverage=99%, HitCoverage=99%, E-value=1e-138, Identity=78%"; Hit description =Inorganic pyrophosphatase
  Pfam annotation: Domain name=Pyrophosphatase; Domain location=94-302; Score=227.8; E_value=2.4e-65; Accession=PF00719.9; Description =Inorganic pyrophosphatase
  Subcellular localization annotation: CTP_CleavageSite=54; ConfidenceScore=5.57e-01
MAATRAVTIASNSTCSLLAKKTFVGGTALSLNNLKFCRTRRSYTCRAIYNPLVVVKEEGQPETFDYRVFFVDKSGKKVSPWHDIPLRLGDDIFNFIVEIPKESSAKMEVATDESFTPIKQDTKKGKLRYYPINLSGSRELQYPLLAFDDYPSFLDVIFIYNIHWNYGLLPQTWEDPSFANSEVEGALGDNDPVDVVEIGERQRKIGEVLKVKPLGALAMIDEGELDWKIVAISLDDPKAPFVNDVDDVEKHFPGTLTAIRDWFRDYKIPDGKPANKFGLGNKAANKDYALKVITETNESWNKLIKRSIPAGELSLV

SEQ ID NO: 230956 - protein, 502 aa, Glycine max
  Coding DNA Sequence Number=SeqID_114178
  Gene Ontology: Mol. function=transporter activity; Cellular component= integral to membrane; Biological process=transport
  Homolog annotation: Hit_ID=Q1SYG1; Match level="QueryCoverage=93%, HitCoverage=90%, E-value=0.0, Identity=69%"; Hit description=Major facilitator superfamily MFS_1
  Pfam annotation: Domain name=MFS_1; Domain location=41-462; Score =113.4; E_value=6.6e-31; Accession=PF07690.6; Description=Major Facilitator Superfamily
  Pfam annotation: Domain name=OATP; Domain location=38-475; Score= -241.3; E_value=0.00083; Accession=PF03137.10; Description=Organic Anion Transporter Polypeptide
  Pfam annotation: Domain name=Sugar_tr; Domain location=35-493; Score=- 148.3; E_value=0.031; Accession=PF00083.14; Description=Sugar (and other) transporter
  Pfam module annotation: Pfam domain module=MFS_1::OATP::Sugar_tr; Domain location=41-462::38-475::35-493
MAQDDHSQVKPKPSPQLVEPRISTMIPTASWFTPKRLLAIFCVINLLNYVDRGAIASNGVNGSKGTCTEGGTCTSGSGIQGDFNLNNFEDGVLSSAFMVGLLVASPIFASLAKSVNPFRLIGVGLSVWTLATLCCGFSFNFWSISICRMLVGVGEASFISLAAPFIDDNAPVTQKTAWLAIFYMCIPSGYALGYVYGGLVGSHLGWRYAFWVESLFMVPFAISGLFMKPLQLRGFVPADSKKTLTPETVASGVQVMEASNGKDEPLSLKAELRDKSSNDHSKSKSVTQIFEKFSRFLNDMKELLLDKVYVVNVLGYIAYNFVIGAYSYWGPKAGYNIYHMTDADLIFGGITIVCGIVGTLAGGFVLDYMSNTLSNAFKLLSITTFIGAAFCFGAFLFRSMYGFLALFSIGELLVFATQGPVNYVCLRCVKPSLRPLSMAMSTVVIHIFGDVPSSPLVGVLQDNINNWRTTALILTSILFLAAGIWFIEQENLILRSGTTGHE

SEQ ID NO: 230957 - protein, 187 aa, Glycine max
  Coding DNA Sequence Number=SeqID_114179
  Pfam annotation: Domain name=BRF1; Domain location=69-162; Score= -3.6; E_value=0.0011; Accession=PF07741.3; Description=Brf1-like TBP -binding domain
MVPCIWGSEINSNFQKLHFFPNNMVLISFRRAINATKSLYSGSFGANVEHEATEDGKYDGSHREDESETLSDIHDEEVDLYIHDEEGKHIKKILWETTNREYLEDLTQVYFLKEQAAKEAAAVANKKAFEEKFENCSEDILAARELVASSTEAVAKSRKSCHHCERASVLKSQGSESMWLERSEQCL

SEQ ID NO: 230958 - protein, 153 aa, Glycine max
  Coding DNA Sequence Number=SeqID_114180
MANPAVRQQEERAEIETHQESIFKVTSIHHQMTTEEKTSEVSSTPEYSCPAIASYVGGTEKGRLELSVEDQKVSFDLFEAMKHSDMGDACSDTTVIQQFPLEKELGDEIDNLVDNEECDDPKDNCVDHVVFEELEKMRPPENPKAELKPFQHI

SEQ ID NO: 230959 - protein, 684 aa, Glycine max
  Coding DNA Sequence Number=SeqID_114181
  Gene Ontology: Mol. function=RNA binding; Biological process =gynoecium development
  Homolog annotation: Hit_ID=Q1SU11; Match level="QueryCoverage=96%, HitCoverage=96%, E-value=0.0, Identity=65%"; Hit description=KH, type 1
  Pfam annotation: Domain name=KH_1; Domain location=180-247; Score =59.2; E_value=1.4e-14; Accession=PF00013.19; Description=KH domain
  Pfam annotation: Domain name=KH_1; Domain location=328-390; Score =43.9; E_value=5.6e-10; Accession=PF00013.19; Description=KH domain
  Pfam annotation: Domain name=KH_1; Domain location=35-97; Score=65.5; E_value=1.7e-16; Accession=PF00013.19; Description=KH domain
  Pfam annotation: Domain name=KH_1; Domain location=413-480; Score =70.3; E_value=6e-18; Accession=PF00013.19; Description=KH domain
  Pfam annotation: Domain name=KH_1; Domain location=605-673; Score =24.5; E_value=0.00038; Accession=PF00013.19; Description=KH domain
  Pfam annotation: Domain name=KH_2; Domain location=180-224; Score =9.7; E_value=0.0083; Accession=PF07650.7; Description=KH domain
  Pfam annotation: Domain name=KH_2; Domain location=35-82; Score=4.4; E_value=0.036; Accession=PF07650.7; Description=KH domain
  Pfam module annotation: Pfam domain module=KH_1::KH_1::KH_1::KH_1::KH_ 1::KH_2::KH_2; Domain location=180-247::328-390::35-97::413-480::605 -673::180-224::35-82
  Subcellular localization annotation: CTP_CleavageSite=60; ConfidenceScore=5.28e-01
MASSKRPNAGPNGRGKRRKSSGGFSPLDVSPGSVVFRLLCHASRIGSVIGKGGSIISQIRLETGVKVKIEEAVPGCDERVITISGSDKEAEEYTAEQGKEVNDNDDVGSEGKDGEEKNGSDGNGNEDKEEKDAVPVEDSKSEKGNSAIWKAISLVFERMVEGVEETTEGDEESNKSSSFFLRLLILTAQVGCVLGKGGSVIKRMAAESGAQIRILPKDKVPVCASAFDEIVQISGSVEVVRKALQSVSQQLLENPPRDHESLSAKSTGPSSHSFGQFPPHNHSFAAQGEPFATGPHDISAFHSAPPLIPKFHEAAIHGRTRPLQEMLTFRLLCPVERVGNIIGKGGAIIKTVQQETVSEIKVLEAPPDSEDCVIVISGPAHPEDRVSPVQEAVFRVQTRIAKPIPDANDHTMLARFLVSSNQIGCLLGKGGSIITEMRKKSGAHIRILGKDKVPKCASEDEEVIQVNGEIEAVHEALLQITTRLKHHFFRDSYPSVNYPSNSPFLDQLPPFPPYLGRRGLSPPGMYSDLGPPPSHAGFPLDDRPAFLNNIHRPGLPPHISQRKPWGPLGVLEGGTPIGLPDFPRGPPRRISGFAGGSQPIITSTTVEVVVPRAVVPVIYGEDGECLKQILQVNPLYLISDANITITDPKPGAVETKIIISGTPEQTHAAQSLIQAFVMSERESV

SEQ ID NO: 230960 - protein, 55 aa, Glycine max
  Coding DNA Sequence Number=SeqID_114182
MAQKLIQNTTQKVVYQLAGKQEVEQAWWFLMTNSDMLLMAVECNSFQPIGEFGIA

SEQ ID NO: 230961 - protein, 420 aa, Glycine max
  Coding DNA Sequence Number=SeqID_114183
  Subcellular localization annotation: CTP_CleavageSite=33; ConfidenceScore=5.71e-01
MAPMQSIGVATTSASMVLPPSSPALMASPSIVLAIMVSPSLSSHPRVSLDHLYTSSNVDSLWGATYKLKQKTSVGFVSTFDKNLIRLAGVQNATDSTKIFFQRSLEILEENGQWYQEAVHKVASLEAEVAKWRATARTLWLVESPKVANATVAFVEVIRSNHQLSLKVDGVLAKLLRTKVDGDELFKCCKDLQMEKKEVGGMVESMARLKESESRLEESELRAAKEKEASKELEEELFLQAGFFAKDLDLGLFDPFKDVKDGVLLDEEDIRRKQGLVDVEVGLRWSCKEFYDTKSSQSFSPDDCEELCFTCPWLKVLPTNRGLPLVSRPKGYLGFCAPRADLQFCKNVYQGWTLGFEGMSTKGRPWVFDMELSNRKGSPRVILGFVESWTGEALTLAYGAMFGHGFGFVVWCRIQSFMSN

SEQ ID NO: 230962 - protein, 618 aa, Glycine max
  Coding DNA Sequence Number=SeqID_114184
  Gene Ontology: Mol. function=hydrolase activity; Cellular component =cytoplasm; Biological process=translation
  Homolog annotation: Hit_ID=Q4FCX5; Match level="QueryCoverage=99%, HitCoverage=99%, E-value=0.0, Identity=79%"; Hit description=N -acylethanolamine amidohydrolase
  Pfam annotation: Domain name=Amidase; Domain location=146-591; Score =258.5; E_value=1.3e-74; Accession=PF01425.11; Description=Amidase
MGKKRVMTPAKDVDLSSIKYEREIVQAPHLTGFVFRLFVRIIEAPVIGPIIMNILKKENKMDEILRHTMIPEEPMFKPEYPPQEMEPGVVVLEEDGRPEDRVEYALKCLPHYDVAESWENSSASFRYWKIRDYAHAYQSRKVTPSMVAERIISIIEDNGRNKPPTPLLISFDAAGVREQAAASTQRFEAGNPLSILDGIFMAIKDDIDCYPHPSKGATTWMHEVRTVKEDAVCVSRLRTCGVIFIGKANMHELGMGTTGNNPNFGTTRNPHAPDRYTGGSSSGPAAIVASGLCSAALGTDGGGCANLMAGSVRIPSSLCGVVGFKTTYGRTSMEGSLCDSGTVEIIGPIASTVEDVLLVYSAMLGASPANRISLKPAPPCLPTLSSNDNSNALGSLRIGKYTPWFNDVHSTEISDKCEEALNLLSKAHGCEMIEIVIPELLEMRTAHVVSIGSECLCSLNPDCEDGRGVNLTYDTRTSLALFRSFTAADYVAAQCIRRRNMYYHLEIFKKVDVIVTPTTGMTAPIIPPSALKSGETDMQTTASLPANLMQFVVPANLLGFPSISVPVGYDKEGLPIGLQIMGRPWAEATILRVAAEVEKLCGESKKKPVSYYDVLKAK

SEQ ID NO: 230963 - protein, 108 aa, Glycine max
  Coding DNA Sequence Number=SeqID_114185
  Subcellular localization annotation: CTP_CleavageSite=62; ConfidenceScore=5.11e-01
MIPPAPSQIPLPTPLSASPADFIFTPQMLHSMLQSIHRGQSIIMQSLQGLGLPSIISMEEFDAQVAWPGDQPSSSGGGGASTAQEPMTEEPTAPAPSPAAVEEETTPA

SEQ ID NO: 230964 - protein, 225 aa, Glycine max
  Coding DNA Sequence Number=SeqID_114186
  Homolog annotation: Hit_ID=Q9FGF0; Match level="QueryCoverage=89%, HitCoverage=66%, E-value=3e-49, Identity=53%"; Hit description =Putative ZW10 protein
MADKATQQVHGSGILSFRTLQTAVGVFGGESYTDITDVLPLMVENAGNSNRAAISSLNCPPIVAVELCREHLELNTILGGLQHSHTLLNQLSWIPWEFVPATKGEASASINPYFLQLIFHWQIDSNEDTWWKADVRETKEELAARGRKFMNWLGTRKEKEIAIVTHRALLLHTLSAFGNYSHPLEKKELSKPFANCELRSMVIVDWYEHNLNNFKSSLAPQSGFL

SEQ ID NO: 230965 - protein, 160 aa, Glycine max
  Coding DNA Sequence Number=SeqID_114187
  Homolog annotation: Hit_ID=Q9FGE8; Match level="QueryCoverage=62%, HitCoverage=50%, E-value=4e-14, Identity=38%"; Hit description =Arabidopsis thaliana genomic DNA, chromosome 5, BAC clone:T12B11
  Subcellular localization annotation: CTP_CleavageSite=47; ConfidenceScore=5.07e-01
MALRIHVISPFFSISTTSPVALSTHKLTIRRINCTGGGEGGINDASLASELAARAARMNAHSVMAEEAMRKSRKLLFGELCEYMGLDEDQAQHKWTYMDDDEKLVLVKAFLAEWGSHFHPLSARSTKEMLEEYLRQGNSPPKLTNSPFFFEGLNRIIGFP

SEQ ID NO: 230966 - protein, 33 aa, Glycine max
  Coding DNA Sequence Number=SeqID_114188
MTHLLFASTLSSPLLNQRAIAAIYAHNRFITLL

SEQ ID NO: 230967 - protein, 168 aa, Glycine max
  Coding DNA Sequence Number=SeqID_114189
MPWPIRFVPVGGSHEDAKSRSSGEIPPSLRRELYNAGRAKHRNERGLGPLLKGDEICPWVLREAFSAVDAFLIPDPTDSVDFSAVPKPDLHLGFDRGLGPTLMTWMDAKLAFPACEREDDLCFDLKSANIVEVFVYKVPQWLRDKSVYKRLISLDFQAMLDLVTTRTI

SEQ ID NO: 230968 - protein, 161 aa, Glycine max
  Coding DNA Sequence Number=SeqID_114190
  Gene Ontology: Mol. function=nucleic acid binding; Biological process= response to oxidative stress
  Homolog annotation: Hit_ID=Q1SHC9; Match level="QueryCoverage=99%, HitCoverage=41%, E-value=8e-23, Identity=35%"; Hit description=Zinc knuckle, putative
MENNEKIADFFNRIIIHTNAMKNCGEKISNQTIVEKILRTLNPKFDHIVVVIEESKKLKEITVEELQGFLEAHEQRNREARGSSGVIGHFSTECVIAPSSIDHRGNQSHNDYQAHMAKKENEANSDEQPLTLMMVIDSETHNNEAWYIDSGCSNHMIGHRD

SEQ ID NO: 230969 - protein, 577 aa, Glycine max
  Coding DNA Sequence Number=SeqID_114191
  Gene Ontology: Mol. function=kinase activity; Cellular component =nucleus; Biological process=positive regulation of DNA binding
  Homolog annotation: Hit_ID=Q1SFT6; Match level="QueryCoverage=78%, HitCoverage=87%, E-value=1e-133, Identity=57%"; Hit description =Bromodomain
  Pfam annotation: Domain name=Bromodomain; Domain location=130-219; Score=105.7; E_value=1.4e-28; Accession=PF00439.15; Description =Bromodomain
  Subcellular localization annotation: CTP_CleavageSite=54; ConfidenceScore=5.56e-01
MGKVPFSNPNPNPNSNPKLANGKKTQSASDDASSINRRSNDAATHSQYVTFNVASCTKKELNDFKNRLVSELEQIQKLRNQIGSSEFQPGQSLNGHPKKPSGKKISGNKRPLPSNSAKDLKRSHSEVGNLMKCCSQVLQKLIKHKHGWVFKAPVDVVGLKLHDYCDIIKQPMDLGTVKSNLSKNVYATPADFASDVRLTFNNALAYNPKGHDVYTMAEQLLARFEELYRPVHEKFEGSIVHDRESEEELQASSWSQVEPERVKKKENPIPPAKLHKEPPPQHPASSSNPPLVQSPVRTPSPMRAPPVKPLKQPKPKAKDPNKRDMSLEEKHKLGLGLQSLPPEKMEQVVQIIRRRNGHLKQDGDEIELDIEAVDTETLWELDRLVTNYKKMVSKIKRQALMGNIDNNNNDVQSNKGNGELPSSEKVDGGPVEVKKPKKVEAGDEDIDIGDEMPTSMFPPVEIEKDKDVVGGHASSSSSSSGSSSSDSSSSSGIYLPLTIRIRGVPQGVILKQTTGTRSSQWVFGTNGHVDEENAFASLASFEGVARIHGRGIVTVVCWFVLGVAVCIVALSTPGFVV

SEQ ID NO: 230970 - protein, 336 aa, Glycine max
  Coding DNA Sequence Number=SeqID_114192
  Gene Ontology: Mol. function=transferase activity, transferring hexosyl groups; Biological process=metabolic process
  Homolog annotation: Hit_ID=Q53UH2; Match level="QueryCoverage=84%, HitCoverage=61%, E-value=6e-75, Identity=47%"; Hit description =Glucosyltransferase
MSESDLMQPPEGYPVSSVKLHAHEVKFLASKRDWEFGSGVLFYHRLNKGLIFSDAVGFKGCREIEGPYVEYLAEQFGKPVLLSGPFIPEPPNTVFEGKWGSWLERFKLGSVVFCVLGTEWKLPHDQFQGLLLGLELTGLPFLAVLKVPIGFETIEAALPEGFKERVEGRGIVHSGWIQQQLILEHPSVGCFITHCGAGSLTEALVNKCQIVLLPQVDADHILNARTMATNKVGVEVEKGEEDGLFTKESVCKAVKIVMDDENELGREIKTNHSKVRKFLLNHKLESTCVDSFCQQLRHLLMISKDIGRYIFGGDVNTRVFTIEASQVGLLKVDDLE

SEQ ID NO: 230971 - protein, 1223 aa, Glycine max
  Coding DNA Sequence Number=SeqID_114193
  Gene Ontology: Mol. function=DNA-directed DNA polymerase activity; Cellular component=nucleolus; Biological process=transcription
  Homolog annotation: Hit_ID=Q9FGF4; Match level="QueryCoverage=96%, HitCoverage=95%, E-value=0.0, Identity=50%"; Hit description =Arabidopsis thaliana genomic DNA, chromosome 5, BAC clone:T12B11
  Pfam annotation: Domain name=DNA_pol_phi; Domain location=232-958; Score=521.3; E_value=1e-153; Accession=PF04931.4; Description=DNA polymerase phi
MGSSSKKRNSASEEQTLAADEYPKMLNKKQKNTTTDDDSQQQQPSVKPMERKKKRKALDKGRRRTASQPDPKPVPPSTDSPSTSGGSAMPEFHIGVFKDLAAASKSAREAAAKQMVTELKAVQNAYDSREKESGEGGLKLEAEKDDGLDNCAPSVRYAVRRLIRGVSSSRECARQGFALGLTILAGTVHNINVASFLKLVVNLLEVTSSMKGQEAKDCLLGRLFAYGALARSGRLIQEWNMDKSTPYLREFISVLISLANKKRYLQEPAVSIILDLVEKLPVEALMNHVLEAPGLKEWFEAAIEVGNPDALFLALKVREKISIDSSVFGKLLPNPFSSSQLFSADHLSSLSNCLKESTFCQPRVHSVWPVLINILLPNTILQLEDAASASNSLKKHKKSRKSSSSDEEIAKNLQSFCEIIIEGSLLISSHDRKHFAFDVLFLLLQKLPASLVPVVLSNKVVQCLVDVLSTKNTWLFKVAQHFLKQLSDWVGDDDVRRVAVIVAIQKHSNGKFDRITRSKLVKDFMSQFKTEPGCMLFIQNLMNLFVDEGNAPEEPSDQSQTTDENSEIGSIEDKDSPRTNGNSDFLKSWVIESLPSILKFLKLDHEEKFRVQKEIMKFLAVQGLFTASLGSEVTSFELQEKFRWPKSSASNALCKMCIDQLQLLLANAQKGEGSRPLANRVEPNDLGSYFMKFFGTLCNIPSVSLFRSLDDVDQKAVKKLQAMEARLSREERSHDCSTDANRLHALRYLLIQLLLQVLLRPGEFSEAASELIICCKKAFSTSDLPESSGEDDVEVDDAPELMDVLVDTLLSLLPQSSAAMRSSIEQVFKYFCGDITDDGLMRMLRVIKKNLKPARHPDAASADDDDEDDDFINIEEEIDQAETGESDGQTDDSESVVEVEETDHGHSEASDDSDSGMDDDAMFRIDTYLAQMFKEKKNQAGGKPQVLMVYSNLAQAFVNPHTAEVSEQLGQRIWGILQKQIFKAKDYPRGDGVQLSTLESLLEKNLKLASKPFKRQKSASNPSKQSAAWNRQKMICSLAQTATFWILKIIDSRNFAESELERIAQIFGEVLVGYFDNKKSQIKSGFLKEIIRRRPWVGHAILGFILERCGSAKSDFRRVEALELVMEILKSLTSGNNDEQNASKKILKNSFDKLSRLMKELVTNMPSKPARRTEVLKFCVKALEILSKHNLTKNFVKTLAPDTQAALEVQLGEQFISLKKLEK

SEQ ID NO: 230972 - protein, 71 aa, Glycine max
  Coding DNA Sequence Number=SeqID_114194
MVAVAGGYNFLPSNAIKKEKVLINLAKMSEIKYGYPYPAQGPYQGPPPVAAPPQYYAAPPPRREPGFLEGW

SEQ ID NO: 230973 - protein, 252 aa, Glycine max
  Coding DNA Sequence Number=SeqID_114195
  Gene Ontology: Mol. function=protein serine/threonine kinase activity; Cellular component=nucleus; Biological process=protein amino acid phosphorylation
  Homolog annotation: Hit_ID=UPI0000162DEA; Match level="QueryCoverage =87%, HitCoverage=36%, E-value=1e-28, Identity=35%"; Hit description =ATP binding / kinase/ protein kinase/ protein serine/threonine kinase/ protein-tyrosine kinase
MNPKQLLLLFFSLFLTITFSLNERFEACDAKTCGNGQNISYPFYIQGKQKPFCGQPGFELTCSHKGFPILTLMYTPYTIHQIFYDNQSLRVSNPVFSQPNLSSCIAPTQNLTVGRYRFRVAPNQRELFVLYGCDSAALQKTVPERRIWCSAAGNETTSVVGLDKGDRDLVSARESCKGGAVNATVDDLKGGVREALQRGFLLLWNATSCSECKSSGGRCGFDIDPRVYAFRCYCPDRPHAVKCTNTEGGRLT

SEQ ID NO: 230974 - protein, 399 aa, Glycine max
  Coding DNA Sequence Number=SeqID_114196
  Gene Ontology: Mol. function=protein serine/threonine kinase activity; Cellular component=nucleus; Biological process=protein amino acid phosphorylation
  Homolog annotation: Hit_ID=Q9C6K9; Match level="QueryCoverage=99%, HitCoverage=62%, E-value=1e-130, Identity=60%"; Hit description=Wall- associated kinase, putative
  Pfam annotation: Domain name=Pkinase; Domain location=61-333; Score =172.5; E_value=1.1e-48; Accession=PF00069.15; Description=Protein kinase domain
  Pfam annotation: Domain name=Pkinase_Tyr; Domain location=61-333; Score=147.3; E_value=4.2e-41; Accession=PF07714.7; Description =Protein tyrosine kinase
  Pfam module annotation: Pfam domain module=Pkinase::Pkinase_Tyr; Domain location=61-333::61-333
  Subcellular localization annotation: CTP_CleavageSite=34; ConfidenceScore=5.30e-01
MLMIGLLLHCKRKHSSSSGQFQTRNTFSIPSSPNAEVESGSVYFGVPLFSYKELAEATNRFDLNKQIGDGGFGTVYNGKLKDGREVAVKHLYNHNYRRVEQFMNEIQILTRLRHRNLVSLYGCTSRQSRELLLVYEYIPNGTVASHLHGELAKPGLLTWSLRIKIALETASALSYLHASKIIHRDVKTNNILLDNSFCVKVADFGLSRLFPNDMTHVSTAPQGTPGYVDPEYHQCYQLTSKSDVYSFGVVLIELISSMPAVDMNRHKDEINLSNLAIKKIQERALSELVDPYLGFDSDKEVKRMIVEVAELAFQCLQQDRELRPPMDEVLEVLKRIESGKDELKHLEEAVHGSGSGVSHNVTTSSLDEAGLLKNRKPPSSPISVTDSWESKSTTPNASS

SEQ ID NO: 230975 - protein, 114 aa, Glycine max
  Coding DNA Sequence Number=SeqID_114197
MVEREKFNHIEKRLRAIEGDEDYVFADMVELCLVLDVVIPLKFKVSGFDKYKGTTCPKNQLKMYNRKMRAYSKNEKLLMHFFQESLTGAIVTWYTNLEPSRIHSSKDLMVAFIR

SEQ ID NO: 230976 - protein, 145 aa, Glycine max
  Coding DNA Sequence Number=SeqID_114198
MSEIEEVQEQMKADMEAMKDQMAAIMEAMLSMKKIMESNAAAVATTSAATEVDPTHLSGLNQVNRPTSDMVRQGGEVLGSMDGPYFVKIQNKHFFPPYGLPPNYTPSNVAHTPNENVDNSTPIPIESQQPQSDHAHVSQPMGGDT

SEQ ID NO: 230977 - protein, 209 aa, Glycine max
  Coding DNA Sequence Number=SeqID_114199
MTCPLDESISCFHIKVDPWVLVPITFRGLYVLAIRGLHILACRGLHALAFRGLRVLIFSVLYIHTLGEYKQYSAQRPQCQSPPANVSVGLCRHDIGITPTRRPVDQKKSNRALGFPALVTGLCQSYRVPVPPASSCHRDIGIEPTKTPSGPGEVQQGPGVSSFGYGPLWSYRVPVPPARSRHHDIGKDRARKTPSGPEEVQQGLGVVKL

SEQ ID NO: 230978 - protein, 149 aa, Glycine max
  Coding DNA Sequence Number=SeqID_114200
  Subcellular localization annotation: CTP_CleavageSite=64; ConfidenceScore=5.13e-01
MQDQDEGVDARFEDVRSASQTLSSWRSSSLTTHSSSGIRSYTWGQRGCTTMSGLELLSRQVAVSGDVVVGPDFSLVLVKVVAAQHGGKDAQIQISRVRISLLISSDAGLFFPEIMVMLFLFFNVQWKGKTQEAIGKKQFLVDFNRQKMN

SEQ ID NO: 230979 - protein, 560 aa, Glycine max
  Coding DNA Sequence Number=SeqID_114201
MGDNNYGGSIKQPIIDREVISIGSSSSEDTRRGAPDNESSSLEKVRASRHIGGALLALAGGELVPVTIILPPSASGGVRRGSGGRDVKLASTKDSCKLVVQACGSDDFLLCQVKLASTENCCKLAIQACGSDDFPLCQVKLANTEDSCKLVVQACGSDDFRFLRDRLFMVMATGVMADGYFGAAVDLAGRKSHSFSSFGERSRRWLGWYYGNFVRRPLVKQVGPAGGNLPPFAAALDVREEGQPVGDVGPIAVVAEAARLTPSVGHPLAPPIVEAPTADATTLAPSPPLIFVVQKVTLIAAEIILSVAMVGSIVVPSYTVVAPLSSAGVATTSASVVLPPSSSAPMVLPSTVLAVASPSSSSHPRVFLDHLYTSSDADSLWEALQWVASLEGEVAKWRAIARTVWRTEHSMVANTTIAFAKAVRLNFRLSSKVGGVLDLAGKVEGIATEGDGLTKMVADLEARLKESESRLEESELRASRERKANKELEEELLDGVFLDEEEIVAEEAIDEEQGVVEQGGDTHVLSPIWWDFLLLCGASPLMLVRSMLDLPLVEGLVAQS

SEQ ID NO: 230980 - protein, 215 aa, Glycine max
  Coding DNA Sequence Number=SeqID_114202
  Gene Ontology: Mol. function=nucleotide binding; Biological process =translation
MKHCSFVIKHKGFIIQWHQYSIKVSSEFINADKSGGEGVIAHGEQVYLRVKEKCSSKRWFASDDLNSLEELIGRLRRLKENVGFIVNRVTAIQAGLDSWQSEQINRKLYYLSFLSIIFLPLSIITGVFGMNVGGVPWTGQNTPELKEGFRNVMLLCVAMLFLVLLCFIFPALYTRIAAAWRNKRAMGRSWSLNRKSLLRRSLRIGEQERGGYLRI

SEQ ID NO: 230981 - protein, 278 aa, Glycine max
  Coding DNA Sequence Number=SeqID_114203
  Gene Ontology: Mol. function=nucleotide binding; Biological process =translation
MELARHRVMENGVGEEMEGETSARVPLRERRVYPAHPSCLVRKRAYIFDGMGNFYHKDWDLADLFQKEEKESGVGEGRGNEFSWYHVELPKGNQKLSQSAQDLIGVFCPPLKLQDILSLVSNGPFCAHVDGALVFRVNSPGPPSSDFTFRIAARVTEHSVITVSLGRVPRLGFSRVGESLLSEIPSVESSYPSRGQQQERTVIKEHVLEFLLTMNHSEEADNPVPRSVSNLVVHIIDTHVDQIQDLVTKLEMELDSVELDLDKGDFVINSLIPPPNPF

SEQ ID NO: 230982 - protein, 81 aa, Glycine max
  Coding DNA Sequence Number=SeqID_114204
MVPSDRRRGRRKRHHGGGESGARRPWPEEKRRLIDQKGNGERERKSEKEGSRSITQTVSSDILGYVARRNSTTSPWLVGTF

SEQ ID NO: 230983 - protein, 99 aa, Glycine max
  Coding DNA Sequence Number=SeqID_114205
  Subcellular localization annotation: CTP_CleavageSite=24; ConfidenceScore=5.22e-01
MCQLCTGGLVGACMLSATIACLVRISEFRLSTHLFAQRMDSSSALNEISPSSRFFLALSQRSVALSGWVAKLEDWLSECMEISTSQTYLINLKLRGNDY

SEQ ID NO: 230984 - protein, 79 aa, Glycine max
  Coding DNA Sequence Number=SeqID_114206
MEEKKRETELHCTAHVSSTKGVWIYKGEEAQAQALAACCYSPPLQQKQNQKIKMVAKPCLAAFTLRVMQALRFLGLGMA

SEQ ID NO: 230985 - protein, 59 aa, Glycine max
  Coding DNA Sequence Number=SeqID_114207
MEENNNTLLVLVLVLPSTTCNDPYALPPKQMRHEQYNVALSLFSSLPLRPKRQTGWSQA

SEQ ID NO: 230986 - protein, 46 aa, Glycine max
  Coding DNA Sequence Number=SeqID_114208
MEWGTYLDCCVLKMRKRCKKKARMQRGMRLAVDGSHSAAMAARNWA

SEQ ID NO: 230987 - protein, 95 aa, Glycine max
  Coding DNA Sequence Number=SeqID_114209
MAKTTKQSLSNWGPNHVLTLIVDNATSNDVAILLLKKRLTSWNSLIMEIMFTWNSTNLMLDTALKHWKAFEEFEMEDMKYADKLQNGGGVSIFED

SEQ ID NO: 230988 - protein, 36 aa, Glycine max
  Coding DNA Sequence Number=SeqID_114210
MKYFSTSQSMCCIAATSRIKVGFALTDIHSSNLRNL

SEQ ID NO: 230989 - protein, 76 aa, Glycine max
  Coding DNA Sequence Number=SeqID_114211
MKAVIERYNKLKEETHHLMNPASEEKVAVFVTCNPNYFTTLMAIKLRLKPPNPPSLLPSDFPSIPTLSMTFLDRES

SEQ ID NO: 230990 - protein, 102 aa, Glycine max
  Coding DNA Sequence Number=SeqID_114212
  Gene Ontology: Mol. function=transcription factor activity; Cellular component=nucleus; Biological process=regulation of transcription, DNA-dependent
  Homolog annotation: Hit_ID=Q1T3Q6; Match level="QueryCoverage=58%, HitCoverage=30%, E-value=6e-21, Identity=83%"; Hit description=Helix- turn-helix, Fis-type; Transcription factor, K-box
  Pfam annotation: Domain name=K-box; Domain location=36-102; Score =38.5; E_value=2.4e-08; Accession=PF01486.8; Description=K-box region
MGINNNHHTYWCHKTNHPLLHLFTQFSARLFGLIKEREALGINQPLKEFWQTEAASLRQQLQYLQECHRQLMGEELTGLGIKELQNLENQLEMSLKGVRMKK

SEQ ID NO: 230991 - protein, 126 aa, Glycine max
  Coding DNA Sequence Number=SeqID_114213
LLLDLKGTVEVEQMQAIMMALEGGIRVEVTLYEPRSLRIDKEVVDGREESSGGKDWGSGEFNGETKAGGNMRTGTEVIESVGMLGKSEGSRDDAETTKMEIQDFFLFRLEGWVELWLCSLNSGGSL

SEQ ID NO: 230992 - protein, 76 aa, Glycine max
  Coding DNA Sequence Number=SeqID_114214
MMAHQQLERGSMKMMQNEGLKGGKGETEASRGYGSRDICDHTNKEIHDKHISVGCQQAMSRTMKIISWNSRELGNP

SEQ ID NO: 230993 - protein, 69 aa, Glycine max
  Coding DNA Sequence Number=SeqID_114215
MEEKVKLKISGGLRSTYLKLLCFDTTCWKLAYEASIEAESLSFNKPSTWEASLRSKEGSFLGKQGRKLS

SEQ ID NO: 230994 - protein, 477 aa, Glycine max
  Coding DNA Sequence Number=SeqID_114216
  Gene Ontology: Mol. function=transferase activity, transferring phosphorus-containing groups; Cellular component=membrane; Biological process=peptidyl-histidine phosphorylation
  Homolog annotation: Hit_ID=Q6D864; Match level="QueryCoverage=45%, HitCoverage=49%, E-value=7e-79, Identity=69%"; Hit description =Phosphate regulon histidine kinase
  Pfam annotation: Domain name=HATPase_c; Domain location=139-218; Score=30.4; E_value=6.1e-06; Accession=PF02518.16; Description =Histidine kinase-, DNA gyrase B-, and HSP90-like ATPase
  Pfam annotation: Domain name=HisKA; Domain location=29-95; Score =95.5; E_value=1.6e-25; Accession=PF00512.15; Description=His Kinase A (phosphoacceptor) domain
  Pfam module annotation: Pfam domain module=HATPase_c::HisKA; Domain location=139-218::29-95
MEFRVMPYSEGQWLMVARDVTQMHQLEGARRNFFANVSHELRTPLTVLQGYLEMMDDAGMNERTRSKALNTMQEQTRRMDSLVKQLLTLSRIEAAPAIDLKETVDVPTMLLLLQREAETLSQGRHSIHFHTDPHLKVFGNDEQLRSAISNLVYNAVNHTPDGTRIDISWLRTKQGAEFKVCDNGPGISEEHLPPCARPPHHAAGDQQRAASGNLLPLRAATALDCGERNPRECGAVNATGLCDEIAAALPFITVPAAGDGSAKHADRQPEQRGLGHAGLSDDAAAGSSTAPTALAAGAAQLGAMSRPMQVDERQLFIARYGYAPLAVPVAMDALVVVVNQDNPLPSISQPQLDALFSVTRLCGAQQVPQRWGDVGLHTANWATRSIQRFGRNSASGTWGFFKQQALCRGDFRADVAEFPGSAAVVQAVASTPNSIGYASFGFHLSGVKTLPIVTASGDSVMPDAESIRSGRYPWSRP

SEQ ID NO: 230995 - protein, 56 aa, Glycine max
  Coding DNA Sequence Number=SeqID_114217
MGNGHVDFPKPRALTFPAFRFGEKCVKMALHSVCFLLLTIVSVASNIQLSDLEFVS

SEQ ID NO: 230996 - protein, 253 aa, Glycine max
  Coding DNA Sequence Number=SeqID_114218
MGETHEIPHHNLVNFELRLRYATKGRAAGGVLLPNTLEGPQFRPQPLHFAAGKVPPAMVEKGKLDHIEEMLRAIEGGGDYSFADMEKLCLVPDVVIPPKFKESLTGAAVTWYTKLEPSRVHSWKDLMVTFVKQYQDLAAQVAPPMIVSQPTLRRGRDAGLDGASSKEGKCAESPPTFIRGKHRKNQKWKKVEGLRILKMRVRESFTHEEGGGAYRPTHAGELVTYSRSNLLAQASSACPGELVTSPLSLLMDP

SEQ ID NO: 230997 - protein, 168 aa, Glycine max
  Coding DNA Sequence Number=SeqID_114219
  Gene Ontology: Mol. function=protein serine/threonine kinase activity; Cellular component=membrane; Biological process=protein amino acid phosphorylation
  Homolog annotation: Hit_ID=Q1SFV2; Match level="QueryCoverage=47%, HitCoverage=15%, E-value=4e-24, Identity=56%"; Hit description =Protein kinase; Concanavalin A-like lectin/glucanase
  Pfam annotation: Domain name=Pkinase_Tyr; Domain location=40-168; Score=-144.1; E_value=0.0013; Accession=PF07714.7; Description =Protein tyrosine kinase
MIVKNEDYKLVEWQGVGMGLIWLWALDPGGSELKSATSKFAQSEKLGQGGFGAGVKEYATEVKIISQLRHKNLVQLLGLCHGKNDLLLVYEFMPNGSLDFHLYGGKYFLTWPVTNHLKVADPKLCGAFDAEQMERFRPSVMQVFQMLKFEAELLILPVDAFDKLLAIL

SEQ ID NO: 230998 - protein, 223 aa, Glycine max
  Coding DNA Sequence Number=SeqID_114220
  Homolog annotation: Hit_ID=UPI0000DBF0F4; Match level="QueryCoverage =85%, HitCoverage=75%, E-value=6e-16, Identity=40%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
  Subcellular localization annotation: CTP_CleavageSite=9; ConfidenceScore=5.57e-01
MVRTLNPLKARTLSPLKARTLSPLKVTTLSPLKARTLSPLKARILSPLKERTLSPLMARTLNPLKVRTLSPLKARTLSPLMARTLSLLKARTLSPLKARTLSPLMARTLSPLKARNFESFDGEDFEPSKGENFESSEGENFESFDGEDFEPSKGKNFESSEGENFESSKGENFESFDGEDFEPSKGENFESSEIQSKESRLKIQESREDSIKISIKRVFQNIE

SEQ ID NO: 230999 - protein, 680 aa, Glycine max
  Coding DNA Sequence Number=SeqID_114221
  Gene Ontology: Mol. function=protein serine/threonine kinase activity; Cellular component=cell surface; Biological process =protein amino acid phosphorylation
  Homolog annotation: Hit_ID=Q1SFV2; Match level="QueryCoverage=99%, HitCoverage=99%, E-value=0.0, Identity=59%"; Hit description=Protein kinase; Concanavalin A-like lectin/glucanase
  Pfam annotation: Domain name=Lectin_leg-like; Domain location=27-256; Score=-108.3; E_value=0.04; Accession=PF03388.4; Description=Legume -like lectin family
  Pfam annotation: Domain name=Lectin_legB; Domain location=31-263; Score=188.4; E_value=1.8e-53; Accession=PF00139.10; Description =Legume lectin domain
  Pfam annotation: Domain name=Pkinase; Domain location=373-642; Score =163.1; E_value=7.3e-46; Accession=PF00069.15; Description=Protein kinase domain
  Pfam annotation: Domain name=Pkinase_Tyr; Domain location=373-642; Score=106.7; E_value=7e-29; Accession=PF07714.7; Description=Protein tyrosine kinase
  Pfam module annotation: Pfam domain module=Lectin_leg-like::Lectin _legB::Pkinase::Pkinase_Tyr; Domain location=27-256::31-263::373 -642::373-642
MATSHVGLHATSHLFCYARGIVFFLMITFVNPLSFHYQGFEYNDARIEGDATLSHSEIQLTATTRYQSNAYSVGRVTSFKLLQLWDMSSGKLTDFTTEFSFVIYSNETSFGDGFAFFFADPKLPLSNQIQQGGGLGLVDGNRLLKPTKYPFVAVEFDTHQNSWDPPGTHVGINFNSMRSNITVPWSIDIRQMKVYYCAIEYNASTHNLNVSFTGNQINGKPIKSYISCNVNLRDYLPERVIFGFSAATGFMFEMNTLLSWSFRSSLPSDEKVSNQIPPMAAPPIQNPSPSPFPTANISPKQEGNKGLLKGIEAGIGIAASFLILGLVCIFIWKRAKLKKEDSVFDLSMDDEFQKGIGPKRFCYKELASATNNFAEAQKIGQGGFGGVYKGYLKKLNSNVAIKRISRESRQGIKEYAAEVKIISQLRHRNLVQLIGWCHMKKDLLLIYEFMQNGSLDSHLYRGKSILTWQMRYNIAMDLALAVLYLHEEWEQCVLHRDIKSSNVMLDLSFNAKLGDFGLARLVDHEKGSQTTILAGTVGYIAPEYCTTGKARKESDIYSFGVVLLELASGRKPIDLNAKEGQITIFEWVWELYRLGKLLEVVDSKLGGAFDEEQMEHLVIVGLWCANPDYTSRPSVRQVIQVLTFEAPLPVLPQKMPEPYHHSPTMSTIFASVSSLSLATC

SEQ ID NO: 231000 - protein, 243 aa, Glycine max
  Coding DNA Sequence Number=SeqID_114222
  Homolog annotation: Hit_ID=Q10NT0; Match level="QueryCoverage=27%, HitCoverage=7%, E-value=2e-07, Identity=40%"; Hit description =Expressed protein
  Pfam annotation: Domain name=DUF593; Domain location=119-212; Score =75.0; E_value=2.4e-19; Accession=PF04576.6; Description=Protein of unknown function, DUF593
  Subcellular localization annotation: CTP_CleavageSite=42; ConfidenceScore=5.03e-01
MQTLGLLVAPVLGFYLRFLRFSLRFLLLMFMDFPSTFKFITQASELGCGFLLLGYFSRLFNFLGLLLIFFFCLKFLRSPLLISNHEKSSSSSSRDDNSNSKEEENLFREESLEDEVFDVMSLRRMVKEERQRYNAACAEIEQEQGAAASAAEEAMSMILRLQSEKSAVEIQAKQFQRVVEQKQEYDLEVIESLRWTVVQVESQKNLLERQLGVLRERLRQFVNDQEIQQLQEQEQEQELQGTA

SEQ ID NO: 231001 - protein, 266 aa, Glycine max
  Coding DNA Sequence Number=SeqID_114223
  Gene Ontology: Mol. function=methylmalonate-semialdehyde dehydrogenase (acylating) activity; Cellular component =mitochondrion; Biological process=valine metabolic process
  Homolog annotation: Hit_ID=Q2HV89; Match level="QueryCoverage=96%, HitCoverage=55%, E-value=2e-87, Identity=62%"; Hit description =Aldehyde dehydrogenase
  Pfam annotation: Domain name=Aldedh; Domain location=1-263; Score= -141.6; E_value=1.3e-09; Accession=PF00171.12; Description=Aldehyde dehydrogenase family
ASVMLAELAMEAGLPEGVLNIVHGTHAGMHIYARAAAKGKRVQANMGAKNHVVVMPDANVNALVAAGFGAAGQRCMALSTVVFVGGSKLWYLSLSRMVNSFHPFDNTGDCSKYFDLFVMQSWESKLLEHAKALKVNVGTKPDADLGPVISKQVLGYESGNFIDPTILSDVTANMECYKEEIFGPVLLMEADSLEEAINIINENKYGNGASIFTTSSVAARKFQAEIEAGQVGINVSSSFALFLIYWQQGLICWRSQFLRYSDFSLS

SEQ ID NO: 231002 - protein, 279 aa, Glycine max
  Coding DNA Sequence Number=SeqID_114224
  Gene Ontology: Mol. function=structural molecule activity; Cellular component=intermediate filament; Biological process=homophilic cell adhesion
  Homolog annotation: Hit_ID=UPI0000DBF0F4; Match level="QueryCoverage =99%, HitCoverage=87%, E-value=2e-28, Identity=36%"; Hit description =Choline-phosphate cytidylyltransferase B (EC 2.7.7.15) (Phosphorylcholine ...
  Homolog annotation: Hit description=transferase B) (CTP:phosphocholine cytidylyltransferase B) (CT B) (CCT B) (CCT-beta).
RLKVLAIRGLKVLAFRGLKVLAFRRLKVLAIRGLKVLAFRGLKVLTFRGFKVLAIRGLKVLSFRGLKILAFRGLKVLAFRGLKVVTFRGLKVLAFRGLKVLAFRGFKVLTIRGLKVLAFRELKVLTFRGLKVLTIRGLKVLVFRGLKVLAFRGFKVFAIRGLKVLAFRELKVLTFRGLKVLTIRGLKVLSFRGLKVLAFRGFKVLTIRELKVLTFRGLKVLAFIGLKVLTFIGCKVLALEDSKSSPLEDSKSSPLEGSKSSPLEGSKSLPLEKSKSSPL

SEQ ID NO: 231003 - protein, 326 aa, Glycine max
  Coding DNA Sequence Number=SeqID_114225
  Gene Ontology: Mol. function=hydrolase activity; Cellular component =mitochondrion; Biological process=cell division
  Homolog annotation: Hit_ID=Q2HV98; Match level="QueryCoverage=97%, HitCoverage=38%, E-value=1e-134, Identity=78%"; Hit description =Dynamin central region; Dynamin; Dynamin GTPase effector
  Pfam annotation: Domain name=Dynamin_M; Domain location=1-162; Score =39.1; E_value=5.2e-13; Accession=PF01031.10; Description=Dynamin central region
MSTSELSGGARIHYIFQSIFVRSLEEVDPCEDLTDDDIRTAIQNATGPKSALFVPEVPFEVLVRRQISRLLDPSLQCARMCLNKIPSLQISHRCMVTELQRFPFLRKRMDEVIGNFLREGLEPSENMIAHLIEMEMDYINTSHPNFIGGSKALEIAAQQTKSSRVAIPVSRQKDALESDKGSASERSVKSRAILARQANGVVTDPGVRAASDVEKIVPSGNTGGSSWGISSIFGGGDSRMTMKENIASKPHAEPVHSIEQSISMIHLREPPPILRPSESNSETEAIEITVTKLLLRSYYGIVRKNVEDLIPKAIMHFLVLYYFISL

SEQ ID NO: 231004 - protein, 79 aa, Glycine max
  Coding DNA Sequence Number=SeqID_114226
  Gene Ontology: Cellular component=extracellular region; Biological process=response to biotic stimulus
  Homolog annotation: Hit_ID=Q9XFB4; Match level="QueryCoverage=93%, HitCoverage=48%, E-value=7e-22, Identity=64%"; Hit description=PR1a precursor
MGLCKVSFSVLCVLGLVIVSHVAYALDSPSDYVNAHNAARSEVGVQNLAWDDTVAAFAQNYANQRKGDCQRGESCNEHG

SEQ ID NO: 231005 - protein, 215 aa, Glycine max
  Coding DNA Sequence Number=SeqID_114227
  Subcellular localization annotation: CTP_CleavageSite=62; ConfidenceScore=5.35e-01
MRRGGEGENMAVPQLTSSSSTRRLSLRTTRPDPFLSLCKCFSFVVVLSAILCIAVNVLSAIRSFKHQSDIFDGIFRCYAVFLACFVVLAETEWNFIIKFWKVLEYWVGRGMLQIFVAVMTRAFPDYSGERKELVIFQGIACYMLLACGSIYVVSGSMYYILRVTVPLYYHLKGILCVGLLKRSRQKQEISREQAEKDLQELERRREELEQLLITE

SEQ ID NO: 231006 - protein, 729 aa, Glycine max
  Coding DNA Sequence Number=SeqID_114228
  Gene Ontology: Mol. function=RNA binding; Cellular component =ribonucleoprotein complex; Biological process=mRNA metabolic process
  Homolog annotation: Hit_ID=Q2HVA1; Match level="QueryCoverage=88%, HitCoverage=98%, E-value=1e-176, Identity=54%"; Hit description=KH, type 1
  Pfam annotation: Domain name=KH_1; Domain location=146-208; Score =43.6; E_value=6.8e-10; Accession=PF00013.19; Description=KH domain
  Pfam annotation: Domain name=KH_1; Domain location=327-395; Score =40.8; E_value=4.5e-09; Accession=PF00013.19; Description=KH domain
  Pfam annotation: Domain name=KH_1; Domain location=419-486; Score =74.5; E_value=3.4e-19; Accession=PF00013.19; Description=KH domain
  Pfam annotation: Domain name=KH_1; Domain location=46-106; Score =48.0; E_value=3.3e-11; Accession=PF00013.19; Description=KH domain
  Pfam annotation: Domain name=KH_1; Domain location=659-721; Score =62.0; E_value=2e-15; Accession=PF00013.19; Description=KH domain
  Pfam annotation: Domain name=KH_2; Domain location=146-189; Score =5.4; E_value=0.027; Accession=PF07650.7; Description=KH domain
  Pfam annotation: Domain name=KH_2; Domain location=419-463; Score =1.2; E_value=0.086; Accession=PF07650.7; Description=KH domain
  Pfam annotation: Domain name=KH_2; Domain location=46-96; Score=11.6; E_value=0.0049; Accession=PF07650.7; Description=KH domain
  Pfam module annotation: Pfam domain module=KH_1::KH_1::KH_1::KH_1::KH_ 1::KH_2::KH_2::KH_2; Domain location=146-208::327-395::419-486::46 -106::659-721::146-189::419-463::46-96
  Subcellular localization annotation: CTP_CleavageSite=52; ConfidenceScore=5.74e-01
MGSNFLSPPAKRSALDPNPFPPNGPSKRSRQSKPPPPLSVPPGHVAFRLLCNASRIGGVIGKSGSVIKTLQQSTGAKIRIEDAPQESPDRVILVIADAALSCKVLLRNEEVVEVSKAQEALLKVFDRILEVAAEMEGVDVGDRVMSCRLVADSAQAGSVIGKGGKVVERIKKETGCKIRVLTDDLPLCASASDEMIENLKVRAWLLAVNVERIEGRVSSVKKALVAVSQRLQDCPSVNRIKMMGNKPYEIVQYETLDALPREILTAAPRGTLTVVPHETVDHLLLRSSALSTLSSSSNSYATRVHSLSAEVNRVSSLEPKALQQEVSFRILCSNDRVGGVIGKGGNIVRALQSETGATISIGPLVAECEDRLITIAASENPESRYSPAQKAAVLVFSRSIEVGFEKELDSGLNKGSTVTVRLVVPSSQVGCLIGKGGVIVSEIRKATGANIRIIGTDQVPKCASDNDQVVQISGEFSSVQDALYNATGRLRDNLFVSTQNSAGTRSLSSLRVDTSPYGIQQDFVPHGSQLPATTSHCLSRHTFAQGIDHLGLSRNLDHPSSPGLWTRNLDRTSSPLLWTRNLDCPSSPGLWTRNLDRPSSPGLWTRKLDRPSSPGLWTQPTVAGINSRSINDFSLGLTSRKGGLELVSGSKSAIVTNTTVEIVVPDDTIDCVYGENGRNLVRLRQISGAKVVIHEPRPGTSDRIIVISGTPDETQAAQSLLQAFILSGS

SEQ ID NO: 231007 - protein, 685 aa, Glycine max
  Coding DNA Sequence Number=SeqID_114229
  Gene Ontology: Mol. function=transferase activity, transferring phosphorus-containing groups; Cellular component=chloroplast; Biological process=phosphorylation
  Homolog annotation: Hit_ID=Q93YW0; Match level="QueryCoverage=91%, HitCoverage=84%, E-value=1e-154, Identity=47%"; Hit description =EXECUTER1 protein, chloroplast precursor
  Subcellular localization annotation: CTP_CleavageSite=50; ConfidenceScore=5.80e-01
MASLSSSRTTTQFNLPNSKLCSSLPFSFSTRPSFLFSSLNKFYSYSNSLRCSASVEDTEWDWERWQNHFHVVDEQELLLDILKSRLGDALRLEDYEDAATLKVAIATVATKDTVGTAISHLKRAIEEERYSDAAFLRDEAGTGLVGWWAGMSKDINDPHGLIIRITPEHGRYVARSYSPRQLATSAAGVPLFEFFLTKNKNGEFKSQVVYLKRREAFHTPPTTSSKALDAAERLRSVESPEDRSELVVGSPEDPEVVDDRNDNSDPSEAMPGFQNVLKDTIPGVKMKVLKVTTPDKVDNDTISKVIEQITDDEGNEDEDSDECAGKDNETENPELSDIKTETDDEIELNSSVESFEREEQNKIAVKVIVGGLVQKLPSSLTTRNLLRVPAKLEKTGQGSFSLTFEKVANQQVGHGKGKPSSDKSTKIQRQNSVDGVMVNLAKLIGRGKVLKDLGELISLSLSRAWNHERLSGSTMFSRIEIPTSLDPLNGLYIGAHGLYSSEVIQLRCRYGQWQEDGGPKEPSDLEFCEYVEALKLTGDSYVPVGQILKNRNIDRHSSCTCTLMQGITYAEGKYSMYSVWLQFFLWELTNQCSIDPGFNVAFRAKVGKRYQLPLKGIIPKEFGVIARYKGQGRLAEPRFENPRWVDGELVILDGKYIKAGLVIGFMYLTPENPFLVLFNRLRLQK

SEQ ID NO: 231008 - protein, 357 aa, Glycine max
  Coding DNA Sequence Number=SeqID_114230
  Gene Ontology: Mol. function=transferase activity; Cellular component= membrane; Biological process=metabolic process
  Homolog annotation: Hit_ID=Q6ZIF8; Match level="QueryCoverage=77%, HitCoverage=64%, E-value=6e-87, Identity=56%"; Hit description =Putative pectin-glucuronyltransferase
  Pfam annotation: Domain name=Exostosin; Domain location=90-351; Score= 68.6; E_value=2e-17; Accession=PF03016.6; Description=Exostosin family
MPVSRENSIWAVRNRARSSCGHAIAVFSDTRVCIGGYVLVLFIFYTQQPPDLPSDSDALRRTLPFSSGVFHSPEEAFRLDYQKMEEEFKVFVYPDGDPETYFHTPRKLTGKYASEGYFFKNIRESRFFTDDPRRAHLFFLPISCHKMRGRLPSIVSDVNCNAHMNMQGLTNERMIDEVEKYVEHLKFEYPYWNRTLGADHFFVTCHDIGVKATKGVPHMMKNSIRVICSSRYDDDGYIPHKDVTLPQVQLPFFHPPGGNDIKNRNTLAFWAGRSDSRLKEDLIAIWDNDTEIDIQNSRVDLRATGPVVYMEKLYKSKFCLCPHGPIGSSRIADSIHFGCVPENYYSYWKESPDSNRE

SEQ ID NO: 231009 - protein, 159 aa, Glycine max
  Coding DNA Sequence Number=SeqID_114231
  Gene Ontology: Mol. function=sequence-specific DNA binding; Cellular component=nucleus; Biological process=regulation of transcription, DNA-dependent
  Homolog annotation: Hit_ID=Q9AT62; Match level="QueryCoverage=41%, HitCoverage=29%, E-value=1e-18, Identity=68%"; Hit description=MADS box transcription factor
  Pfam annotation: Domain name=SRF-TF; Domain location=9-59; Score =92.3; E_value=1.4e-24; Accession=PF00319.9; Description=SRF-type transcription factor (DNA-binding and dimerisation domain)
MVRRKIPIKKIDDVTARQVTFSKRKSGLFKKARELSLLCDAEIALIVFSPGGKLFDYGSSRISSAWEHLARLCVELDLRRASAFNMFCLWKIYGHKIDQCDHEKNQLRGYTSRNHEDVGQAKNREQVVKEGKSSIIKEKSTVKFRPYNGEHACSYGNPL

SEQ ID NO: 231010 - protein, 683 aa, Glycine max
  Coding DNA Sequence Number=SeqID_114232
  Homolog annotation: Hit_ID=Q2HVA8; Match level="QueryCoverage=15%, HitCoverage=63%, E-value=6e-21, Identity=48%"; Hit description =Peptidase C48, SUMO/Sentrin/Ubl1
  Pfam annotation: Domain name=Peptidase_C48; Domain location=246-445; Score=61.5; E_value=2.7e-15; Accession=PF02902.9; Description=Ulp1 protease family, C-terminal catalytic domain
  Subcellular localization annotation: CTP_CleavageSite=52; ConfidenceScore=5.06e-01
MTRRKRSSSSSSSSTKKFEVFEFNDEDENVEKTSRKILRKFANPSTSSSRSRSSTVTKYDFLQALASGTNSKPLSDDVTADPIDLDSEQEEEMKRSPEEVANKPLEVVVDDDGGGGGGGGGGGDGGVVDNRGKCDNRCSIDTPLLDSADEEIPGHTDFAESDLDSKNQSLDVVSDDGDSNQMSSSSTSTSNPSEDEGGKKSDYGILNNSIMTTEVGEERPQKTMNEGSFDEAFDEVIYPKGEPDAVSISKRDIELLQPQTFINDTIIDFYIKYLKKKLPTDEQNRFHFFNSFFFRKLADLDKDPSSACDGRAAFQRVRKWTRKVNLFEKDYIFIPVNYSLHWSLIVICHPGEVSCFKDEEIKESSKVPCILHMDSLKGSHKGLKNVFQSNWFPPLEVSLKRSHIQSVIYDIFENNSLQAPHTDCLDKDLLLEDPAIIVNPKLEEDSLRGCCYPTASPIRVASCLTGPGLVSKDLVAVVTSRSACLQMSACHQRGFLSPLEEIEESSEETVLSLERENSQVGILAYDFPATYVSNDHGASETFQVGFSVNFVEAVESHSHSRTSTGVSWIPSNTATHEDQPLEKIEESSIPDKTALEYLSTSVSGEELTDYTVPDSPVANDVDVSVESHSSFRNNMNSVTHQIFDLTHNTSLEDNTLVSKEESLAFESDERDAKRPKLMNAGWL

SEQ ID NO: 231011 - protein, 124 aa, Glycine max
  Coding DNA Sequence Number=SeqID_114233
  Homolog annotation: Hit_ID=Q1SG95; Match level="QueryCoverage=38%, HitCoverage=32%, E-value=3e-07, Identity=54%"; Hit description =Transcription factor, K-box
MGQLNGEEIQGLTIKELQKVEELLQRRWTTISKIKDEKIIQEINHLKTKKPSDLNLEAYETSTILKCVNDRGGRFATLQVPTPERPLKVSNLKVGQSIIPLALSLKHLKHIIQSASVVTTSQNS

SEQ ID NO: 231012 - protein, 61 aa, Glycine max
  Coding DNA Sequence Number=SeqID_114234
  Gene Ontology: Mol. function=sequence-specific DNA binding; Cellular component=nucleus; Biological process=regulation of transcription, DNA-dependent
  Homolog annotation: Hit_ID=Q1SG97; Match level="QueryCoverage=74%, HitCoverage=21%, E-value=8e-16, Identity=91%"; Hit description =Transcription factor, MADS-box
  Pfam annotation: Domain name=SRF-TF; Domain location=9-59; Score =98.7; E_value=1.7e-26; Accession=PF00319.9; Description=SRF-type transcription factor (DNA-binding and dimerisation domain)
MARKKIPIKKIDNINARQVTFSKRRKGLFKKAQELSTLCDAEIALIVFSTTSKLFEYASSR

SEQ ID NO: 231013 - protein, 48 aa, Glycine max
  Coding DNA Sequence Number=SeqID_114235
MSSMQQILERRDRHSGIQGLVNPSIGQQLGSDSLGILRKEIEHKTNEM

SEQ ID NO: 231014 - protein, 282 aa, Glycine max
  Coding DNA Sequence Number=SeqID_114236
  Gene Ontology: Mol. function=chitin binding; Cellular component =extracellular region; Biological process=chitin metabolic process
  Homolog annotation: Hit_ID=UPI000044A8F0; Match level="QueryCoverage =80%, HitCoverage=99%, E-value=4e-37, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHALTYRGVHVLGFKGQQVQTFRGLHVLPIKGLHALAIRGLHALAIRGLHVLAIKLLHALTFRGLHVLTFKGLHALTFRGLHILTFRMLQVLTFRGLHVLAIRGQHALAYRGLHVLAIRGLHALAIRGLHVLAITWLHALTIKELHVLAFKGLHALAFRGLHVLAIRGLHVRAFRGLHALTLGGLHVLTIRGLHALAITRLHVLAFKGQHVQTFRGLHVLPIKGLHPSPSEDYTPSPLENYTFSPSEDYTPSPSEDYTSSPLECYKCSPSEDYTSSPSEGC

SEQ ID NO: 231015 - protein, 446 aa, Glycine max
  Coding DNA Sequence Number=SeqID_114237
  Gene Ontology: Mol. function=RNA-directed DNA polymerase activity; Biological process=RNA-dependent DNA replication
  Homolog annotation: Hit_ID=Q1RYI2; Match level="QueryCoverage=18%, HitCoverage=12%, E-value=9e-14, Identity=46%"; Hit description =Ribonuclease H
MKLKKGKKGWMTIKIDLEKTYDRLSWDFIKDTFQEGDTTDERSDHWVCWEGICSPKEIGGLGLRQARHVNDVFTMKVAWELCTKNDALWVQVIRAKYNCGELGFPVVNKARNDSNLWSVIKSVRDKFVTGCEGNVEDDELIWRASNKGVLDIPSAYKMIANLDGRQSIPIFILVWRWEGYERWKIARRALPTNLAHWNRKMTLEFLCLLCNKEPESVMHCLRDSEEVRQLHLGFMRLNVDGACGGVIGDHTGKFQGAFACNLKSCSITQLELWAILHGINMARERGFMALEVHSDSEEAIQRVQGLQEVEWGRAARSKNSGITEARETNKESATSFSTVLTASWCHCAPPHSAALWDPSSPSDTPHPQPQPPPKATARSRLGHCLSGRSEKCLPQVGEKMVEFRKSSRIISALSGRCLREMRWSPMTPVRLSGARGVEGGGGGEKI

SEQ ID NO: 231016 - protein, 41 aa, Glycine max
  Coding DNA Sequence Number=SeqID_114238
MSDHALNATTSRLSEYGGEHALSRGFALKTLLGFFMGPSSR

SEQ ID NO: 231017 - protein, 275 aa, Glycine max
  Coding DNA Sequence Number=SeqID_114239
  Gene Ontology: Mol. function=DNA binding; Cellular component=beta -galactosidase complex; Biological process=DNA integration
  Homolog annotation: Hit_ID=Q1SJY5; Match level="QueryCoverage=70%, HitCoverage=19%, E-value=3e-65, Identity=60%"; Hit description =Integrase, catalytic region
MHPTKYLGLDEESTKVDGTQYRTMISSLLYLTASRPDIMFSVCLCARFEKEPREVHLTAVKPIFRYLIGTPNFGLMFKRRESFRLTSYCDADYVGDKVERKRTSGSYHFIGGNLVTWICKKQGSTSLSTIQAEYMSATSFCAQLLWIKNQFEDYSIYESKIPIFCDNKVVITLSKNPALHSKEKHIEIKNHFYKRLCLKWDNGLVATCPFVGERRRGSRVRFPKEERCAESPPMFICGKCRKNRRKPVKMKILSSGVVFTFEASHVCLKGQQPIF

SEQ ID NO: 231018 - protein, 174 aa, Glycine max
  Coding DNA Sequence Number=SeqID_114240
  Gene Ontology: Mol. function=DNA binding; Biological process=DNA integration
MVSRPFSTKRKGNLYKIRLGELSDQKVSCLLSIKENHWLWHRKLGHASWRLISKLQKSNLVRCLPSMTYKDDLLCEACQKGKQIENSFTSKNIVSTSRPLQLLHHDLFGPTRIASTGGKRYSETSKAFKRALVVEEAIHIRFDKNKHDKDLSELDASFVDLRLDDSSIATNSSR

SEQ ID NO: 231019 - protein, 101 aa, Glycine max
  Coding DNA Sequence Number=SeqID_114241
  Subcellular localization annotation: CTP_CleavageSite=43; ConfidenceScore=5.41e-01
MWDTLAVTYKGMPKVKRTNSVSSLDKGIRREKSLALSSQKNKKASSSREQVLRSSSKALKVDDSSDNSSEEDSKMKMSSPLYVIKSIRCEETKVGPSDEAP

SEQ ID NO: 231020 - protein, 234 aa, Glycine max
  Coding DNA Sequence Number=SeqID_114242
  Subcellular localization annotation: CTP_CleavageSite=63; ConfidenceScore=5.09e-01
MSFELQKVAVGLNAYSPLSTASVPLARLNARLALSPIPLTQAKCEGGTKRKCTAFHSAYFGKRALEAAKRNNLCIEAGITIGSLRVIRRPEPHLSFLFACLYVFVDVHGEVALRKWMMDKDTLRCSRRRGSKNLEELASGDYPTFAITLDCHPYDFVRPSRPGRIGGEVVEHPQRMLKWISSYLYNYTMEEEARLHPHFGYIWCHVLLLDEPHVPLITIEANASYDYPFEHTSL

SEQ ID NO: 231021 - protein, 578 aa, Glycine max
  Coding DNA Sequence Number=SeqID_114243
  Gene Ontology: Mol. function=heat shock protein binding; Cellular component=integral to membrane; Biological process=protein folding
  Homolog annotation: Hit_ID=Q1SGA1; Match level="QueryCoverage=84%, HitCoverage=99%, E-value=7e-68, Identity=58%"; Hit description=Heat shock protein DnaJ, N-terminal
  Pfam annotation: Domain name=DnaJ; Domain location=72-134; Score =46.0; E_value=1.3e-10; Accession=PF00226.21; Description=DnaJ domain
MDGQGHGGGSRAEAERWLYTANKVLSARDLHGARSFAIRARESDPRYEPTELLLTVIDTLMAGEARINDHFDWYAILQVLRYTQNIDYITAQYRRLATQLDPHHNPFAFASHAFTLVNDAWSVLSNPTKKAFYDNQLRLLTQPAPPPQPPPPPPPPPLASPAPVAFFPIQPPQPNLNPNQFPQRESPRPRVEVEPPPPPPSQVDNATELTRASDVETEGVSFWTACPYCYVMYEYPKVYEDCTLRCQNCRRGFHGVVVPSPSKDGTFGSFCSWGFFPVGFSGDFKDINGSSSKWNPFSPLFPCALQGGEENGRYQKGPWVFYDDDESAEFVEGGSDTTEDDSDDDDWRGGNQKGTTRKRKRRKKSSNVGGGGDVRRVPTTIERPRRGVQNSDGNDNVENGEAVDGGTGGAIAVVVPESSKKAVALGGSRRRSERNLGKLDLNVEFSNEVEEPMYGPGEGNVNGNAEDNIEGIGFFEGLDEFLSSLPILNVVADDKFCGFALMFCKRHTSLNEFVYLTKILKVPTNWHLPTTTSPMGYMCFYIILRQVLWWVMIVKAYTRFSGGIFLGAFSPLLHFKRK

SEQ ID NO: 231022 - protein, 502 aa, Glycine max
  Coding DNA Sequence Number=SeqID_114244
  Gene Ontology: Mol. function=RNA-directed DNA polymerase activity; Cellular component=chromatin; Biological process=RNA-dependent DNA replication
  Pfam annotation: Domain name=RVP_2; Domain location=167-264; Score= -50.7; E_value=0.009; Accession=PF08284.2; Description=Retroviral aspartyl protease
MGCYEEHKVISATYMLSGKAKDWWKFTSQTLLREEGVIAWGAMIVGEYASKFNELMKYFPYYRNSENGEDIYAQFKNGLRADIHTMVSVFQLIDLLTLVSKCRIYEASAKGKQVEPKNNNNNYYYYYYYSQVNGALTEGLLICTLEERQPWKYGAKVDYKNNNGVKPKVAGKVFVISGSESLDFHVSSLPYEVVVSTPIDKPVTTSSACLDCSMMVNNKNFSMNLICLPFSHLDVVLGMDWLLSNHVILNCKNKTLIFGACAQNILGSSSLEISHASEAKRVENVKAFMVLSNTKESLNIGGMPIVCKFPKVFLRDVIELPPERALEFAINLVLGSSLVSIAPYWMSLMELAEVKKQVEGFLNKQLVRPSVSSWGAPTLLVKKKDKSMRMTAFRTCYGHYEYLVMPFGVTNVPIVFMDYMNWIFHQYLNKFVVELKKRFTSAPILILPDLEKKFEVYCDASGQGLGCILMQEREMIAYDSRQLRLNEVNYPTHDLEQMAMVF

SEQ ID NO: 231023 - protein, 78 aa, Glycine max
  Coding DNA Sequence Number=SeqID_114245
KEHALRRPYRTRATARVMGEVEEVQEKMKADMEAMKEQMATMMEAIMIMKKVMEANVVAVAVTSTVAKVNPMPPSGLN

SEQ ID NO: 231024 - protein, 102 aa, Glycine max
  Coding DNA Sequence Number=SeqID_114246
  Gene Ontology: Mol. function=chitin binding; Cellular component =extracellular region; Biological process=chitin metabolic process
  Homolog annotation: Hit_ID=UPI000069F178; Match level="QueryCoverage =80%, HitCoverage=22%, E-value=7e-09, Identity=36%"; Hit description =UPI000069F178 related cluster
  Subcellular localization annotation: CTP_CleavageSite=85; ConfidenceScore=5.45e-01
MARTCSPLKVRTCSPLKVRACSPTKVKAHDPLTARTCSPLKLKVRACSPLKASSCSPLEVRACSPLMVRTCRPLKARTCSPLTVRVTSTQGEGVQPSQGKDM

SEQ ID NO: 231025 - protein, 347 aa, Glycine max
  Coding DNA Sequence Number=SeqID_114247
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=1e-33, Identity=33%"; Hit description= UPI00006A17C9 related cluster
YLSPFRGLHVLTFRGLHVLNFKGLHVLAIRGLHILAFRGLHVLAIRGLHALAFRGLHVLTFRGLHVLALRGLHTLAFRGLHRTTRPRLVGLHAFTFRGLHVLAFRGLLSSPSEEYTSSPSEDYTSSPSEDCTSSPPEDYLSSPSEDSTSSPSEGYTPSPSEDYTSPPSEDYTSSPCRATRLHLQRTTRPRLQRTPVLAFRGIHVLAFRGLHVLAFRGLHVLASRGLPVLAFRGLHMLTFRGLHALTFRGLHILTVGGLHALAFSGLHALAFRGLHVLTFKGLHTLIFRGLYVLPLRGLYVVPLIGLHVLAFRGLHILHFRGLHVLPFRGLHALAFSRLHIRTLREFK

SEQ ID NO: 231026 - protein, 140 aa, Glycine max
  Coding DNA Sequence Number=SeqID_114248
VKLPAFIVDHRVVPGDMSRGSGDLGDVRRAPGSQQIKGKQDHKARRLVVAGQLLENEVRKLRKPLVIDYQGIVMAAQLIRDRVEMECLEGAWETLEGNTRCRFRGTIRFTATSLVHPDEPARTLQRTVEWTAPWISFVYF

SEQ ID NO: 231027 - protein, 148 aa, Glycine max
  Coding DNA Sequence Number=SeqID_114249
MDSQKASTSGYDGSNNTKHRDVIQLYEAQQRKKAKEEVGVVAEKENVASIQAKAFAKSVDDTIVPGIIIVLTNTGVMDETPEESNIVMADEVEHNVIEPTSKQSKTSNVATSRDKGEPDAIIVTLPVPASLLSTMHNPPLSLEIKYKI

SEQ ID NO: 231028 - protein, 281 aa, Glycine max
  Coding DNA Sequence Number=SeqID_114250
  Gene Ontology: Mol. function=carbonate dehydratase activity; Cellular component=chloroplast; Biological process=carbon utilization
  Homolog annotation: Hit_ID=Q69MC9; Match level="QueryCoverage=83%, HitCoverage=83%, E-value=4e-45, Identity=40%"; Hit description =Putative carbonic anhydrase
  Pfam annotation: Domain name=Pro_CA; Domain location=110-258; Score =43.5; E_value=7.4e-10; Accession=PF00484.9; Description=Carbonic anhydrase
  Subcellular localization annotation: CTP_CleavageSite=54; ConfidenceScore=5.60e-01
MAAPAPFSLSSDPFASKSATSTIFGPAALKKGNFEQTHFGIFTALRRNQGFTLKASMGPPGFTEKLNNNKLKTLADAEDGCDIFNDLKDRFLSFKKNKYLKNIEHFENLAKVQTPKSGPTETNAALEFAVNSLLVENILVIGHSCCGGIRALMGMQDDDVEKSFIKSWVIAGKNARKKAKAAASNLSFDEQCKHCEKGKGVGVGVGRVGTSILTEESINHSLLNLLTYPWIEEKVANGELSIHGGYYDFTDCSFEKWTLDYRGTKLEENGKIAAKNKIFWC

SEQ ID NO: 231029 - protein, 137 aa, Glycine max
  Coding DNA Sequence Number=SeqID_114251
MAARGGHRWSWVMEEEFLGWFGRSYNLQISLCELVSLNSAIPSWVGILLSALLTPSERSFNGDFPPWRCSGRQRRRGERRRHLLGNKPWKKELHHQDEPWIRSLEECFNGGKERGRERERGEHKIEGIKEGEKWNFE

SEQ ID NO: 231030 - protein, 49 aa, Glycine max
  Coding DNA Sequence Number=SeqID_114252
MEHMATNHVDSINWILKKFVNRYAGKINIFKVIEDAQKKANAHTVLEFD

SEQ ID NO: 231031 - protein, 323 aa, Glycine max
  Coding DNA Sequence Number=SeqID_114253
MNDTAHNKAAMPHTCLMISRGFDQSIAKKYEATVSLLWVETIPQPGFAVAEILPSLDRWLCLFSFLSSNFTQLPLILDLGVSQKDLILSMEFSTMKKKKKKHLHDGRTIALNPETETFLVIRIPDALVLRIVSRSLIVAMVLAALPFLGTVLEGFYFSSSFVPNLDTGSLDVGLLNSILHDFAEEGLLRENDKALIVNSPVPDIFREKIDAVMNSDWESKSLFADESYDFVFTSGAIDAEFIDRILKNDGIVALPLGTKSSNSAFKEQSNYKVVSLKRYGFVIVALKKTGPAIRLLVDSEYSSPKRKLLAIKTKTGQGVGLIN

SEQ ID NO: 231032 - protein, 125 aa, Glycine max
  Coding DNA Sequence Number=SeqID_114254
  Subcellular localization annotation: CTP_CleavageSite=20; ConfidenceScore=5.44e-01
MASSKLFITAFLLALTFSSMSMSLAARHLMQTSTAPNLPGIPSLPSPTLPPLPSLPTLPQANVPPLPTIPTLPQPNLPSLPTTLPPLPSSIPTIPTLPQLNIPPLPSIPTTMPSIPFLSPPPSTP

SEQ ID NO: 231033 - protein, 161 aa, Glycine max
  Coding DNA Sequence Number=SeqID_114255
MEGIVVGIVNVGIEGVLGNEGMVGMLLGSGGKVVGKDGRVGCGSVELNEITIEWDLDSFPGWFYSMNPTPKPRSSDPTYLQLGGSVRINGEGNLYSGQSVTGGNGGNITRGGELPILGIVGAISFLLAWTLLMDKSDKAMKKNDKRNTRKEAILVVYGRNQ

SEQ ID NO: 231034 - protein, 125 aa, Glycine max
  Coding DNA Sequence Number=SeqID_114256
MQPTITESQNQTPRIRVPMYPISRKGKEGIVVGTVGKFGSKVAASGGRVTCGTVGMVGRDGIVGKGKGGNVGFGKGKFGAVLVCIRWRAARPKSMHEKEIAMKKAKMKQLLEAMAKDLMNLLCDN

SEQ ID NO: 231035 - protein, 59 aa, Glycine max
  Coding DNA Sequence Number=SeqID_114257
MEHHIYVSLLSLSKYASGFIFGVRSDQVISYNQSKNEDAKKVGNGSQGFIINHISYKKK

SEQ ID NO: 231036 - protein, 107 aa, Glycine max
  Coding DNA Sequence Number=SeqID_114258
  Pfam annotation: Domain name=zf-CCHC; Domain location=17-34; Score =21.9; E_value=0.00024; Accession=PF00098.13; Description=Zinc knuckle
ISNINPKKKGEDSSLAPKCYECDQPGHRRFNCPIFKRRMEKSDKRNFKEKKAYITWEDNNMDSSSDSENEIINMGLMVKDYESEEEIMSSNYDLSISFDELQDALND

SEQ ID NO: 231037 - protein, 230 aa, Glycine max
  Coding DNA Sequence Number=SeqID_114259
  Gene Ontology: Mol. function=signal transducer activity; Cellular component=membrane; Biological process=response to light stimulus
  Homolog annotation: Hit_ID=Q1SGA7; Match level="QueryCoverage=78%, HitCoverage=26%, E-value=1e-76, Identity=80%"; Hit description =BTB/POZ; NPH3
MPPWKFSMLLVLITIKGKIDWWIFLSVAIHLIYHITELSPDIKSNNSMAHPTLSEHERKRLCRVMDCQKLSIDACLHAAQNERLPLRVVVQVLFAEQVKISNALASSSVKDVESESHAMVTNRKTLLEGTPQSFQEGWTAAKKDINTLKFELESVKAKYMELQNDLASLQKQFDKMLKQKHTSAWSSGWKKLSKLGRTTHLVENQDDSPKIPDSLEQNRKTTRRWRNSIS

SEQ ID NO: 231038 - protein, 294 aa, Glycine max
  Coding DNA Sequence Number=SeqID_114260
  Gene Ontology: Cellular component=membrane of vacuole with cell cycle- correlated morphology; Biological process=mitochondrion organization and biogenesis
  Homolog annotation: Hit_ID=Q1RSX3; Match level="QueryCoverage=99%, HitCoverage=90%, E-value=1e-86, Identity=64%"; Hit description=CBS
  Pfam annotation: Domain name=DUF21; Domain location=14-143; Score= -67.0; E_value=0.058; Accession=PF01595.10; Description=Domain of unknown function DUF21
MGVEYKCCDMEFYKRILIVVLLLMFAGLMSGLTLGLMSLSLVDLEVLAKSGTPQDRNNAGNFSPCLMEHHHLLDFLLGHRHKALFHRAELKTLVYLHGHKAGKGGELTYHETTIIAGALELAEKTAGDAMTPITETYCIDIHSKLDRYLMNLILENGHSRVPVHYNQIKNVWTIDPEDEAPVKSVTICRIARVPETMPLYDILNEFQKGHSHMAIVVKHCGKTGYQSSNNNAYDSARDAKVDIDGEKPPREKKLKTKMSCHKWKSFPNPNNLKKGSPQSRKWSKNMYSDILEID

SEQ ID NO: 231039 - protein, 529 aa, Glycine max
  Coding DNA Sequence Number=SeqID_114261
  Gene Ontology: Mol. function=oxidoreductase activity; Cellular component=integral to membrane; Biological process=electron transport
  Homolog annotation: Hit_ID=Q1T3E8; Match level="QueryCoverage=99%, HitCoverage=100%, E-value=0.0, Identity=82%"; Hit description=Helix -turn-helix, AraC type; NAD-binding site; Fumarate lyase
  Pfam annotation: Domain name=DAO; Domain location=63-430; Score= -17.9; E_value=7.8e-05; Accession=PF01266.14; Description=FAD dependent oxidoreductase
  Pfam annotation: Domain name=FAD_binding_3; Domain location=61-409; Score=-73.7; E_value=2.6e-06; Accession=PF01494.9; Description=FAD binding domain
  Pfam annotation: Domain name=Lycopene_cycl; Domain location=63-429; Score=-208.0; E_value=0.083; Accession=PF05834.3; Description =Lycopene cyclase protein
  Pfam annotation: Domain name=SE; Domain location=212-485; Score =646.8; E_value=1.8e-191; Accession=PF08491.1; Description=Squalene epoxidase
  Pfam module annotation: Pfam domain module=DAO::FAD_binding _3::Lycopene_cycl::SE; Domain location=63-430::61-409::63-429::212-485
MGYEYLLGGIIASSLVLVFVVYGSVSKKMTKGSVVHAESNGGSIIRTSSENRNHHQEISETTDIIIVGAGVAGAALAYTLGKEGRRVHVIERDLTEPDRIVGELLQPGGYLKLIELGLQDCVDEIDAQQVFGYALYKDGKNTKLSYPLEKFASDVSGRSFHNGRFIQRMREKASSLPNVKLEQGTVTSLLEENGIIKGVNYKSKSGQEVTAKASLTIVCDGCFSNLRRSLCNPKVDVPSHFVGLVLENCNLPYANHGHVILSDPSPILFYPISSSEIRCLVDVPGQKLPSLGNGDMARYLKTVVAPQVPPELRESFIAAVEKGNMRSMPNRSMPASPYPTPGALLMGDAFNMRHPLTGGGMTVALSDIVLLRNLLRPLHDLHDANALCKYLESFYTLRKPVASTINTLAGALYKVFCASPDPASKEMRQACFDYLSLGGVFSDGPIALLSGLNPRPLSLVLHFFAVAIYGVGRLLIPFPSPKRMWIGARLISGASAIIFPIIKAEGIRQMFFPVTVPAYYRTPPTNLDD

SEQ ID NO: 231040 - protein, 363 aa, Glycine max
  Coding DNA Sequence Number=SeqID_114262
  Homolog annotation: Hit_ID=Q6AU54; Match level="QueryCoverage=53%, HitCoverage=36%, E-value=1e-32, Identity=42%"; Hit description =Expressed protein
MAETRCLAIIDEEEIEVDDDDIYENIEAPKFVDLTAPDCRRPDHDRHWFCFRVGCDQKHEQELDSEAIYKNFVLRVMAARSPNVRLRKALNRREASANLKCPLTAPAKSRVSRMDLISSLPHKMTDNNVKVKPLSMVAATPNAKVKQSPSVAKALTTPRNHQKKVSKVEQFRSVQSKKALTVGVPKSRVVAKALVFHSPKKVLKIKSSIELKTAMRTLCSAMNKLELNGVKKNGKGGSNSLAVATSKKQLRGREVKSRVFDSLYSNNRKEPETNTKTSLKEKKVKKGTQKCPVAVPHENDTSHMEIDEKSRCGSLEGCHESGTSGSGGELSFGDEKSHKSTRGESSVPVLTEASRSDITSLSS

SEQ ID NO: 231041 - protein, 980 aa, Glycine max
  Coding DNA Sequence Number=SeqID_114263
  Gene Ontology: Mol. function=protein serine/threonine kinase activity; Cellular component=integral to membrane; Biological process=protein amino acid phosphorylation
  Homolog annotation: Hit_ID=Q9LJM4; Match level="QueryCoverage=95%, HitCoverage=96%, E-value=0.0, Identity=50%"; Hit description =Receptor-like protein kinase HAIKU2 precursor
  Pfam annotation: Domain name=LRRNT_2; Domain location=41-81; Score =47.1; E_value=5.9e-11; Accession=PF08263.3; Description=Leucine rich repeat N-terminal domain
  Pfam annotation: Domain name=LRR_1; Domain location=110-133; Score =6.4; E_value=18; Accession=PF00560.23; Description=Leucine Rich Repeat
  Pfam annotation: Domain name=LRR_1; Domain location=135-156; Score =17.2; E_value=0.058; Accession=PF00560.23; Description=Leucine Rich Repeat
  Pfam annotation: Domain name=LRR_1; Domain location=158-181; Score =11.8; E_value=1.8; Accession=PF00560.23; Description=Leucine Rich Repeat
  Pfam annotation: Domain name=LRR_1; Domain location=183-204; Score =9.3; E_value=5.1; Accession=PF00560.23; Description=Leucine Rich Repeat
  Pfam annotation: Domain name=LRR_1; Domain location=208-230; Score =15.3; E_value=0.22; Accession=PF00560.23; Description=Leucine Rich Repeat
  Pfam annotation: Domain name=LRR_1; Domain location=232-254; Score =18.9; E_value=0.018; Accession=PF00560.23; Description=Leucine Rich Repeat
  Pfam annotation: Domain name=LRR_1; Domain location=256-278; Score =11.4; E_value=2.1; Accession=PF00560.23; Description=Leucine Rich Repeat
  Pfam annotation: Domain name=LRR_1; Domain location=280-301; Score =9.4; E_value=5; Accession=PF00560.23; Description=Leucine Rich Repeat
  Pfam annotation: Domain name=LRR_1; Domain location=303-325; Score =12.7; E_value=1.2; Accession=PF00560.23; Description=Leucine Rich Repeat
  Pfam annotation: Domain name=LRR_1; Domain location=327-349; Score =15.3; E_value=0.22; Accession=PF00560.23; Description=Leucine Rich Repeat
  Pfam annotation: Domain name=LRR_1; Domain location=351-374; Score =13.1; E_value=1; Accession=PF00560.23; Description=Leucine Rich Repeat
  Pfam annotation: Domain name=LRR_1; Domain location=375-397; Score =3.3; E_value=69; Accession=PF00560.23; Description=Leucine Rich Repeat
  Pfam annotation: Domain name=LRR_1; Domain location=399-421; Score =10.1; E_value=3.7; Accession=PF00560.23; Description=Leucine Rich Repeat
  Pfam annotation: Domain name=LRR_1; Domain location=423-445; Score =0.2; E_value=2.6e+02; Accession=PF00560.23; Description=Leucine Rich Repeat
  Pfam annotation: Domain name=LRR_1; Domain location=447-469; Score =8.2; E_value=8.4; Accession=PF00560.23; Description=Leucine Rich Repeat
  Pfam annotation: Domain name=LRR_1; Domain location=471-493; Score =12.6; E_value=1.3; Accession=PF00560.23; Description=Leucine Rich Repeat
  Pfam annotation: Domain name=LRR_1; Domain location=495-517; Score =14.4; E_value=0.41; Accession=PF00560.23; Description=Leucine Rich Repeat
  Pfam annotation: Domain name=LRR_1; Domain location=519-541; Score =13.7; E_value=0.66; Accession=PF00560.23; Description=Leucine Rich Repeat
  Pfam annotation: Domain name=LRR_1; Domain location=543-565; Score =16.7; E_value=0.084; Accession=PF00560.23; Description=Leucine Rich Repeat
  Pfam annotation: Domain name=LRR_1; Domain location=566-585; Score =12.4; E_value=1.3; Accession=PF00560.23; Description=Leucine Rich Repeat
  Pfam annotation: Domain name=LRR_1; Domain location=85-108; Score =2.6; E_value=95; Accession=PF00560.23; Description=Leucine Rich Repeat
  Pfam annotation: Domain name=Pkinase; Domain location=678-963; Score =132.4; E_value=1.3e-36; Accession=PF00069.15; Description=Protein kinase domain
  Pfam annotation: Domain name=Pkinase_Tyr; Domain location=678-963; Score=79.8; E_value=8.5e-21; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=41-81::110-133::135-156::158-181::183-204::208-230::232 -254::256-278::280-301::303-325::327-349::351-374::375-397::399 -421::423-445::447-469::...
  Pfam module annotation: Domain location=471-493::495-517::519 -541::543-565::566-585::85-108::678-963::678-963
  Subcellular localization annotation: CTP_CleavageSite=79; ConfidenceScore=5.39e-01
TLTLTRTNNHPPFAAGMFAGGIFRYGSPTTLLFLCLVASTLSDELQLLMKFKSSIQSSNANVFSSWTQANSPCQFTGIVCNSKGFVSEINLAEQQLKGTVPFDSLCELQSLEKISLGSNVYLHGSISEDLRKCTNLKQLDLGNNSFTGEVPDLSSLHKLELLSLNSSGISGAFPWKSLENLTSLEFLSLGDNLLEKTPFPLEVLKLENLYWLYLTNCSITGNIPLGIGNLTRLQNLELSDNHLSGEIPPDIVKLQRLWQLELYDNYLSGKIAVGFGNLTSLVNFDASYNQLEGDLSELRSLTKLASLHLFGNKFSGEIPKEIGDLKNLTELSLYGNNFTGPLPQKLGSWVGMQYLDVSDNSFSGPIPPHLCKHNQIDELALLNNSFSGTIPETYANCTSLARFRLSRNSLSGVVPSGIWGLANLKLFDLAMNQFEGPVTTDIAKAKSLAQLLLSYNKFSGELPLEISEASSLVSIQLSSNQFSGHIPETIGKLKKLTSLTLNGNNLSGIVPDSIGSCTSLNEINLAGNSLSGAIPASVGSLPTLNSLNLSSNRLSGEIPSSLSSLRLSLLDLSNNQLFGSIPEPLAISAFRDGFTGNPGLCSKALKGFRPCSMESSSSKRFRNLLVCFIAVVMVLLGACFLFTKLRQNKFEKQLKTTSWNVKQYHVLRFNENEIVDGIKAENLIGKGGSGNVYRVVLKSGAEFAVKHIWTSNLSERGSCRSTSSMLRRSSRSPEFDAEVATLSSIRHVNVVKLYCSITSEDSSLLVYEFLPNGSLWDRLHTCKNKSEMGWEVRYDIALGAARGLEYLHHGCDRPVIHRDVKSSNILLDEEWKPRIADFGLAKILQGGAGNWTNVIAGTVGYMPPEYAYTCRVTEKSDVYSFGVVLMELVTGKRPMEPEFGENHDIVYWVCNNIRSREDALELVDPTIAKHVKEDAMKVLKIATLCTGKIPASRPSMRMLVQMLEEADPFTTTKMIVTIDA

SEQ ID NO: 231042 - protein, 320 aa, Glycine max
  Coding DNA Sequence Number=SeqID_114264
  Homolog annotation: Hit_ID=Q6AU54; Match level="QueryCoverage=61%, HitCoverage=33%, E-value=3e-08, Identity=28%"; Hit description =Expressed protein
TKNSVSNKGKVSVAKKRKAEENSLASDDRENERQLTENDEKENVSAPHENIEISNNDDVPKKKAILGSKHEDSRKTQKKFTSTSTTPQVLKFRKLKPTNPKPFKLRTDERGILKEANLDRKIPSSLKETTVKGSESKAMRKYQNANRSSETCSTKSEQDTDNHYSSCDEKSNQTTRENQSGSIKSNNSNCKVQRKLSATSPLRNPPGPKLQKVTDLDDNLKRKSRMMQRKIVRPRSALPRKKERVVLATKLSVIVEKASDIVKPKETKPRKNDAVSSPTSKTTGSIHRPFSRGKRDLTVPKEPKFQSLHVPKDCTTGGHT

SEQ ID NO: 231043 - protein, 152 aa, Glycine max
  Coding DNA Sequence Number=SeqID_114265
  Homolog annotation: Hit_ID=Q9XII1; Match level="QueryCoverage=96%, HitCoverage=44%, E-value=6e-13, Identity=34%"; Hit description =Expressed protein
MDKEYLSQIPSVNKSGRNGLITLDPMIEVSNSLSEKEQNHVENGAKNSRKGLGFFITSAAKTMLTVVGVVSILSLSGFVPKLGTRFSVQGWCHRVENERSTTKNGGERSNIQCPPGRILVWENGEARCQVKERVEIPFSAVAATPDINYGCG

SEQ ID NO: 231044 - protein, 88 aa, Glycine max
  Coding DNA Sequence Number=SeqID_114266
  Homolog annotation: Hit_ID=Q1RXQ0; Match level="QueryCoverage=76%, HitCoverage=7%, E-value=2e-10, Identity=44%"; Hit description =Tetratricopeptide-like helical
MAIRSLRVKDAMVYRDHVQAIKSGLVSSIFTCNQLIHLYFNHGLLQEANKLFDEIPHPNVFSWNAIIMAYIKAHNLTQARALFDSASQ

SEQ ID NO: 231045 - protein, 171 aa, Glycine max
  Coding DNA Sequence Number=SeqID_114267
  Gene Ontology: Mol. function=nucleic acid binding; Cellular component= intracellular; Biological process=protein amino acid phosphorylation
  Homolog annotation: Hit_ID=Q2HU53; Match level="QueryCoverage=87%, HitCoverage=24%, E-value=1e-27, Identity=38%"; Hit description =Tetratricopeptide-like helical
MEQDYNILHEIYHYACVVDMYGKANQLEKAVEFMRKIPLQIDATIWGAFLNACQMSSDAALVKQADEELLKVEADNGSRYVQLANVYAAKGKWDEMGRIRKKMRGYEAKKLAGCSCIYVENGLNVFTSGDRSHSKADAIYSTLTCLNGKLYLFFTEQKQLYEIQGDVEDIF

SEQ ID NO: 231046 - protein, 71 aa, Glycine max
  Coding DNA Sequence Number=SeqID_114268
  Homolog annotation: Hit_ID=Q9XII1; Match level="QueryCoverage=88%, HitCoverage=29%, E-value=2e-09, Identity=45%"; Hit description =Expressed protein
MEEEGIGLVLARATELRLKISNCIQRATSNGPSPHADDDDDEATERLLNICDALEALETQLSSLQFSIQIA

SEQ ID NO: 231047 - protein, 226 aa, Glycine max
  Coding DNA Sequence Number=SeqID_114269
  Gene Ontology: Mol. function=binding; Cellular component =intracellular; Biological process=metabolic process
  Homolog annotation: Hit_ID=Q69WY1; Match level="QueryCoverage=98%, HitCoverage=50%, E-value=8e-28, Identity=30%"; Hit description =Selenium-binding protein-like
  Pfam annotation: Domain name=PPR; Domain location=133-167; Score =12.4; E_value=0.25; Accession=PF01535.11; Description=PPR repeat
  Pfam annotation: Domain name=PPR; Domain location=18-52; Score=46.4; E_value=9.5e-11; Accession=PF01535.11; Description=PPR repeat
  Pfam module annotation: Pfam domain module=PPR::PPR; Domain location =133-167::18-52
MGMALNVFLKNPELNDTVSWNTLIAGYAQNGYMEKSLTVFVEMIENGIGFNEHTLASVLSACSALKCLKLGKSVLAWVLKKGYSSNQFISSSNVALLTSTLSAGISDMQTYSSQGNMTEAQRLFDSLLERNSVVWTALCSGYVKSQQCEAVFKLFRECRTKEALVPDAMIIISVLGACAMQADLSLGKQIRAYILRMRFKVDKKLLSALVDMYSKCGNVAYAKKIF

SEQ ID NO: 231048 - protein, 89 aa, Glycine max
  Coding DNA Sequence Number=SeqID_114270
MVERSLKPETDTKDIVGHARMGAQMLFGAQRKARESVEAPMRMPSPPSCKSMGGDAGDGITRRKGRQTAVDAENAPEKEKNRRKEGQRA

SEQ ID NO: 231049 - protein, 108 aa, Glycine max
  Coding DNA Sequence Number=SeqID_114271
  Subcellular localization annotation: CTP_CleavageSite=76; ConfidenceScore=5.03e-01
MATLRNPSEKHLTCRSSKTTQGVVACHDLHGSFYPQTACPSLQGSTSALTRLMVSELYTYRMSLQQQQLKKSSKPEAKTLQESTTNYRCNQGADFLLAPHMIENQTKA

SEQ ID NO: 231050 - protein, 526 aa, Glycine max
  Coding DNA Sequence Number=SeqID_114272
  Gene Ontology: Mol. function=transcriptional elongation regulator activity; Cellular component=cytoplasm; Biological process =regulation of transcription, DNA-dependent
  Homolog annotation: Hit_ID=Q84U02; Match level="QueryCoverage=87%, HitCoverage=80%, E-value=2e-86, Identity=43%"; Hit description =Putative ternary complex factor MIP1
  Pfam annotation: Domain name=DUF547; Domain location=401-526; Score =182.0; E_value=1.5e-51; Accession=PF04784.5; Description=Protein of unknown function, DUF547
  Subcellular localization annotation: CTP_CleavageSite=28; ConfidenceScore=5.02e-01
MARFWFQAIQVHGSNRFNFKSQAPQQIYVTKYSDPMKRRVMGDGLESISEASCRPEVELGELKQNIESKKRQYHNMDLQSSLTQELQKRLQQQFVIRRALEKACYVPFSQDATIENSIPKAAKELIKEIGILELEVVYLEQYLLSLYRKRFDQQISTLSTKERRLELASDTKQGTSAVPGNDAISDKEISVVHCSNVISPRNSSGFKLKEFNNQLEAETGLDSSIHRCHSALSQRTTCSIEASPGNIETKAAIDSYHSLPLSMLEQAQCAKSSSTSLAEHLGSSYVDNVPETPNWLSEEMIKCISAIYCELTEPTSLGHKNASSPISFPSSGNELSSQSQGSKWGSQWKKHSSFNLNSTNPFHVRGSKEFSGTYCSMIRIQQLCTDSQKLKEIEYMLRRFRSLVSRLEDVNPRNMKHEEKLAFWINVHNSLAMHALLIYGISANNVKRMSSVLKAAYNIGGHTISVDLIQNFILGCRLPRPGQWLRLWFPSMTKPKVRDARKGYAIHRPEPLLLFALCSGSHSDPA

SEQ ID NO: 231051 - protein, 109 aa, Glycine max
  Coding DNA Sequence Number=SeqID_114273
  Gene Ontology: Mol. function=metal ion binding
  Homolog annotation: Hit_ID=Q10PH9; Match level="QueryCoverage=97%, HitCoverage=17%, E-value=6e-10, Identity=35%"; Hit description=IBR domain containing protein, expressed
YECIENDLLGTLNLGIHSIAPYKSKGIERASELSVCWNNKVNNTEILLSEKDYCIYAASVGVTEELDRPSGSGSSEDSGCSSRKRPRKEGLGGGGFFDLNLPAEFVDRN

SEQ ID NO: 231052 - protein, 217 aa, Glycine max
  Coding DNA Sequence Number=SeqID_114274
  Homolog annotation: Hit_ID=Q1SN43; Match level="QueryCoverage=97%, HitCoverage=59%, E-value=6e-22, Identity=39%"; Hit description =Nucleic acid-binding, OB-fold, subgroup
MTNKYNSVAEINSEKENISTNKQTSSIKIPFYMETMLVDSKGDTVHGFVKRTLIYKFDKNLQEGKVTTHHKYIIVFQYFTKVVLVDNASVPNFVYDCVPIRDIVCDKIHLQNCIYGARVVFNAECEKAKELATRMFESPSQGLSQIIDSTALSMLEDFLHNTARKTIGGLKDCFEDTCFAVFGTVKHVVDDEEWCYTACTCNKTVYPDSKMFFAKME

SEQ ID NO: 231053 - protein, 126 aa, Glycine max
  Coding DNA Sequence Number=SeqID_114275
MANAPGNDDFLRDAMIVSTNQELIDKQGRVSKVKLLENDKDSIVIYKGWPEFRRLNEIYYQREIRLIYVGDRKFHVRFFKGDPELARVFQQLQEKIQELLTLMIEDYQRTNGEGGIVKTCSMQARK

SEQ ID NO: 231054 - protein, 211 aa, Glycine max
  Coding DNA Sequence Number=SeqID_114276
  Gene Ontology: Mol. function=N-acetyltransferase activity; Biological process=metabolic process
  Homolog annotation: Hit_ID=Q1T0F6; Match level="QueryCoverage=75%, HitCoverage=55%, E-value=3e-47, Identity=60%"; Hit description=GCN5 -related N-acetyltransferase
  Pfam annotation: Domain name=Acetyltransf_1; Domain location=27-115; Score=42.9; E_value=1.1e-09; Accession=PF00583.14; Description =Acetyltransferase (GNAT) family
METGTSKVAPKRTSTVNAGATAKNLVAELLDTRELVGVVRGIIKNMGTLSRPFLKMGCILGLGVSPTYRRKGVALRLVTVAEEWMARNGVEHALLATENKNDASKNLFTIKSNYVNLSSLVIFVQPISSLTKQISMDIKIDRVDIDLAISLYKRTMRTKDLYPLDKDVIPKEKLSLGTWKYYKEKYSLVIPEPSSTKECKEVLRTLFNNIT

SEQ ID NO: 231055 - protein, 94 aa, Glycine max
  Coding DNA Sequence Number=SeqID_114277
MYTKAQSYNEDMNLTSNPTVTMLVRLAVKCTSGHHEFPNPCTRNQKSSRVQDKNQEEFKNSRRKFRVKNQDSRFKISRIKIKIQDSRFKNQEKA

SEQ ID NO: 231056 - protein, 235 aa, Glycine max
  Coding DNA Sequence Number=SeqID_114278
  Gene Ontology: Mol. function=GTP binding; Cellular component =cytoplasm; Biological process=Mo-molybdopterin cofactor biosynthetic process
  Homolog annotation: Hit_ID=Q8Z9R3; Match level="QueryCoverage=81%, HitCoverage=97%, E-value=1e-90, Identity=83%"; Hit description =Molybdopterin biosynthesis Mog protein
  Pfam annotation: Domain name=MoCF_biosynth; Domain location=47-200; Score=108.4; E_value=2.1e-29; Accession=PF00994.14; Description =Probable molybdopterin binding domain
  Subcellular localization annotation: CTP_CleavageSite=3; ConfidenceScore=5.05e-01
MCRGGCRSPRFSRFPRWCFVLSFLPFPFFSPPRGQHSDNSMDTLRIGLISVSDRAANGIYQDQGIPALESWLSAALATPFEIDTRLVPDEQPMIEQAICELVDERFCHLVLTTGGTGPARRDVTPDATLAVADREMPGFGEQMRQISLQFVPTAILSRQMGVIRKQSLILNLPGQPKSIKETLEGLKADDGTVKVPGIFAAVPYCLQLLEGPYVETHPKVVAAFRPKSARRETNF

SEQ ID NO: 231057 - protein, 115 aa, Glycine max
  Coding DNA Sequence Number=SeqID_114279
  Subcellular localization annotation: CTP_CleavageSite=81; ConfidenceScore=5.26e-01
TFRGLRKARGKKSEAPSTSAPEAEGPSSSTLPPSSSTEIPMIPPTPSQMPFLAPVSTGDQSSSYGGGGASTAQEPVTKEPPAAAVEEEATPEQIPKPSLAPAHAPDDATPVVEPE

SEQ ID NO: 231058 - protein, 46 aa, Glycine max
  Coding DNA Sequence Number=SeqID_114280
MMHAPDSTLRCNVGTVLSLSRPPGCARNIPPPIGDQPGSPTVFPTR

SEQ ID NO: 231059 - protein, 122 aa, Glycine max
  Coding DNA Sequence Number=SeqID_114281
  Subcellular localization annotation: CTP_CleavageSite=36; ConfidenceScore=5.13e-01
MAFLGETSSHTIVNSTLGFIFPNRSIVHNDNGVSFQASTPVPIRAPNSCDFQMLKTRIHNTLKLTNKQFLDEIYYRQPFTYAGKNPKKFDIPSRCTMDELKDLIKKVAPAGIPPYGIHETQM

SEQ ID NO: 231060 - protein, 116 aa, Glycine max
  Coding DNA Sequence Number=SeqID_114282
MTEDIFVFEMCVDYRIGRLRMLSNLIVSDDKRDFDSLRIGRVWATICCLHASSDLSSLDDEGADNYEVSPHAIGPSSHDSRIETFLRSRPEDVDISGKGADDHIGLCVSMRSLASG

SEQ ID NO: 231061 - protein, 53 aa, Glycine max
  Coding DNA Sequence Number=SeqID_114283
MALLSLEIPLFLLPRARMEILIMGQGLWWFEVLAQKACRTAEHDICQGVGLAN

SEQ ID NO: 231062 - protein, 76 aa, Glycine max
  Coding DNA Sequence Number=SeqID_114284
MQERRLFLIQRRCRHFLVMLIFPLKRFTLPRFAIDDGSEAHGTLASVTFLLLGETLTKFPGNPLLEASKIANNAPH

SEQ ID NO: 231063 - protein, 63 aa, Glycine max
  Coding DNA Sequence Number=SeqID_114285
MAPKTQGLSLCVPPTVSDTHARAYYDGDSSIGHPQQVACVDEHPNKPPVCAIHDKCHTCKSTS

SEQ ID NO: 231064 - protein, 547 aa, Glycine max
  Coding DNA Sequence Number=SeqID_114286
VLATDVVADGMPLMFNRDGEPRFAFYWQYDPTKFKSYDEDLLTLVERVDKVILEQLLASLDARASLSLPSASDPLTTLDGIMGDFTWRPLVKQVGPGGQPTSEVGLVAAAEAARLMPTAGHLSNEQDVPLAALTIEAPAIAVVEAATPVIPAPSPPPAVDVVQEATPATTKVVAPAAQVGPVVVSPSTVTATLLSAGVTTTGASTMSPPLSTPVALLATVLAAMALPFSSLCPRVSLNHLYTSSDIDSPNLIRSAGVRNTTHSAKVAKWRATAQTLWRVDCPKVVSAIVAFAEAVRMNRQLSFKVGDALAKLLCTRLDGDDLFRCCKGLKIKKLDLGGKVESVAVEKDGLAKRIVELEARLMESKSKLAVEQHEKGFQKVVRKDGLFMKDLNLGLFDPLEDVKDGVLLDEEEIVAEEDEVADEGQDAAEQGDDDHHGLVKSGMMRSHLKFDFNLIKGLVTHLPNQCGDRSLDLPCSSSDAYEDGPRGCLGFGRSRYQGQTLGFVRGEPRVYQALDQGHVCPGFCQAYGVVSRLTKDGPWILWSYEDQ

SEQ ID NO: 231065 - protein, 58 aa, Glycine max
  Coding DNA Sequence Number=SeqID_114287
MTLAMGDTYWRCGDILLHICHSLCYTLKTWQNARARIPGVTRTRGLVLCSCMCITRRG

SEQ ID NO: 231066 - protein, 52 aa, Glycine max
  Coding DNA Sequence Number=SeqID_114288
MGCIPMSDVTYAIVEFLPVDMNSLSSLVYCIGVIVSLENFHTSSSFSPCGLP

SEQ ID NO: 231067 - protein, 56 aa, Glycine max
  Coding DNA Sequence Number=SeqID_114289
MKNLHEIAHRNEKRGRWLLPSSPRRAGLLPPEGTAFCWNPLKGPSGPGGYLHSLFY

SEQ ID NO: 231068 - protein, 81 aa, Glycine max
  Coding DNA Sequence Number=SeqID_114290
MRKRLSEGHVSPERDTWRDLTGRWDRGGSGGLPSATTSGGAPGATTSGSLSGASTNGGPSHVPLPYKTPSPPFHFHTKTLK

SEQ ID NO: 231069 - protein, 198 aa, Glycine max
  Coding DNA Sequence Number=SeqID_114291
NTADDLSPSYKHYPAKWTDRRHAFIDHIMEADIPLCWKPLNLEQYGGTTGTTLTWYGGLPPKSLDSFDPFVKQFSAQYATRRCHFMTSTALASLRQADDESLKKFMDRFGSMTIQIQNLNLEKRDKHEANTKADLQKSNKRHKSDKRQPLSKGPRYERYTPLTTNRTIIHEEAFNLEVPIRLPQTKPPRPGSDTTKYY

SEQ ID NO: 231070 - protein, 105 aa, Glycine max
  Coding DNA Sequence Number=SeqID_114292
MSEIEEVQEQMITMMKAMMSMRRMMEVNTTTVVATSTAIEVDPTQPPGFNQVNCPSSNMVGQGGKALGNAGSPHFVQIQNKHFFPPYGLPPNCTPPSVAHAPDEN

SEQ ID NO: 231071 - protein, 39 aa, Glycine max
  Coding DNA Sequence Number=SeqID_114293
MFAYSHFAKRKPRAKCIFGHALSQESLALSTHPLHLRLI

SEQ ID NO: 231072 - protein, 197 aa, Glycine max
  Coding DNA Sequence Number=SeqID_114294
DAPGLHQCSQILPQELPGRALCIKYKSIPWDAESSGQLLRVYASAAEPASPALGPAWGIFLQDHTVPPLKFPTELIVLRDVKNNIPLRKNVPGVNVLIISFLSALKYESGSAIGLLGSGGSSFSLSGGGSVIGIKLDRLAKPNSKTEKKLHLVRLTHLAQEQKLRKLNCLRLSETDSLSHQQKTNNLVHFDLSNTTR

SEQ ID NO: 231073 - protein, 108 aa, Glycine max
  Coding DNA Sequence Number=SeqID_114295
MVAWPRTQPSLHKEDEGPTAQGRRQVRQVATATPERSLEATSEPPAPVVDLPSPQCTTDPSTPIVQTPEDPTTPDLAMDTSPPATPVLHLTNEKDVQTHDTQDQSQEF

SEQ ID NO: 231074 - protein, 50 aa, Glycine max
  Coding DNA Sequence Number=SeqID_114296
MMDTSEPYTGAMKGTMHKPQANLGAMRGTVHEPQANLGSDQKFSPVDVYK

SEQ ID NO: 231075 - protein, 77 aa, Glycine max
  Coding DNA Sequence Number=SeqID_114297
MACTHIPVEAKMSYSAQWNVPELLHDMHMLRLSRILGKMEVEEPWQWLWLPLHYQAGLVADLGMAFVDDWVRRIVIG

SEQ ID NO: 231076 - protein, 127 aa, Glycine max
  Coding DNA Sequence Number=SeqID_114298
  Gene Ontology: Mol. function=RNA-directed DNA polymerase activity; Biological process=RNA-dependent DNA replication
MPHPIVAECTQVMTVDEGSHVRALTVYQASLGDLFAHEYRCLADMLRKNIDLFASQPSEMSRIHLDIIFHQLAIWPQAKQLANVVMIKKANDKWRMCIDYIELNRACPKDAYPISSIDRLVDRSFGF

SEQ ID NO: 231077 - protein, 66 aa, Glycine max
  Coding DNA Sequence Number=SeqID_114299
MWKLQDFFLYCTRKITKPDDHKTHQIRWLSARKVVRVMMTMAAATAKVMGKGERAVRRKAASRKVY

SEQ ID NO: 231078 - protein, 181 aa, Glycine max
  Coding DNA Sequence Number=SeqID_114300
  Gene Ontology: Mol. function=protein binding; Biological process =defense response
  Homolog annotation: Hit_ID=Q1SW19; Match level="QueryCoverage=70%, HitCoverage=17%, E-value=1e-15, Identity=33%"; Hit description =Disease resistance protein
MSPSYTVEGLMRDLLKKLCKENRVNPPQGISEMDRVSLIDEVRNHFQQKRKKDVIESSMKSPLDKVHELKPLTQEESMQLFSKKAFRCHKNRYCPEDLKKVSSDFVEKCKGLPLAIVAIGSLLFGKEKTPFAIESLPNIGRWLPPRSPRRVGLLPLEGTAFCWNILEGPNGPDCYLYTPVY

SEQ ID NO: 231079 - protein, 218 aa, Glycine max
  Coding DNA Sequence Number=SeqID_114301
  Gene Ontology: Mol. function=zinc ion binding
  Homolog annotation: Hit_ID=Q53MN0; Match level="QueryCoverage=24%, HitCoverage=23%, E-value=3e-12, Identity=55%"; Hit description=PHD -finger, putative
  Pfam annotation: Domain name=PHD; Domain location=39-89; Score=21.7; E_value=0.00038; Accession=PF00628.19; Description=PHD-finger
MMRKLRILYIGYKRNDYNGERHQGLFAILKYLPNSKVTLCDICGDQGIEEYLAICNKCPDGAEHIYCNDDKLDKLPEGDWWVCEDCRKSPGISSRSYSSANRHGVHSLEKDRVFKMSAKPPKPCHNTLLYRDFSCKTFKNVKAKATKDFTSELQTSCNCQKKAKVPYAFSDKRCENTLEVELDRKRKALKQDPNSSKHANQPTNLYLVGSPLSKNWRR

SEQ ID NO: 231080 - protein, 442 aa, Glycine max
  Coding DNA Sequence Number=SeqID_114302
  Homolog annotation: Hit_ID=Q10K55; Match level="QueryCoverage=72%, HitCoverage=59%, E-value=2e-56, Identity=42%"; Hit description =Expressed protein
SNLSQPAASKGSYSQVGFSYDGNGKEETHISDDDDNDNEEEEDDEDDEDFNSDDSNDEGMEIIAKEYGVKRYGWLVYMDKKAKEEEKRQKELIKGDPAIRKLSRKERRKASQIEREREREATRISGTRVLHHDPYRETRQSPTYEAYSRSRRSRSPLRSYSPSHSRRYSRSGHSDDIHRSKPRTPKIEYITEFGGSGAADERRPEGFSPPRSPTSQVDLLNRPTSGCILEALHVDPASGVSIDKDKGTKVLKPSVSGSSSALAKLKAGGSGGPLKQGEKKETPQERLKRIMNKQLNKQIKKDTAAELAKKREQERQRQEKLAETSRLSRYRCRSRSRSFSGSPPSCHAILNPLKVLSHRSNTMINLSKEDTGAVEVQVEAEVPEDIILVLIHGPLLAHVLRLLILDLPALKLLSPGTAKNGPRAVRDQGLWSLPHWSLLSTP

SEQ ID NO: 231081 - protein, 232 aa, Glycine max
  Coding DNA Sequence Number=SeqID_114303
MDAKVAALKTEVARLNHNAKAMQLKADSNHEKLLDDQYFKYFIQGLKKVGWYGFHSMGARGSNGMGLTHRNGPPSPTLGYRPGVPRSDFGSGRSNREGNGGKTEFNNEPRHPLFQEITGEGNGGRTEFNNEPRHPLFQEITASAIFRIKSCLNDDEEKGDANVVEVEDQTDEEGDKGECSMMFSGNTTAEISQKPQTMKVRAMINGVPILLLVDSSATHNFISTKLVQANPA

SEQ ID NO: 231082 - protein, 35 aa, Glycine max
  Coding DNA Sequence Number=SeqID_114304
MRVCEREIRECVREKMGVFVDTVRDGRCGEAHACE

SEQ ID NO: 231083 - protein, 67 aa, Glycine max
  Coding DNA Sequence Number=SeqID_114305
MVVLDMRTRSIREELYRALPLSQKTLKPGKGVWFIWKGMCLTSYMGGCDFSGRGIGEGRRRLRECIY

SEQ ID NO: 231084 - protein, 237 aa, Glycine max
  Coding DNA Sequence Number=SeqID_114306
  Homolog annotation: Hit_ID=Q2QVG6; Match level="QueryCoverage=48%, HitCoverage=48%, E-value=7e-12, Identity=39%"; Hit description =Expressed protein
  Pfam annotation: Domain name=DUF1685; Domain location=91-187; Score =146.3; E_value=8e-41; Accession=PF07939.2; Description=Protein of unknown function (DUF1685)
MGAIFLRQASKENSETRVWYPLAFKSAERKKPNSAIAFSKLSCEVPRPPHNPSTKGLCLSSSSTPMSEPDTQAPPPPPFLLQRPPLLQSASPLFKQRSWSPDAFRDEAWLRRKGNWKNRRSKSVTDEDVDELKACIELGFGFDSSPEVELDQRLSDTLPALGLYYAVNKRYNDSLVTKTTPSSSSSSAASDCDSTPCPHGSPHSAIFTTGDNPQTVKTRLRQWAQVVACAVRQSSDV

SEQ ID NO: 231085 - protein, 157 aa, Glycine max
  Coding DNA Sequence Number=SeqID_114307
  Homolog annotation: Hit_ID=Q2HS22; Match level="QueryCoverage=74%, HitCoverage=34%, E-value=3e-07, Identity=35%"; Hit description=IMP dehydrogenase/GMP reductase
MVPNRGRNIDVNGRNIRPLGLSASAWPTLQHAKQQNQQYGSGMRAVFLGNPSGRRECAGTGVFLPRRVDIPESRKKPACSTVLVPTRVAQALNLNLDDMIVGQPQHLQRFNACPNIENGAAVSRLRGNYVLSQQKRNLNKPQPAGYHEIRLPQEWTY

SEQ ID NO: 231086 - protein, 115 aa, Glycine max
  Coding DNA Sequence Number=SeqID_114308
MPLRHFTEHLVGARLGINSKRTGTMWHGGKEVFECKNAPPFVIFIHSPVESPTVATYPSAGGRRVTRGMRVPRKEYARSRHQRLFEENVGKTGKDAIYELLSERFGSCIYARGRY

SEQ ID NO: 231087 - protein, 134 aa, Glycine max
  Coding DNA Sequence Number=SeqID_114309
CLSPPARSSGPPTNRAFIKKYCVPRQAQGETAQQPGDGRQRATDAPPSPLLIHKKVRVLLTTHGRPIGDQVQSQSHSRTHLFAHDPRNLNKTSTSSEGHPLYPRTAGQTLTYIMTSRSTSLEPKSQLIINLDPG

SEQ ID NO: 231088 - protein, 92 aa, Glycine max
  Coding DNA Sequence Number=SeqID_114310
  Gene Ontology: Mol. function=transcriptional elongation regulator activity; Biological process=regulation of transcription, DNA -dependent
  Homolog annotation: Hit_ID=P30128; Match level="QueryCoverage=100%, HitCoverage=58%, E-value=2e-45, Identity=93%"; Hit description =Transcription elongation factor greB
  Pfam annotation: Domain name=GreA_GreB_N; Domain location=1-74; Score= 153.7; E_value=4.8e-43; Accession=PF03449.6; Description=Prokaryotic transcription elongation factor, GreAGreB, N-terminal domain
MRTQLITREGYDKLKQELDYLWREERPEVTKKVTWAASLGDRSENADYQYNKKRLREIDRRVRYLTKCLEQLKIVDYSPQQEGKVFFGAWVE

SEQ ID NO: 231089 - protein, 274 aa, Glycine max
  Coding DNA Sequence Number=SeqID_114311
  Gene Ontology: Mol. function=heat shock protein binding; Cellular component=cytoplasm; Biological process=protein folding
  Homolog annotation: Hit_ID=UPI00005F9254; Match level="QueryCoverage =99%, HitCoverage=85%, E-value=2e-90, Identity=64%"; Hit description =COG2214: DnaJ-class molecular chaperone
  Pfam annotation: Domain name=DnaJ; Domain location=1-57; Score=94.4; E_value=3.5e-25; Accession=PF00226.21; Description=DnaJ domain
  Pfam annotation: Domain name=DnaJ_C; Domain location=180-270; Score =82.9; E_value=9.9e-22; Accession=PF01556.9; Description=DnaJ C terminal region
  Pfam module annotation: Pfam domain module=DnaJ::DnaJ_C; Domain location=1-57::180-270
MGVEPNADLKTIKTAYRRLARKYHPDVSTEEDAESKFKELAEAYEVLKDEERRAEYDQIRLHRNDPNFGRQARGDRGGYQQSASWHGGGADAQDFSDFFESMFGGRAAGGHRSASHSHGGHGFRGQDLEMEVPLFLEETLHGQSREISYKLPVYDELGRQVSEASKTLNVKIPAGVGDGERIRLKGQGVAGVGGGQNGDLYLVIRLAPHPLFEIDGHNLSIVAPLAPWEAALGASIEVPTLTGKIALTVPAGSQSGKRLRVKGKGLAGKKEPGD

SEQ ID NO: 231090 - protein, 57 aa, Glycine max
  Coding DNA Sequence Number=SeqID_114312
MGVAIGPGPIAIRPSIWITFYFMATGKSIPMRKRQDDIGVSRKDSKELKLMKWQELI

SEQ ID NO: 231091 - protein, 143 aa, Glycine max
  Coding DNA Sequence Number=SeqID_114313
  Gene Ontology: Mol. function=copper ion transporter activity; Cellular component=integral to membrane; Biological process=copper ion transport
  Homolog annotation: Hit_ID=Q39065; Match level="QueryCoverage=72%, HitCoverage=62%, E-value=1e-23, Identity=51%"; Hit description =Copper transporter 1
  Pfam annotation: Domain name=Ctr; Domain location=24-134; Score=68.6; E_value=2e-17; Accession=PF04145.6; Description=Ctr copper transporter family
MYMSPGQDMPSMSNDTNNMKKTIMHSSLYWGKDAIVLFPRWPENSVGMYILALIFVFFLAMAIEVLSNQPLLKPGTSPLVGGLIQTSVHLFRISFVYMVMLAVMSFNAGIFIAAVVGHSLGFFVAKFRALAVANREDKGSSSI

SEQ ID NO: 231092 - protein, 226 aa, Glycine max
  Coding DNA Sequence Number=SeqID_114314
  Gene Ontology: Mol. function=DNA binding; Cellular component=nucleus; Biological process=regulation of transcription
  Homolog annotation: Hit_ID=Q2VRX1; Match level="QueryCoverage=97%, HitCoverage=97%, E-value=4e-52, Identity=44%"; Hit description =Anthocyanin 2
  Pfam annotation: Domain name=Myb_DNA-binding; Domain location=3-50; Score=52.3; E_value=1.6e-12; Accession=PF00249.21; Description=Myb -like DNA-binding domain
  Pfam annotation: Domain name=Myb_DNA-binding; Domain location=56-101; Score=44.0; E_value=5.1e-10; Accession=PF00249.21; Description=Myb -like DNA-binding domain
  Pfam module annotation: Pfam domain module=Myb_DNA-binding::Myb_DNA -binding; Domain location=3-50::56-101
MGGVAWTEEEDHLLKKCIQQYGEGKWHRVPILAGLNRCRKSCRLRWLNYLRPNIKRGNFAEEEVEMIIKLHKLLGNRWSLIAGRLPGRTANDVKNYWNCHLSKRLNALEAEDRPITRDVQVIRPQPRNIGSSSVKRRGGQNESATDKGVQQESSMSSLTFDASDGQNHMLESQQDNDIYACLDQQGIVSELSMDFQLQGFEAMMNGEGSSSQWDWGDYLLDMDFYE

SEQ ID NO: 231093 - protein, 44 aa, Glycine max
  Coding DNA Sequence Number=SeqID_114315
MVVSESNSENERKHRRGDLKKVLPLYTYSHQYKSSLHFNKLFLV

SEQ ID NO: 231094 - protein, 114 aa, Glycine max
  Coding DNA Sequence Number=SeqID_114316
MESNYGGEVVRMVGKGEIVVAEAFSRRFHGGQSLDPMYLKTRRSSADAVTDRDGVAIGNGNTYHILPPEPLLRIEKSFLEYLYKHVFCECASKECGEIGISVDGEGIKRLVVTE

SEQ ID NO: 231095 - protein, 121 aa, Glycine max
  Coding DNA Sequence Number=SeqID_114317
MPISTHSSFFRFWFLLMKVSEIRGGLERKEGREVWRERRLVRACSTEKTKTVIMTKGGFNGWDWVIYFFLVVLARVVCVCVLHRGGGPVPVNSDGNLETGNLTAPLYGLRRSVTKWRIDTS

SEQ ID NO: 231096 - protein, 53 aa, Glycine max
  Coding DNA Sequence Number=SeqID_114318
MGSTRLLSNGKSNSHGSWTTAPCKVLRDYGALHCHVLASYSTLKVDVKGHGKV

SEQ ID NO: 231097 - protein, 148 aa, Glycine max
  Coding DNA Sequence Number=SeqID_114319
MNWKVKTKEKSMHCLARCLKTPGEDARLADYFDVIAGTSTGGQTLLFQLLTSRYFNLPSFPRIRFETCILCRWQRSQHCLGEASFDMVDYHNYLRIQNNTLKGDLASADVATKENLDNLVCKITLGGKKREKVQFTMTRWEVNDRQNA

SEQ ID NO: 231098 - protein, 80 aa, Glycine max
  Coding DNA Sequence Number=SeqID_114320
  Gene Ontology: Mol. function=methionyl aminopeptidase activity; Cellular component=mitochondrion; Biological process=proteolysis
  Homolog annotation: Hit_ID=Q6Z6H2; Match level="QueryCoverage=59%, HitCoverage=12%, E-value=1e-18, Identity=85%"; Hit description =Putative aminopeptidase MAP1
MIVFSTVGTNGLIEGNTLFCYITNSNYAVNFTEPMLTIGSINPVMWNDDWTVVTEDGSLSAQFEHTILITPDGAEIMTQC

SEQ ID NO: 231099 - protein, 322 aa, Glycine max
  Coding DNA Sequence Number=SeqID_114321
  Homolog annotation: Hit_ID=Q10K64; Match level="QueryCoverage=96%, HitCoverage=91%, E-value=5e-92, Identity=53%"; Hit description =Nodulation protein, putative, expressed
MVEDMCFLYKEILVMKPPKRSPMLLRTAVIIFSMISTQARTTFMDFKVIDNHSQSILKLMNTHLLHYPKPSSFSRNECAHNPVLFFAILSNQRSGSGWFETLLNSHVNVSSYGEIFSVRERRQNVSSILLTLDKVYNLDWFNSASKNECSAATGLKWMLNQGLVEHHKEIAEYFNHRRVSIIFLFRRNLLRRMVSMLANSYDRYAKLLNGTHKAHAEILSKYKPIINSTSLLDDLKDMEMRSAKALEYFNSTRHIIVYYEDLMRNHTKLKDVQEFLGLPQMELTSRHVKIHRGPLSDHIQNWDDVNKTLKGTIYESFLEADY

SEQ ID NO: 231100 - protein, 77 aa, Glycine max
  Coding DNA Sequence Number=SeqID_114322
MAQHKFLLCLILLALIIFCQGLHSIEGSGISTTNVAALVADVSPPTPPSAAVPGRDNDNFRPTAPGHSPGVGHAAHN

SEQ ID NO: 231101 - protein, 150 aa, Glycine max
  Coding DNA Sequence Number=SeqID_114323
MDEFQTMHKYFTIFVALFACHGSLFAHGRQIKPLNQHSSLNTNPILAPLSRTSIKVIEAPIVPKFKFSDVDSGDSGADHANAFRPTTPGNSPGVGHKKFEEDKVMKVMGALVHSPDVKTSVAEGSFENDFKPTDPGHSPGVGHPRQNKRN

SEQ ID NO: 231102 - protein, 110 aa, Glycine max
  Coding DNA Sequence Number=SeqID_114324
MDNKSTKIHWQAPEFGDLGYKRHKCSIQWKDIGGMTSLEEIPPVFIDDDGVVIREVGKLKQLRELWVLVLWGTLTRLPNWILQFPNLVQLSLRIAPDGGEDHWIIQDVPH

SEQ ID NO: 231103 - protein, 159 aa, Glycine max
  Coding DNA Sequence Number=SeqID_114325
MEAMQEQMTTMMEAMISMRKMMEVNTTTVVAASTTTEVDPTHPSGLNQLSRLVPDMVGQWGKVLGSMGGPHFAQVQSKHPFPPYGLPPNYAPPNIVHVLYENIDHSAPIPLESQQPQFGHAHGSQPMGETHEVPRDHTLADFEPYPGYAIEGQTFGGIP

SEQ ID NO: 231104 - protein, 47 aa, Glycine max
  Coding DNA Sequence Number=SeqID_114326
MKDDFVGQRRLLYGDTGLLRSMLLYGNCCGGGSCSCGHEGCGDDGCG

SEQ ID NO: 231105 - protein, 271 aa, Glycine max
  Coding DNA Sequence Number=SeqID_114327
MAPCKIKATVTLSQASYDSSRFVSRDAWDRYTDNIIDQNILLKRNVKLYINEFDDFKREVERRNWHRELTNFSDGSIDVAIVKEFYANLYVPKDKEQKQVRVQRHLIKFDADSLNTFLKTPMVLEQGENLPFYSRFCRLRPDPQELAGRNYWNLDDPSVTFLGTQKSRAKRSEALSPSAALAPPTSALPSAPTAPVLPEPAPGLAPDYAELARCGLAGTSYERGGVSAEGCLARSPTFSFGRGGYSAGTPALDLNEEAMDQDPPPPQDQDH

SEQ ID NO: 231106 - protein, 147 aa, Glycine max
  Coding DNA Sequence Number=SeqID_114328
MENIYLRIVCVLLLFFILHHQDLYVEGKRHLRPRLNKRCTKDGENFSNVVAHGVGDRESRATTDDAAHQGRKGRVEFEEKDFRPTSPGHSPGSHLWFGSVAAIIGLDPSGFTFGFQVSFIFYYTIVGSTGRKLRKLSCLFGLPQFRP

SEQ ID NO: 231107 - protein, 104 aa, Glycine max
  Coding DNA Sequence Number=SeqID_114329
MEAQSAWKAEATVVTARRKKIGSGGWSRQSGVELQQVWPWRPPGSPWWFGGCNERSWLMARVEVEVPTEVVADGWLCGKDVVGRGGLGWHGSHWSSMKAPNVMN

SEQ ID NO: 231108 - protein, 244 aa, Glycine max
  Coding DNA Sequence Number=SeqID_114330
  Homolog annotation: Hit_ID=Q69MD6; Match level="QueryCoverage=45%, HitCoverage=18%, E-value=1e-24, Identity=56%"; Hit description =Ternary complex factor MIP1-like protein
METRGSKAMVAAEKTVKNGRRSNRERKIALTQDVDKLKRKLRHEENVHRALERALTRPLGSLPRLPPYLPPHTLELVAEVAVLEEEVVRLEEKVVNFRQGLYQEAVYISSKRNAENLRDSMDQNSIRSSKHQRSKSLSQSELNSTTMARPQISLARSASSRRLFSDIFTDHSGKLVNGKLLHINQDSLSSIPEEGRRKENPLFYSSLKDKQSPEKKTAKVIAPVKKSPIKKESADKCVDHLKLQ

SEQ ID NO: 231109 - protein, 264 aa, Glycine max
  Coding DNA Sequence Number=SeqID_114331
  Gene Ontology: Mol. function=transcriptional elongation regulator activity; Cellular component=cytoplasm; Biological process =regulation of transcription, DNA-dependent
  Homolog annotation: Hit_ID=Q45GG2; Match level="QueryCoverage=98%, HitCoverage=46%, E-value=1e-81, Identity=60%"; Hit description =Expressed protein
  Pfam annotation: Domain name=DUF547; Domain location=44-185; Score =290.9; E_value=2.4e-84; Accession=PF04784.5; Description=Protein of unknown function, DUF547
MRDIGTYNSLCEIKASNVDLNRTRYVVFLIRRLKCLSNLTDIFRFLLGKLASVSMKDLTHQEKLAFWINTYNSCMLNAYLEHGIPESPEMIVALMQKATIEVGGQLLNAITIEHFILRLPYHLMFTCPKAAKHGEMKLRSIFGLEWSEPLVTFALSCGSWSSPAVRIYTASQVDNELEAAKRDYLQATVGITKTNKLIIPKLLDWYLLDFAKDLETLLDWVCLQLPIELRKEAIECLERRERQPLSQLVQMMPYDFSFRLLLHQ

SEQ ID NO: 231110 - protein, 119 aa, Glycine max
  Coding DNA Sequence Number=SeqID_114332
MFASHGNQIGLVKLIQGYRLSTSSSKSNGHYISTKSEGKKSINLKRNEIVLQVYWQETLRGHVAGILTTQRVENMEADEEMEHKLSSLSLEVITLVENHVHSILYFYLQTFHTYSAKKP

SEQ ID NO: 231111 - protein, 167 aa, Glycine max
  Coding DNA Sequence Number=SeqID_114333
  Gene Ontology: Mol. function=DNA binding; Biological process=DNA integration
MTIENFTNQVRGASLRDHKEPFFLTYTLAHDYEKHLEEQTHQTFFDLVNPSRPNKCFPGGTDTKSQVVVLCKGHSNDNPFDHPHNQERYILQNEKKIYYVLCANEEQKAFKEELSGSQPYNFWKGHTLDVTKYGIMLIAWTTIRTASPQNSLGIEANNRREQTILTI

SEQ ID NO: 231112 - protein, 70 aa, Glycine max
  Coding DNA Sequence Number=SeqID_114334
MESRHTCPVIVKWWSDSASILNMFPAMDKLEGSNAETILATMTHLRERLLKYKCEDEVPHWVQMGKLRNI

SEQ ID NO: 231113 - protein, 407 aa, Glycine max
  Coding DNA Sequence Number=SeqID_114335
MAMPEFDALTGSKISALDIGAPVVRMLYSPTRGHTVIAILQVSIGGDIGMTLIEEMMPGNQMSHQCHERFGYVQRRLLEVPVRKVDCMIFSFMRRWRRRPRMTLEEVVKRDLTMNISIRIWSLTEPNGIDSTIRSCDFDFEQTCVLHSPEKKTEQISSDTEVHLALTPLQSIVFFGFHKRLSVTVVGTVEGGRAPTKIKTDLKKPIVNLACHPRLPVLKDLVTGLSFNDTSVLSFLTPLLFCPIDNTIKLNGAGAFAFHPTLEWIFVGDRRGTLLAWDVSTERPSIIGLQSLEIFKLRLNVTSGDPLKNKTTYSRERRKQLFSVLQSARGSSEILCSIYFERKIVGLGFIWSVSGPSASSSITRTSFERHFMEGNTKSAPISRLPLITILDTKHYLKDFPVIQARIL

SEQ ID NO: 231114 - protein, 502 aa, Glycine max
  Coding DNA Sequence Number=SeqID_114336
  Gene Ontology: Mol. function=protein serine/threonine kinase activity; Cellular component=flagellin-based flagellum; Biological process=protein amino acid phosphorylation
  Homolog annotation: Hit_ID=Q2QDF4; Match level="QueryCoverage=81%, HitCoverage=67%, E-value=0.0, Identity=88%"; Hit description=CDPK -related protein kinase
  Pfam annotation: Domain name=Pkinase; Domain location=17-265; Score =268.4; E_value=1.4e-77; Accession=PF00069.15; Description=Protein kinase domain
  Pfam annotation: Domain name=Pkinase_Tyr; Domain location=32-263; Score=-47.8; E_value=1.5e-09; Accession=PF07714.7; Description =Protein tyrosine kinase
  Pfam module annotation: Pfam domain module=Pkinase::Pkinase_Tyr; Domain location=17-265::32-263
MADRHGRCCCNCNYGCSNNLEDKSGRCTCNCGWLESKNLDVMTTAIAIEDVRREVKILRALTGHKNLVQFYDAYEDHDNVYIVMELCEGGELLDRILSRGGKYTEEDAKAVLRQILNVVAFCHLQGVVHRDLKPENFLFASKEDTSKLKAIDFGLSDFVKLDERLNDIVGSAYYVAPEVLHRAYSTEADVWSIGVIAYILLCGSRPFWARTESGIFRAVLKADPIFDEPPWPSLSDEATNFVKRLLNKDPRKRMSAAQALSHPWIRNKDVKVPLDILIFKLMKAYMRSSSLRKAALRALSKMLTVDELFYLREQFALLEPSKNGTISLENIKAVLMVNATDAMKESRIPDFLASLNALQYRRMDFDEFCAAALSVHQLETLDQWEQNARCAYDLFEKDGNKAIVIDELASELGLGPSVPVHAVLHDWIRHTDGKLSFLGFVKLLHGPSRSLAKGVDHVDNWPEAGNMNIIIDVATRVWYYKTRLTMEMETLHTSKNLYCKGI

SEQ ID NO: 231115 - protein, 192 aa, Glycine max
  Coding DNA Sequence Number=SeqID_114337
  Gene Ontology: Mol. function=nucleic acid binding; Biological process= DNA integration
METWEVNNSKITTQINNYVLQTIGMQVEKYDLAKAIWDHLKMLNDDFEGLRWMILRLHPLPNVDVVVNELLAEEIQLKSNSSSDKGIFFASPPVFVALFTKFKKLLATQSLDMSASSLKGLPSSSSLGMSLSIWILDFGESHHMSYDPKYFVSLNPILSLSVMIADGSPMPLVGTESGRLIGTDCRLGDFIY

SEQ ID NO: 231116 - protein, 332 aa, Glycine max
  Coding DNA Sequence Number=SeqID_114338
  Homolog annotation: Hit_ID=UPI000068C007; Match level="QueryCoverage =97%, HitCoverage=43%, E-value=7e-57, Identity=35%"; Hit description =putative secreted protein
MDMQSYGGLATYKRIQYSPDYKGFKAGLYVHQANHGQFNTSWGSYDSSSPYINQFNMKNLMPEKEQQQIAKVYISAFLDVNLKGENVYKPLFTDYRYGRKWLPNHVYFNQFEDSETTFVARYEEDLNLSTATLKGVQITGENLSLWREAQQKLIWNSQISRAAYIGWNHSETGNKPGKYTFTFPDSLRQDLKGKALAFNLAESDESSVAARKGKKETKKEESVKKDLQKKAIDFSIELTDQNGKKAHFLLSDCAPLQPQLKKNLTKFSFFNDNPDAESIPDYFYFDLDTVRKKYPELDLDRLKSISLIFDKTPEGVVILDDISFVKLSTSTH

SEQ ID NO: 231117 - protein, 94 aa, Glycine max
  Coding DNA Sequence Number=SeqID_114339
MGCNSPPKIISRQKDKRGNFRRLREGDVALLRPQGHVVEASFMMMNQTILMMPKAQVIDSRLIQDFKIKHQESNPRFKIQEKKSRSNKSRLHIG

SEQ ID NO: 231118 - protein, 79 aa, Glycine max
  Coding DNA Sequence Number=SeqID_114340
MGWGKRAYRNSRIETYPVPRNQLGTELVRTGKLDQVFNVRRVCVRVLCPRVVFTVTRAVNKKKLKWMVIVSTMSMEMPH

SEQ ID NO: 231119 - protein, 525 aa, Glycine max
  Coding DNA Sequence Number=SeqID_114341
  Gene Ontology: Mol. function=protein serine/threonine kinase activity; Cellular component=cell cortex; Biological process=protein amino acid phosphorylation
  Homolog annotation: Hit_ID=Q10EQ9; Match level="QueryCoverage=62%, HitCoverage=41%, E-value=1e-111, Identity=62%"; Hit description =Protein kinase domain containing protein, expressed
  Pfam annotation: Domain name=Pkinase; Domain location=186-447; Score =272.9; E_value=6.1e-79; Accession=PF00069.15; Description=Protein kinase domain
  Pfam annotation: Domain name=Pkinase_Tyr; Domain location=186-447; Score=145.8; E_value=1.2e-40; Accession=PF07714.7; Description =Protein tyrosine kinase
  Pfam module annotation: Pfam domain module=Pkinase::Pkinase_Tyr; Domain location=186-447::186-447
MESRKKWLVFKNSDVWVCVYSVFARQETRSAGVVAEQERSEGDKFWLSVPPRSAPTSPLGSPSNKNDDDLVPYYYVSPKGNQFWSAPEMPTFDSSHPPPAFFDLSALHTDNIPSPHQSPTRLSSLSIPPKLSLDTSIARRETTAPLAVHPLPLPPWAGPGPPLLSPSSTFSPPVAKTESLPMKNQWQKGKLLGRGTFGTVYVATNRKTGALCAMKEAEIFSDDPKSAECIKQLEQEIKVLSHLQHPNIVQYYGSEIVEDRFYIYLEYVHPGSMNKYVREHCGAITECVVRNFTRHILSGLAYLHSKKTIHRDIKGANLLVDSAGVVKLADFGMAKHLTGHVADLSLKGSPYWMAPELFQAGVQKDNSSDLAFAVDIWSLGCTIIEMFTGKPPWSEYEGAAAMFKVMKDTPPIPETLSAEGKDFLRLCFIRNPAERPTASMLLQHRFLKNLQQPDVSSSMQLYNGTSLMDIHSPKELSENKLDQISIPSAHIAKGKLATERFFPGISIDAPASDKLVHCGVYSMRI

SEQ ID NO: 231120 - protein, 276 aa, Glycine max
  Coding DNA Sequence Number=SeqID_114342
  Gene Ontology: Mol. function=oxidoreductase activity; Cellular component=vacuole; Biological process=hydrogen peroxide catabolic process
  Homolog annotation: Hit_ID=Q9FX85; Match level="QueryCoverage=97%, HitCoverage=77%, E-value=5e-92, Identity=64%"; Hit description =Peroxidase 10 precursor
  Pfam annotation: Domain name=peroxidase; Domain location=1-240; Score= 417.5; E_value=1.9e-122; Accession=PF00141.13; Description=Peroxidase
MAKDARIAASLLRLHFHDCFVIGCDASVLLDDTGTLKGEKNALPNKNSLRGFEVIDTIKAALEKACPSTVSCADILTLAARETVYLSKGPFWYVPLGRRDGTTASESEANNLPSPFEPVENITAKFISKGLEKKDVAVLSGAHTLGFAQCFSFKPRLFDFGGSGKSDPSLDVSLLQNLVKLCPNQADSDTNLAPLDPVTTNTFDNMYYKNIVNNSGLLQSDQALLGDSTIASLVNVYSKWPIMFFRDFAVSMEKMSRIGVLTGSRGQIRTNCRAVN

SEQ ID NO: 231121 - protein, 82 aa, Glycine max
  Coding DNA Sequence Number=SeqID_114343
MKVKEGTSTESSDDGESEKIRLNMHEEDMVVHALMTTYLRIFISESPTIDAHAYPPCKEKIESEMKISSLSVFIRSNSNSFM

SEQ ID NO: 231122 - protein, 122 aa, Glycine max
  Coding DNA Sequence Number=SeqID_114344
MVKDLNIIGIPKGHIYPQLLIYLLEEGFDGSNGCVLLATRSFQKTIKGVMYALTGLNTNARVGGGVPLIASATTLASGANASKGRPHTGVDSLHREDEAKSTLPVPLLNVIDLHLKAMLSKS

SEQ ID NO: 231123 - protein, 304 aa, Glycine max
  Coding DNA Sequence Number=SeqID_114345
  Gene Ontology: Mol. function=histone-lysine N-methyltransferase activity; Cellular component=nucleus; Biological process =multicellular organismal development
  Homolog annotation: Hit_ID=Q9FKZ3; Match level="QueryCoverage=75%, HitCoverage=76%, E-value=3e-54, Identity=50%"; Hit description =Protein ASYMMETRIC LEAVES2
  Pfam annotation: Domain name=DUF260; Domain location=8-108; Score =228.6; E_value=1.4e-65; Accession=PF03195.5; Description=Protein of unknown function DUF260
MSSSSNSPCAACKFLRRKCTQECVFAPYFPPDNPQRFAYVHKVFGASNVAKLLNELSAAQRDDAVKSLAYEAEARLRDPVYGCVGLISVLQHKLRQIQVELNNAKKELATYIGPQAIQGIPAPMLQQHPNNPFPGAMYGNMPTATAAVHGGQLVIRDAQPAPQQQQQQILEAQQLAAAVAAREQQEMFRSYEHQQQQEFLRFSGGFDVGSASSAGGFSQVSPAAASADQLSPSLALGSFDNAYHMQQPQQEEPHHHHHHPHHIPLEAQLLLPPQQKQQTHHESQLPLHQQHSDNEERRSVGPSC

SEQ ID NO: 231124 - protein, 75 aa, Glycine max
  Coding DNA Sequence Number=SeqID_114346
MDENEWGIGWVREQKGSKIRQHSRPDQGTLLMASEYSCHPFNSNNDNKVSLGHLSILMQQSHHTYHIYYFLLIFR

SEQ ID NO: 231125 - protein, 106 aa, Glycine max
  Coding DNA Sequence Number=SeqID_114347
MKGRINLGLESENAVYEWRKSEALRVGGTYEKAWTVLERKTNDQSEPRAISRAKLGVEESNFDSVQQDFGFVQKIAMHLLVVERAVQNEFWVFASRSQRSKCRLMY

SEQ ID NO: 231126 - protein, 61 aa, Glycine max
  Coding DNA Sequence Number=SeqID_114348
MMNISERARRVQDPTQALQQQSALGELPGKKSHLVQGKLPRRVACLRLKVLAHPGEWLTYG

SEQ ID NO: 231127 - protein, 544 aa, Glycine max
  Coding DNA Sequence Number=SeqID_114349
  Gene Ontology: Cellular component=mitochondrion
  Homolog annotation: Hit_ID=Q0WMY3; Match level="QueryCoverage=99%, HitCoverage=100%, E-value=1e-166, Identity=54%"; Hit description =Tubulin-like protein
MKEIVTVQVGDFANFVGSHFWNFQDELLGLAGNPSADSVFKNQDLNMDVLYRTGSLGSMSSRGTLYTEVASTTPDVVTWTGRVSTQASEPYKRNLFLQRLYEEEESLNMINEIRGSNNGSQSEYEDKDITECLENGVQFWTDYSKVHYHPRSLYELNGVWAHVEEFDNYGIGRDSFAWAAQGEEIGDRLRFFVEECDHIQGFQFVVDDSGGFSAVASEFLENIVDEYTNIPVLLYAVQGSGSRTNLQSRKRAVLEDLHDAVSFSRLSSYCKLIVPVGKASRFLHIEDAKHYHSSAVYAAALHSISLPFRMVPVGPTADACSVSGAVDVHGVVQMLSGQGRQNMVSVLDVAMPAPALTGEQNELSLLEILQPLTPQIAEDVEDMQAIEHMTVHGALASGHRASVGEVKDTVDAAFRCANTRPMFCHLSVALSPLPIPLPFPSIFGNNVGQHGELMSGQITNSSPKGSLDIHSIPMAARLRSSSIVLPLLESKLRNLHQFGIQRGAAGAELLRSWGFGQEELVEMEEMLSKMVAALHPPQLSSDSD

SEQ ID NO: 231128 - protein, 74 aa, Glycine max
  Coding DNA Sequence Number=SeqID_114350
  Subcellular localization annotation: CTP_CleavageSite=38; ConfidenceScore=5.17e-01
VPQQEGGWRSHDSEIGLRGYMRRSFSRRVSGPFRRSLVFAMKSTIQMDLRMRSQTALPGLTARKLPENEPGYSL

SEQ ID NO: 231129 - protein, 72 aa, Glycine max
  Coding DNA Sequence Number=SeqID_114351
MLVVIYPHGGLRRISSQLLSSVAMEEGSKERIGWFQDFAKVEEVLVVKCQVFALTLEPHYQILDLVLFSTLE

SEQ ID NO: 231130 - protein, 51 aa, Glycine max
  Coding DNA Sequence Number=SeqID_114352
MLTSSSRDGNAPTVNQPKDQLNQFFRPFNTGKIPGLVKVAIAQCQEFFGGK

SEQ ID NO: 231131 - protein, 603 aa, Glycine max
  Coding DNA Sequence Number=SeqID_114353
  Gene Ontology: Mol. function=indole-3-acetic acid amido synthetase; Cellular component=cytoplasm; Biological process=response to auxin stimulus
  Homolog annotation: Hit_ID=O81829; Match level="QueryCoverage=98%, HitCoverage=99%, E-value=0.0, Identity=80%"; Hit description=Indole -3-acetic acid-amido synthetase GH3.5
  Pfam annotation: Domain name=GH3; Domain location=16-573; Score =1217.9; E_value=0; Accession=PF03321.4; Description=GH3 auxin -responsive promoter
MPEAPRDYNLLEQNKKTLEFIEDVTANADQVQKRVLSEILSNNANAEYLKRHGLHGQTDRETFKKLLPVITYEDIQPDINRIANGDTSPILCSKPISEFLTSSGTSGGERKLMPTIEEELGRRSLLYSLLMPVMSQFVPGLEKGKGMYLMFIKSEAKTPGGIVARPVLTSYYKSSYFKDRPYDPYTNYTSPNETVLCLDSYQSMYSQLLCGLCQHKEVLRVGAVFASGFIRAIRFLEKHWPLLCHDIRTGTIDNTVTDLSVRDAVMKILKPDARLADLIQCECGKSSWQGIITRLWPNTKYVDVIVTGTMSQYIPTLDYYSNGLPLVCTMYASSECYFGVNLNPLCKPSEVSYTLIPTMCYFEFLPVNRSNGVSHDNLHTPRSLNEKEQKELVELVDVKLGQEYELVVTTYAVGDVLRVAGFKNKAPQFNFVCRKNVVLSIDSDKTDEVELQNAMKNAVTHLVPFDASVSEYTSYADTTTIPGHYVLYWELSLKGSTPIPPCVFEDCCLTIEESLNSVYRQGRVSDKSIGPLEIKIVEQGTFDKLMDYAISLGASINQYKTPRCVKFAPVLELLNSRVVEKYFSPKCPKWVPGHKQWINQNSS

SEQ ID NO: 231132 - protein, 77 aa, Glycine max
  Coding DNA Sequence Number=SeqID_114354
MQFGMHQEVSDCVIALSGTKAIALKNYCISKIALKNCKQYYLAKKQSKATLSSWTSYTVDPRDGGFGGRLSRWKWEK

SEQ ID NO: 231133 - protein, 218 aa, Glycine max
  Coding DNA Sequence Number=SeqID_114355
  Gene Ontology: Mol. function=catalytic activity; Biological process =trehalose biosynthetic process
  Homolog annotation: Hit_ID=Q9FJQ1; Match level="QueryCoverage=93%, HitCoverage=53%, E-value=2e-86, Identity=76%"; Hit description =Trehalose-6-phosphate phosphatase
  Pfam annotation: Domain name=Trehalose_PPase; Domain location=28-218; Score=188.8; E_value=1.3e-53; Accession=PF02358.7; Description =Trehalose-phosphatase
MKQLHHPSALDMFDKIIDASKGKQFVMFLDYDGTLSPIVDNPDRAFMCDSMRKTMRKLARCFPTAIVTGRCKDKVYNFVRLAELYYVGSHGMDIKGPTTTSKYNKDSKVEPILCQPASDFLPLIDEVYQQLVEKTKSTPGALVENNKFCLSVHFRCVDEKKWSELARQVKSVLKEYPKLRLIQGRKVLEICPTIKWDKGKALEFLLESLDNAHECGSA

SEQ ID NO: 231134 - protein, 77 aa, Glycine max
  Coding DNA Sequence Number=SeqID_114356
LASSPSNQPHDVEQLPGSNFQVREQLSLHQGVAVCQQGHWSQETREHIQTTTDTYFTGLQTDQCVFVDFIYLMDAHI

SEQ ID NO: 231135 - protein, 114 aa, Glycine max
  Coding DNA Sequence Number=SeqID_114357
  Gene Ontology: Mol. function=nucleoside-triphosphatase activity; Cellular component=membrane; Biological process=proteolysis
  Homolog annotation: Hit_ID=Q1SGD5; Match level="QueryCoverage=84%, HitCoverage=28%, E-value=2e-41, Identity=69%"; Hit description=AAA ATPase, central region; MIT
MHPYFPNSEDPRFPTALGVGHNDQKVLVLATTNTPYALDQVHLGDTPHNLAESDFEHLTRKTEGFSGLDISVCVKDVLFEPVRKTQDAMFFFRNPDDMWIPCGPKQQSAVQTTM

SEQ ID NO: 231136 - protein, 94 aa, Glycine max
  Coding DNA Sequence Number=SeqID_114358
  Gene Ontology: Mol. function=transition metal ion binding; Cellular component=cytoplasm; Biological process=cytoskeleton organization and biogenesis
MRHFPTCRVSRYKVKYDKCSDDLATKNDHPSKVCWYLPIIPRFKRLFANRDDEKTLHGMQMTEKMMDCFDIPLILPNGRQLIACIRILERIQET

SEQ ID NO: 231137 - protein, 73 aa, Glycine max
  Coding DNA Sequence Number=SeqID_114359
MYKPHLSESPVSGLFPEGSTQLPFVLSEDRRDQDQPEAQEVPETASVTEGYLQLMNKFLNYLSLRFYCFFSYM

SEQ ID NO: 231138 - protein, 145 aa, Glycine max
  Coding DNA Sequence Number=SeqID_114360
MYRDAFGFADIIGGNWTSESRYDHLDLQKSSVLNFQRLDKLWAAIGHPIQKIWPFKFAESFHFHVQKLINFGRPSDIRVKRYGRLNLPRASVFKFKHLDISWEAIRHSSQNIWTFEFAQSFRFQSLASQYITGDNCTLESKDMDV

SEQ ID NO: 231139 - protein, 122 aa, Glycine max
  Coding DNA Sequence Number=SeqID_114361
MGGHQSSESNDMDVRIFPELSLSISCISIHYGRQSYIRVQGYGRLNLPRASIFKFKRLNILWARFNFQSQASRYIVDGNRTSESRYDRLDLPKSSVLKFMRLDTLWAVIGHPSQKIWPFEFA

SEQ ID NO: 231140 - protein, 117 aa, Glycine max
  Coding DNA Sequence Number=SeqID_114362
MVLSIKKWPMSLPSWLSFTMIDDHYEWQIPWKKGNVPCHTLISSGDLCLMTCDLSLVLVRCLAPIIRQFVKFQDMPKNQKNIDAQSLGCFWRKQPSSPRRAKVAWASWVATSSLFFL

SEQ ID NO: 231141 - protein, 102 aa, Glycine max
  Coding DNA Sequence Number=SeqID_114363
MVYRGRQDASIISVRNDMPFAKITNISGMSGMTHSGRIFAAPELLARSKDKGKLKADIGEKERTGPTENDEAFVGKIVEEGNDFSKREISAEEATEFLRIIQ

SEQ ID NO: 231142 - protein, 92 aa, Glycine max
  Coding DNA Sequence Number=SeqID_114364
  Subcellular localization annotation: CTP_CleavageSite=48; ConfidenceScore=5.35e-01
MRLADRRNLEGNLSRRQVLSTSSARSVSRLSPSRLSATLALREHSLTRAKRENGAKCDVEVKKREIERALNSRKSLKSEIHKGKEQIKEAKF

SEQ ID NO: 231143 - protein, 68 aa, Glycine max
  Coding DNA Sequence Number=SeqID_114365
MLIIIDQYKEEVNLVASHGQMLEDDQAKVSVMQIEREAGERVIELLHGEAMKWMNRFALTLNESQELP

SEQ ID NO: 231144 - protein, 125 aa, Glycine max
  Coding DNA Sequence Number=SeqID_114366
IAPIRHPVDPEEPNRALGFPALVTGLCQSYRVPVPPARSCHRDIEFQQGPGVSSSDYEPFQFYEVPVATSKVIRPPTNRAFIKKYCTSRQAQGKTPQQPGDGRQRAIDAPPPPLEPLSSSTRDGA

SEQ ID NO: 231145 - protein, 98 aa, Glycine max
  Coding DNA Sequence Number=SeqID_114367
  Subcellular localization annotation: CTP_CleavageSite=42; ConfidenceScore=5.42e-01
MPSLPLACRTPCVSSRPRPAACTWSGSGCRHRRRGRSSRPCSAAQAQAQALEEIAQHLVQATPVVGVAGLAEQRAHFRLGHVETGAGEDLHQIDVAQL

SEQ ID NO: 231146 - protein, 239 aa, Glycine max
  Coding DNA Sequence Number=SeqID_114368
  Gene Ontology: Mol. function=transporter activity; Cellular component= integral to membrane; Biological process=transport
  Homolog annotation: Hit_ID=Q1ID42; Match level="QueryCoverage=76%, HitCoverage=46%, E-value=2e-46, Identity=56%"; Hit description =Putative transport protein
MAAFGGAGEVAFLGQGDGKLELLEVHPAISFPDDRDDDDSFPSSLQQADTVHPASLEHRVSWHGGHCRTAELCRRTDPAGAAGRPVRTPPPDRGDEPVVRRRAGDQCLCAVADLAAGGHRDHRPVLGGGPGAGAVRRHAGGARASWSRGRHVDEWPAAGHPAGTYRGRPAFQPGRLAPGVRDRRRHPGTDRAGTAARAAALPPQRRPWLLRVAALDRCAVRTGTRAAPAHAAWRLQLRH

SEQ ID NO: 231147 - protein, 102 aa, Glycine max
  Coding DNA Sequence Number=SeqID_114369
  Gene Ontology: Mol. function=DNA binding; Cellular component =intracellular; Biological process=DNA integration
MEIRDEFLDESLFMMSERPWFADLASFKAARIIPKDLTWQQRKKFLHDASFYVWDDPYLFKIGPDNILRRCVTKKEAKNILWLCHNSPCGGHYGEDKIAAKV

SEQ ID NO: 231148 - protein, 282 aa, Glycine max
  Coding DNA Sequence Number=SeqID_114370
  Gene Ontology: Mol. function=RNA-directed DNA polymerase activity; Cellular component=intracellular; Biological process=RNA-dependent DNA replication
MVLHSSLERALVNHVECLTKEEEHEVQTCIQELDVVGENSERHTAFEELNNSGQVEKPKVELKTLPAHLKHVFLEDNESKPVIISSSLNEAGMTVIKMIRIVLGRNDSHQNDKDELISTRTITRWRMCIDYRKLNDATRKDHYPFLFMDQMLERLAGQSYYNFLDGYSGYNQIAVDPKDQEKTTFTCPCAVFAYRCMPFGLCNAPATFQRCMMAIFSDMVEKCIEVFMDDFYVFGSSFDGCLSNLEKVLQRCEESNLVLNWGKCHFMVQGIVLGHKISVSVS

SEQ ID NO: 231149 - protein, 68 aa, Glycine max
  Coding DNA Sequence Number=SeqID_114371
MIALQVKESLDSRIRKNYVGLISSSMEGELVALDLEIEATFRRNNTERKRKLLHDRTVASSREEAHFF

SEQ ID NO: 231150 - protein, 176 aa, Glycine max
  Coding DNA Sequence Number=SeqID_114372
  Gene Ontology: Mol. function=nucleic acid binding; Cellular component= nucleus; Biological process=DNA integration
  Homolog annotation: Hit_ID=Q1S9T9; Match level="QueryCoverage=76%, HitCoverage=14%, E-value=1e-21, Identity=35%"; Hit description =Peptidase S8 and S53, subtilisin, kexin, sedolisin; Integrase, catalytic region; Zinc finger, CCHC-type
MVIEFDLELEQIGVKRIFLFGEIDETILMRQPGGFEIRGNEDYLSQETYLKKVLETIRMSNLKLVVISTSQQFKLSVSQSPKKIEELTYMESIPYANIAGSIMYAMALKWILRYIKGSLGRVLVYGGAKDKKGTTTIEGFVDSDYAWGLDTRKSLTVEYMVVTEAVKEALWLEGIA

SEQ ID NO: 231151 - protein, 71 aa, Glycine max
  Coding DNA Sequence Number=SeqID_114373
  Subcellular localization annotation: CTP_CleavageSite=33; ConfidenceScore=5.07e-01
MSSFSMYYAPESDFRETSYDLLNFSRASGFQFRASRYVMHQNRSSVSQVMTIGICRELSMFNFEILDVLCA

SEQ ID NO: 231152 - protein, 89 aa, Glycine max
  Coding DNA Sequence Number=SeqID_114374
  Subcellular localization annotation: CTP_CleavageSite=16; ConfidenceScore=5.38e-01
MVIAAPTEVASGHTSRTANAWRRRWCGCRRQRNTPPTNRSTTKVSGNTMGCYTAKIHDPKKKSPFCSTPSTSSLDLPPCAWIGSRGQRF

SEQ ID NO: 231153 - protein, 378 aa, Glycine max
  Coding DNA Sequence Number=SeqID_114375
  Gene Ontology: Mol. function=serine-type D-Ala-D-Ala carboxypeptidase activity; Cellular component=periplasmic space; Biological process =proteolysis
  Homolog annotation: Hit_ID=Q11VD0; Match level="QueryCoverage=76%, HitCoverage=66%, E-value=3e-24, Identity=28%"; Hit description=D -alanyl-D-alanine carboxypeptidase
  Pfam annotation: Domain name=Peptidase_S13; Domain location=139-378; Score=-152.1; E_value=0.075; Accession=PF02113.6; Description=D-Ala -D-Ala carboxypeptidase 3 (S13) family
MIELKHRREDKVNRASQFLGSVLRKYLPEECVLGPERSQIARINNLYQFQILLKLPRGKNYEKYKEQAYDNQKTNLNLPSPITSVVEKTILSAKELVDINVNTLVSDPVLKNASWGFVVYDPKTKKVISSYNENTPLVPASTTKLLTTETALNLLGENYRWMTQLEYSGSIDENGVLNGNLYVVGSGDPSLGTNKGGALSYREIVSDFLSGISHEGIKRVNGDIIIQTALFKGNISRLPENVVWLENNNYYLPVGTTREINPANEKLIVKKSGNFSTEKKYFYVSPYANQMVYADKYEGDGVLTTKLPDAPAYLANTLRATMVKSGIAVSGKVTPKMTDPMPESRKLISAYKSPTLSDIIYYTNQHSDNSLAEALLKQ

SEQ ID NO: 231154 - protein, 77 aa, Glycine max
  Coding DNA Sequence Number=SeqID_114376
EMLMMLKMHCDVVMLCMYLGGAVTLLDIPVTLLDIPGGGNRVDDLDTYCLVFLSESVVWTRLGYFFRDGTTLHLRVE

SEQ ID NO: 231155 - protein, 64 aa, Glycine max
  Coding DNA Sequence Number=SeqID_114377
  Homolog annotation: Hit_ID=Q7XXN8; Match level="QueryCoverage=53%, HitCoverage=66%, E-value=1e-07, Identity=62%"; Hit description =Hypothetical protein ROT4
MGKRNIEETPYRSKLPHDKKEVRIPADKHCDAPPEDIEPCPLLLSKPSASPSKGFEWFKDMSSA

SEQ ID NO: 231156 - protein, 58 aa, Glycine max
  Coding DNA Sequence Number=SeqID_114378
MDGWFIVCIDGGNLHGKDDFFFKLSEPLAEHTTPAAECEEESGRRMSWTHALSEGSSR

SEQ ID NO: 231157 - protein, 91 aa, Glycine max
  Coding DNA Sequence Number=SeqID_114379
MDPSQEVTPPKLLPVNLVDLNITTSEYSMLGGLHAQMNTRNQAIECPPGLHISKATYIKIIANKVCPLLPILDATKKKGFKLYHYVEMPIR

SEQ ID NO: 231158 - protein, 96 aa, Glycine max
  Coding DNA Sequence Number=SeqID_114380
MEGKKAIQIKRRISFNALKKKLEIRFLVSGKYVALQICDDEDVETILESFQQQDQMSDMELYIEKDVAGGSMFHSANSLTSCGNKLSNNEAQPPRN

SEQ ID NO: 231159 - protein, 255 aa, Glycine max
  Coding DNA Sequence Number=SeqID_114381
  Gene Ontology: Mol. function=transition metal ion binding; Biological process=iron ion homeostasis
  Homolog annotation: Hit_ID=Q9KVK4; Match level="QueryCoverage=55%, HitCoverage=90%, E-value=1e-44, Identity=60%"; Hit description=DPS family protein
  Pfam annotation: Domain name=Ferritin; Domain location=61-209; Score =70.6; E_value=5.1e-18; Accession=PF00210.14; Description=Ferritin -like domain
MAADRAQQLTQLARLAFDRAFITVLIAAALLMALGAGAEKIIMATAKKAAKTHIGLDSKQSAKLAEALNALLANYQVLYMNVRGYHWNITGPQFFELHAKFEETYNDLLTKVDELAERILTLGSQPRHAFSDYLKTADIKEHTNVTDDKGTLRGLLEGYSILLQQQRELLTVAADAGDEGTASLMSDYIKEQEKQAAPHPDDMAIAARLALQPAMPAALALPQHAPAAHFISTASHNSVTRSSNANRGHYSPFRP

SEQ ID NO: 231160 - protein, 131 aa, Glycine max
  Coding DNA Sequence Number=SeqID_114382
  Gene Ontology: Mol. function=superoxide dismutase activity; Cellular component=chloroplast; Biological process=superoxide metabolic process
  Homolog annotation: Hit_ID=Q3SAW8; Match level="QueryCoverage=75%, HitCoverage=36%, E-value=2e-48, Identity=85%"; Hit description=FeSOD
  Pfam annotation: Domain name=Sod_Fe_C; Domain location=30-123; Score =100.1; E_value=6.4e-27; Accession=PF02777.8; Description =Ironmanganese superoxide dismutases, C-term
MPLAWEVQSLKEVPRVWNHDFFWESMQPGGGDMPKLGLLQQIEKDFGSFTNFREKFIGAALSLFGSGWVWLVLKREEKRLEIVKTSNAICPIVWDDIPIINLDLWEHAYYLDYRGWQWPYGILGGVDKRNE

SEQ ID NO: 231161 - protein, 56 aa, Glycine max
  Coding DNA Sequence Number=SeqID_114383
MVWPKNVVEEALIGRFGARDDFASPVSTSPSADAWPRCSILPEVQRRNPIGNDLVP

SEQ ID NO: 231162 - protein, 122 aa, Glycine max
  Coding DNA Sequence Number=SeqID_114384
MDQIVVSVQKSGRRSVLRSQLSSVASQFFFRHVIMVLVEGLLLRESIGDGSEVHGYDNKVFEVSSDSYFSVSDFSSSINLSTIEGSSDLSTFFSQLPTNMGEKVGENVVASVVDPIGETGTS

SEQ ID NO: 231163 - protein, 195 aa, Glycine max
  Coding DNA Sequence Number=SeqID_114385
MSRFRNEVRQVGQKRDKREGGTRTDLHKSDKQRKPNKCQLLPRGPKYECYTPLMTNRTIILEEAFNTEVPIMLPLPLPYRPRKTLNKLRAIVSMPHLMMKFLTLRGEIVIAKADQKQVRQCYVESLKVAPYPPTREPIRPHPTAGGSLLMTLLKVLKLLIKAQSLLKNLSSCSSDPNPSNAHSLARTLPAMSTDT

SEQ ID NO: 231164 - protein, 95 aa, Glycine max
  Coding DNA Sequence Number=SeqID_114386
  Gene Ontology: Mol. function=RNA-directed DNA polymerase activity; Biological process=RNA-dependent DNA replication
MVMKSQSITQHMTDLEEVFSEIRKYDICLNLENALLGVKGGKFVGFMITHRGIEANPDKWTTILKVHNPTNIQEVQKLNGRLVSLSKSSRSSPRK

SEQ ID NO: 231165 - protein, 315 aa, Glycine max
  Coding DNA Sequence Number=SeqID_114387
  Gene Ontology: Mol. function=ribonuclease H activity; Biological process=DNA integration
MRAGGCTAARPSELVTSSLSFLGHIHPGFWQGSQRADLRFVEPLELRDSPRMDLGFDEHLEMRDSPRTNLVFNEPLEMRDSPRMDLGVNLGFDEPLEKRDSPRMHLGFDEPLEKRAWVDLGFDEPLEKRDLPRTDLRFDEPLEKRDLPTADHGFNEPLEKQDSPRANLGFDKPLIWRSETYQGWTLGLANNDKPKVCWGVPPSIDPWACHHRQELFISLTFELSIVVDDNGIREAISTYEELDRSWGFWQWSQNVHPPHGERPRGTLLGGVRMGAWNVREFLALSTPPNKVEGVGLVCRAILDDTHHLCHKGACP

SEQ ID NO: 231166 - protein, 394 aa, Glycine max
  Coding DNA Sequence Number=SeqID_114388
  Gene Ontology: Mol. function=chitin binding; Cellular component =extracellular region; Biological process=chitin metabolic process
  Homolog annotation: Hit_ID=UPI000044A8F0; Match level="QueryCoverage =95%, HitCoverage=100%, E-value=1e-31, Identity=30%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
  Pfam annotation: Domain name=Cornifin; Domain location=139-319; Score= -50.9; E_value=0.087; Accession=PF02389.6; Description=Cornifin (SPRR) family
TLTFRGLHALTFRGLHALAFKGLHVFTLKGLHALAFRGLHVLAFRGLHALVFRGLHVLTFRGLHALAFRGLHVLAFRGLHVRAFTGLHVLTFKGLHVLTFKGLHVLAFRGLHVLAFRGLHVLAFKGLHANAFRELHALTFTGPHVLKGLHVFALEDYTPSTLEGYTLSPLEGCTPYPSKGDTPSLLEHYTSSPSEGYTPTPLEDNTSSPSESCTPSPLQSDTPLPLEDYTSSPSEGYMSSPSEDYTSSPSENYTSSPSEDYMSSPSEGYTSSPSEGTTPSPSEGYAPFPSEGYTPSPLEDYTSSPSEGCTPSPAEDYMSLPSADYTSSPSEGCMPSPFRGLHVFAFRGLHGLAFRGLRALAFKGQHILSFRGLHALAFRGLHALFFKRVTHPRL

SEQ ID NO: 231167 - protein, 146 aa, Glycine max
  Coding DNA Sequence Number=SeqID_114389
  Gene Ontology: Mol. function=transition metal ion binding; Biological process=cytoskeleton organization and biogenesis
  Pfam annotation: Domain name=Transposase_21; Domain location=27-146; Score=-60.1; E_value=1.8e-09; Accession=PF02992.5; Description =Transposase family tnp2
MFPFDFRHVAELRGLPNDGCQVPPSSHAKVASQQTDGPRTKLGYDKGVAMFDGYQNETFKLRAMLFCTINVFPTYENLSGYNVKGNCACLICEENTSYVQLKHGRKIEYTRHRRRLRKPYHPYWRLKKAFNGRQEHESALKPLTGQ

SEQ ID NO: 231168 - protein, 161 aa, Glycine max
  Coding DNA Sequence Number=SeqID_114390
  Gene Ontology: Mol. function=protein kinase activity; Biological process=protein amino acid phosphorylation
  Homolog annotation: Hit_ID=Q1ST94; Match level="QueryCoverage=62%, HitCoverage=21%, E-value=1e-27, Identity=64%"; Hit description =Protein kinase
MDVYAMLDYQKLMKMQLSLNDCGRFLNHLKCRLLLGDYLWIGYKLSKTPQDKYWWLVCKNGNCEEDNRELHDTSSRLITSTTLNSGPDVKSGCLHEGNLNRTPAPKFRGVQVFTYRELEIVTDGFSEANVIGSNGIIGGHGLMYRGVLRDGTMAAINLLCT

SEQ ID NO: 231169 - protein, 328 aa, Glycine max
  Coding DNA Sequence Number=SeqID_114391
MTSRKRKSTASRPQAQYDTRRFQSLEAWNRYTDNILDQRILPKRNVKIYHTKFDEFKAELERLNLHKRLANLQEGSIDVAEVKEFYANLYSLEDQSPKQVRVRGHLIRIDADSLNTFLETPVVLEEGETLPTYSRFTRMRIDPQEFVAPLCIPGRGFVLNAEGHPWKLLRKDLTTLAHTWSVLSYYNLTHTSHTSDLSMDRAKLVYSLVTGMDMNIRALISGQISIIAQSNSSRLGFPALVTALCRASGVTSGSLTYESLSSAINLAYIKKNYWNMNDLAINFRGSRKSLQVVGPPGSILSVEQFIEKVSWPGTLLSTVGEGEGPQCS

SEQ ID NO: 231170 - protein, 99 aa, Glycine max
  Coding DNA Sequence Number=SeqID_114392
MRNKLIHKLHADQLDPHEGTSSKILLRIIYLVLDPSAYLDNGDVLKKKKKKRTMAPRREQTTMENRELRINLLGRTRSQKKEQEGVAGRRKANCWVQMF

SEQ ID NO: 231171 - protein, 208 aa, Glycine max
  Coding DNA Sequence Number=SeqID_114393
MYKPGPKNKALDALLCQMGSVEFRDNSISLLWVDFPTIHTKIQQDTELSKLPSQIQNDPASMLQYVQGDGLVFFKGHLVLPKTHREDSLRGRLWLITSFCAMLLARETLVGSITSVLFDRDKAMHQLKAHLLCAQQSMNKVHPLFHVSQLKKSVTTSSNVSTLPLSLTMEESDFPFLEVVLATCEGKTNGSCEERLILWKSQPMEEAT

SEQ ID NO: 231172 - protein, 182 aa, Glycine max
  Coding DNA Sequence Number=SeqID_114394
MACTKKSGQMVSEATNEMAERIDSLEEQVSQGSFVAHGRQDVLIATIGRLEHLGRVSAAGAGVTIKNYFGLTSRGFCTSSSMAAEDLEQGIALPFQAKVGPFVAHVSTKESCVDPSGHDPEMEDSDKCGLYVDDSPPRLVALRRVYEGSMTIHNVPLGNDQVKVGVEEVRHADARVPVPTQE

SEQ ID NO: 231173 - protein, 111 aa, Glycine max
  Coding DNA Sequence Number=SeqID_114395
MLDPKVNDPLYLMTLTIPELFLRPYQVTWDATMFGVFNPDFPLYIKHEDLSKIAHGGQCLSISVLWLWILHLTETKFKTRCLPWNLPEWRTLEDGGHPAQGTPSCLVLFIA

SEQ ID NO: 231174 - protein, 205 aa, Glycine max
  Coding DNA Sequence Number=SeqID_114396
MASNPSRAQKKAKLDTWFTNENKENDFKMLYTVKNMRIPKFLDLEWFSQQGFNFPDLLEAQGLSKLVQMKGTFYLVLVKVFYTCVYADMEGNMFSTVNGVEMVIEAAVRKAIARLDIGGVCKFEESIDGYSKMQNYREDEARQEHTNQWSPFESLMISKMDAMLHLHQEHSVDVHNTLENITTKLENIETRLTLSNLLNPDDDET

SEQ ID NO: 231175 - protein, 160 aa, Glycine max
  Coding DNA Sequence Number=SeqID_114397
MVHCLVNSGDIVATKRVVTDEAAMTFVATLSIGEHKRKLEEDSRLDALVGRVSEEIPKFVVQESLKTLSIKEMQRKAVEEATMMDTNGESVLEKVVLESVIAHLEDEVQSTTKDEAVLMPVSVAERQVEIEATMVPEDMDHEKNDSFEEDMFKFVIKASL

SEQ ID NO: 231176 - protein, 189 aa, Glycine max
  Coding DNA Sequence Number=SeqID_114398
MVYGGPHSIIDDRKAMIRFLRTENLTYMCILIHSILFNMVMPRLGSQDYVSDKDILCMYKLWWERRSILRTRSRRSLRRNHCQWWVRQWPQEFVFAILATPQPKPASPSKWVKPIWVKFEKSKVERLKRVKVMCRNFKNLKLASPTLSKKEVVALEKAKKKSLFETRKKAKVDKSLEKKEAFNMDDVTP

SEQ ID NO: 231177 - protein, 347 aa, Glycine max
  Coding DNA Sequence Number=SeqID_114399
  Gene Ontology: Mol. function=oxidoreductase activity; Cellular component=cytoplasm; Biological process=gibberellic acid mediated signaling
  Homolog annotation: Hit_ID=Q4A3R2; Match level="QueryCoverage=97%, HitCoverage=99%, E-value=1e-105, Identity=54%"; Hit description =Gibberellin 3-oxidase
  Pfam annotation: Domain name=2OG-FeII_Oxy; Domain location=201-301; Score=120.1; E_value=6.4e-33; Accession=PF03171.10; Description=2OG -Fe(II) oxygenase superfamily
MVTTLSEAYRDHPLHLHHIIPLDFSSLRTIPDSHAWPQSEDGDDDNHGAGSCIPIIDLMDPSAMELIGLACENWGAFQLTNHGIPLSVAEGVEEEAKRLFALPADQKLKALRSAAGATGYGRARISPFFPKHMWHEGFTIMGSPCDDAKKIWHNDCARFCHIMNNYQKQMKALAEKLTHMIFNLLGNISEEQKRWIGSTNLCEAVQLNFYPCCPEPNRAMGLAPHTDTSLLTILHQSQTNGLQIFQEGAGWVPVHPHPGTLFVHTGDILHILSNSWFRCALHRVMVNSMRQRYSAAYFYAPPMDHVVSPLVLDSLPRFRSLTVKEYIGIKAKNLGGALSLISMLNNN

SEQ ID NO: 231178 - protein, 109 aa, Glycine max
  Coding DNA Sequence Number=SeqID_114400
MEDMVDHLEQKKIMMAFEEPIRLIDLFAQIDKCLMRKYQQQAIECILPSRPFPPSPQITPIKPHVNDKTRIEEIFLPEDITLEDPEYSQRFSEWEKTDYEPELRMKLSC

SEQ ID NO: 231179 - protein, 143 aa, Glycine max
  Coding DNA Sequence Number=SeqID_114401
MASRKRKAPSTPTQVRFDRSRFTSQEAWERYADVIVPRKPLLERNMVVYTIEFDEFLDEIARRHWDEELTDFIDGSIDVAIVKEFYANLYDPEDKTPKQVQVRGHLIKFDEDTLNTFLKTPVIVEEGESLCAYSRFALLRHDP

SEQ ID NO: 231180 - protein, 101 aa, Glycine max
  Coding DNA Sequence Number=SeqID_114402
  Homolog annotation: Hit_ID=Q8LKU0; Match level="QueryCoverage=63%, HitCoverage=24%, E-value=4e-14, Identity=50%"; Hit description =Putative expressed protein
MVEQSVLALEKQQGSNPVLSEGIHDWVFECHGFLHNAGLIIASFLFLLYLALQAKKSFLKLSHGRSYIIISYYASLWLVSILNLLWCFSQVNLFFLTISSI

SEQ ID NO: 231181 - protein, 83 aa, Glycine max
  Coding DNA Sequence Number=SeqID_114403
  Subcellular localization annotation: CTP_CleavageSite=53; ConfidenceScore=5.19e-01
MKWAKLWFIKELKSPLGMATSSSNRQCYWLLPTAVQIASSTGAFHCKKVVPPSCNAAARSLRITVPYSQLASQTGESKPAKRH

SEQ ID NO: 231182 - protein, 208 aa, Glycine max
  Coding DNA Sequence Number=SeqID_114404
MTGRLLAGSLTFDCRIMHYIIVRILMPRSSDLAQASEEDLILMWAFLTSRPIDWAHLVRYRMHKALQFGAPLPYLQLVTLFLRHFEIPLDSEPFVIVKRSFAIGVGAVTSFGYRKDIDRQWLKKDAQPLQDERTPSPPPQRDDSSALMNAVLSESRGLCTYVGERFDSLDGCIDAIDARFEGMDTRITHLEEDVSYLRRCFDLPPPPS

SEQ ID NO: 231183 - protein, 133 aa, Glycine max
  Coding DNA Sequence Number=SeqID_114405
TEINGLLEGYLRHFSANQPEGLELLDPLTPHTIAAGGGLPISLLFCQDVAGAQRPSPNLLKLKAWPGLKEEESRPCREADRRDRPREERAQPTRAPPDVGQPESEASWERAETDDSKTKSETTGRLAERLSTR

SEQ ID NO: 231184 - protein, 118 aa, Glycine max
  Coding DNA Sequence Number=SeqID_114406
  Gene Ontology: Mol. function=zinc ion binding; Cellular component =nucleus
  Homolog annotation: Hit_ID=Q7XCX5; Match level="QueryCoverage=83%, HitCoverage=5%, E-value=3e-29, Identity=56%"; Hit description=Plus-3 domain containing protein, expressed
WHICSTCGKGSHYLCYTCTYSLCKGCTKKADFVSIRENKGLCGMCKKTIMLIENCAQGDKAACEVDFDDKSSWEYLFKVYWTYLKEKLSLTFDEILQAKNPYKGTASISFRVQICHEF

SEQ ID NO: 231185 - protein, 105 aa, Glycine max
  Coding DNA Sequence Number=SeqID_114407
MSYHPKYISFVEQVEGQLESLKRTREKFPLLVIKENEHNKEKEKEKTQREYLVDEEGKSLVVRIPWYHHLGIIQHMGALTPEEAQRMKDVVETNIKERVVSRAQA

SEQ ID NO: 231186 - protein, 67 aa, Glycine max
  Coding DNA Sequence Number=SeqID_114408
MAIRVFGDRAMTSASGFVHGRQGAFLAPTYPQSLVLQKKGKQFHDTGGQLELKLTNEMKLPMIKGRR

SEQ ID NO: 231187 - protein, 121 aa, Glycine max
  Coding DNA Sequence Number=SeqID_114409
MDKFDIFVPHPLVITSLLPLECGFKPLVCLLKRHALLSLDFQDRLIKNYSCYTFGEGAIKRRVKQKRFKKKKEKSFLRISRFFHSSLLQGCENKTTIDTSKPYIGAMRGTMHKPQANLGAD

SEQ ID NO: 231188 - protein, 95 aa, Glycine max
  Coding DNA Sequence Number=SeqID_114410
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q1T1H3; Match level="QueryCoverage=89%, HitCoverage=13%, E-value=4e-27, Identity=68%"; Hit description =Cadmium-transporting ATPase; ATPase, E1-E2 type
MTVKALNQARLEANIRVYGDEKHQKRWPSPYSIASGVLLLLSLLKFVFHPLKYLALGAVAVGAYPIILKAIVSIRNLRLDINILMLIAARKYKVD

SEQ ID NO: 231189 - protein, 289 aa, Glycine max
  Coding DNA Sequence Number=SeqID_114411
  Gene Ontology: Mol. function=hydrolase activity, acting on acid anhydrides, catalyzing transmembrane movement of substances; Cellular component=integral to membrane; Biological process=metal ion transport
  Homolog annotation: Hit_ID=Q1T1H3; Match level="QueryCoverage=98%, HitCoverage=46%, E-value=1e-127, Identity=78%"; Hit description =Cadmium-transporting ATPase; ATPase, E1-E2 type
  Pfam annotation: Domain name=E1-E2_ATPase; Domain location=18-249; Score=256.2; E_value=6.6e-74; Accession=PF00122.10; Description=E1 -E2 ATPase
MRKVIGTIVMNDYLEAGTIVFLFSIAEWLESRASHKNTKAGFSVSILIANAVMSSLMNITPQKAVIAETGEVVDADEVKIDTVLAVKAGEVIPIDGVVLDGTCEVDEKTLTGESFPVAKQKDSTVWAGTINLNGYISVKTTALAEDCVVAKMAKLVEEAQNSKTSIQRLIDKFAKFYTPGVVIISALVAVIPLALKQHNEKHWLHFALVVLVSACPCALILSTPVATFCAYSKAATSGLLIKGGDHLETLAKIKVMAFDKTGTITKGEFVVTHFQSLSDDIDLNTLAYW

SEQ ID NO: 231190 - protein, 673 aa, Glycine max
  Coding DNA Sequence Number=SeqID_114412
  Homolog annotation: Hit_ID=O64474; Match level="QueryCoverage=42%, HitCoverage=24%, E-value=1e-112, Identity=70%"; Hit description =Putative cadmium/zinc-transporting ATPase 2
  Pfam annotation: Domain name=Hydrolase; Domain location=12-191; Score= 69.0; E_value=1.6e-17; Accession=PF00702.16; Description=haloacid dehalogenase-like hydrolase
VSSIESKSSHPLAAAIVDYGRSLSVEPEPEKVTEFENFPGEGICGKIEGRVIYIGNKKIATRAGSETVPILQGEIERGKTTGYIYLGATPLGFFSLSDTCRLGVQEAIGQLKSLGIKTAMLTGDSQSAAMQAQEQLGHSLELVHAELLPEDKVKIISEFKKEGPTAMIGDGLNDAPALAAADIGISMGISGSALASETGNIILMSNDIRKIPEAIKLARKARRKVLENIVLSIMTKAAILGLAIGGHPLVWAAVVADVGTCLLVIFNSMLLLRKGHNHGGKCCRSSTKPHNHKNGCGGSHGSSSHHHHHHEHDQQHQHEHHSHKHCCSDKTKKMSQPQKCGGAHGSSSHHHHHQHQHEQHNHDQHDQHEHHNHDQLDQREHHGHSQHDQHHQKCASQTCSSTCPPCSSNSSFGGIVNHCNTMKAHDQCKGSDEFHEHDHCHHGRCDKNHDEVHKHDTEDNHAVAEKRHGSCLGHKNHGTKHCHNQNLDKVTHDSASHSSPCHLNLPCKKESQQFTHNHCHLIHGCENLKDHESKDVLRSNHDIQHEKSGCHSDFEKHETGEISIDIITEYVELASSLEEKGKGSCREDCSDTCGNLAAVCGCESSNEREDIACCRNEDSSKECKESPIMHVCDGLNKREVGGCCKSYMKECCAKLGHSSRPRFVGGLSEIITE

SEQ ID NO: 231191 - protein, 304 aa, Glycine max
  Coding DNA Sequence Number=SeqID_114413
  Gene Ontology: Mol. function=transporter activity; Cellular component= membrane; Biological process=transport
  Homolog annotation: Hit_ID=Q1GQE7; Match level="QueryCoverage=95%, HitCoverage=36%, E-value=1e-52, Identity=41%"; Hit description=TonB -dependent receptor, plug precursor
TYSGRQPGTGITAGYSQYAQCDGASRDFSARTGWALGDYGSLALFAESSNSDATSRTRQRPDAIAFQAAHPELDVPNPVQRWGQPELESRRVGFNLKANASDTLELYAFGLYSHSDGVSDFNWRNPDTTTGAYRTTSIFPGWNLRSLYPVGFSPQYGNTQNDLQLVAGLRGEITPKLRWDLSASYGRNAIDYSLDNSINASLGPDSPTSFDLGRLTQTEKNANADFNYEWDVAALSKPINVAFGGEFRQETYQVRAGDPASYAVGPGAAAGLEANSNGAPGFSASQAGQWSQRSKAAYVDMEVP

SEQ ID NO: 231192 - protein, 404 aa, Glycine max
  Coding DNA Sequence Number=SeqID_114414
  Gene Ontology: Mol. function=nucleoside-triphosphatase activity; Cellular component=intracellular; Biological process=protein metabolic process
  Homolog annotation: Hit_ID=UPI00005F72DE; Match level="QueryCoverage =99%, HitCoverage=49%, E-value=1e-137, Identity=60%"; Hit description= COG0542: ATPases with chaperone activity, ATP-binding subunit
  Pfam annotation: Domain name=AAA; Domain location=139-361; Score= -17.3; E_value=0.0043; Accession=PF00004.19; Description=ATPase family associated with various cellular activities (AAA)
  Pfam annotation: Domain name=AAA_2; Domain location=135-303; Score =299.4; E_value=6.6e-87; Accession=PF07724.4; Description=ATPase family associated with various
  Pfam annotation: Domain name=AAA_5; Domain location=139-308; Score =7.3; E_value=0.0005; Accession=PF07728.4; Description=ATPase family associated with various
  Pfam annotation: Domain name=Torsin; Domain location=87-368; Score= -178.8; E_value=0.03; Accession=PF06309.2; Description=Torsin
  Pfam module annotation: Pfam domain module=AAA::AAA_2::AAA_5::Torsin; Domain location=139-361::135-303::139-308::87-368
AVAAQRATLETERDALQQRWQQERELVDQLIALRARCVTEGEAALRDELDATQRQLQQVQGEAPLLFAAVDASVVAAVVADWTGIPLGRMVKNEIDAVLNLADTLNQRVIGQRHGLDLIAKRVRTSRARLDNPNKPVGVFMLCGPSGVGKTETALALAESLYGGEQNIITINMSEFQEAHTVSTLKGAPPGYVGYGEGGVLTEAVRRRPYSVVLLDEIEKAHPDVHELFFQVFDKGWMEDGEGRHIDFRNTIIILTSNVGTQLISAMCADPELMPDPEALSTALRKPLLEVFPPALLGRLLVVPYYPLSDAMLAEIVRLQLGRIVQRLADNHGISAQIDDSVISQIVQRCTEVESGGRMVDAILTNTLLPQMSQMLLSAHARDERYRRVQVRCEQGEFVCQFDV

SEQ ID NO: 231193 - protein, 133 aa, Glycine max
  Coding DNA Sequence Number=SeqID_114415
  Homolog annotation: Hit_ID=Q9LTU4; Match level="QueryCoverage=59%, HitCoverage=5%, E-value=2e-16, Identity=47%"; Hit description =Helicase-like protein
MDIGPTFYTVDTLSGKRRKRNRFTMREWFAYRLQCRPNEGQTLLHSKKLFRQFVAEGYTMIESKRLSYVRNNQKKLRVDKFCSLQQSSDAGNTKDMYTVEFQKRGLPHVHLLLFLHVNNKYPSPNDIDHIISA

SEQ ID NO: 231194 - protein, 99 aa, Glycine max
  Coding DNA Sequence Number=SeqID_114416
  Gene Ontology: Mol. function=structural constituent of ribosome; Cellular component=ribonucleoprotein complex; Biological process =translation
  Homolog annotation: Hit_ID=P61841; Match level="QueryCoverage=85%, HitCoverage=55%, E-value=6e-42, Identity=98%"; Hit description =Chloroplast 30S ribosomal protein S7
  Pfam annotation: Domain name=Ribosomal_S7; Domain location=1-93; Score=64.3; E_value=3.9e-16; Accession=PF00177.11; Description =Ribosomal protein S7pS5e
QTLEDPTSSNTWSTPDIAVKARRVGGSTHQVPVEIGSTQGKALAIRWLLGASRKRPGRNMAFKLSSELVDAAKGSGDAIRKKEETHRMAEANRAFAHFR

SEQ ID NO: 231195 - protein, 74 aa, Glycine max
  Coding DNA Sequence Number=SeqID_114417
MMPPATKVYRICPGVTDVEGFPGGHHDTSVLRDFENYIALRVKNAELKLSFHGRKMTKFDRPALEIEGIVALVD

SEQ ID NO: 231196 - protein, 142 aa, Glycine max
  Coding DNA Sequence Number=SeqID_114418
  Homolog annotation: Hit_ID=Q9LVD1; Match level="QueryCoverage=82%, HitCoverage=16%, E-value=2e-15, Identity=39%"; Hit description =Arabidopsis thaliana genomic DNA, chromosome 5, P1 clone:MJB24
  Pfam annotation: Domain name=DUF266; Domain location=102-142; Score= -21.8; E_value=0.001; Accession=PF03267.4; Description=Arabidopsis protein of unknown function, DUF266
MVSFSFESCSSCGVHLPGICSPPFLQGHEGKFSVYVHASKTKPVHVSRYFVNRDIRSDQIHIIDILFYPEQKGEIVAPSPGLMRCRFCNAIVIASLIACCFPVVCGFLVIWGKISMVDAERRLLANALQDTDNQQFVLLSDR

SEQ ID NO: 231197 - protein, 96 aa, Glycine max
  Coding DNA Sequence Number=SeqID_114419
MKEEADLTTSILRRWSSFRILQIVWRSSISLPKESGSHDWSKGAFGEIDQKIDSTMKEMDIINGEFSQGMVDKAIERNKLTKEFWNLVRLKRSFIL

SEQ ID NO: 231198 - protein, 117 aa, Glycine max
  Coding DNA Sequence Number=SeqID_114420
MYELEACLNDNKGLRHEIKEDLLPSSIGGADNISGIRSNGQIGSKNANFRVLFVAIGLQWNPGGNTLAVALKGFLSQSVSESSSDSEAISAQVFLANFGILVRPISSKAKRVCIDQA

SEQ ID NO: 231199 - protein, 224 aa, Glycine max
  Coding DNA Sequence Number=SeqID_114421
  Gene Ontology: Mol. function=nucleic acid binding; Cellular component= nucleus; Biological process=DNA integration
MKQSPSQWYKRLNEFIVSHGYIRSPYDSCVYHSKVKDDSHIYLLLYGDDMLKASQNLLEIQKVKSLLNSEFEMKDLGVVEKILGTEIKRDKVQKKFFMHKKEFIQKVLTHFGMASAKQVCSPLAKSICLFELNTTQSESKKEYMSHVPNASFATSLMYDMVCTRSNLAQIVNVVSRHMGILGRNIGKFSMAAEWRRKKDDWRCHFKEKMSQEQAHHYRKPWIRT

SEQ ID NO: 231200 - protein, 150 aa, Glycine max
  Coding DNA Sequence Number=SeqID_114422
  Gene Ontology: Cellular component=integral to membrane
  Homolog annotation: Hit_ID=Q1SE17; Match level="QueryCoverage=70%, HitCoverage=100%, E-value=3e-45, Identity=86%"; Hit description =Amino acid/polyamine transporter II
MSNNAKVLSYKKLLKAYNLENQAKSTKLLRRKPIFIRTSGNESGGVDTIKPCQVLSIFHLHQKRVGTFYPGYWSLSSLFWSGDVIDWIITHNACYFDTTLCLFPKNLARQSDTNTGSTLHYNYHSRCCMFYFWIILRPCRDCEEFEGMKF

SEQ ID NO: 231201 - protein, 157 aa, Glycine max
  Coding DNA Sequence Number=SeqID_114423
MGLVMFSAREQYHHIELVHKKSKRVYLKPKRDYKKGSEVVHIMASPNKGYFTFSMVECPHIIGQVKMLIVGVEVLIDGNLMLKKKRDKKKEILTSPQKLGITDLEPTNIFLHLADRLVVYPRGAIEDVVVKVTKFIFAIDFVILYMEDDEDVPIILG

SEQ ID NO: 231202 - protein, 108 aa, Glycine max
  Coding DNA Sequence Number=SeqID_114424
  Gene Ontology: Mol. function=oxidoreductase activity; Cellular component=chloroplast; Biological process=electron transport
  Homolog annotation: Hit_ID=Q2PHG3; Match level="QueryCoverage=88%, HitCoverage=14%, E-value=7e-30, Identity=59%"; Hit description =Zeaxantin epoxidase 1
VHSKLFGRQEANYSSFTCYRGLTRYVPPYIDTVGYRVFLGLNQYFVASDVGHGKMQWYAFHGEPPSSDPFPEGKKKRLLDLFGNWCDEVIALISETTKHMNTEYLRKP

SEQ ID NO: 231203 - protein, 100 aa, Glycine max
  Coding DNA Sequence Number=SeqID_114425
  Subcellular localization annotation: CTP_CleavageSite=36; ConfidenceScore=5.28e-01
MHALLGSFNSGNWSDSKVFGSTGLSCCVITRDWVLVAFSLTRRICGRGLIRTRLGYCRNLPFGGRARRGSQVRLPKEENARSRHHRLFVENVRKTEGNRS

SEQ ID NO: 231204 - protein, 127 aa, Glycine max
  Coding DNA Sequence Number=SeqID_114426
MQQGQTDILIARFLDPSYGVKTGSSRCGVSTENNDGLWWLMVVVGDGESAWDVRNGFGRKKGEEMMFFLRYTKAKAETPTFEKIQRLTKAGQCFYRESSCSFLKKLHEEASSRSFLVASLRFLKRLL

SEQ ID NO: 231205 - protein, 123 aa, Glycine max; identical to SEQ ID NO: 193936
  Coding DNA Sequence Number=SeqID_114427

SEQ ID NO: 231206 - protein, 131 aa, Glycine max
  Coding DNA Sequence Number=SeqID_114428
DGDLDLNASPQALDKLLGHVLAFKVRIQSKFKNAVVLRYSKDLDLINVVLKMLPYSETCSKIDPSNVDCNDATQVERQSLSVTADHDPVAGLPLTPKKRMSYDEADDELGSSQISSAQLSSNKLTRHSHKS

SEQ ID NO: 231207 - protein, 56 aa, Glycine max
  Coding DNA Sequence Number=SeqID_114429
MAAQRDNYRLAALCKRHTPVWRNMGRLAAGEEPAKPKVSRMDLRLAKGRLCLVALN

SEQ ID NO: 231208 - protein, 366 aa, Glycine max
  Coding DNA Sequence Number=SeqID_114430
MSSRKRNSVGSRPTAQYDTWRFHSFDAWTRYTDNVLRRHILAERKVEIYHTKLDEFKGKLKRRNFHKPLTNLADSSIDLALVKEFYANLYSPEGPSPKQVRIRRHLIRIDADNLNAFLETPVVLAEGEFLPAYSRYCRMPTDNREIEAALCIPSQGFILNAEGHPGKILRKDLTTLAQVWSVLSYSNLAPTSHTSDLTVDQARLIFGLVTQLDMNVEALISGQITSMAQSNSSRLRFPALITALCRTRGVASDSLVFEHLNPPPPHSNDEDPAAQVPHQPADESSESSILEPLIRKRRVVITQEAATTPEKSLEATPEPPAPIEDTTSPQQAADPSTPEDQTTPVQSPNASLVSTPVLHLTDKEEV

SEQ ID NO: 231209 - protein, 441 aa, Glycine max
  Coding DNA Sequence Number=SeqID_114431
  Subcellular localization annotation: CTP_CleavageSite=45; ConfidenceScore=5.01e-01
MASLMTRRNQYGHLLPLSKARCLSTETTLVSPFRNPETIKSDDTQSSPKTRNNQHGCLHPLSKTRHLSTETTLVFTFRHPETIKYNDKQQPTWSSSPFVEDVTSIDGDYFSLPSSSRDGKSDDAHRPICQSTHFVEDSMSINRDYISLPSSSKDGKYDDAHRPIWSSAPFIKDWMSIDQRQSSPMTRSDQHGHLHPLSKMRCLSIETTLVSPFCHPTTIMSDDTQQPTWSSAPCVEDVSSIDRDYFGLSFSSSIDNQARHLSIETTFCSTFHHPETIKSNDMQQPKWSSPPFVEDPTSIDRDYFSLPSSSRDGKSDDTKRPIWSSATFVEDSIDQHGRLHPLSKTRRLLTETTLVSTFRHPETIKFNGTQQPTWLSTPFVEDATSIDQDYFSLPSPYRDSKSDDMQQPTWSSAPFVEDSMSIDRDYFSLPSSSRDSKSDDA

SEQ ID NO: 231210 - protein, 53 aa, Glycine max
  Coding DNA Sequence Number=SeqID_114432
MASKDSSWRSSGVSGGGGGAWGHWGGCYYHHPHKRMKSMQLAYVLWQDHKKMR

SEQ ID NO: 231211 - protein, 678 aa, Glycine max
  Coding DNA Sequence Number=SeqID_114433
  Homolog annotation: Hit_ID=O80935; Match level="QueryCoverage=99%, HitCoverage=74%, E-value=1e-157, Identity=46%"; Hit description =Putative WD-40 repeat protein
  Pfam annotation: Domain name=WD40; Domain location=383-421; Score =38.7; E_value=2e-08; Accession=PF00400.22; Description=WD domain, G -beta repeat
  Pfam annotation: Domain name=WD40; Domain location=487-524; Score =41.5; E_value=2.8e-09; Accession=PF00400.22; Description=WD domain, G-beta repeat
  Pfam annotation: Domain name=WD40; Domain location=535-574; Score =20.8; E_value=0.0048; Accession=PF00400.22; Description=WD domain, G- beta repeat
  Pfam annotation: Domain name=WD40; Domain location=578-615; Score =3.0; E_value=16; Accession=PF00400.22; Description=WD domain, G-beta repeat
  Pfam module annotation: Pfam domain module=WD40::WD40::WD40::WD40; Domain location=383-421::487-524::535-574::578-615
MERRKTLTMNWDGLGDVDDDDTFFESYNRLSTAAPLDLPSSSDDDDDDDFDDPRLSFVSAASSLQSRKNRAPPPTDTASDYGIWMAAPVSITERRKRLLHGMGLDDDHKEFSKATNVVSKKIDSAPSSNSSEKKSILLTTSLPVTIPPSDSSVSEHKKTEQSSVHLVLVRSRSEGDVDLFSMERSRKENFIGKQSKQRLTRTATEVAFPRGGNGTGGRAVVRDSDDAATSKRSVAKLENSGVGAFFLIRNLDTGKEFIVNEYGKNGAWNRLSDLQTGKQLTMEEFERTVGKSRVVNQLMRRAHTGSNHNDGLSRKLSSSSYISRSLRMSKRRGAALLKNIKGVASGFIGEREPITMPVPVMEAKNQWVRVRQTGKAHKELSALHLCQEFQAHEGCVWTIRFSLDGRYLASAGEDRVIHVWEVQECEVMSLRPDEGSLTPLHPSLLASSSETPSLSSEKKKKGKFGSKRGTAIPEYVHVPETVFSLSDKPHCSFRGHLDDVLDLSWSKSQLLLSSSMDKTVRLWDLETKTCLNMFAHNDYGEGEMLDSVTCIQFNPIHDDYFISGSLDAKVRIWNIPERQVVNWTDIHEMITAVSYTPDGQGALVGSLKGSCRTYRTEDCILTQTGTIEIRHKKKSQLRKVTGFQFAPGKPSEVLVTSADSRIRILESSEVVQKYKGAA

SEQ ID NO: 231212 - protein, 136 aa, Glycine max
  Coding DNA Sequence Number=SeqID_114434
MVVQAPTVFIPEGASTNRPPDFDGKDFYYLKDRMIFEYDKVKECETTQEIWNTLKTTHGGTNLVHKQELMDETQSPKGKIIALKASQKIKTRNQSKALNLEVMSDVENNDDEPSKEDEEELAFLTKRVKRFLRRRK

SEQ ID NO: 231213 - protein, 270 aa, Glycine max
  Coding DNA Sequence Number=SeqID_114435
  Homolog annotation: Hit_ID=O80935; Match level="QueryCoverage=95%, HitCoverage=24%, E-value=8e-34, Identity=37%"; Hit description =Putative WD-40 repeat protein
FRNANSSIAASFSPDGRYIISASEDSQVYIWKHEEHRSGGSGKGRNVLVTRSHEHFHCKDVSVAIPWPCTIRGDPPLVPTHHSKRHSKRSQAPSNCIEDTSSPSATNSKRTLPPLPNKKSNNNHATEGASNSPREDPAAISHTESGLNDSFVNSKRMMPQSPMKANCHTAGDEDIEAISRTDSGFSDSFSSGSSSVRCGDSPSSSWSSSYSLLDSSHVSSTVLPSAWGLVIVTAGFGGEIKCYQNFGLPKRMGRQPHLFGGHNSSSHGNT

SEQ ID NO: 231214 - protein, 215 aa, Glycine max
  Coding DNA Sequence Number=SeqID_114436
MKSTRHIPIAPRTKKEKEPAKGGPSSRGKRIAHSPLPLTALKATPWLSEEHYESSYKFCYAKKEMIQLKYIILAWLISEGFAFPKLIEYHELKKLVEMKDTYTNLVSMCLVERATNYDDTREGVMANQLGLKEARFSFNKVEKYKSVMNNPSTYVVVVTKAKGNECFGTEPLILKHKFLPYVVAWIITSRGSNRAQLNEEDLLIIILMQGKMNIN

SEQ ID NO: 231215 - protein, 168 aa, Glycine max
  Coding DNA Sequence Number=SeqID_114437
  Gene Ontology: Mol. function=nucleic acid binding; Cellular component= membrane; Biological process=DNA integration
MVEPSTIEEALVDERWVFKNKLDEHGFITKNNARLEAKCYKQQEGIDFGKTYAPITRLEVVRLLLAFACIIDIKLYQMDVKNAFPNGYVDDIIFGSTNKPFYEDFVHKMLGEFEMSIMGELNYFIGLQVKQMNHATFLHQTKYCKELLKKFDIDKSKEVATHGYKLLP

SEQ ID NO: 231216 - protein, 52 aa, Glycine max
  Coding DNA Sequence Number=SeqID_114438
MGLKKCCGWECDRHMAPLGNCEVARLWSLWVKVVAIANEVSLRAGRSLRLKE

SEQ ID NO: 231217 - protein, 386 aa, Glycine max
  Coding DNA Sequence Number=SeqID_114439
  Gene Ontology: Mol. function=nucleic acid binding; Biological process= DNA integration
  Homolog annotation: Hit_ID=Q1SG63; Match level="QueryCoverage=61%, HitCoverage=15%, E-value=6e-16, Identity=27%"; Hit description =Integrase, catalytic region; Zinc finger, CCHC-type
  Pfam annotation: Domain name=zf-CCHC; Domain location=77-94; Score =25.8; E_value=5.5e-05; Accession=PF00098.13; Description=Zinc knuckle
MAYDELFGKLREYEMDLTRMDEEEAIDKKNKGLALKTSIPSSGKSEDDNAEGLDAKNLNLLPKRNLKKGKPYSSNGFTCFKCGKTSHIKVDCPIYQKKQEGKKKNKGSFKKKKKAYVAWDDNESTTSIDNNEEKEVNLCLMATNEVESELLHAFNEIHEEAQNLSIANNLLKGKLKWHVDKLVEIQKEFLKERAKNDILEKEKNKSSCNCTNTTNVTSPCEGCKVLEVKVEYLLKTLSKFTMGRDNLEALLTQQKCAIEKARLATDKQLCYLDSSFSEHMTRDKSKFMSLKTKEGGFVTYGDNNKARILGVGPLGPSSFFLQKAVASGGSNLARLGELGGKLLPYFAINRGRSEEERGSAFLALLILSKLLRKIVSVKKIQAEALP

SEQ ID NO: 231218 - protein, 100 aa, Glycine max
  Coding DNA Sequence Number=SeqID_114440
  Gene Ontology: Mol. function=oxidoreductase activity; Cellular component=intracellular; Biological process=lignin catabolic process
  Homolog annotation: Hit_ID=Q9FJD5; Match level="QueryCoverage=62%, HitCoverage=15%, E-value=3e-16, Identity=56%"; Hit description =Laccase
MVTNGTKLEVLPFNTSVELVMQDTNILGAESHPLNLHGFNFSMGTQWEVPSCGWVAIRFLADNLAIGKGALDSTENVIIANGECLNDYLKIRDELLTLGD

SEQ ID NO: 231219 - protein, 158 aa, Glycine max
  Coding DNA Sequence Number=SeqID_114441
  Gene Ontology: Mol. function=RNA-directed DNA polymerase activity; Biological process=RNA-dependent DNA replication
  Homolog annotation: Hit_ID=Q2HTR6; Match level="QueryCoverage=36%, HitCoverage=13%, E-value=4e-11, Identity=51%"; Hit description=RNA -directed DNA polymerase
MINEIDIQDEEEVSEEVLLNRKELLKEFWNVATKLSLGCTKKQDFGAYFMRTSQRLGFCKVSIKWIKGCVELAPVSILVNGSPTDEFGIVMSAPFVYSGIPIGANPLKEASWEPIIQKVTKKLSNWKHRHLSFGGRICLLKSMLLALLRQGFKFGCYL

SEQ ID NO: 231220 - protein, 237 aa, Glycine max
  Coding DNA Sequence Number=SeqID_114442
  Gene Ontology: Mol. function=phospholipase A2 activity; Biological process=lipid metabolic process
  Homolog annotation: Hit_ID=O23179; Match level="QueryCoverage=95%, HitCoverage=59%, E-value=4e-31, Identity=35%"; Hit description =Patatin-like protein
LKTETYLNAKLSDICIGTSAAPTYLPPHQFQNDGVQFDLVDGAMSANNPALVAVSEVIQHNEHKEILLLSLGTGTIKAEEKLSGFFDDLLDDLYDDLCGLKWLASSRNVFYEALYSTNMIHYYLATVFPGVLPADNYLRIEEYNLDPSMKEMDNADKENMDKLEKVGKSLLLQKALRMNVNTFVPVELDQTNAEALDRLSEKLYAERQLRLKRKSMEKGGSRIIESVKVPSGRMHAT

SEQ ID NO: 231221 - protein, 218 aa, Glycine max
  Coding DNA Sequence Number=SeqID_114443
PAQLAQASQVASSRSNSLLEEYSGGPKKAEVEVVDVDVDADVQYLNRSTTFKRFSSNSNRNAEVEADGVDTDVQPLNRGFGEEEGILQVLSSTTSATATNNVLEISVHEAKFMGHASLPLVSQPVEKESLLVESDDDDDNDDTETEDQDVEGGRTVDQNNDRGKGPPVIGGESSKTDGDEGPDMDKKANEFIAKFIKQIRLQRIESIKRSTRSARNSS

SEQ ID NO: 231222 - protein, 77 aa, Glycine max
  Coding DNA Sequence Number=SeqID_114444
MENAKHMPTPMSTACYLDKDETGQSIDIEKYRVKSKIVFALSAAEAKYISAGSCCAQIVWMKQQLSDYGLMLDHIPI

SEQ ID NO: 231223 - protein, 85 aa, Glycine max
  Coding DNA Sequence Number=SeqID_114445
MDPITILVALKRSYNCEIAQFIVPNSMLDKWYQSFILVQSLEASRKRWPQQIPYFQKGILSIDLQSLMERVTTTGKPECKFLSRQ

SEQ ID NO: 231224 - protein, 156 aa, Glycine max
  Coding DNA Sequence Number=SeqID_114446
MDRSATCKVILMGMISNSPNLLRMESDIRLILAPKSMRAFPIVTSPIEQGIVTLPRSLCFGGRICRSKLHDESRLIQRSFDDNKGDDKKLKDQEHFMITKMMISRIKFQDSSSKNQELREDLIKISFLKVITLLMVLLTRHEESIKARLCFAFQKS

SEQ ID NO: 231225 - protein, 167 aa, Glycine max
  Coding DNA Sequence Number=SeqID_114447
  Gene Ontology: Cellular component=mitochondrion
  Homolog annotation: Hit_ID=Q41658; Match level="QueryCoverage=58%, HitCoverage=66%, E-value=2e-30, Identity=68%"; Hit description=Vicia faba NADH ubiquinone oxidoreductase subunit 5
MALACSIPIAFCARADDAVNQPLPGEQAMPPALPVMQEAANRALPYPYQNNEIIGGDSVESIQRRLLGRFPSPSAHEIQMARIEAEDLFEVKVDICQVMAGLHPSGDWMGRGARALDNLRTATGEESLSKLLRMREDLQTAGLQSATFRQLADRVAFRADGDQHSAT

SEQ ID NO: 231226 - protein, 234 aa, Glycine max
  Coding DNA Sequence Number=SeqID_114448
  Pfam annotation: Domain name=Transposase_23; Domain location=149-219; Score=10.0; E_value=9.1e-05; Accession=PF03017.5; Description =TNP1ENSPM transposase
MAEKTKKKLEEATQSGSTEAVIDPSSPIRRHMKWKMARTKKTGQMMSEAAKEIVEKIASQGSFVPHGHQDVLTATIGRPEHPDRVHAGPARGVNHRKSDSVADVILQPDAIPVSVTDAITWTCTKVGPSAACVSTKESCVYPSGNDPDIGDSNKCRLYIEENPPRLVALGRVYEGSTIVHNIPLLHDQVKVGVEEVKDADAPVPVPTDEVNLVGQTLNTFLAWPTHLVKRLSEQ

SEQ ID NO: 231227 - protein, 379 aa, Glycine max
  Coding DNA Sequence Number=SeqID_114449
  Gene Ontology: Mol. function=hydrolase activity, acting on glycosyl bonds; Cellular component=cell outer membrane; Biological process =carbohydrate metabolic process
  Homolog annotation: Hit_ID=UPI00005FA9DA; Match level="QueryCoverage =99%, HitCoverage=61%, E-value=0.0, Identity=78%"; Hit description =COG0366: Glycosidases
  Pfam annotation: Domain name=Alpha-amylase; Domain location=2-348; Score=286.1; E_value=6.8e-83; Accession=PF00128.14; Description =Alpha amylase, catalytic domain
LYGGDLDGIGAKLPYLQQLGLTALYLNPIFTAPSVHKYDTEDYYQVDPHFGGNAALQRLRVSTHKVGMKLVLDGVFNHTGDSHPWFDRHRQGENGACHHPDSPYRGWFNFYPDGRALDWKGNASLPKLNFAEPQVAEAIYRGEGSVVRHWLRPPYSIDGWRLDVVHMLGENGGATGNLYHLAGIYQAVKQENPQAYVLGEHFGDARRWLHAGVEDAAMNYMGFALPVRAFLAGLDVAYHPVRLDAAGCAQWMDGYRAGLPHGRQLIQFNQLDSHDTARFLTLLQGNPARMQMAAVWLLSWIGVPCLYYGDEIGLDGGNDPFCRKPFPWDVGDWDRPLLALFQRMAALRKQSVALRRGGCQVLYASGETLVFVRLYQQEQ

SEQ ID NO: 231228 - protein, 97 aa, Glycine max
  Coding DNA Sequence Number=SeqID_114450
  Gene Ontology: Mol. function=RNA-directed DNA polymerase activity; Biological process=RNA-dependent DNA replication
  Homolog annotation: Hit_ID=Q1SYR3; Match level="QueryCoverage=92%, HitCoverage=3%, E-value=2e-35, Identity=74%"; Hit description=RNase H, putative
MALLKNYQDIFAWSYQDMPGLSSDIVQHRLPLNPECSPVKQKLRRMKPETSLKIKEEVKKQFDAGFLAVTRYPEWVANIVLVPKKDGKVRMCVVIET

SEQ ID NO: 231229 - protein, 77 aa, Glycine max
  Coding DNA Sequence Number=SeqID_114451
MEDEEDEDVGLPPELERIIAQEDREMKPHKEEKELIDLGADSEKKEVKVGTGYLLSYPNFVRGPLFGGMQPSLDRRE

SEQ ID NO: 231230 - protein, 374 aa, Glycine max
  Coding DNA Sequence Number=SeqID_114452
  Gene Ontology: Mol. function=fumarate hydratase activity; Cellular component=tricarboxylic acid cycle enzyme complex; Biological process=fumarate metabolic process
  Homolog annotation: Hit_ID=Q7WG65; Match level="QueryCoverage=96%, HitCoverage=78%, E-value=1e-171, Identity=85%"; Hit description =Fumarate hydratase class II
VIADVRVQGGDQHQRAVDQFGDALAVWLDAGGAVMVAAGHAVGQQAHRMQEVVDHQGLVDVQLEVAAGAADVDGDVVAHDLGGQHGDGFALGRVDLARHDGAAGFVFGDVDFTQAGPWAAGQPAHVVGYLHEAGGERLEGAVGEQQGFVRGQGLENVGRGEEGGFGGVGQFGRDLGGKLRMGVQAGADGGAADGQLVQARQRGADLLFVQVELGDVAGQFLAPASGGVASCKVGAADLDDIVELSALGGEGGAQGLQGRQQVVLDLHGGSHVHGGGEGIVGRLAAVDVVVGVHLRSSPRTPPSSSEARLASTSFMFMLLCVPEPVCHTDSGNSLGHLPAMTSSAARMKPSAILGSSSPRSALTLRPHASGAPSR

SEQ ID NO: 231231 - protein, 385 aa, Glycine max
  Coding DNA Sequence Number=SeqID_114453
  Gene Ontology: Mol. function=DNA-directed DNA polymerase activity; Biological process=response to DNA damage stimulus
  Homolog annotation: Hit_ID=P22494; Match level="QueryCoverage=71%, HitCoverage=71%, E-value=2e-92, Identity=68%"; Hit description =Protein umuC
  Pfam annotation: Domain name=IMS; Domain location=2-236; Score=112.0; E_value=1.7e-30; Accession=PF00817.11; Description=impBmucBsamB family
MQRNHPLEDFGRAVRARVKQETHLTVGVGIAQTKTLAKLANHAAKKWTKTGGVLDLSNIDRQRKLMALVPVEDVWGVGRRISKKLNAMGIMTAKDLSEQSTYTIRKHFNVVLERTVRELRGEPCLQLEEFAPTKQQIVCSRSFGSRITKYDDMREAICTFAARAAGKLRGERQYCTQIAVFVRTSPHAVGEVFYGNQSTGKVLTPTNDTRDITRVAIEALDRIWLEGHRYMKAGQQRGADARDGWSQPEREGESMVRRAGYTQHMGDEARNAFAGIYHKSFRPAGGPVLITSRPSETLHVPTCDGVAIIDRSVRPKPGDTILFEAYGICHIGRLGPNYIICEDGDTYEGEALENISVIGVQMWNVEGMCGDAVHRNRAASASASS

SEQ ID NO: 231232 - protein, 196 aa, Glycine max
  Coding DNA Sequence Number=SeqID_114454
  Gene Ontology: Mol. function=protein dimerization activity
  Homolog annotation: Hit_ID=Q1RTL4; Match level="QueryCoverage=88%, HitCoverage=37%, E-value=4e-11, Identity=29%"; Hit description=Zinc finger, TTF-type
MSNRKYESGYEKLKKKQKVEKLIESQRGALDKFVIIHKNDAEASSIGENVIEQPLIDHTDNEENVIEQPPIDNTDNGVEQPPRDDTDNGINVIEQPPINNTDNTNSHNFNQELEDNILEIGVEGNVEHNNTYSEVPTNIYDLGLWKNIDGKFRDLMIEKGPLRHDNFQYPKDENNRYFYSSCYQRTLSNGEKHDRR

SEQ ID NO: 231233 - protein, 133 aa, Glycine max
  Coding DNA Sequence Number=SeqID_114455
  Homolog annotation: Hit_ID=Q8ZMV1; Match level="QueryCoverage=56%, HitCoverage=76%, E-value=4e-26, Identity=71%"; Hit description=Fels -2 prophage protein
  Pfam annotation: Domain name=Phage_E; Domain location=8-90; Score =133.6; E_value=5.3e-37; Accession=PF06158.2; Description=Phage tail protein E
MTDKTTGKAIELDTPLLRGKTEITHITVRKPQSGAMRGTRLQALMDMDVNAMMVVLPRVTTPALTAQEISEMDPADLLSLSVEVLSRRPDGRGSGSGHRYRFSLAAAGHVRGVADGRAGVAAQSNSAKRSRRR

SEQ ID NO: 231234 - protein, 278 aa, Glycine max
  Coding DNA Sequence Number=SeqID_114456
  Homolog annotation: Hit_ID=Q8ZMV0; Match level="QueryCoverage=98%, HitCoverage=70%, E-value=1e-138, Identity=88%"; Hit description=Fels- 2 prophage protein
  Pfam annotation: Domain name=Phage_sheath_1; Domain location=1-271; Score=266.9; E_value=4e-77; Accession=PF04984.4; Description=Phage tail sheath protein
MKALLAAQSVCGVKPRILGAPGHDTQAVATELLSVAQSLRGFAYLSAYGCKSVEEAIAYRANFSQREGMLIWPDFISFDTVLKQDATAYATARALGLRAKIDEQTGWHKSLSNVGVNGVTGISKDVFWDLQEPATDAGLLNQNDVTTLIRKDGYRFWGSRCLSDDPLFAFECYTRTAQVLMDTMAEAQMWSVDGPLNPSLARDIIEGIRAKLRSLVTQGYLIGADCWLDASVNDKETLKAGKLLIDYDYTPVPPLENLLLRQRITDQYLVDFSSRVGV

SEQ ID NO: 231235 - protein, 65 aa, Glycine max
  Coding DNA Sequence Number=SeqID_114457
MVSLVCWKLTLLNLAHADQSFEYFSFIKTGDVVDAIAEELLQAKSSSQKTSHAEKHLKSSGGKVM

SEQ ID NO: 231236 - protein, 204 aa, Glycine max
  Coding DNA Sequence Number=SeqID_114458
  Gene Ontology: Mol. function=ribonuclease H activity; Biological process=RNA-dependent DNA replication
  Homolog annotation: Hit_ID=Q1RYI2; Match level="QueryCoverage=94%, HitCoverage=30%, E-value=2e-19, Identity=30%"; Hit description =Ribonuclease H
MNNISWDTICNPKDQGGLGIRNIHVLNQAYFIKLGWALINDLNVLWVHILYSKYKCGVASILTIAKGHHSSYIWNVVVNNWDHVLSNLAWSINNGHITRFLMDDKISGLGPFNMLLEDNIPILKKHYPVLAYVKNDSWRRDILNYLLPSSARAHLSSIPPPRERMDDIPIWKAFKDGAFFIKEAYNYLTATPPPMGSRSTFSSI

SEQ ID NO: 231237 - protein, 96 aa, Glycine max
  Coding DNA Sequence Number=SeqID_114459
MEPSHETLSQGVSTLTRPPDPRGISCMTIDEAFQPNDVSFLDPSKANNPIRDMGFPGLSFTWSRSNLKECLGRVLANPSWQKAFPVASIHLEAWLL

SEQ ID NO: 231238 - protein, 156 aa, Glycine max
  Coding DNA Sequence Number=SeqID_114460
  Homolog annotation: Hit_ID=Q1SBV5; Match level="QueryCoverage=69%, HitCoverage=20%, E-value=5e-08, Identity=33%"; Hit description=RNA -directed DNA polymerase homolog F21E10.5-Arabidopsis thaliana
MAHALFIHKEFHRSPFLTIHFSRQDANIVWHKPPPSSYKVNTDGSYSNTLNTTPCGRLVRDSNGRVLKSFHVNLGNCNALMAEHRALSMLILSPHYLRWLICDIKATFHDHGWKTTISHIYREANRSADFLASIGLNDSYSPGFCSPSFPFAQAHH

SEQ ID NO: 231239 - protein, 279 aa, Glycine max
  Coding DNA Sequence Number=SeqID_114461
  Pfam annotation: Domain name=zf-CCHC; Domain location=91-108; Score =15.1; E_value=0.0032; Accession=PF00098.13; Description=Zinc knuckle
MKDSLSDLAIDPKAIMEVITDDLCSYVVDGLSSAQIHSKIVNYYYAGAEDEDMTYEFPFNPCPTILVPVESYDRWWFWVEEFNLEYQGLHLICFRCGKYGHNVTICHMHVINPKDATRVPNDQNGRPTKEGDDRNMFVVCGVPNSQGHQNPNMERAFVPWMIAKKPKQHPPGPKTSKPTPNGQARDSKNTNVDAQPSSSTTSSRYEALEVEPNTISLDAGVNNTQIEIAKPPLPKTPKPSNTEPSYSGKFKTNYKKQNHSKPYSKPHTPSIPSFGKNQT

SEQ ID NO: 231240 - protein, 82 aa, Glycine max
  Coding DNA Sequence Number=SeqID_114462
  Subcellular localization annotation: CTP_CleavageSite=41; ConfidenceScore=5.05e-01
MEAPSVRRIAVVVFVTVSVFSIALVAVLTDFGGGGGGTLTDTMAAVSLSRGLDEVTNTFLPNSHRKLLTSGNSFFLFLFFHY

SEQ ID NO: 231241 - protein, 86 aa, Glycine max
  Coding DNA Sequence Number=SeqID_114463
MGMIPDSNNPEEKPYLKPKRNITRPGHLKDLRLNLGATIRLLSSYPERSQIQILKTVSLKKNFLHEYDIAYAIAVWCKNIDHYETY

SEQ ID NO: 231242 - protein, 106 aa, Glycine max
  Coding DNA Sequence Number=SeqID_114464
  Gene Ontology: Mol. function=metal ion binding; Cellular component =intracellular; Biological process=signal transduction
  Homolog annotation: Hit_ID=Q86L99; Match level="QueryCoverage=99%, HitCoverage=26%, E-value=4e-15, Identity=37%"; Hit description =Similar to Arabidopsis thaliana (Mouse-ear cress). F25I16.5 protein
  Pfam annotation: Domain name=Kelch_1; Domain location=16-67; Score =21.9; E_value=0.0022; Accession=PF01344.15; Description=Kelch motif
  Pfam annotation: Domain name=Kelch_2; Domain location=16-67; Score =21.3; E_value=0.0034; Accession=PF07646.5; Description=Kelch motif
  Pfam annotation: Domain name=Kelch_2; Domain location=72-105; Score =10.0; E_value=1.8; Accession=PF07646.5; Description=Kelch motif
  Pfam module annotation: Pfam domain module=Kelch_1::Kelch_2::Kelch_2; Domain location=16-67::16-67::72-105
SNTWVFPTVRGEAPDAREGHDAALVGKRLFVFGGCGKSADNINEVYYNDLYILNTELFVWNRATTSGTPPSPRDGHTCSSWRNKIIVIGGEDENDSYLSDVHILDT

SEQ ID NO: 231243 - protein, 122 aa, Glycine max
  Coding DNA Sequence Number=SeqID_114465
MVHDIFVKVKLEVTRTSTVLNVFGSRRSSDKWVYGPNMVGSWYLTHETKNRKTQGSCMSKHVNKSLENHLFLLAHSGAQCPMCASKKVIWTFWLPMTKVETNIQRVCEDMMQTRKSATRGCT

SEQ ID NO: 231244 - protein, 155 aa, Glycine max
  Coding DNA Sequence Number=SeqID_114466
  Subcellular localization annotation: CTP_CleavageSite=60; ConfidenceScore=5.73e-01
MEASLHNQVRFRNIPKSKPRRFRNVSVTFSVKNFAKVSTVLRRSSFVLHRSSIFNGLPSLGADVWGANTFPVRKYNSRTFHLKVRRSRLFRFFRRFPQINVGGDSAHIPFVEHASRESRVALPPKGRLRQHVYELIDLSESRIHSGFWIHIGFRN

SEQ ID NO: 231245 - protein, 374 aa, Glycine max
  Coding DNA Sequence Number=SeqID_114467
  Gene Ontology: Mol. function=binding; Biological process=protein transport
  Homolog annotation: Hit_ID=Q8RZX0; Match level="QueryCoverage=94%, HitCoverage=34%, E-value=6e-64, Identity=42%"; Hit description =Putative adapter-related protein complex 4 epsilon 1 subunit
MVDKNLSFLYEYVQQSLERGALPYIPEDERNGMVNVSNFRSQDQHESAQHGLRFEAYEVPKPPMPSKLAPVSLSSSTDLVPVPEPLYSRETHPISSMGASETGSSGLKLKLDGVQKKWGRPIYSSPASSSSTSTSQNSVNGVTQMDVATAVNSKGRDNYDRRKQRIEISPEKQKLADKLFGGSTKTEKRSSTSNKVPKASTSAADRTQESKAAAVPSEVAREKTNQQSPPPDLLDLGEPTVTVAPPSVDPFKQLEGLLDPNLSSTANRSGAAVTNAPDIMALYAETPESRESGSGDYSIPVRGDNVNLLSEFSNAAARGTTVETTVTPLSQSVKGPNVKDSLQKDAKVRKMGVTPSGMDDFSHPELGDSISRNV

SEQ ID NO: 231246 - protein, 79 aa, Glycine max
  Coding DNA Sequence Number=SeqID_114468
MAKFDPDIVLEFYANACPIEEGVRDMRSWVKGQWIPFDADALSMPPTRHPLDPDKSKQGRRVSCIDHGPLPVSRGSRHT

SEQ ID NO: 231247 - protein, 67 aa, Glycine max
  Coding DNA Sequence Number=SeqID_114469
MLPFDFRHVTELHGLPNNGCQVPRSGQTRIASQQTDDPRTKLGYDTRDAGEGLRALMSLRIDFRPMG

SEQ ID NO: 231248 - protein, 170 aa, Glycine max
  Coding DNA Sequence Number=SeqID_114470
  Homolog annotation: Hit_ID=Q6CQE5; Match level="QueryCoverage=24%, HitCoverage=38%, E-value=1e-07, Identity=66%"; Hit description =Protein TAR1
MLLRGVYADLPRAPASWLVEIWVHGRLRRDKMVDEPRSRPITCEPVSSGPIDDPLRARTLPTRPQSGEASSVADRAQVPWKGAPERVRAPSCPDPVAPRGAVGESGCLGMQPQSGGKFRPRLNTGERPIANNGWGPAMCPGRMWNGESRSADRLGTLTDADCDGGPSPGC

SEQ ID NO: 231249 - protein, 204 aa, Glycine max
  Coding DNA Sequence Number=SeqID_114471
  Gene Ontology: Cellular component=mitochondrion
  Homolog annotation: Hit_ID=Q8TGM6; Match level="QueryCoverage=58%, HitCoverage=97%, E-value=6e-09, Identity=43%"; Hit description =Protein TAR1
  Subcellular localization annotation: CTP_CleavageSite=51; ConfidenceScore=5.50e-01
MSRVDRRTGSHRSTSDRDTSPAPIRFPPDNFKHSLTLFSKSFSSFPRGTCSLSVSRQYLALDGIYRPIGAAFPNNPTRRQRLVVRQGPGTTGLSPSLAPPSRGLGPGPPLRTLLQTTIRTPRATDFHGGLFPGRRALGLMASGATCVQRLDGSRDSAIHTKYRISLRSSSMQEPRYPLPRVIVCKCCVVTTPAGHRLRAPGSRT

SEQ ID NO: 231250 - protein, 294 aa, Glycine max
  Coding DNA Sequence Number=SeqID_114472
  Gene Ontology: Mol. function=zinc ion binding; Cellular component =integral to membrane; Biological process=defense response to bacterium
  Homolog annotation: Hit_ID=Q949G4; Match level="QueryCoverage=84%, HitCoverage=94%, E-value=3e-95, Identity=69%"; Hit description=N3 like protein
  Pfam annotation: Domain name=MtN3_slv; Domain location=144-230; Score= 133.2; E_value=6.9e-37; Accession=PF03083.6; Description=MtN3saliva family
  Pfam annotation: Domain name=MtN3_slv; Domain location=21-110; Score =128.4; E_value=2e-35; Accession=PF03083.6; Description=MtN3saliva family
  Pfam module annotation: Pfam domain module=MtN3_slv::MtN3_slv; Domain location=144-230::21-110
MAIHHETWAFVFGLLVSEDMMITRTTCGNVISFMVFLAPLPTFYQIYKKKSSEGFQSLPYVVALFSSMLWIYYAFVKKDASLLLITINSFGCVIETIYLAIFLVYAPSKTRLWTIKLLLMLNVFGFGAMLLSTLYLTTGSKRLTVIGWICLVFNISVFAAPLCIMKRVIKTKSVEFMPFSLSFSLTINAVMWFFYGLLLKDYYIALPNTLGFLFGIIQMVLYLIYRNAKKDEPMKLEELNSHIINVGKLSRMEPSEPNHATKNGTVTEITIEDPNGKETEEGNLKNIMNSASNV

SEQ ID NO: 231251 - protein, 364 aa, Glycine max
  Coding DNA Sequence Number=SeqID_114473
  Gene Ontology: Mol. function=acyl carrier activity; Cellular component=chloroplast; Biological process=fatty acid biosynthetic process
  Homolog annotation: Hit_ID=Q9SQI3; Match level="QueryCoverage=70%, HitCoverage=60%, E-value=3e-77, Identity=54%"; Hit description =Myristoyl-acyl carrier protein thioesterase, chloroplast precursor
  Pfam annotation: Domain name=Acyl-ACP_TE; Domain location=89-359; Score=347.4; E_value=2.4e-101; Accession=PF01643.8; Description=Acyl- ACP thioesterase
  Subcellular localization annotation: CTP_CleavageSite=49; ConfidenceScore=5.76e-01
MAAISNIGSHFPGNLSDAKKDNNVLRLSFCSPRNTTNMSNNKRRFLSVSASYNDSPRKMDTTNRVNVNGINVAEAPLQAGKLANESAADEAIVTSLRGRFVEDKTATMETIMNFLQETALNHVTSSGIGGEGFGATREMSLRKLIWVVTRIQVQVQRYNKWGDEIEVDTWVDAAGKNGMRRDWIIRDHYTKEIITRATSTWVIMNRQTRRLSKIPEEVKQELLPFYLNNRLAVPTEEADSEKIDKLTDETAQRIRSGLAPRWNDMDANQHVNNVKYIGWILESVPIEVLEHYNMTSMTLEFRRECTQSNLLESMTCPTARVMESNNNSKNRKPELQYTHLLRLQQYKADVIRARTEWNLKQKQQ

SEQ ID NO: 231252 - protein, 317 aa, Glycine max
  Coding DNA Sequence Number=SeqID_114474
  Gene Ontology: Mol. function=oleoyl-[acyl-carrier-protein] hydrolase activity; Cellular component=chloroplast; Biological process=fatty acid biosynthetic process
  Homolog annotation: Hit_ID=Q0MT79; Match level="QueryCoverage=62%, HitCoverage=46%, E-value=9e-49, Identity=51%"; Hit description =Palmitoyl-ACP thioesterase
  Pfam annotation: Domain name=Acyl-ACP_TE; Domain location=83-312; Score=182.3; E_value=1.2e-51; Accession=PF01643.8; Description=Acyl -ACP thioesterase
  Subcellular localization annotation: CTP_CleavageSite=55; ConfidenceScore=5.58e-01
MTSMVAPINMGLQFRGNWCNVNKNKGREFLKPNFNSSCNTNIALNNKRRFSLLVTASSQCSPGRIMGTINEIKHVPMIHPAAGKLANENKQHTTLVTLFRGRFVKDRQNDEYDRGEEIEVDTWFDIAGKNGIRRDWIIRDHYTKEIIAKATSTWTMMNRETRRLSKISEEVRQELVPFFFNKLAIAREEIDHQKIHKLTDSTAESFRYGVTPGWNDMDVNQHVNNVKYIRWILESVPREVLEDYKMTSMTLEFRRECTQSDLLESMSSSSSNVTGASNNDSVNTKPDLQYIHLLRLQDTKAELVRARTEWHLKQNHK

SEQ ID NO: 231253 - protein, 160 aa, Glycine max
  Coding DNA Sequence Number=SeqID_114475
  Gene Ontology: Mol. function=acyl carrier activity; Cellular component=chloroplast; Biological process=fatty acid biosynthetic process
  Homolog annotation: Hit_ID=Q8S9G4; Match level="QueryCoverage=57%, HitCoverage=28%, E-value=2e-13, Identity=46%"; Hit description=Acyl -ACP thioesterase
MDVNQYVNNVKYITWILESVPREVLEDYKMTSMTLEFRCECTQSDLLESMSSPSVIGASNNDSVNTKPDLQYIYTCFVYKTLKPSWSKPEQNGILSKTQVMQGYELKTVDALDGQRNVEERKGTVQTFALFLCLLSMHSHGNFGKTCETHVKRFPRKNEQ

SEQ ID NO: 231254 - protein, 71 aa, Glycine max
  Coding DNA Sequence Number=SeqID_114476
HRREIDRERDGTRLMQSYPSRVLDRRLQEDWARVAKEGLGVLINPKLSSSFSRNLLKEVSQGSFLRKLLKE

SEQ ID NO: 231255 - protein, 62 aa, Glycine max
  Coding DNA Sequence Number=SeqID_114477
MAKNFSKKLAMMLVPAECVFAISLHPCTLPVCIAKCTQILKHKFMSASCTITSTGKLCLCFG

SEQ ID NO: 231256 - protein, 75 aa, Glycine max
  Coding DNA Sequence Number=SeqID_114478
MAATNFPKKLALIMVITVMVMLVLEPQHVECAFAVPLNPCTVPECIAQCKKILHAKFMSASCTTGSQGNLCICLG

SEQ ID NO: 231257 - protein, 81 aa, Glycine max
  Coding DNA Sequence Number=SeqID_114479
  Subcellular localization annotation: CTP_CleavageSite=62; ConfidenceScore=5.22e-01
MSEFILRSLHPPQAKAPHPYASTPILAPPSSLQPPQPNYPPISTSPPTTSLPARPPSPSTPPTGTKNAPNIILLYKKSLDL

SEQ ID NO: 231258 - protein, 182 aa, Glycine max
  Coding DNA Sequence Number=SeqID_114480
  Gene Ontology: Mol. function=structural constituent of ribosome; Cellular component=ribonucleoprotein complex; Biological process =translation
  Pfam annotation: Domain name=PPR; Domain location=121-155; Score =37.2; E_value=5.8e-08; Accession=PF01535.11; Description=PPR repeat
MTNKVVPLPYDPFSNKLAVELPSDPKDLQQIFHDMRTGEGLFNHAVKLFAHCPKRVSPMKPWSSSPDQGGGPHARRGGSQHRPRGLHQRRLAQRGSQNVKFVEACKYVLEMMDKGMRPNVQTYTCVFEGLVREEKLDEAARLLEQMKGKGFVPDEKAVREVLASKKGTVFRNVTNLLFGNPL

SEQ ID NO: 231259 - protein, 647 aa, Glycine max
  Coding DNA Sequence Number=SeqID_114481
  Gene Ontology: Mol. function=ATP-dependent helicase activity; Cellular component=nucleus; Biological process=regulation of transcription, DNA-dependent
  Homolog annotation: Hit_ID=Q2HUZ8; Match level="QueryCoverage=93%, HitCoverage=82%, E-value=0.0, Identity=74%"; Hit description =Helicase, C-terminal; Zinc finger, CCHC-type
  Pfam annotation: Domain name=DEAD; Domain location=116-289; Score =245.2; E_value=1.4e-70; Accession=PF00270.19; Description=DEADDEAH box helicase
  Pfam annotation: Domain name=GUCT; Domain location=521-622; Score =139.4; E_value=9.8e-39; Accession=PF08152.3; Description=GUCT (NUC152) domain
  Pfam annotation: Domain name=Helicase_C; Domain location=359-434; Score=118.9; E_value=1.5e-32; Accession=PF00271.21; Description =Helicase conserved C-terminal domain
  Pfam annotation: Domain name=ResIII; Domain location=112-284; Score= -22.5; E_value=0.0036; Accession=PF04851.6; Description=Type III restriction enzyme, res subunit
  Pfam module annotation: Pfam domain module=DEAD::GUCT::Helicase _C::ResIII; Domain location=116-289::521-622::359-434::112-284
  Subcellular localization annotation: CTP_CleavageSite=50; ConfidenceScore=5.73e-01
MASTIGISSSISIYKTPSFQLFKRPAATTTSVFFNTLPRNRDATLSSVPSAIATPSILTEQPLKGLTLDDLSNSDQFGYDFEPDTNVSDHELDISKLGLPSPLVHSLQKRGIISLFPIQRAVLVPALEGKDIIARAKTGTGKTLAFGIPILKGLTNDDEQSPHRRSGRLPKALVLAPTRELAKQVEKEIQESAPYLKTVCVYGGVSYVTQQSALSRGVDVVVGTPGRIIDLVNGNSLKLSEVQYLVLDEADQMLAVGFEEDVEVILDKVPTQRQTMLFSATMPGWVKKLSRKYLNNPLTIDLVGEQEEKLAEGIKLYALLATATSKRTVLSDLITVYAKGGKTIVFTQTKKDADEVSMALTSSIASEALHGDISQHQRERTLNGFRQGKFTVLVATDVAARGLDIPNVDLVIHYELPNDAETFVHRSGRTGRAGKEGTAILMYTSSQRRTVRSLERDVGSKFEFVSPPAVEEILESSAEQVVATLNRVHPESVEFFTATAQKLVEEQGARALAAALAQMSGFSQPPSCRSLINHEQGWTTLQLTRDSDTSGRYFSARSVTGFLSDVYSQAADEVGKIHLIADERVQGAVFDLPEEIAKELLNKDMPSGNTISKITKLYALTTPTTTTTTSTVTEQQCQCCQRRSVQA

SEQ ID NO: 231260 - protein, 126 aa, Glycine max
  Coding DNA Sequence Number=SeqID_114482
IDGDPVLRGTRIRATWEYVISVEGGQLGMVDLCVICGCGESTCTIAQLPPMVPGDMSRGSRDLGDVRRAPGSQPIKEQRPQSKEACVVAGQLWILSDIWVMASEWGQEVEMASGNRLPRGVIDYQA

SEQ ID NO: 231261 - protein, 113 aa, Glycine max
  Coding DNA Sequence Number=SeqID_114483
KDKELRGSSNGVIGGEETEVPEESEEVQALKAELERTQVVKEKFKPTTIRVRKECDELRDVNMAIAEALEQETKRARKEEWGRNKQVKGGRNDIRGQVEGLSKVEEELDQTVE

SEQ ID NO: 231262 - protein, 238 aa, Glycine max
  Coding DNA Sequence Number=SeqID_114484
  Pfam annotation: Domain name=zf-CCHC; Domain location=104-121; Score =22.8; E_value=0.00017; Accession=PF00098.13; Description=Zinc knuckle
RHRSHLRPHSYRREKERKPQETNINLPYIHGKYNVEANLDWEIRVEQQLKRKYTSKSYGSHSYPKKDQGQGILRVTPSKPKDDKGKTIEKKPLRASMQERTSSIKCFKCLGRGHITSQCPTKKTMIMRDQDIYSSQDEDTTSPSSSESEKAKGKESSEEIYPQEEGQPLMVKEECKEVSVSSKRLAKKESHFEIKTNIKETSPLRQPLGLEVIPQVKEFLDEDLIRKSLNPCALLVPK

SEQ ID NO: 231263 - protein, 104 aa, Glycine max
  Coding DNA Sequence Number=SeqID_114485
MEAASSNGGSLAARRRRAETVFVLVPQHDRIITTWNCCCYIRMVLEFFWFFNLKEAVLPLPSLLLNCLAFEGWYPLVAIAELSMDVPSMSFLLLSSLLTSEKTS

SEQ ID NO: 231264 - protein, 44 aa, Glycine max
  Coding DNA Sequence Number=SeqID_114486
MKKENEEGGWKNHSSGIGVTHKVKWWLDRNIEMTITEATGLQMR

SEQ ID NO: 231265 - protein, 1000 aa, Glycine max
  Coding DNA Sequence Number=SeqID_114487
  Gene Ontology: Mol. function=nucleic acid binding; Cellular component= intracellular; Biological process=DNA integration
  Homolog annotation: Hit_ID=Q1T010; Match level="QueryCoverage=100%, HitCoverage=89%, E-value=0.0, Identity=43%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=rve; Domain location=402-565; Score =156.1; E_value=9.1e-44; Accession=PF00665.16; Description=Integrase core domain
  Pfam module annotation: Pfam domain module=RVT_2::rve; Domain location=731-891::402-565
MKAILGYQEVAEIVEEGYPTITKGSTEAQKALYIENKKKDCKATVLIHQCVDDAHFEKIAGAATSRETWKIWEKCNEGVEQLKKVKLQTTRRQCELMQMENNEKIADFFNRIITHTNVMKNCDEKISNQTIVEKIPRTLNPKFNHIVVAIEESKKLEEITVEELQGSLESHEERLIERETTNPRDHQTLQAHTSKRVGNNSKECVATPSSIDHMGNQSHNDYQAHMAKEENEVDSEEQPLMLMMITDSESHNNETRYRDSGYTNHMIGHRDWLVNFDAMEKSKVRFADNRVIQAEGAGNVAIRRLDGRQAMITDVLYVPGMKSNLISMGQLLEKGFSMKMSNGSLEVYDTTKKMIMKAALARNRTFKVNLNTIEPQCFSAVTLSDDSCKQPKTSCSSYTISKANDVLHIIYSNVCGPFDVPSLGGNKYFVSFVDEFSRKLWLYLIKVKSEVFNTFKGFKALVEKQSGKCIKTLRTDGVGEFTSSELEDFCKKHGIVHKVIAPYTPQHNGIVERRNRIILNIVRYMLKQKNLLHNFWGEATMTTAHVLNRCPTKRLNSMVPKEAWSSNKPSIKHFRIFGSLCYKHVPDQKRKKLDDKSEPMIFVGYNSTCLYKLYNPKIKEVLFNIDVYFDESKSWSEPQAITETIPRLQLNWEEIDSGKEATQGTLNTEQQIMNNRPRRNKNFPLRLLDYQLYPNNAISGDGDLVQQLALMADAEPIDLDEAIVSEVWRSTMEEGLRSIEKNQTWEMVKLKPDGTVAKYKARLVAKGFMQKEGIDYTEVFAPVARLETMRLVVALASWKNWKLWQLDVKSAFLNGPLDEDVFILQPLGFICKGNEHKVLKLRKALYGLKQAPRAWNKRIDTFLHNIDFQGVYIKLFNMWDCNPTETPVEVNLKLAKGENEASVDGTLLEITFNVGLVSRFMSDLRQSHLLATKRIMRYLKGTLGYGIIFPHQTKDDDNLHVVAYSYSDWCGDLVDRKKALWDKYFYCLALPYLGTQRSNQ

SEQ ID NO: 231266 - protein, 76 aa, Glycine max
  Coding DNA Sequence Number=SeqID_114488
  Gene Ontology: Mol. function=DNA binding
MEKKPMTYVIKKKYWPKEDTGMPIFIHEDNARCHVHQDDPYFCRATSEGGFDIHLIYQPPNSPDLNVLDLGFFNVI

SEQ ID NO: 231267 - protein, 202 aa, Glycine max
  Coding DNA Sequence Number=SeqID_114489
MVPKWVISSVGRASPLQGGGRRFEPVITHHFGSLAQLVEQLTFNQLVAGSTESPGAIQADAPASPAGRGPGWAEAYPARPTRFRKERPMGAFPLQLGCVPITKGHICKENVMTTISTNTNIGSSSTSGSGSASGSSDSASKIASLTKQIASLNDELKDIAKDKSLTEKQRKDKQETINAQIQLLQAQIQQLQKQERRKRSRS

SEQ ID NO: 231268 - protein, 105 aa, Glycine max
  Coding DNA Sequence Number=SeqID_114490
MAPHVQMKATMYNKIETIWRPNFESPPSARVGEKTAIRSVNPRRNRRMILGRGKGVDLRRCWMRKGKGACSGHRIMAAMKESEGFFFFLFFPVPSANIHNGTKIK

SEQ ID NO: 231269 - protein, 144 aa, Glycine max
  Coding DNA Sequence Number=SeqID_114491
MGSVSMNPVFRSEVPFGYYYYNNNYTEQNNTMLEKRQVFLRSYQFCRKKSFTERIKGSLVRAKKIVWLRLRSACKLRRSLKCAFYYRRRRFFQLLHNNNNRITESSSCLCSRCLVVFAPAKLQELRVMVGDPFFVKEKKLGMGV

SEQ ID NO: 231270 - protein, 58 aa, Glycine max
  Coding DNA Sequence Number=SeqID_114492
  Subcellular localization annotation: CTP_CleavageSite=21; ConfidenceScore=5.36e-01
MTLPSPTTSHHQTTLPFSTTSTSTLRKSFSQRDCHHEFRFINCLKQGQTYSTILALNP

SEQ ID NO: 231271 - protein, 147 aa, Glycine max
  Coding DNA Sequence Number=SeqID_114493
RRVVVGEGRGSPWWRMLGRIEEGGHGIKGKWFKRSTCKKVGNGKVGGVRDGNREQVSLGRRVISRTTGSVVVTTIKLKVDDCWKWMRVADGIYSVSSAYRGLKIPSRGSQVQVNWNGRWKRHHTYLLVAIKLSLCGITATDGWEWSL

SEQ ID NO: 231272 - protein, 71 aa, Glycine max
  Coding DNA Sequence Number=SeqID_114494
MGDRLEDMICYLGKEYFQQVHAPLYDTLKNDLKNPVFREQEIIDIVVNGVKSKMNLKKCINAPSVGDRGCT

SEQ ID NO: 231273 - protein, 104 aa, Glycine max
  Coding DNA Sequence Number=SeqID_114495
  Gene Ontology: Mol. function=nucleic acid binding; Cellular component= nucleus; Biological process=mRNA metabolic process
  Homolog annotation: Hit_ID=Q00M91; Match level="QueryCoverage=71%, HitCoverage=16%, E-value=3e-26, Identity=63%"; Hit description =Poly(A)-binding protein
  Pfam annotation: Domain name=RRM_1; Domain location=1-63; Score=5.7; E_value=0.043; Accession=PF00076.12; Description=RNA recognition motif. (a.k.a. RRM, R
MEKAKIIKTSLRLNTISQNLHKHDVATQQSLGYSYVNFSNSHDAAKAIDVLNFTPLNGKIIRIMYSIRDPSAQKSGATNVFIKEFGQGHGFVKFKSEEFVGFND

SEQ ID NO: 231274 - protein, 306 aa, Glycine max
  Coding DNA Sequence Number=SeqID_114496
  Homolog annotation: Hit_ID=Q1ST43; Match level="QueryCoverage=17%, HitCoverage=3%, E-value=6e-12, Identity=66%"; Hit description =Integrase, catalytic region; Peptidase aspartic, catalytic
MIDDYSRFVWVFLMHSKAETQSHLKNFVANVKRNVIFYEDCFSFIGQNKPDPVTILPIPHNSIDQSNGVSSESPVDHIMHVPNNTNSDPLTLEQSSNRTRRSLRQAHRPQLYGLKQASRQWYARLSFFLISHGYKQCASYHSLFLKHGFNTIIALLVYVDDIALHCRSKLHDVESRLIQVVLMITKMMTKKPKRMISRLSKEQFKNQEKFDFKIQEKMNSRFKRRNQEDFTREGTSFVVQVKGTSTWVVVTENKRGYISCGSVLVEGTSTRLFKENKGGYIPCGSLLVKAFTRMKRNLKDRRSLGD

SEQ ID NO: 231275 - protein, 264 aa, Glycine max
  Coding DNA Sequence Number=SeqID_114497
  Gene Ontology: Mol. function=DNA binding; Cellular component=oxygen evolving complex; Biological process=DNA integration
  Homolog annotation: Hit_ID=Q1S1E0; Match level="QueryCoverage=85%, HitCoverage=23%, E-value=9e-57, Identity=43%"; Hit description =Integrase, catalytic region
MPIASTPFLIIPRPFDPTGITQLLDNAFKIKDLGDLRHFLGFEVARKPTGINLCQRKYALYILSDASMLGSKPLSTPSDYATKLHQQSRTPLSLEDVSSFRRLIGRLIYLTNTRPNITYAMQHLSQLVVAPTSAHQQAVVRILSDSGWAGCINTIRSITGYAMMYISDSLISWKSKKQATVSRSSSEVEYKALAHAICDLQWLTYLLEEFKVLSGLVKLLLIPSTNQLVDVYTKALMPGPSMVIFNHGYAVEDKGEEVRGGVIH

SEQ ID NO: 231276 - protein, 123 aa, Glycine max
  Coding DNA Sequence Number=SeqID_114498
  Gene Ontology: Mol. function=transferase activity, transferring glycosyl groups; Cellular component=chloroplast; Biological process =carbohydrate metabolic process
  Homolog annotation: Hit_ID=Q1S9B5; Match level="QueryCoverage=40%, HitCoverage=11%, E-value=3e-12, Identity=60%"; Hit description =Glycoside hydrolase, family 77
MNTKPPPVTAEKKMKKKLATSVEKPVLSVFALGISSFQIPFNVYHIIFMPPSRKANERIPLLWLGSVQLGCELCGKTLLISLEGLVEDGLLEKHELPQPIDAKRAADRLISSEGKLKTQLENF

SEQ ID NO: 231277 - protein, 145 aa, Glycine max
  Coding DNA Sequence Number=SeqID_114499
MNTSSNVSDAGPSNLHVPRIVHRFEASFHVQQNAIEVPLSYHRQWSPNYPNYVLFDYEGDKHFIKLHKYGNRFYFGDGLKELRKTHGIHESVLMRFVGRDKNTTFSVDVVRPLHQRAAPTIRHHVFTIDVSEDMIQQNYQLVGVS

SEQ ID NO: 231278 - protein, 212 aa, Glycine max
  Coding DNA Sequence Number=SeqID_114500
MMEVSMTTVISASTSTEVDLTHPSGFNQVNNLALDMVGQGGKELGSTGNPHFVQVQNEYSFPPYGLPPNYAPPNVVHVFEENVDHSGPIPLESQQPQSGHAHVTQPMGETHEYCPQPQPFHFAVGRVPPAIVEREKLDHIEEMLRVIEGGGNYAFADMAKLCLVPDVIIPPNFKVSDFDKYKGTTCPKNHLKMYNRKMGAYSKNEKLLMHFF

SEQ ID NO: 231279 - protein, 205 aa, Glycine max
  Coding DNA Sequence Number=SeqID_114501
  Gene Ontology: Mol. function=pyruvate kinase activity; Cellular component=chloroplast; Biological process=glycolysis
  Homolog annotation: Hit_ID=Q1RYJ8; Match level="QueryCoverage=88%, HitCoverage=38%, E-value=1e-68, Identity=66%"; Hit description =Pyruvate kinase
  Pfam annotation: Domain name=PK; Domain location=4-199; Score=-54.3; E_value=9.1e-14; Accession=PF00224.11; Description=Pyruvate kinase, barrel domain
MLDKRAATLFCATWPCVLFGKDGMMSMVVKSTTKDSVKCAVVDGGELKSRMPKVVHELKNYLKSCGVDIHVIIKIESANSIPNLHSIISASHGTMVARGDLGAELPIEEVPLLQEEIINLCCNMGKVVIVATYMLESMIVHPTPTRAEVSDITIVVREGSDGIMLSGETTHGKFTLKAMQVMHTVTLRTEATIPVVKCHLTLVKC

SEQ ID NO: 231280 - protein, 1010 aa, Glycine max
  Coding DNA Sequence Number=SeqID_114502
  Gene Ontology: Mol. function=glutamate-tRNA ligase activity; Cellular component=cytoplasm; Biological process=tRNA aminoacylation for protein translation
  Homolog annotation: Hit_ID=Q1S2H1; Match level="QueryCoverage=66%, HitCoverage=89%, E-value=0.0, Identity=85%"; Hit description =Glutamyl-tRNA synthetase archae/euk cytosolic; Glutathione S- transferase, C-terminal-like
  Pfam annotation: Domain name=PK; Domain location=564-856; Score= -69.1; E_value=6.5e-13; Accession=PF00224.11; Description=Pyruvate kinase, barrel domain
  Pfam annotation: Domain name=tRNA-synt_1c; Domain location=224-540; Score=428.0; E_value=1.3e-125; Accession=PF00749.11; Description =tRNA synthetases class I (E and Q), catalytic domain
  Pfam annotation: Domain name=tRNA-synt_1c_C; Domain location=542-693; Score=93.0; E_value=9.2e-25; Accession=PF03950.8; Description=tRNA synthetases class I (E and Q), anti-codon binding domain
  Pfam module annotation: Pfam domain module=PK::tRNA-synt_1c::tRNA -synt_1c_C; Domain location=564-856::224-540::542-693
MDIKTFAFAPSSPPLPVIAAAKLAGISPSIDTSLSPDSPPAFIFSDGLKLHGAYALLRYIGRVASLPNFYGQNALESSQIDEWLDYAPILSSGPAFENACKYIDEYLEKCTFLVGYSLSIADLAIWAGLAGSGKRWESLRKSKKYPNLARWFNSIVAEHGTVLNEVTSVYAGKKGLGEPTATKSKDQSVNTDKVKKVNGDVSENNKGGSKPSAEIDLPDAEVGKVRLRFAPEPSGYLHIGHSKAALLNKYFAERYKGQVIVRFDDTNPAKESNEFVDNLIKDIDTLGIKYEQITYTSDYFPELMEMAEKLIRQGKAYVDDTPREQMQKERMDGIDSKCRNNSVEENLKLWKEMIAGTERGLQCCVRGKLDMQDPNKSLRDPVYYRCNPMPHHRIGSKYKVYPTYDFACPYVDSIEGITHALRSSEYHDRNAQYYWIQEDMGLRKVLIYEFSRLNMVYTLLSKRKLLWFVQNGKVDGWDDARFPTVQGIVRRGLKIEALIQFIVEQNVDDSSLILVQGASKNLNLMEWDKLWTINKKIIDPVCPRHTAVIADRRVLLTLTDGPEKPFVRIIPRHKKYEAAGDKATTYTKRIWLDLADAVSLSAGEEVTLMDWGNAIVKEIEKDQDGNIIGLSGVLHLEGSVKTTKLKLTWLPEIDELVSLTLVEFDYLITKKKQLDVYFILFDGWVADACQLFDDTGGMMSMVVKSKTEDSMKCEVVDGGELKSRRLLNFRGKSATLPSITEKDWDDDIMFGVDNKVDFYAVSFVKNAEVVHELKNYLKSCGDLGTELHIEEGPLLQEEIINLCCSMGKAVIVTTNMLDSMIVHPTPTRTEFPLKAVQVMHTVALRTEATIPGGKMPPNIGQVLKNHMCEMFAYHATMMSNTLGTSIIVSTGTGFHGSSENGLPPHKATPLFDKLAFEKTQQALGGHVPIVLLGDLWKKFISHIQELTTVSCISSVVAVLDHNYHLEDKVFFNGIGDVRKGIMAQQDTIGICTNERPKRKINPPRHLKDFI

SEQ ID NO: 231281 - protein, 309 aa, Glycine max
  Coding DNA Sequence Number=SeqID_114503
  Gene Ontology: Mol. function=RNA-directed DNA polymerase activity; Cellular component=extracellular region; Biological process=RNA -dependent DNA replication
  Homolog annotation: Hit_ID=Q1SWC8; Match level="QueryCoverage=90%, HitCoverage=34%, E-value=2e-57, Identity=32%"; Hit description=RNA -directed DNA polymerase
MNDWGHKLRKNFRDQIEVFRRELEIARASNDNQDVGSFLEEFQTILFQMNSNKSPDSDDLNPTFFKNVWHLYGLEIFHYGTTWLEIGHFPPQPFLPKCISIEQSAFIEDRSILDNVILASEIIHHMRYKSKGKIGEVTLKLGLDCLQTIQYSVMINGDFVGQITSERGLRQGDPLSNAIEASILKDILDTYDRASGQLINFQKSEVFFSSNTPHTTRQFIYSLLGVTKTIGIRKYLGLPSIIGRRKKEIFCFIKDRLWKRISHWTSKNLSKADELQKMMNSFWWGSNSHSKKDINWLNWDKLTMIKDYG

SEQ ID NO: 231282 - protein, 317 aa, Glycine max
  Coding DNA Sequence Number=SeqID_114504
  Gene Ontology: Mol. function=nuclease activity; Cellular component =nucleus; Biological process=DNA repair
  Homolog annotation: Hit_ID=UPI000034F276; Match level="QueryCoverage =99%, HitCoverage=75%, E-value=1e-150, Identity=80%"; Hit description= 5''''-3'''' exonuclease/ DNA binding / nuclease
  Pfam annotation: Domain name=5_3_exonuc; Domain location=195-286; Score=-5.2; E_value=0.00042; Accession=PF01367.11; Description=5'-3' exonuclease, C-terminal SAM fold
  Pfam annotation: Domain name=XPG_I; Domain location=127-214; Score =96.9; E_value=6.2e-26; Accession=PF00867.9; Description=XPG I-region
  Pfam annotation: Domain name=XPG_N; Domain location=1-88; Score=93.3; E_value=7.3e-25; Accession=PF00752.8; Description=XPG N-terminal domain
  Pfam module annotation: Pfam domain module=5_3_exonuc::XPG_I::XPG_N; Domain location=195-286::127-214::1-88
MGIKGLTKLLADNAPKSMKENKFESYFGRKIAIDASMSIYQFLIVVGRSGTEMLTNEAGEVTRYVFDGKPPDLKKQELAKRYSKRAEATEDLSEALETANKEDIEKFSKRTVKVTKQHNDDCKRLLRLMGVPVVEALGSTGTLRSRGSVYGVASEDMDSLTFGAPKFLRHLMDPSSKKIPVMEFEVAKILEELNMTMDQFIDLCILSGCDYCDSIRGIGGLTALKLIRQHGSIENILENLNKERYQIPDNWPYQEARRLFKEPLVITDEKELDIKWSSPDEEGLITFLVNENGFNRDRVTKAIEKIKVAKNKSSQGR

SEQ ID NO: 231283 - protein, 134 aa, Glycine max
  Coding DNA Sequence Number=SeqID_114505
  Homolog annotation: Hit_ID=Q9LJX4; Match level="QueryCoverage=47%, HitCoverage=6%, E-value=3e-12, Identity=53%"; Hit description=RNA binding protein-like
MMKDQFSNYVIPKVLEICSENQRATLLSRITLNVDALKNTYGKHIVAQFEELVGECDQICSQGTICENLDPQGFTAHVETRDLESSSSTRFEKEDGTRGNVDTMLTEDPSNGLTQPSLQIEDTDHVNIHELSEI

SEQ ID NO: 231284 - protein, 346 aa, Glycine max
  Coding DNA Sequence Number=SeqID_114506
  Gene Ontology: Mol. function=cysteine-type endopeptidase activity; Cellular component=endoplasmic reticulum; Biological process =proteolysis
  Homolog annotation: Hit_ID=Q1SPP4; Match level="QueryCoverage=96%, HitCoverage=98%, E-value=1e-117, Identity=61%"; Hit description =Peptidase C1A, papain
  Pfam annotation: Domain name=Inhibitor_I29; Domain location=41-98; Score=95.5; E_value=1.6e-25; Accession=PF08246.2; Description =Cathepsin propeptide inhibitor domain (
  Pfam annotation: Domain name=Peptidase_C1; Domain location=128-345; Score=406.2; E_value=4.8e-119; Accession=PF00112.13; Description =Papain family cysteine protease
  Pfam module annotation: Pfam domain module=Inhibitor_I29::Peptidase _C1; Domain location=41-98::128-345
MASTFWLEGHCGRQRLNQVDWKSMEHVFKWWLSEACTSERHEKWMAQYGRVYKDAAEKEKRFQVFKNNVHFIESFNAAGDKPFNLSINQFADLNDEEFKALLINVQKKASWVETSTETSFRYESVTKIPATIDWRKRGAVTPIKDQGRCGSCWAFSAVAATEGIHQITTGKLVPLSEQELVDCVKGESEGCIGGYVDDAFEFIAKKGGIASETHYPYKGVNKTCKVKKETHGVAEIKGYEKVPSNNEKALLKAVANQPVSVYIDAGTHAFKYYSSGIFNARNCGTDPNHAVAVVGYGKALDGSKYWLVKNSWGTEWGERGYIRIKRDIRAKEGLCGIAKYPYYPTA

SEQ ID NO: 231285 - protein, 262 aa, Glycine max
  Coding DNA Sequence Number=SeqID_114507
  Gene Ontology: Mol. function=metal ion binding; Cellular component =nucleus; Biological process=ubiquitin cycle
  Homolog annotation: Hit_ID=A0CW17; Match level="QueryCoverage=22%, HitCoverage=33%, E-value=4e-11, Identity=48%"; Hit description =Chromosome undetermined scaffold_3, whole genome shotgun sequence
  Pfam annotation: Domain name=PHD; Domain location=170-214; Score=5.0; E_value=0.018; Accession=PF00628.19; Description=PHD-finger
  Pfam annotation: Domain name=zf-C3HC4; Domain location=171-211; Score= 48.1; E_value=3e-11; Accession=PF00097.15; Description=Zinc finger, C3HC4 type (RING finger)
  Pfam module annotation: Pfam domain module=PHD::zf-C3HC4; Domain location=170-214::171-211
MSRNMNNFTPLPGSWQRGFRSFDDHTFNHRESNEVPVFYRSHSTHATDGRSSGVLARERFSDFRNPLGFHSIPNFPAPPPRRQQIHAHNEDIGRLREIFLHPPQRSTFQTSTQALPVVEITKSAALSKLKKVVYDPPPKRYARRVSLYYRNNAAKPLKEKQGENDEDRKSCAICLEDFDPSEEVMLTPCNHMFHEDCIVPWLTSKGQCPVCRFVICEIGRGNHSSFNNNDIANLEPSNLINGELLSILRAMEEAFQLGRMTY

SEQ ID NO: 231286 - protein, 336 aa, Glycine max
  Coding DNA Sequence Number=SeqID_114508
  Gene Ontology: Mol. function=cysteine-type endopeptidase activity; Cellular component=endoplasmic reticulum; Biological process =proteolysis
  Homolog annotation: Hit_ID=Q6F6A4; Match level="QueryCoverage=99%, HitCoverage=93%, E-value=1e-132, Identity=68%"; Hit description =Cysteine protease
  Pfam annotation: Domain name=Inhibitor_I29; Domain location=38-95; Score=105.6; E_value=1.4e-28; Accession=PF08246.2; Description =Cathepsin propeptide inhibitor domain (
  Pfam annotation: Domain name=Peptidase_C1; Domain location=121-335; Score=456.9; E_value=2.7e-134; Accession=PF00112.13; Description =Papain family cysteine protease
  Pfam module annotation: Pfam domain module=Inhibitor_I29::Peptidase _C1; Domain location=38-95::121-335
MAFTCQKQHMLALFLLLAVAISQVMCRKLHETSMRERHEQWMTEYGKVYKDAAEKDKRFQIFKDNVEFIESFNADGNKPYKLGVNHLADLTVEEFKASRNGFKRPHEFSTTTFKYENVTAIPAAIDWRTKGAVTPIKDQGQCGSCWAFSTIAATEGIHQITTGKLVSLSEQELVDCDTKGVDQGCEGGYMEDGFEFIIKNGGITSETNYPYKAVDGKCNKATSPVAQIKGYEKVPPNSETALQKAVANQPVSVSIDADGAGFMFYSSGIYNGECGTELDHGVTAVGYGTANGTDYWIVKNSWGTQWGEKGYVRMQRGIAAKHGLCGIALDSSYPTS

SEQ ID NO: 231287 - protein, 507 aa, Glycine max
  Coding DNA Sequence Number=SeqID_114509
  Gene Ontology: Mol. function=DNA binding; Cellular component =membrane; Biological process=DNA integration
  Homolog annotation: Hit_ID=Q1SH28; Match level="QueryCoverage=66%, HitCoverage=46%, E-value=3e-65, Identity=39%"; Hit description =Integrase, catalytic region
MMNPLPSISQVFSYVVQQERQINRSDMMGNTSLINAAGSLSSKSCTYYGSGRESSDGKGSKVCTHSGFTNHIVDECYRKHGYPPGHKLHGPQGSNVNNVNVVKEEGDGLVLERSQEVQNDELKLSSQYYKALMTLLQQQHNLAHNNSHVNQIGTITGSVGSNNIQKAKPQSYNQVSKDPNWIEAMNAKIKALELKNTWILTNISKHKIAIGCRWGRIIWTLSPVAKLTIVKLLLALTAINQWHLKQLDVNNNAFLHGDLNEEVYMVFLEGLQVDKPGQYASDYSLFIKHGSKTIIALLVYVDDIVLSGNDLIEIQSITHLLDSAFRIKDLGDLRLFLGFEIFLPTDSNIHLKGFNDSNWAGCLDTRISPIGYAIYIGNSLISWKSKKQATVSRSSSEAEYRALASATCELQWLTFLLEEFKVHFQQPATLYCDNKSALHIAANPIFHERTKHIEIDCHIVQEKVMTRLVKLLPISSANQLADIYTKALLPGVFQFLYSKLGTSNIHS

SEQ ID NO: 231288 - protein, 126 aa, Glycine max
  Coding DNA Sequence Number=SeqID_114510
  Gene Ontology: Mol. function=cysteine-type endopeptidase activity; Biological process=proteolysis
  Homolog annotation: Hit_ID=Q1SPP4; Match level="QueryCoverage=85%, HitCoverage=32%, E-value=1e-23, Identity=52%"; Hit description =Peptidase C1A, papain
  Pfam annotation: Domain name=Inhibitor_I29; Domain location=35-91; Score=83.8; E_value=5.2e-22; Accession=PF08246.2; Description =Cathepsin propeptide inhibitor domain (
MSSVSQNHYVLVLFLILTVWISRVMSRGLIRSERHEKWIAQYGKVYKDAVEEKRFQVFKNNVQFIESFNAAGDKPFNLSINQFVDLHDEEFKALLINVQKKASGVETVKEPAMDIQKLTEEACREN

SEQ ID NO: 231289 - protein, 183 aa, Glycine max
  Coding DNA Sequence Number=SeqID_114511
  Gene Ontology: Mol. function=structural constituent of ribosome; Cellular component=ribonucleoprotein complex; Biological process =translation
  Homolog annotation: Hit_ID=P42794-2; Match level="QueryCoverage=98%, HitCoverage=98%, E-value=5e-74, Identity=80%"; Hit description =Isoform 2 of P42794
  Pfam annotation: Domain name=Ribosomal_L5; Domain location=1-64; Score=68.8; E_value=1.7e-17; Accession=PF00281.9; Description =Ribosomal protein L5
  Pfam annotation: Domain name=Ribosomal_L5_C; Domain location=68-167; Score=213.2; E_value=6e-61; Accession=PF00673.11; Description =ribosomal L5P family C-terminus
  Pfam module annotation: Pfam domain module=Ribosomal_L5::Ribosomal_L5_ C; Domain location=1-64::68-167
MREIKVQKLVLNISVGESGDRLTRAAKVETPSHLAASTNVLEQLSGQAPVFSKARYTVRSFGIRRNEKIACYVTVRGDKAMQLLESGLKVKEYELLRRNFSDTGCFGFGIQEHIDLGIKYDPSTGIYGMDFFVVLERPGYRVGRRRRCKSRVGIQHRVTKEDAMKWFQVKYEGVILNKSQAIV

SEQ ID NO: 231290 - protein, 198 aa, Glycine max
  Coding DNA Sequence Number=SeqID_114512
  Gene Ontology: Mol. function=cysteine-type endopeptidase activity; Cellular component=endoplasmic reticulum; Biological process =proteolysis
  Homolog annotation: Hit_ID=Q1SPP4; Match level="QueryCoverage=96%, HitCoverage=55%, E-value=3e-62, Identity=61%"; Hit description =Peptidase C1A, papain
  Pfam annotation: Domain name=Peptidase_C1; Domain location=1-197; Score=245.9; E_value=8.3e-71; Accession=PF00112.13; Description =Papain family cysteine protease
MWDLGFFLIATIESLHQITIGELVFLSEQELVDCVRGDSEACHGGFVENAFEFIANKGGITSEAYYPYKGKDRSCKVKKETHGVARNIGYEKVPSNNSEKALLKAVANQPVSVYIDAGAPAYKFYSSGIFNARNCGTHLDHAATVVGYGKLHDGTKYWLVKNSWSTAWGEKGYIRMKRDIHSKKGLCGIASNASYPIA

SEQ ID NO: 231291 - protein, 237 aa, Glycine max
  Coding DNA Sequence Number=SeqID_114513
  Gene Ontology: Mol. function=nucleic acid binding; Biological process= DNA integration
MKVKVGDPTPRITSTRIKEVSMSNHKNIESAINNLEVLVGQLAKQLAEKSIGNFVANTKKKPKEELGKALIDLGASINLMPLSMCWRIGNLKIAPTWMTFQLADRSITMPYGVVKNVLVKVCQFIFPMDFVIMDIEEDSDIPLILGHPFMLTTKCVVDMGNDNLEMSVEDQKDLGKLKEIPLGEYVFKELKKDSATEKPKVELKAQLMEVLKKYKATIGWHIPILRELALPTASTRS

SEQ ID NO: 231292 - protein, 329 aa, Glycine max
  Coding DNA Sequence Number=SeqID_114514
  Gene Ontology: Mol. function=sugar porter activity; Cellular component=membrane; Biological process=transport
  Homolog annotation: Hit_ID=Q7CJ57; Match level="QueryCoverage=91%, HitCoverage=92%, E-value=1e-112, Identity=72%"; Hit description=D -ribose high-affinity transport system
EVDGGQDDAALHHVLDIRRHVHQIEAVVEHPEHHRPHQRADDGAAPAGDRRPAQHHRGDGVQLEAFAGVGLPAHQARGQHQPGQRGGQAADHVHQHLVARHADAAQPRRLFVAAHRVDVAAERQLVEHQPGQHVHAEHDQDRHLDAQHRAAAKEREDVGQAGDRVAAGIEQRQAAGDAHRRQGDDDRRHAQVGDAGAVGQAEQRPDRQCRHHRQRDRHRRQHQPGGDRAGQRHHRPHREIDAAGQDGAGHAHRDDGIDRHLARHVGQVVDAEEAVVQQAHQYEQDSEADKRQDRRVMQQFFPALAEAGAGGAARHGGLFNSDHKALPVA

SEQ ID NO: 231293 - protein, 306 aa, Glycine max
  Coding DNA Sequence Number=SeqID_114515
  Homolog annotation: Hit_ID=Q9LUS8; Match level="QueryCoverage=20%, HitCoverage=12%, E-value=9e-22, Identity=80%"; Hit description =Similarity to protein phosphatase-2c
LELLRADQRLISPKVGPGLPGINRDTRIYLFCEVLQWLLFLSAVPPVQLLTGWCVTAKAPPDISAGKCSGHAARRVPFAIQAAQLLGRAIGAGLFAITPAGERGMCCKAIKLGNARVFPEFDLNAKEVQVAGGAAGEDRVQAVCSEENGWLFCAIYDGFNGRDAADFLAGTLYDTIISYFNKLIWELEPGSVIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPEDT

SEQ ID NO: 231294 - protein, 105 aa, Glycine max
  Coding DNA Sequence Number=SeqID_114516
MREAHEIPHHNLADFNPCLGYATKGQAVGGVPLPNTLEDPPFRPQPQPLHFVVGRVPTAMVEKGKLDHIEERLKAIEGGGDYAFADIVELCLVPDVVIPLKFKVS

SEQ ID NO: 231295 - protein, 98 aa, Glycine max
  Coding DNA Sequence Number=SeqID_114517
  Homolog annotation: Hit_ID=Q1SPB9; Match level="QueryCoverage=89%, HitCoverage=17%, E-value=5e-08, Identity=34%"; Hit description =Transposase
MLDQFEPLIQDFIDNIVDVKVDGNCGYRSIAALLGMGEDSWQLDDYINLFGGTKRFEELRMSLLVDGFSKVSVDKWMDIMKMEYVIASRYIEDSYSNF

SEQ ID NO: 231296 - protein, 168 aa, Glycine max
  Coding DNA Sequence Number=SeqID_114518
YIYLGLTENKRGYISCGSVLVEGTSTRFKKNKGGHGLLPNFLLFLHSSSSSATSSSATSSFHLLLSQLLRIHLLPFGFLFFLKVLGIPLLFRKMLGIPLLFRKVLGIPLLFRKVLGIPPLPQGASCSSSAPLCLFIFFLGHFHLRFVRSSLASRVEDLELRCFHGMAL

SEQ ID NO: 231297 - protein, 84 aa, Glycine max
  Coding DNA Sequence Number=SeqID_114519
  Gene Ontology: Mol. function=actin binding; Biological process =cytoskeleton organization and biogenesis
  Pfam annotation: Domain name=Transposase_21; Domain location=1-84; Score=-109.9; E_value=3.2e-05; Accession=PF02992.5; Description =Transposase family tnp2
MIVGPRKPGNDIEVYLTPLIEDLRKLWEDRVDVWDGNRQHTFNVKGHYMCPICEKKTSFIQLKHGKKTVYARHQRFPKPYHRYQ

SEQ ID NO: 231298 - protein, 137 aa, Glycine max
  Coding DNA Sequence Number=SeqID_114520
MPFLAKIGMGRLKQRVPEFPEVQKEEEKRENKAKTLPNCIRDRFLHRLSFVHRSFFVLHPQSGPLGPSRRFLQKAVASGGSNLARLGELGGKLLPYFAINRGRSEEEKGSAPLALLSLSNLLRKIISVKKIQAEVLP

SEQ ID NO: 231299 - protein, 126 aa, Glycine max
  Coding DNA Sequence Number=SeqID_114521
MNFLMKHDKGWEQELSPYNQYEEERTPNLESVFEEFRAYHASSKTNQNEIERGLNLDKLLMQFMETTKSTQRALQSVEIQVGELAEAVTKFMSRREKSFVEAEAQEKSLVKEHESREKDEEQAQQQ

SEQ ID NO: 231300 - protein, 222 aa, Glycine max
  Coding DNA Sequence Number=SeqID_114522
GEISETLHFMVSPAGRRVCTLDDLLPCIEKITLLYEEEDRILEAHQDAPPSQPQFEHQQFNILQRSVETRGLGRRRQTVDAAPYSLPPMPEREHGMYYTPPVFTQEPSQMAPMYSYPHDFQPGYSMTGIFGSSPPSGGTPSFTQNNELPTPNAPLGGPWNVPGNILDMNDLLGSIYVMISLSRLTKWMKGGILEEETLIGQLGIGIGHVRHRRGITDIVMID

SEQ ID NO: 231301 - protein, 313 aa, Glycine max
  Coding DNA Sequence Number=SeqID_114523
  Gene Ontology: Mol. function=RNA-directed DNA polymerase activity; Cellular component=chromatin; Biological process=chromatin assembly or disassembly
MDYQALNFVTVRDKFPMPTIDKLLDELGCACWFSKLDLCQGFHQIRVEKEDIPKTTFRTHHGHYEFCVMPFGLCNAPSTFRTTMNELLKPFFRKFATVFFDDILGYSTSLPGHLDHLELILQALTNGEFYLCHSKCLFARRQLQYLGHIVSTDGVAPDLKKIQTMVNWPRPSSTTKLREFLGLTGFYRRFIKTYASIAGPLNALLCKDQFHWNYEAQNAFEHLKTLMTQVSILATPDFNLPFILETDASGIAMGVVLLQQLHPIAYYNKPLCPRLQKASIDTKMVPLPPGTLVHCPHRPPKLEGINGASYSDP

SEQ ID NO: 231302 - protein, 142 aa, Glycine max
  Coding DNA Sequence Number=SeqID_114524
MFVKFLIFFCKASICSLKSVTTIVSLETEDELEIRIAARLPWWHCRMKLPENAQQLPLADMDKSSEQAAGNEPQSRRRRSNSAWEEEEEDEEEEEEEEATSSFVNPNFFGEEEATLHGLICKVVTISGTKLPIHSTNKYGKE

SEQ ID NO: 231303 - protein, 67 aa, Glycine max
  Coding DNA Sequence Number=SeqID_114525
LSLAYQWAKRASTAKCRFSMLNAAEECGKASISRPRAKREISALSTTVVFSQAHRMTSAKLKSTYSR

SEQ ID NO: 231304 - protein, 241 aa, Glycine max
  Coding DNA Sequence Number=SeqID_114526
  Gene Ontology: Mol. function=DNA binding
  Homolog annotation: Hit_ID=Q1RUD8; Match level="QueryCoverage=83%, HitCoverage=46%, E-value=1e-15, Identity=33%"; Hit description=IMP dehydrogenase/GMP reductase
MGSSQKPSLKKRFYQVKIKSLEVTSLRELGQLMGQLQRQAFCKAYGKIWDLARVEVSMEPIASLSQYYDQPLRCFTFEDFQLVPTVKEFEEILGCPLGGRKPYLFSRFYPSTTRVAKVVKISAQELDRVKQNRNRVVGVPRKCLEERAKALENQGKWAFFYRHLRTVDFRGSPLSKCGWPTYMTPSTEDVKKAMQGLFVVLQLSMWGWFHTFFSKKVGPSICYKVTARASKKKDELGPTLG

SEQ ID NO: 231305 - protein, 51 aa, Glycine max
  Coding DNA Sequence Number=SeqID_114527
MDTSEPYTGAMKGTMHKPQANLGVMMIDNNFVPQSLILGQSGAPCMSLKRT

SEQ ID NO: 231306 - protein, 145 aa, Glycine max
  Coding DNA Sequence Number=SeqID_114528
MVVTIRYSKAAPDQSRTETSLFLNQKSQLAAFLASSKSKESLAQNLKEVLQLVQQEVEEEPSKKEAESSETNDDQEDDPFYQNEDDCFDEWQRNGERERERRRHFKEKMSLEEAHHHRRPWIRAWRKKEMNEGRGREEHEILCSK

SEQ ID NO: 231307 - protein, 208 aa, Glycine max
  Coding DNA Sequence Number=SeqID_114529
  Homolog annotation: Hit_ID=Q8TGM6; Match level="QueryCoverage=46%, HitCoverage=78%, E-value=4e-11, Identity=40%"; Hit description =Protein TAR1
VCSHSNPSQKIRVGRRCNPQGDPTNQLPCALRVYSPVDSHTCQTPWSVFQDGPNGEPTGRRQERAGAEARQGRALPSTIAMMTSPRAYQQPGLGPPSQSASVNVPSRSADRLSPFHIRPGHIAGPHPLPSRQFQALFDSLFKVLFIFPSRYLFAIGLSPVFSLGRNLPPDWGCIPKQPDSPTAPRGATGSGHDGALTLSGAPFQGTWA

SEQ ID NO: 231308 - protein, 179 aa, Glycine max
  Coding DNA Sequence Number=SeqID_114530
MGASGNRLPACVIDYTEEWVTGNRLPGMCNRLHSIVMVAQLIRDRVEMECLEGAWETLEGNTRCRFRGTIRFTATSLVHPDEPARTLQRTVEWILPTPTPYRLVEPVQVIEVTSSEEDPEEDLEELPPEPAVDALDLLEGDEDPLLEVDSPEEVMSASEADSTEDSGPREMAISGGSSS

SEQ ID NO: 231309 - protein, 109 aa, Glycine max
  Coding DNA Sequence Number=SeqID_114531
MPENQKNILMHNLGHGFLSTVPGLPPDIGGRPTVRAHPERKAITHQLCIPGQDFTHAAAKRLVWIMRTNMTTFTWIWMMLLFSNILPGDHNANLPLQMYRLGSRPQDAK

SEQ ID NO: 231310 - protein, 241 aa, Glycine max
  Coding DNA Sequence Number=SeqID_114532
  Homolog annotation: Hit_ID=Q33P84; Match level="QueryCoverage=76%, HitCoverage=31%, E-value=1e-20, Identity=31%"; Hit description =Hypothetical protein precursor
DAAILRNQLQSEIWNAEVLQSGKWDPQLYNGIAGSAIYGLMAREFAPLPERLKSATARMEKLPAIFAQARENLDPARVPKIHAETVAKQNKGILSIVDTFITPHIGELPQADQQRLQAAIDGLKKAVDEQQTWLDKTLVPNAKGDFRIGAEKYDQKLKFALSSSLSRQEIGERARAELKRVRQDMYGIAQTVLKDKPVRRNAGAATDEHQHMAIEAALELATTTIRHSTRWLDDATAPLIA

SEQ ID NO: 231311 - protein, 246 aa, Glycine max
  Coding DNA Sequence Number=SeqID_114533
  Gene Ontology: Mol. function=DNA binding
  Homolog annotation: Hit_ID=Q1S0F5; Match level="QueryCoverage=55%, HitCoverage=33%, E-value=2e-13, Identity=31%"; Hit description=IMP dehydrogenase/GMP reductase
YYDQPLRCFTFEDFQLVPTVKEFEEILGCPMGGRKPYLFSRFYPSTTRVAKVVKISAQELDRANGLSFIDILALLIFGVVLFPNMEGLVDLAAIDAFLAFHHGKESPIVAILAMYDTFDRGCEKSGARIVCCTPALYVGAGFTPFSPRRKEESRSIFMRRMSKCSLDGNKGDHNARVLQGVRKAWDATVRDDEVKASEESDEVQALKAELERARVVEEKFKSIAIKGSNSKLKLRRGERNHHGSKA

SEQ ID NO: 231312 - protein, 143 aa, Glycine max
  Coding DNA Sequence Number=SeqID_114534
  Gene Ontology: Mol. function=DNA binding
  Homolog annotation: Hit_ID=Q1SFS3; Match level="QueryCoverage=62%, HitCoverage=17%, E-value=2e-30, Identity=68%"; Hit description =Lambda repressor-like, DNA-binding
ASDVGEIIVSCGEYPNVPLLGMRGGISYNPLLARRQFGYPIKTKPNNLALTNEFYLNHGDHSNKRERFAQAWSAIRRLNRSQLGKKSDYVHESYTQNQRMIEKDDFFVGKTFCSPQDARRKRKFMDLFSRAHSDSEDPSTPGV

SEQ ID NO: 231313 - protein, 172 aa, Glycine max
  Coding DNA Sequence Number=SeqID_114535
  Gene Ontology: Mol. function=nucleic acid binding; Cellular component= cytoplasm; Biological process=mRNA polyadenylation
  Homolog annotation: Hit_ID=Q9FJN9; Match level="QueryCoverage=68%, HitCoverage=55%, E-value=1e-43, Identity=71%"; Hit description =Poly(A)-binding protein II-like
  Pfam annotation: Domain name=RRM_1; Domain location=48-118; Score =57.3; E_value=4.9e-14; Accession=PF00076.12; Description=RNA recognition motif. (a.k.a. RRM, R
MAETGTAGVECVKDASTSLLEETACGSFGRTFCKCWACNPSHRALLLTVVRSVVDYACTPEEVQQHFQSCGTVNRVTILTDKFGQPKGFAYVEFVEAEAVQEALLLNESELHGRQLKVLPKRTNVPGMKQYRPRCFNPYMAYGFRRPYTPYLYSPYGKVPRFRRPNRYMPYY

SEQ ID NO: 231314 - protein, 781 aa, Glycine max
  Coding DNA Sequence Number=SeqID_114536
  Gene Ontology: Mol. function=protein serine/threonine kinase activity; Cellular component=mitochondrion; Biological process =protein amino acid phosphorylation
  Homolog annotation: Hit_ID=Q654Y7; Match level="QueryCoverage=95%, HitCoverage=85%, E-value=1e-150, Identity=29%"; Hit description =Putative fertility restorer
  Pfam annotation: Domain name=PPR; Domain location=145-179; Score =47.2; E_value=5.4e-11; Accession=PF01535.11; Description=PPR repeat
  Pfam annotation: Domain name=PPR; Domain location=180-214; Score =48.3; E_value=2.6e-11; Accession=PF01535.11; Description=PPR repeat
  Pfam annotation: Domain name=PPR; Domain location=215-249; Score =53.0; E_value=9.9e-13; Accession=PF01535.11; Description=PPR repeat
  Pfam annotation: Domain name=PPR; Domain location=250-284; Score =43.0; E_value=1e-09; Accession=PF01535.11; Description=PPR repeat
  Pfam annotation: Domain name=PPR; Domain location=285-319; Score =40.0; E_value=8.3e-09; Accession=PF01535.11; Description=PPR repeat
  Pfam annotation: Domain name=PPR; Domain location=320-354; Score =45.9; E_value=1.4e-10; Accession=PF01535.11; Description=PPR repeat
  Pfam annotation: Domain name=PPR; Domain location=355-389; Score =29.3; E_value=1.3e-05; Accession=PF01535.11; Description=PPR repeat
  Pfam annotation: Domain name=PPR; Domain location=390-424; Score =47.6; E_value=4.1e-11; Accession=PF01535.11; Description=PPR repeat
  Pfam annotation: Domain name=PPR; Domain location=41-75; Score=12.9; E_value=0.22; Accession=PF01535.11; Description=PPR repeat
  Pfam annotation: Domain name=PPR; Domain location=425-459; Score =37.5; E_value=4.6e-08; Accession=PF01535.11; Description=PPR repeat
  Pfam annotation: Domain name=PPR; Domain location=460-494; Score =18.9; E_value=0.018; Accession=PF01535.11; Description=PPR repeat
  Pfam annotation: Domain name=PPR; Domain location=495-529; Score =40.7; E_value=5.2e-09; Accession=PF01535.11; Description=PPR repeat
  Pfam annotation: Domain name=PPR; Domain location=530-564; Score =32.0; E_value=2.1e-06; Accession=PF01535.11; Description=PPR repeat
  Pfam annotation: Domain name=PPR; Domain location=629-663; Score =36.8; E_value=7.6e-08; Accession=PF01535.11; Description=PPR repeat
  Pfam annotation: Domain name=PPR; Domain location=664-698; Score =25.9; E_value=0.00014; Accession=PF01535.11; Description=PPR repeat
  Pfam annotation: Domain name=PPR; Domain location=699-733; Score =16.4; E_value=0.085; Accession=PF01535.11; Description=PPR repeat
  Pfam annotation: Domain name=PPR; Domain location=734-768; Score =32.8; E_value=1.2e-06; Accession=PF01535.11; Description=PPR repeat
  Pfam annotation: Domain name=PPR; Domain location=79-113; Score=25.9; E_value=0.00015; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR::PPR::PPR::PPR::PPR::PPR; Domain location=145-179::180-214::215-249::250-284::285-319::320-354::355 -389::390-424:...
  Pfam module annotation: Domain location=:41-75::425-459::460-494::495- 529::530-564::629-663::664-698::699-733::734-768::79-113
MIKSCTSPHDATFLLNLLRRMNTAAAAADHQHQLAFKLSLTSYNRLLMCLSRFSMVDEMISLYKEMLTDNGNSVFPNLITLNTMLNSYCKLGNMAVARLFFVRILRCEPGPDLFTYTSLVLGYCRNDDVERACGVFCVMPRRNAVSYTNLIHGLCEAGKLHEALEFWARMREDGCFPTVRTYTVLVCALCESGRELEALSLFGEMRERGCEPNVYTYTVLIDYLCKEGRMDEALKMLNEMVEKGVAPSVVPFNALIGSYCKRGMMEDAVGVLGLMESKKVCPNVRTYNELICGFCRGKSMDRAMALLNKMVESKLSPDVVTYNTLIHGLCEVGVVDSASRLFRLMIRDGFSPDQWTFNAFMVCLCRMGRVGEAHQILESLKEKHVKANEHAYTALIDGYCKAGKIEHAASLFKRMLAEECLPNSITFNVMIDGLRKEGKVQDAMLLVEDMAKFDVKPTLHTYNILVEEVLKEYDFDRANEILNRLISSGYQPNVVTYTAFIKAYCSQGRLEEAEEMVIKIKNEGVLLDSFIYNLLINAYGCMGLLDSAFGVLRRMFGTGCEPSYLTYSILMKHLVIEKHKKEGSNPVGLDVSLTNISVDNTDIWSKIDFGITTVLFEKMAECGCVPNLNTYSKLINGLCKVGRLNVAFSLYHHMREGGISPSEIIHNSLLSSCCKLGMFGEAVTLLDSMMECSHLAHLESYKLLICGLFEQMNKEKAEAVFCSLLRCGYNYDEVAWKVLIDGLAKTGYVDQCSELLNLMEKNGCRLHPETYSMLMQELNRA

SEQ ID NO: 231315 - protein, 185 aa, Glycine max
  Coding DNA Sequence Number=SeqID_114537
MGWFMMNKKNQPPMECPCRQGGSSARISDTVVLLYEGKDGGVGRGVQCEGADRDDARLGVLGEVHKVEVVGGTTGALKERGGELARGGEDVVVKDVCEGDQGEVMAREVIVGGEVGVGEGKNGEGGVLLEIRNERREGGDERGFSQTQRKLPLCRHNYRKANKNIFSRQEIKEPVVEDIFPMSNV

SEQ ID NO: 231316 - protein, 122 aa, Glycine max
  Coding DNA Sequence Number=SeqID_114538
MHVIKSPPLEVTAHLKEKTRWPKFNKNPTKRKKAFYSIYFPVSSSAFLLMAYSLKKEEKREKCVVNLRSINTNTDTGHDTDMDTWTPVKYIKFNPNTGIGVVSVSVSVSYPDTARNCGVRAS

SEQ ID NO: 231317 - protein, 361 aa, Glycine max
  Coding DNA Sequence Number=SeqID_114539
  Homolog annotation: Hit_ID=Q9FJP0; Match level="QueryCoverage=34%, HitCoverage=41%, E-value=1e-37, Identity=66%"; Hit description =Genomic DNA, chromosome 5, P1 clone:MQN23
  Subcellular localization annotation: CTP_CleavageSite=66; ConfidenceScore=5.82e-01
MLLTCYHHPFPHSLSSTSTHSLFTTNRNCNLSLSFSIVTSRPLHLTTHTAHRFNSLTVRADSFRLRSEHAAADSNFDSLLSLLEFSCLLSSAISSAAAAVLAGSKNELIAGIGARAAPFGGALLVVGVLAGKGGLEVNLLERIEKLEEDLRSSATVVRVLSRQLEKLGVRFRVTRKGLKDPIAETAALAQKNSEAARALAVQSDILEKELGEIQQVLLAMQEQQRKQLDLILAVGKASKLWESKQETNERHDTLELSNSAEDGVKQEHFNECFLPSLSGPATAKQIGPIRKVLHELWTIKKPVCLSAMFKLASPREEFVKLNSNRTLNLQTKKAVAGCILKDHLGHLIVGLIFGIVYRHKG

SEQ ID NO: 231318 - protein, 90 aa, Glycine max
  Coding DNA Sequence Number=SeqID_114540
  Gene Ontology: Mol. function=nucleotide binding; Cellular component =membrane; Biological process=small GTPase mediated signal transduction
  Homolog annotation: Hit_ID=Q40191; Match level="QueryCoverage=93%, HitCoverage=37%, E-value=7e-36, Identity=87%"; Hit description=Ras -related protein Rab11A
  Pfam annotation: Domain name=Ras; Domain location=20-90; Score=-20.5; E_value=9.7e-08; Accession=PF00071.12; Description=Ras family
MAGAGGGYGDANQRIDYVFKVVLIGDSAVGKSQILARFARNEFSLDSKSTIGVEFQTRTLVIDHKTVKAQIWDTAGQERYSITSFVFHSS

SEQ ID NO: 231319 - protein, 182 aa, Glycine max
  Coding DNA Sequence Number=SeqID_114541
  Homolog annotation: Hit_ID=Q6K4D4; Match level="QueryCoverage=68%, HitCoverage=13%, E-value=4e-34, Identity=57%"; Hit description =Proliferating-cell nucleolar protein-like
MERQTAREGSSASCAFRISSEGLPLILPYITKQILHASPADFKHILQNKEVKFEDFNDAEFGEKAANLLPGCCVVILHIGNTLAAESLQVDESTIAIGCWKGRARLSVMVTAMDCQELLERLLIRFDTEKGSSGHADKSSNDVQELNSINDGVKVTFEMLKMSIAVVNIDNTLRAIFDVLFR

SEQ ID NO: 231320 - protein, 308 aa, Glycine max
  Coding DNA Sequence Number=SeqID_114542
  Gene Ontology: Mol. function=protein serine/threonine kinase activity; Cellular component=spindle pole body; Biological process =protein amino acid phosphorylation
  Homolog annotation: Hit_ID=Q84TC6; Match level="QueryCoverage=99%, HitCoverage=100%, E-value=1e-111, Identity=62%"; Hit description =Serine/threonine-protein kinase SAPK2
  Pfam annotation: Domain name=Pkinase; Domain location=4-223; Score =154.8; E_value=2.2e-43; Accession=PF00069.15; Description=Protein kinase domain
  Pfam annotation: Domain name=Pkinase_Tyr; Domain location=4-224; Score=-83.6; E_value=2.4e-07; Accession=PF07714.7; Description =Protein tyrosine kinase
  Pfam module annotation: Pfam domain module=Pkinase::Pkinase_Tyr; Domain location=4-223::4-224
MERYEIIKDIGSGNFGVAKLVKEKWSGELYAIKFIERGFKIDEHVQREIINHRSLKHPNIIRFKELLLTPTHLAIVMEYASGGELFERICSAGRFSEDELITQLYVRIFLQSSVLHSQPKSTVGTPAYIAPEVLSRREYDGKVADVWSCGVTLYVMLVGAYPFEDPEDPRNFRKTLQRILSVHYSIPDYVRISKECRHLLSRIFVANPEKRITIPEIKMHPWFLKNLPLEFMDEGEGVLQNDDHVNEESSEITQSIEEILAIVQEARKPGEGPKVGEQFVGGSMDLDDIDADADIDDIETSGDFVCAL

SEQ ID NO: 231321 - protein, 464 aa, Glycine max
  Coding DNA Sequence Number=SeqID_114543
  Gene Ontology: Mol. function=beta-lactamase activity; Cellular component=chloroplast ribulose bisphosphate carboxylase complex; Biological process=beta-lactam antibiotic catabolic process
  Homolog annotation: Hit_ID=Q5H2L1; Match level="QueryCoverage=99%, HitCoverage=82%, E-value=0.0, Identity=73%"; Hit description=Beta -lactamase
  Pfam annotation: Domain name=Beta-lactamase; Domain location=13-363; Score=261.5; E_value=1.7e-75; Accession=PF00144.14; Description=Beta- lactamase
MASAATPAQLQDLDATVERVRAQFDVPGIAVAVVKDGEVVLERGWGVREQGKPEPVQADTLFAIASNTKAFTATSLNLLAEDGKLKMDDKVIDHLPSFRMSDPFVTGQMTIRDLLSHRSGLSLGAGDLLFWPTTSYSIAEVVERLGRVPLKGGFRESYAYDNILYAVAQQVIEHVSGMSYQQFLQTRIFDKVGMAGTRYNADHLKPGDKAAVGHAKYDFKDLRTVAPLTWSNNAGAGGIYSSAHDMARWMKVQLAEGKLADGTPLFSEKSQQQMWRMITPQSIPAPSVPELAPARANFAGYGEGWSLSDYRGQKLVWHTGGWPGMVSRLTLVPGEKLGVVLLTNQEVGAAFNAITLSVLDAYLGGGKHDWVDAYAKAVAKGQDKADEAWAKHQSARDKGSKPSLALAGYTGTFRDRWYGDMQISAEGKGLRLCFMKTAQLSGAPGALAARHLHRALGRPFAQRD

SEQ ID NO: 231322 - protein, 103 aa, Glycine max
  Coding DNA Sequence Number=SeqID_114544
  Gene Ontology: Mol. function=binding
  Homolog annotation: Hit_ID=Q6Z236; Match level="QueryCoverage=68%, HitCoverage=12%, E-value=2e-17, Identity=57%"; Hit description =Pentatricopeptide (PPR) repeat-containing protein-like
MLSNIYAAAGKWKDVHRIRVLMKEQGVKKQTAYSWLQIGNKTHYFVGGDPSHPNINDIHVALRRITLHMKVKGSWEDLRDDNIGKLMSSILSYRVLSHQNIGS

SEQ ID NO: 231323 - protein, 176 aa, Glycine max
  Coding DNA Sequence Number=SeqID_114545
  Gene Ontology: Mol. function=DNA binding; Cellular component=nucleus; Biological process=regulation of transcription
  Homolog annotation: Hit_ID=UPI00001631DC; Match level="QueryCoverage =81%, HitCoverage=36%, E-value=2e-65, Identity=79%"; Hit description =ANAC026; transcription factor
  Pfam annotation: Domain name=NAM; Domain location=26-155; Score =313.0; E_value=5.4e-91; Accession=PF02365.6; Description=No apical meristem (NAM) protein
MAQVTGRADIWWRTKEWENMNTFTHVPPGFRFHPTDEELVDYYLRKKITSGRIDLDVIKDVDLYKIEPWDLQEICRIGTEEQNEWYFFSHKDKKYPTGTRTNRATAAGFWKATGRDKAIYSKHELIGMRKTLVFYKGRAPNGQKSDWIMHEYRLETDENGTPQAKRYKNSFIVSKN

SEQ ID NO: 231324 - protein, 208 aa, Glycine max
  Coding DNA Sequence Number=SeqID_114546
  Gene Ontology: Mol. function=enzyme inhibitor activity; Cellular component=cell wall; Biological process=cell wall modification
  Homolog annotation: Hit_ID=Q9LVA3; Match level="QueryCoverage=89%, HitCoverage=91%, E-value=8e-40, Identity=49%"; Hit description =Ripening-related protein-like; contains similarity to pectinesterase
  Pfam annotation: Domain name=PMEI; Domain location=38-195; Score =141.8; E_value=1.9e-39; Accession=PF04043.6; Description=Plant invertasepectin methylesterase inhibitor
MEAISPKHLMTSLVIIIASSLTAHCGCAKRGGERPYKEANTLFIRTSCSSTTYPRLCYSSLVKHADLIQTNRVVLTGAALNVTLASVKSTSAMMSTLAKKQGLKPREVAAMQDCVEQLSDTVDELRRSIAEMSDLRASNFEMIMSDVQTWVSAALTDETTCNDGFQEITAATDIKSTVRRLVIQLRLLSPLASVNVSGLLAGGQILVM

SEQ ID NO: 231325 - protein, 485 aa, Glycine max
  Coding DNA Sequence Number=SeqID_114547
  Gene Ontology: Mol. function=hydrolase activity, hydrolyzing O -glycosyl compounds; Cellular component=cellulose and pectin -containing cell wall; Biological process=carbohydrate metabolic process
  Homolog annotation: Hit_ID=Q5K6L5; Match level="QueryCoverage=98%, HitCoverage=96%, E-value=1e-134, Identity=50%"; Hit description=Endo- 1,4-beta-glucanase isoform 01
  Pfam annotation: Domain name=Glyco_hydro_9; Domain location=25-480; Score=750.2; E_value=1.3e-222; Accession=PF00759.9; Description =Glycosyl hydrolase family 9
MGFPQRLLFILAAGTILSVTGLEHNYGEALSKSILFFEGQRSGKLPPTQRMTWRKDSALQDVYIVPADTTVLPFLRNKVDLVGGYYDAGDNVKFNFPMAFSTTMLAWSVIEFGKFMGPDLKHALDAIRWATEYFLKATSIPGFVFAQVGDPYADHNCWERPEDMDTPRTAFAVSRDFPGSEVSAEIAAALAASSIVYRKYHLGYSTRLLQRAIKVFDFADKYRGSYNDSLGPWDELVWGAAWLFKATKRPYYADYIDKNVHNLKNFAEFGWDSKDAGINVLVSKLLINSSSNSKPFILNNADKFVCSVLPESPSVLVSYSSGGLLFKPGGSNLQHATAISFLFLVYAGYLKQTNKEIDCGGKVFASPKRLKQIARGQVDYILGSNPANMSYMVGYGAKYPERIHHRASSLPSVDEHRGHIGCKGGSFYFDNQNANPNLLVGAVVGGPDMKDSYADSRADFVHSEPTTYINAPLVGVLAYFNSHPS

SEQ ID NO: 231326 - protein, 475 aa, Glycine max
  Coding DNA Sequence Number=SeqID_114548
  Gene Ontology: Mol. function=hydrolase activity, hydrolyzing O -glycosyl compounds; Cellular component=cellulose and pectin -containing cell wall; Biological process=polysaccharide catabolic process
  Homolog annotation: Hit_ID=Q9CAC1; Match level="QueryCoverage=96%, HitCoverage=94%, E-value=1e-159, Identity=57%"; Hit description =Endoglucanase 8 precursor
  Pfam annotation: Domain name=Glyco_hydro_9; Domain location=16-469; Score=796.8; E_value=1.2e-236; Accession=PF00759.9; Description =Glycosyl hydrolase family 9
MSMMVIVTMTMAASINYAEALAKSILFFEGQRSGKLPPSQRIKWRKDSALHDGSDIHMDMVGGYYDAGDNVKFNFPMAFTMSMLGWSVLEFGDLMGSELQNALEAIRWGSDYFLKATKYPNIVVAQVGNPIADHGCWERPEDMDTPRTSYFVSQKRPGSELSAEIAAALAASSMAFRKTDPHYSNLLLIKAMQVFDFANKYRGSYNNSVGAGACPFYCDISGYMDELIWGAAWLYKASNRPNYRDFVKANIQSIGNLDEFGWDCKHAGINVLVSQWAMADASSRDLFIPNADKFICSLLPSSPTKSVSYSKGGLLFKPGGCNLQHTTALSFLLIVYARYMQSAKKTVTCGNEVADPARLINLAKSQVDYILGKNPLGMSYMVGYGGKYPEKIHHRGSTLPSVDMHPQHIQCREGDQYFKSEKPNPNILTGAVVGGPAEDDSFQDSRYNAGQSEPTTYVNAPFVGLLAYFNKPTIS

SEQ ID NO: 231327 - protein, 443 aa, Glycine max
  Coding DNA Sequence Number=SeqID_114549
  Gene Ontology: Mol. function=signal transducer activity; Cellular component=integral to membrane
  Homolog annotation: Hit_ID=UPI0000D9DFFD; Match level="QueryCoverage =37%, HitCoverage=34%, E-value=2e-10, Identity=28%"; Hit description =PREDICTED: similar to Protein C9orf126 homolog, partial
MFLNNHDDNNPIDYICLSPCLIISAKDCIVLLQETNFKEWRQVVTEINRFTKVDKGFSFRPMRYCATFDTHRASLPYVARFHAKRVLKFQDALLTSYHRNEIKFAELTLDIYRMIQCLEWEPSETFYQKHTVKPKENGDIIDHSGASGIIDMNLTADMTDPTIPPNPRKATLYRPSVTHVIAVLATICEELPPDCVVLVYLSASGKAGLNNVSQVENSGGSSKYSRHKVLSQTSLGQNSGPSETQSNGKRELSYYDNYLWFGPKGNSVITAMHSRQVLHGAERGETAALFLSPLRPIFKNPSDVNSNSGSQFTYFLTAPLSAFCQMIGLTPNEADTDVYNEAENIIANAFTEWEIILCSSTTMDLVWAQVISDPFLRRLILRFIFCRSVISFFCTPEESEQYLPLCLPYLPSSVAPTSEAVRSAVVQLAMHFDVADSFHFTET

SEQ ID NO: 231328 - protein, 345 aa, Glycine max
  Coding DNA Sequence Number=SeqID_114550
  Gene Ontology: Mol. function=RNA-directed DNA polymerase activity; Cellular component=chromatin; Biological process=chromatin assembly or disassembly
  Pfam annotation: Domain name=SRP14; Domain location=4-96; Score =107.0; E_value=5.6e-29; Accession=PF02290.6; Description=Signal recognition particle 14kD protein
  Pfam module annotation: Pfam domain module=Retrotrans_gag::SRP14; Domain location=227-317::4-96
MVLLQLDPFLNELTSMFERSTKLGSVWVTLKRCGIMLSTLLASLKSKVQRNKLATAGEAIEYRCLIRATDGKKTISTSGNKGYQKKDLSSSFISALLLLSLGSYQLVRPASFLSAMPEHHTRQVTTDKLEEAVKSLSQDNSTLNTKIDTIHASLTAKIEALFDRFASFTINSPPPPPPTPLHASFAPHRHHMKLEVPRFDGHDPLGWIFKISQFFDYQGIPDHERLTVASFYMEGPALSWYQWMCRNRFFPSWPAMLQALESRFAPCFYDDPQGALFKLQQTGSVSEYLTDFERLANRTLGLPPSCLLSCFVSGLIPELRREVQALRPMSLRRVVVSKLHLCFLL

SEQ ID NO: 231329 - protein, 37 aa, Glycine max
  Coding DNA Sequence Number=SeqID_114551
MLSGEADDAVELGIVECVGYGVWGQMPAKVKSGNCVN

SEQ ID NO: 231330 - protein, 448 aa, Glycine max
  Coding DNA Sequence Number=SeqID_114552
  Gene Ontology: Mol. function=binding; Cellular component =intracellular; Biological process=metabolic process
  Homolog annotation: Hit_ID=Q1SXH9; Match level="QueryCoverage=18%, HitCoverage=38%, E-value=7e-35, Identity=83%"; Hit description =Adenylate kinase
  Pfam annotation: Domain name=ADK; Domain location=1-62; Score=-57.8; E_value=0.00086; Accession=PF00406.12; Description=Adenylate kinase
  Pfam annotation: Domain name=PPR; Domain location=212-246; Score =44.0; E_value=4.9e-10; Accession=PF01535.11; Description=PPR repeat
  Pfam annotation: Domain name=PPR; Domain location=306-340; Score =26.1; E_value=0.00012; Accession=PF01535.11; Description=PPR repeat
  Pfam module annotation: Pfam domain module=ADK::PPR::PPR; Domain location=1-62::212-246::306-340
MQIGAEPDMVLFFDCPEEEMVKRVLSRNQGRIDDNIDTIKNRLKVFESLNLPVIDYYAKKGKLYRINAVGTVDEIFEHVRPVFEACERRLESQERRNALSFPKPKSTPFLIHHRPHPKTKLEALEQVIKDLEASVEKGIKIDPEIYASLLETCYRSHAVRHGIRVHRLIPTSLLHKNFGISSKLLRLYASCGYLDDAHDLFDQMAKRDTSAFPWNSLISGYAQVGHYDDAIALYFQMVEEGVDPDLFTFPRILKVCARIGSVQVGEEGHRHAVRAGFATDGFVLNARVERSLIRCLIETPPHRDPVPWNSMLTAYVHHGLEVEAMKIFRQMILWVIRRGHERNLSIGNSLIMMYSNNGRAGLIKKAYSIIVDGMGSEAAGPTLWGALLYACFMHGDATIGEIAANRLFDLEPDNEHNFVLLMRIYENAGRLEDMERVRMMLVDRGLDY

SEQ ID NO: 231331 - protein, 531 aa, Glycine max
  Coding DNA Sequence Number=SeqID_114553
  Gene Ontology: Mol. function=enzyme inhibitor activity; Cellular component=cell wall; Biological process=cell wall modification
  Homolog annotation: Hit_ID=O04887; Match level="QueryCoverage=93%, HitCoverage=94%, E-value=1e-136, Identity=51%"; Hit description =Pectinesterase-2 precursor
  Pfam annotation: Domain name=PMEI; Domain location=27-177; Score =82.7; E_value=1.1e-21; Accession=PF04043.6; Description=Plant invertasepectin methylesterase inhibitor
  Pfam annotation: Domain name=Pectinesterase; Domain location=218-517; Score=646.0; E_value=3e-191; Accession=PF01095.10; Description =Pectinesterase
  Pfam module annotation: Pfam domain module=PMEI::Pectinesterase; Domain location=27-177::218-517
MTMMGKTLLTLLLLSSVFSIASSRRRHSNNSNIDWWCNQTPYPETCKYYVKHSHYHYKLKHKSEFRTILVHLALERAVIMRRKARELGRNGVTKKQKSVFRDCLKLYDNTVFHLNRTLEGLHVKRSCSPFDAQTWLSTARTNIETCQNGALELGVRDSMVPTERCNLTEIISNGLFVNWAFLKYKEAHYTADAEDGFPRWFSMHERKLLQSSSSIRAHLVVAKDGSGHFRSIQAAINAAARRRFKSRFIIHVKRGVYRENIEVDKTNDNVMLVGDGMRNTIITSGRSVRAGYTTYSSATAGIDGLHFIARDITFRNTAGPLKGQAVALRSASDLSVFYRCAIEGYQDTLMVHAQRQFYRGCYIYGTVDFIFGNAAVVFQNCVILVRRPLNGQANMITAQGRDDPFQNTGFSIHNSQIRAAPDLRPVVGKFNTFLGRPWQRYSRVVVMKSFLDSLVSPRGWSPWGDSNFALNTLYYGEYRNFGPGSSTRNRVRWPGFHRISSPAEASRFTVANILAGRTWLPATGVPFTSGL

SEQ ID NO: 231332 - protein, 156 aa, Glycine max
  Coding DNA Sequence Number=SeqID_114554
MAGKFDPKDYPNAIDRMLGKKLAFRFKAIPNLSTLTILTDSRAMVAGIKNRARDKASARRRPIFGTDHVKKVAEADVKGTELTFPSNSVASEGNMTWFWSDGHKKGWVKLMNRATGNRWVRTTLVSFAVPIPFIFPRKGSDEDNHFLGPHTPPPSL

SEQ ID NO: 231333 - protein, 98 aa, Glycine max
  Coding DNA Sequence Number=SeqID_114555
MGVADATQICARNHSVAVLTVVIAWGFRFENPSMISLCLSKIKSRKHETTTNAKGGDDNKDDLNGHANINSHQVVARKLPYRLSPNVMDSHCSLIIVP

SEQ ID NO: 231334 - protein, 84 aa, Glycine max
  Coding DNA Sequence Number=SeqID_114556
  Gene Ontology: Mol. function=structural constituent of ribosome; Cellular component=ribonucleoprotein complex; Biological process =translation
  Homolog annotation: Hit_ID=P49200; Match level="QueryCoverage=97%, HitCoverage=97%, E-value=2e-29, Identity=61%"; Hit description=40S ribosomal protein S20-1
  Pfam annotation: Domain name=Ribosomal_S10; Domain location=22-79; Score=58.8; E_value=1.8e-14; Accession=PF00338.12; Description =Ribosomal protein S10pS20e
MAYAAMKPTKPGLEESQEQIHKIRITLSSKNVKNLEKGTNTWDRFELRVHKRVIDLYSSPDVVKQITSITIEPGVEVEVTIADA

SEQ ID NO: 231335 - protein, 397 aa, Glycine max
  Coding DNA Sequence Number=SeqID_114557
  Gene Ontology: Mol. function=oxidoreductase activity; Cellular component=integral to membrane; Biological process=electron transport
  Homolog annotation: Hit_ID=Q67Y73; Match level="QueryCoverage=97%, HitCoverage=98%, E-value=3e-91, Identity=45%"; Hit description=MRNA, complete cds, clone: RAFL25-12-F01
  Pfam annotation: Domain name=DAO; Domain location=8-324; Score=-29.4; E_value=0.00048; Accession=PF01266.14; Description=FAD dependent oxidoreductase
  Pfam annotation: Domain name=FAD_binding_3; Domain location=6-340; Score=-32.6; E_value=1.6e-08; Accession=PF01494.9; Description=FAD binding domain
  Pfam module annotation: Pfam domain module=DAO::FAD_binding_3; Domain location=8-324::6-340
MDRTVDADIVIVGGGICGLATALALHRKRIKSLVLERSENLRATGAAIIVQANGWRALDQLGIGSTLRQTAIQIEGGRFISLNEAEPMEFPFGVNQELRCLKRTDLVKAMADNLPVGTIRTNCQVVSIELDPLTHSPQLLLSNGSILQAKVVIGCDGVNSAIANMFGLHRTKLLLFSTCVARGFTNFPNGHQFASEFVVMSRGQVQLGRIPVSDQLVYWFVTRPRTSKDSTIWKEPVLIRQSLIESMKGFPEGAVEMIQNCKLSFLHLTELKYRAPWDLVLNKFRKGTVTIAGDAMHATGPFIAQGGSASIEDALVLARCLAQKKFAEGMNIADAEEAFDQYLKERKMRIFWLSLHSFLVGKKLDTKSSIVRFIILAIMAILFRDPDWHSRYHCGLL

SEQ ID NO: 231336 - protein, 399 aa, Glycine max
  Coding DNA Sequence Number=SeqID_114558
  Gene Ontology: Mol. function=polygalacturonase activity; Cellular component=cellulose and pectin-containing cell wall; Biological process=carbohydrate metabolic process
  Homolog annotation: Hit_ID=Q2KMJ7; Match level="QueryCoverage=99%, HitCoverage=98%, E-value=2e-88, Identity=43%"; Hit description=PGN
  Pfam annotation: Domain name=Glyco_hydro_28; Domain location=62-393; Score=347.6; E_value=2.1e-101; Accession=PF00295.8; Description =Glycosyl hydrolases family 28
MEVLIAIFFLLYLVSHCSCSRLREAAINLNTFNVMDYGAIGDGLTDDSQAFLKAWSMVCAMKNGAATLKVPPGKTFMLKPLQFSGPCSFSSVHFQLEGDVVAPKSTEAWKGQDSSKWIDFSNVDGLIIDGGGQIDGSGSVWWNSCKVKSCSRPTALSIHNCNNLQLTGTRHLNSARNHISINNSNHTHIFNVTITAPQDSPNTDGIDVSQSSYILIQRSTIATGDDCIAMNSGTSYVNITGITCGPGHGISVGSLGKKGTCQTVEHVHVSNCNFKGADNGMRIKTWPGGCGYARNIKFEHIVLTNTKNPIIIDQDYENVQNEDKKQTSEVQISGVTYRYVNGTCNSETAIILNCGAGAGCTDIFMDLVNITSTSSGSNVLASCNNAHGVAASTSPPVSC

SEQ ID NO: 231337 - protein, 107 aa, Glycine max
  Coding DNA Sequence Number=SeqID_114559
MTLESDQFPLLNDPNKACIYVIKEASLYNKEKNKMKDCKNTSGEDVSFTSRIPQPLTNSSQALRTASSSSSGGLVRAHALSTILDRLAHISEFRLSACFSRLADGLK

SEQ ID NO: 231338 - protein, 647 aa, Glycine max
  Coding DNA Sequence Number=SeqID_114560
  Gene Ontology: Mol. function=metal ion binding
  Homolog annotation: Hit_ID=Q9C810; Match level="QueryCoverage=97%, HitCoverage=88%, E-value=0.0, Identity=52%"; Hit description=PHD finger protein At1g33420
  Pfam annotation: Domain name=PHD; Domain location=550-599; Score =54.5; E_value=3.6e-13; Accession=PF00628.19; Description=PHD-finger
MTWQILFRVGDIVSGPDLSPAMVTLDIVEEDVTRCRTSVYCDQCRVVGWSGHPVCRKRYHFIIRAASDAVEAYQRPCSRCGNLLQLSETRCRSCNFAITVDDLEDWVYLQIEDNTHLLHGVVHANGYGHLLTLNGREGGSKLLSGFDIMNFWDRLCAAISVRKVSVMDLSKKFGLEYRLLHAITNGHSWYGNWGYQFGTGSYALTQNAYKNAVNTLSSMLLSSFSFHGRGPRSRLECVISLYQSLAETELLTIKDLFSFLLTLILECRKPVAMRTSKQTSNLLCAWTGNDVEDVQHALIKVLLASGVCTEAKWVTRRTLKGAVCRGVSSPELLDYCLKHLPGKLAANGMIVCSRCNPISSAIEFRLEPWCNGLSTNSGYPTDAQLISDLTFLFDSIIHPDKMVCYRPKNMRKRVADSARKLLDCKQFMKDYKPYEMAVELPSVIRLLCHVELSDQPKDDPSPPPELIVLPLNATVADLKSEATSAFQEVYAMYKRFQAEELLGYGSISDSLTIKFLLGTSGSIQIQGRCPAKHGLSRFRMERGTEVWKVDCICGAKDDDGEKMLACDTCGVWQHTRCAGIDNNTDGMPSKFVCMRCVNSYREETKKLPTPGEEANETCKFTTSCRDEAVARECATVSCNIAVNFGVR

SEQ ID NO: 231339 - protein, 44 aa, Glycine max
  Coding DNA Sequence Number=SeqID_114561
MKVALSALVTGEIIMILKEVVDNVEGSRDNEVVVVDEGDKVDEE

SEQ ID NO: 231340 - protein, 491 aa, Glycine max
  Coding DNA Sequence Number=SeqID_114562
  Gene Ontology: Mol. function=nucleic acid binding; Cellular component= proton-transporting two-sector ATPase complex; Biological process=DNA integration
  Homolog annotation: Hit_ID=Q1T010; Match level="QueryCoverage=99%, HitCoverage=35%, E-value=1e-128, Identity=47%"; Hit description =Peptidase S8 and S53, subtilisin, kexin, sedolisin; Integrase, catalytic region; Zinc ...
  Homolog annotation: Hit description=finger, CCHC-type; Peptidase aspartic, catalytic
  Pfam annotation: Domain name=zf-CCHC; Domain location=276-293; Score =26.2; E_value=4.7e-05; Accession=PF00098.13; Description=Zinc knuckle
MNGNGGFNTHLPVFDGRNWSRWSIQMRVLFGAQDVLEFVNDGVPVLAENTTEAQRNLHREKKKKDQKALFYIHQCVDAKIFEKIAESTTAKAAWDTLVRCYGGNATVKKVKLQSLRKQYENLNMKHNEKVVDYVSRIITVTNEMKTCGETISEQMIVEKVLRSLTAQFDHIVVAIEQSKDTSTMKIDELQGSLEALELRVIERGNGKETDQALQAASKENWREIKKKQWLDKKAKQNPNSSDKDKGKSLADKAESSNKGGYNSKFNKKKNFDKRKIQCYNCDRFGHFADECWSGAGKWKKPEKGTEQANLAQDSSDTEPVMLMVTTNDAGVVVDWWYLDTGCSNHLTGNRQWLINYDSSKESRIRCADDEYLVAEGMGDVLVELKDGGTVWIENVWYVPGMKSNLMSVGQLLEKGYSVTMRGAVLQLFDNSDKLVLKSKLSRNRTFKCNVKDSGVKVLSTVIESQSWLWHRRFGHLNFKSLTQLSEKELVT

SEQ ID NO: 231341 - protein, 333 aa, Glycine max
  Coding DNA Sequence Number=SeqID_114563
  Gene Ontology: Cellular component=membrane
  Homolog annotation: Hit_ID=UPI00005FA15C; Match level="QueryCoverage =55%, HitCoverage=62%, E-value=3e-47, Identity=55%"; Hit description =COG0697: Permeases of the drug/metabolite transporter (DMT) superfamily
  Pfam annotation: Domain name=Nitroreductase; Domain location=1-108; Score=-2.7; E_value=0.00034; Accession=PF00881.14; Description =Nitroreductase family
VTDASMLVVLCGDLSSWESQVKNVWAQAAEPVQQFMIPAVDQYYRGKPQVQRDEVMRSSGIFAQTLMLAAKAQGYDSCPMDGFDFDAVGEIINKPAHYQIALMVAIGKAAGQPYPRIGKLPFDEFVPVAETDAPLQAVMPHGQLLLPYTAEAVAERGPVHHDRHRRVDERQGADQRGGDLLNGAVQQRGHQAGMHQAEGRQQQPVDRGRRRRGQAGERRHHQRADGQLNQHDQLRRQRGQLFDDRRRNGVHQGRTQRQRHAEQIVIAAAAVLPAGDDQHHSRERQQKPAQPISRQLFAEQQRPQRHQHERLNVVGNGGDRDRGMCIGGKQQRP

SEQ ID NO: 231342 - protein, 66 aa, Glycine max
  Coding DNA Sequence Number=SeqID_114564
MAGRKSYLEASYGCAKNMKETGTLLVQSNLGTKLNAACSGIANTVLSSNPLERLSQCPDESRGNLV

SEQ ID NO: 231343 - protein, 118 aa, Glycine max
  Coding DNA Sequence Number=SeqID_114565
MQVKVGGHIVKFDEDTLNTFLKTPVVLEGGENLCTYSICALLRLDPQELATKLCIPGRGFELNADGQPLKILRKNMTTLAQTWSVLSFSNLIPTSHTFDMTLDRAKLIYGIIMKMDMN

SEQ ID NO: 231344 - protein, 126 aa, Glycine max
  Coding DNA Sequence Number=SeqID_114566
MSDICLPTSAAVPQLPAYYFKNDDVEFNMVDGGAAAGNPEYDLDPSVDDPTDASKENMDNLEEAGKKMLQENVKRINVDTFDLEETNDGTYAEALDRLANILYEEKELRLKRKSMEKRGRPFIETI

SEQ ID NO: 231345 - protein, 102 aa, Glycine max
  Coding DNA Sequence Number=SeqID_114567
  Pfam annotation: Domain name=zf-GRF; Domain location=16-61; Score =52.3; E_value=1.6e-12; Accession=PF06839.3; Description=GRF zinc finger
  Subcellular localization annotation: CTP_CleavageSite=23; ConfidenceScore=5.12e-01
MSASGSCCAFYGSFIRQCHHRRRAAIRTARTRRNPGRLFYTCALPQTDPDNCQFFQWVEKENQVSNSSSVSREAMVVPDLRLQIEALQKKMRNLTNIVLLVY

SEQ ID NO: 231346 - protein, 956 aa, Glycine max
  Coding DNA Sequence Number=SeqID_114568
  Gene Ontology: Mol. function=DNA binding; Cellular component=beta -galactosidase complex; Biological process=DNA integration
  Homolog annotation: Hit_ID=Q1S1E0; Match level="QueryCoverage=99%, HitCoverage=83%, E-value=1e-150, Identity=34%"; Hit description =Integrase, catalytic region
  Pfam annotation: Domain name=rve; Domain location=188-325; Score =29.0; E_value=1.7e-05; Accession=PF00665.16; Description=Integrase core domain
  Pfam annotation: Domain name=zf-CCHC; Domain location=87-104; Score =11.2; E_value=0.014; Accession=PF00098.13; Description=Zinc knuckle
  Pfam module annotation: Pfam domain module=RVT_2::rve::zf-CCHC; Domain location=507-743::188-325::87-104
MEYAMHFLMGLNESYGSIRGQILSMDPFPPITCIFSLVVQEEKQREIGAFVSAFNSTNDASQPHAFAVKDSKYQFDHKFNSNSKNQPLCAHCGRLGHTQGNCFKLHGFPPNYKKNKPSSSNTERKTVNQVLAPNFVPDFHLTVQQYGQLMSLLQAQTSNAVIPNIESFNTGMVLSASLTKFPQNCWIVDSGASTYIEMPHYKKIGRGDLLQGLYVLNFKDTHSTYNTQFAASIKCLRSDNAKELALRNFLASQGTLHQFTCVERPQQNSVIERKHQHLLNVARALFFQSKVPITFLGRLCYYCYFPYQQIAFTIAEKSTLYQVLHGFAHDYSILRSFGCLAFGATLASERNKFSPREVPSVFVGHPQGVKGYKLYNLHTMKFYVSRDLVFHESIFPFQTLPNSSQEPDFLSELAISLPIPEPITSNIQPRAIEPNTSKLDHPIPPDTSDFPIQLSDSIVDTTIGASSTLSSPPLRRSIRTSNPQPYLSDYIRPQPRQRSHPIQDHCSLVHLNPLYKDFIAQVKFKLDDIVDRHKARLVAKGYTQQAGINFSDTFSPVAKLTSVRVLLAIVVAKNWSILQLDVDNAFLNGNLFEEAYMELPKGYNSVDKTLVCRLNKSLYGLRQASRQWFCKFSTTLIANGFSQSKNDYSLFTIGKGAFLVILLVYVDDILLVGPSVACVHSILAKLQALFKLKILGPLKYFLGLEIAKSSKGIVLTQKKYALSLLEDTGFLGYKPSSLPMDPNLKLSMLNGELLTDPSMYRRLLGRLMYLTISRPYITFPVNKLSQYMQNPRTTHLDVVHHLLQYIKGTSGQGLHFPTSNSFNLSAYAYADWGGCLDTCRTTSGPAEYRALSSVSSEVIWLRRLLLHFEIIVPSVMLFYDSKSAIDLASNLTHHEQSKHIDIDYHFIRELVQSNILKLVHVKSQHQVVDVFTKPLLLLAFSSFIRKLGIINIYSPT

SEQ ID NO: 231347 - protein, 216 aa, Glycine max
  Coding DNA Sequence Number=SeqID_114569
MALQEEGWPLGLRLFNERIGLARNGDFSGSVSFSTMLTASPTRSTDSSSDLDTQAKKGRNKLKSTGSFFRDKSITLGSLIGISSFLELSRRSTRGRILVEPSKDNKKINKLRPWLFSLCSMLSTDAVSVNVAPSLGHYLVAERRAASTHRRNNQCSTIYGPNDFSQVQESNSLFVGGQGAAHSSSTSLGEDCGRESNKALEQSNEYAAPIICCLCR

SEQ ID NO: 231348 - protein, 67 aa, Glycine max
  Coding DNA Sequence Number=SeqID_114570
MQRCYHFAAIKHDWSAPMEIKDESQDSIQDFIGLYEKRIGIIHGTHGGTSKNRRIGEEVLERDQRKR

SEQ ID NO: 231349 - protein, 69 aa, Glycine max
  Coding DNA Sequence Number=SeqID_114571
MTLEPDISPRLGSFVVAEFLSRNEHGNHSLSGLKDVDFRQPEVLLVNKVHQFEVRKRPLEALADMGLNG

SEQ ID NO: 231350 - protein, 104 aa, Glycine max
  Coding DNA Sequence Number=SeqID_114572
  Gene Ontology: Mol. function=acetylglucosaminyltransferase activity; Cellular component=membrane
  Homolog annotation: Hit_ID=Q8S8P3; Match level="QueryCoverage=62%, HitCoverage=14%, E-value=5e-17, Identity=66%"; Hit description =Putative RING zinc finger protein
MSSAKSMHLGAISWICSVRTSRIKVKRDLNCIEHTSNTGWKEYAYYLFIDIRHQRARPIIIDPGLYHSKKFGVYWAKEKRSVPSSFKLFTGSFYKNHWSAQPFH

SEQ ID NO: 231351 - protein, 147 aa, Glycine max
  Coding DNA Sequence Number=SeqID_114573
  Gene Ontology: Mol. function=acetylglucosaminyltransferase activity; Cellular component=membrane; Biological process=electron transport
  Homolog annotation: Hit_ID=Q0WS14; Match level="QueryCoverage=66%, HitCoverage=44%, E-value=5e-24, Identity=48%"; Hit description =Putative RING zinc finger protein
  Pfam annotation: Domain name=Branch; Domain location=54-147; Score= -60.6; E_value=0.001; Accession=PF02485.11; Description=Core-2I -Branching enzyme
  Subcellular localization annotation: CTP_CleavageSite=33; ConfidenceScore=5.68e-01
MVIPIVTISILFLSLLLPLTKPSPSSLSSSSSSSSATWSSLNSTEELEASLPKLAYILSGSKGEGAQLKRASNAERLVLAKYVKSQTMFTTFGNVLVVGKPDLVTYKGPTIIASTLHGIALLLKKAPHWDWLINLNASDYPLLSHDS

SEQ ID NO: 231352 - protein, 87 aa, Glycine max
  Coding DNA Sequence Number=SeqID_114574
  Subcellular localization annotation: CTP_CleavageSite=28; ConfidenceScore=5.72e-01
MNQYTSTRAPSPIRPPSPPFAVIGARIRATLRRKARRWRMSKQRWTFRLCALSMVRLTKQLTGVVEALWAVVTTVSVGETLWKGKGK

SEQ ID NO: 231353 - protein, 135 aa, Glycine max
  Coding DNA Sequence Number=SeqID_114575
  Homolog annotation: Hit_ID=Q00M75; Match level="QueryCoverage=23%, HitCoverage=5%, E-value=1e-09, Identity=93%"; Hit description=PPR -repeat containing protein
  Subcellular localization annotation: CTP_CleavageSite=45; ConfidenceScore=5.29e-01
MADSPDDSSRYPGNGKDMEDITSSVANASSSSGSGYCNSLSILSSCFARVSPGAVVKLCLGDLLVMGSNPETASLHMQGLGTVTNSVPFASIIHLCHLELLIIFYPVYPETMLNPVDPPISSSLTKTGSSNLSCQ

SEQ ID NO: 231354 - protein, 138 aa, Glycine max
  Coding DNA Sequence Number=SeqID_114576
  Gene Ontology: Mol. function=RNA-directed DNA polymerase activity; Biological process=RNA-dependent DNA replication
  Homolog annotation: Hit_ID=Q1SRI1; Match level="QueryCoverage=60%, HitCoverage=15%, E-value=1e-12, Identity=37%"; Hit description=RNA -directed DNA polymerase
MSQDVGISGGSILEATCGMERQKPVNRSEIGPYQLSFKQPPFSFDQHGDLSSSSLWWRDMAKIESSPGDGLQTWFWKSRWLGNFSLKDTFPGLFSIAENKNALVQEMVRPFEKNSVWDWKWRRRLFEWEQQQVQGLES

SEQ ID NO: 231355 - protein, 66 aa, Glycine max
  Coding DNA Sequence Number=SeqID_114577
MMIAEEIINGMSIALELVPLWRAMGRSSENSRGFEVEWEVIGLGDESHGKEQNVVGDTDKLEMAED

SEQ ID NO: 231356 - protein, 114 aa, Glycine max
  Coding DNA Sequence Number=SeqID_114578
MHNKPTKSGKKTAKLWWRLELAPLKFSSTGYKFPGGPVMYKYADDGGGGQYFVGGFLGEGGGGDGYTIGGGGEKYSIGGGGDKYSIGGDGVARTSGERNGKEEVGVVMMDFLRC

SEQ ID NO: 231357 - protein, 69 aa, Glycine max
  Coding DNA Sequence Number=SeqID_114579
  Gene Ontology: Mol. function=DNA binding; Cellular component =chromatin; Biological process=DNA integration
  Homolog annotation: Hit_ID=Q0KIN0; Match level="QueryCoverage=100%, HitCoverage=3%, E-value=6e-22, Identity=66%"; Hit description =Integrase core domain containing protein
MANNGIIHQSSCPHTPQQNDIAERKHHHIIETAHTLLIHANVPMMFWGNVVLTPVYLINRMPSSSTQNK

SEQ ID NO: 231358 - protein, 309 aa, Glycine max
  Coding DNA Sequence Number=SeqID_114580
  Gene Ontology: Mol. function=nucleic acid binding; Cellular component= nuclear pore; Biological process=DNA integration
  Homolog annotation: Hit_ID=Q1S7C5; Match level="QueryCoverage=75%, HitCoverage=25%, E-value=2e-63, Identity=46%"; Hit description =Integrase, catalytic region
MVKGLSISAAGSSSFVSPNDSQITFKLHKLLHGTNKVLLQGVVGADGLYSFHNLKLQDYSSLLLSTSASPVSSVTDVKENADGSINKFKARLVAKGFHQVHGFDFHETFSPVLDVNNAFLNGVLEESVFMTQLPGFEVGDRSLVCKLNKALYGLKQAPRQWFDGLKSTLLQFGFVFSKYDSSLFIYRHQNHIVYLLYATLTRPEISFAVNKVCQFMAKPLESHWAAVKMILRYLKAFDVDDRRSTSGAAIFLGPNLISWWSCKQKVTARSSTEAEYRSLAQTFAELTWIHALLTELQVSFTTPVLYCDN

SEQ ID NO: 231359 - protein, 73 aa, Glycine max
  Coding DNA Sequence Number=SeqID_114581
MYMTSYSMAAMGPLQLYNIPSGISSQGAEGAPATRGGEGGAEGLGFGEDRGEVVGGGGKEDEAVGGGDGLCKD

SEQ ID NO: 231360 - protein, 63 aa, Glycine max
  Coding DNA Sequence Number=SeqID_114582
  Gene Ontology: Mol. function=transferase activity, transferring hexosyl groups; Biological process=carbohydrate metabolic process
  Homolog annotation: Hit_ID=Q1T0I6; Match level="QueryCoverage=70%, HitCoverage=7%, E-value=7e-20, Identity=95%"; Hit description =Glycosyl transferase, family 28
MDKNWGPKIDVVGFCFLDLASNYEPPESLVKWLEEGDKPIYIGFGSLAFKAMILRMMEVYSFG

SEQ ID NO: 231361 - protein, 216 aa, Glycine max
  Coding DNA Sequence Number=SeqID_114583
  Gene Ontology: Mol. function=DNA binding; Cellular component=oxygen evolving complex; Biological process=DNA integration
  Homolog annotation: Hit_ID=Q1S326; Match level="QueryCoverage=81%, HitCoverage=60%, E-value=7e-56, Identity=53%"; Hit description =Putative receptor kinase-related
MAPAPTPIVETETMIDSSLAPLITLRDPDPPSILDLPIALRKVAKGYTQVFELDYFDTFSLVAKMDSVKLLFSIAAIPHLPLFQLNIKNAFLHGDLEEEVYMEQSPGFVAQGESSTMVCRLHRPLYGLKWFPRAWKYACDIVEETGLMNAKPVDTPMDPSVKLVPDQGEPFADRKISKDHWIVVIRILKYIKGALGKGLIYEDRGHVRIVGYSDAD

SEQ ID NO: 231362 - protein, 276 aa, Glycine max
  Coding DNA Sequence Number=SeqID_114584
  Homolog annotation: Hit_ID=Q0KIN0; Match level="QueryCoverage=48%, HitCoverage=9%, E-value=2e-12, Identity=31%"; Hit description =Integrase core domain containing protein
MASSRATKTSKLEALLSNFTLSTEKLDSSNYSTWASDILLWISGQGYKEHLTSIVDSIPKTECAKWLKLDAQLCSVIKSTIYPSIKPLMTLVAPQWFDGSMSIYLGRLHPALHDCNEFFPPAVAKPEEAKKELENRSTFFMTFALFGLPPEYSATCDQILGWCEHCHKDNHTTDRCWKINGKPPDYRLAHSANNSGAAALVAQSGNSFACISQFPTPGPWVLDSSASGHIFASPKACSTATSPLTIHAQLGHPDLVLQKLAVSPFALVHSDVWGSS

SEQ ID NO: 231363 - protein, 371 aa, Glycine max
  Coding DNA Sequence Number=SeqID_114585
  Gene Ontology: Mol. function=nucleic acid binding; Cellular component= chromatin; Biological process=DNA integration
  Homolog annotation: Hit_ID=Q1S7C5; Match level="QueryCoverage=86%, HitCoverage=32%, E-value=2e-75, Identity=43%"; Hit description =Integrase, catalytic region
MSPHLPEQKIHIQYKPDRSLEYDARLKNSTWDLVPLPPDRKAIGCKWIFRVKQNADGPVNKFKARLVAKGDNQVQVYMSQPPGFKASDPSLVCKLKKETFVWSQAGPKAVVYVDDIIITGSSVDLIQQLTSQLNARFSLKQQGLLNYFLGIEVCEFMANPLETHWTAVKRILIYLKGTLLYGLHLRPATLGPPYCIRALCDADWASDIDDRRSTSGAAVYFGPNLISWWSCKQKVVARSSTEAEHRSLAQTTAEISWIKTLLTEIKVPFRTHVIFSDNLSAGALTHNPVLHARTKHREIDIFFVRENVLTKQLVAHYILALDQWADALTKALSATRFMFLGQTQCCENSIGPKTGRDIAMEKHMKFGEEYP

SEQ ID NO: 231364 - protein, 64 aa, Glycine max
  Coding DNA Sequence Number=SeqID_114586
MTLHPISPNIKNSDKAICGLHSDPNTVLTWDFNRDHNRGDEEEESIDTKVDLKKMGTRKHKKLL

SEQ ID NO: 231365 - protein, 107 aa, Glycine max
  Coding DNA Sequence Number=SeqID_114587
  Gene Ontology: Mol. function=nucleic acid binding; Cellular component= intracellular; Biological process=thiamin biosynthetic process
  Homolog annotation: Hit_ID=Q1XW38; Match level="QueryCoverage=90%, HitCoverage=16%, E-value=6e-51, Identity=93%"; Hit description =Thiamine biosynthesis protein ThiC
  Pfam annotation: Domain name=ThiC; Domain location=1-107; Score= -193.3; E_value=3.8e-08; Accession=PF01964.9; Description=ThiC family
MDKQLEECHEAPFYTLGPLTTDIAPGYDHITSGIGAAMIGWFGCAMLCYVTPKEHLGLPNKKDVKDGVITYKLAAHAADLAKGHPGAQYRDNALSKARKYGNPLKWG

SEQ ID NO: 231366 - protein, 515 aa, Glycine max
  Coding DNA Sequence Number=SeqID_114588
  Gene Ontology: Mol. function=hydrolase activity, acting on acid anhydrides, catalyzing transmembrane movement of substances; Cellular component=membrane; Biological process=copper ion transport
  Homolog annotation: Hit_ID=UPI000068CB04; Match level="QueryCoverage =98%, HitCoverage=64%, E-value=1e-150, Identity=49%"; Hit description= cation transport ATPase, E1-E2 family protein
  Pfam annotation: Domain name=E1-E2_ATPase; Domain location=272-489; Score=45.6; E_value=6.8e-12; Accession=PF00122.10; Description=E1-E2 ATPase
MKVSENCFHCGQGIEKERILFDEKIFCCNGCKSVYEILNTNNLSNFYELNKRAGIRPDENSSQFDYLDTPEIFEKVTDFSEGNTSLVTFKIPVIHCSSCIWLLESLHTLNDGIKYSQVNFTRKTLQVSFNHNDLKLSELAKFLTNLGYKPVISLETAEKNVDHLDKSLLVKLAIAGFAFGNGMFLAFPEYIGGEDYWMQHYKGLFRTLMFLLAIPVVFYSASDYYKSAWYGLKNKIVNIDVPIVLGIFVLFGRSIYEVATDYGPGYFDTLCGLLFFMLLGKTFQKRTYSALSYDRDYKSFYPIAVTKVDFDGKQDNILLSEVKVGDRILVRNQEIIPVDAILINGEGNIDNSFITGESESISKQPGDKIFAGGKQIGSSLELEVIKNVDQSYLTQLWNKEAFKKYETGLDTLTNNISKYFTFIILGIALISGIYWSFIDLEKMFQVVSAILIIACPCALALSAPFTFGHIMRILGRNKFYVKDTLTIEKIAKIDTLVFDKTGTITHRKKTNIKYE

SEQ ID NO: 231367 - protein, 81 aa, Glycine max
  Coding DNA Sequence Number=SeqID_114589
  Homolog annotation: Hit_ID=Q5FAM5; Match level="QueryCoverage=60%, HitCoverage=29%, E-value=1e-07, Identity=54%"; Hit description =Putative Basic helix-loop-helix(BHLH) family protein
MEIGGLGKVVLIELISSMPVVLAAREKDEVNLANIVIKKIQTGKLSELVDSSFGFESDQPASSSKVHPPQAAAHDSGELGI

SEQ ID NO: 231368 - protein, 224 aa, Glycine max
  Coding DNA Sequence Number=SeqID_114590
  Gene Ontology: Mol. function=protein serine/threonine kinase activity; Cellular component=integral to membrane; Biological process=protein amino acid phosphorylation
  Homolog annotation: Hit_ID=Q7XB99; Match level="QueryCoverage=98%, HitCoverage=46%, E-value=6e-33, Identity=35%"; Hit description =Transmembrane protein kinase
  Pfam annotation: Domain name=LRR_1; Domain location=113-135; Score =18.4; E_value=0.025; Accession=PF00560.23; Description=Leucine Rich Repeat
  Pfam annotation: Domain name=LRR_1; Domain location=17-39; Score =16.0; E_value=0.14; Accession=PF00560.23; Description=Leucine Rich Repeat
  Pfam annotation: Domain name=LRR_1; Domain location=41-63; Score=6.3; E_value=19; Accession=PF00560.23; Description=Leucine Rich Repeat
  Pfam annotation: Domain name=LRR_1; Domain location=65-87; Score=6.6; E_value=17; Accession=PF00560.23; Description=Leucine Rich Repeat
  Pfam annotation: Domain name=LRR_1; Domain location=89-110; Score =8.6; E_value=6.9; Accession=PF00560.23; Description=Leucine Rich Repeat
  Pfam module annotation: Pfam domain module=LRR_1::LRR_1::LRR_1::LRR _1::LRR_1; Domain location=113-135::17-39::41-63::65-87::89-110
MISISGNIPLEIGNLRKLQVLRIGDNMLTGEIPPSVANMSEFKVLALGYCHLNGSIPFGIGKLKHLISLNVQMNNINGHIPEEIEGCEELQNFSASNNMLEGDLPSFMGSLKSLKFLNLANNNLSGSIPTALSHLSNLTYLNLVAFQVTSASKVQSFSNFSWLETCSLASFPRSYSTAPQSNSWTFLITALKENFFPSWTNCRTSQILCSTTTALLDNCVTLEL

SEQ ID NO: 231369 - protein, 214 aa, Glycine max
  Coding DNA Sequence Number=SeqID_114591
  Gene Ontology: Mol. function=ATPase activity, coupled to transmembrane movement of substances; Cellular component=integral to membrane; Biological process=transport
  Homolog annotation: Hit_ID=Q1SEN8; Match level="QueryCoverage=61%, HitCoverage=64%, E-value=8e-41, Identity=46%"; Hit description =Cyclic peptide transporter
  Pfam annotation: Domain name=ABC_tran; Domain location=64-211; Score=- 57.0; E_value=0.019; Accession=PF00005.17; Description=ABC transporter
MASPILTAFIAGQAATFKMFETIKRQPDIDAYDTDIKLKKVCFSYTSRPDEQIFNGFSISIPSDTTAALVGQSGSEKSTIISLIERFYDPQAGEVLIDDGPIDEEIRVAAELANAAKFIDKFLRGLDTMVGKHIRTSTNLRGAMGYIAPKWLGNAPITAKVDKYSFGAKECTLLLVYVCDNTTLPLGELLSKQLHKNIQTMQQHQQSMHCNSHT

SEQ ID NO: 231370 - protein, 91 aa, Glycine max
  Coding DNA Sequence Number=SeqID_114592
  Gene Ontology: Mol. function=adenylate cyclase activity; Biological process=cAMP biosynthetic process
  Homolog annotation: Hit_ID=Q1SH04; Match level="QueryCoverage=86%, HitCoverage=39%, E-value=9e-23, Identity=70%"; Hit description =Adenylate cyclase
MRYMEHNEVLKSRSQDASRRRQRPPLCHHSTLALSRHHPPPVEPLLQWHRLRALRAPHCPLPPLLRLRRVLRRFAEGASGASGRREPRGGN

SEQ ID NO: 231371 - protein, 170 aa, Glycine max
  Coding DNA Sequence Number=SeqID_114593
MAFGGLVARPVELELAQADETETDYHCVHDELAADFEGHDGGCGRLQRSWQGLIATEWRRRRVERRRHFKEKMSLEEAHHHRKQWIRAWRERKRRARNLVGDDGELIKVDKEALLPRETSSSFWNGFINGLVIGIEFEFAWGLKRFLRPKAQLEAIARSFKEKSSTWISE

SEQ ID NO: 231372 - protein, 125 aa, Glycine max
  Coding DNA Sequence Number=SeqID_114594
  Gene Ontology: Mol. function=transcription factor activity; Cellular component=nucleus; Biological process=regulation of transcription, DNA-dependent
  Homolog annotation: Hit_ID=Q1T3Q6; Match level="QueryCoverage=92%, HitCoverage=56%, E-value=7e-22, Identity=50%"; Hit description=Helix- turn-helix, Fis-type; Transcription factor, K-box
  Pfam annotation: Domain name=K-box; Domain location=1-62; Score= -25.2; E_value=0.057; Accession=PF01486.8; Description=K-box region
MGEELSGLGIKELGNLENRLEMNLKDVHMKKDQILIDELKELHQKGSLFHQENVELNRKINFIRKENEKLQKKTSQPWTMETGNANLLLVLTAQCLEATGSNRENRLVVTVGLPQPTLRRYGEAR

SEQ ID NO: 231373 - protein, 271 aa, Glycine max
  Coding DNA Sequence Number=SeqID_114595
MDKSVTESEAELVICHKETSYNIIKDTWVDEGYPTKDKIFIRTKVDEKIYKIYSWNCENKETVKDNIGINVLNPLAKEEPDQSKDLMQQDEDATRKLADNVYNEIVVPEDKILLQKLDIKRSRTSGFEGDEIKQNHAKVASEPEFHSQSEKSKNEIEDAVLSSPASESNIDIHDTSSFLQENGSITHRFDHSASGTSGKEESSQVSDCNCGQTQNADVKSDDYGVTNQVHQRLCELSFSSIGYSGPLPFSGSISLRSDRSIDSTWSFAFPM

SEQ ID NO: 231374 - protein, 73 aa, Glycine max
  Coding DNA Sequence Number=SeqID_114596
MLTNPDTSYQEQAQEVSLVCIKNKLKRLALTDPLKLLQEHNKGLDQTYLREVAKEKKHKLLTILECDEHDAQS

SEQ ID NO: 231375 - protein, 69 aa, Glycine max
  Coding DNA Sequence Number=SeqID_114597
MEKKTERRRRQCEGDKTYLGMVAKKKKQRLVTMLECDEHDARVRRIRCSDADRDLEGRRRLEEEESAKA

SEQ ID NO: 231376 - protein, 118 aa, Glycine max
  Coding DNA Sequence Number=SeqID_114598
  Subcellular localization annotation: CTP_CleavageSite=26; ConfidenceScore=5.18e-01
MKRGWGMSFLHPKLPPPPRPHSRTPLLTETAGIATPKLPLLVFCFPFCTLIHSLQCLSCSIFANFMRQCMLEFTLVCLNWRVVWDGLRPNVGSEMVGNITLPPSPLSLIPMVCPPSAQ

SEQ ID NO: 231377 - protein, 94 aa, Glycine max
  Coding DNA Sequence Number=SeqID_114599
MNHKGILSFLFSDYNQEVMPTSCNEPKSALSPVITTKKLYPLLAMNPKAVSLLDLVINQEANPLLAMNPKAKGLSTDGSDRWMVLTNEKLNEVS

SEQ ID NO: 231378 - protein, 65 aa, Glycine max
  Coding DNA Sequence Number=SeqID_114600
MLISVWVDLDNTLSYEETQEEANFCLMADTTSEESVLDSNEEFLNDKLEKNDNLKGQPQDVVKLH

SEQ ID NO: 231379 - protein, 89 aa, Glycine max
  Coding DNA Sequence Number=SeqID_114601
MGDEVGQGWDGTIETVAFKAEAVELGEGGEVENGVGEVEVFKDEAGNMVVVVVVEVGDIVSGLLAVQRTTCFISLKVLVLANGTVLFVI

SEQ ID NO: 231380 - protein, 321 aa, Glycine max
  Coding DNA Sequence Number=SeqID_114602
MHGSRNQCLFEEKARKTKKRYANFENKSSGVVYAWGSSPSQARARQGELRLSHEATGSPRRAGYLTWKSYGGSGKPKASLGELGSKKFPKMILLPLPFGIFHTSDQNPTSKDQRSMNDSHRIKLGYDRDETETDYHYVHEELAADFEGHDGGCGRLQRSWQGLIAAEWRRRRVERRRHFKENMSLEEAHHHRKQWIRAWRERKRRARNLVGDDGELIKVDKEALLPRETSSSFWNSFIIGLVIGIEFEFAWGLKRFLRPKAQLEAIGRSFKEKSSTRRSELKYLGKHLCNCILYALNNPTLFLVLWIAHTLPMRDETRKTY

SEQ ID NO: 231381 - protein, 105 aa, Glycine max
  Coding DNA Sequence Number=SeqID_114603
  Gene Ontology: Mol. function=adenylate cyclase activity; Biological process=cAMP biosynthetic process
  Homolog annotation: Hit_ID=Q1SH04; Match level="QueryCoverage=74%, HitCoverage=39%, E-value=3e-21, Identity=67%"; Hit description =Adenylate cyclase
MEVEVKMHLANANAHCYVTTLLSPFHVIIHRQQNLFFNGTASELFMRRIVLCLRFYDYDKRCVALLKARAELVDSVSRVEEDPCCPPPERERESEKSERKREMQG

SEQ ID NO: 231382 - protein, 210 aa, Glycine max
  Coding DNA Sequence Number=SeqID_114604
  Subcellular localization annotation: CTP_CleavageSite=39; ConfidenceScore=5.43e-01
MASSSASSLKDLLSPQADSNSMAITKPIMKPFQKLEEVSLGSNTSLSTLISPPSSPSLQFSLSIASNIDMPLNHEGNCLGEKKEKLEIRKDNEERKLGKELEIIRMDYESYLEIKVGKKEMKDNKNNEFTPGKCFPPPISCLKKVKVGKPFKYVAYDKESETYVVEEIKIPEGSLFHATREEERLKLFADFLDKSHKRSRKDIQMMQIGG

SEQ ID NO: 231383 - protein, 125 aa, Glycine max
  Coding DNA Sequence Number=SeqID_114605
VVYKSKGETKDIELVEEEQARIGADSSNCSMHSEAEPLEHMKKRDTGHQSVSLENKTGDSTVLKIGNLAKVVIKQDMKGRRHKYGFNNNKREKTEKKRVVDDETGDKHQLDEVLRMPCTCVFLKI

SEQ ID NO: 231384 - protein, 126 aa, Glycine max
  Coding DNA Sequence Number=SeqID_114606
  Gene Ontology: Mol. function=translation initiation factor activity
  Homolog annotation: Hit_ID=Q6ZI51; Match level="QueryCoverage=51%, HitCoverage=15%, E-value=1e-08, Identity=48%"; Hit description =Putative eukaryotic translation initiation factor
MLSSLTNKKLNSIFSSHLRSWNVETLGNIRAWAVGSEQAKVEEAEAQAMTATMVVKPQRFPSLKEAVNSKPNKKKGTTITLSEFNHGGFDQGHMRPEMHTLPTGPKELSTEEMQFNRLGGDFSSYD

SEQ ID NO: 231385 - protein, 140 aa, Glycine max
  Coding DNA Sequence Number=SeqID_114607
  Gene Ontology: Mol. function=protein phosphatase type 2C activity
  Homolog annotation: Hit_ID=Q1SGM9; Match level="QueryCoverage=51%, HitCoverage=17%, E-value=2e-18, Identity=61%"; Hit description =Protein phosphatase 2C-like
MTDLVVATATATPTTTKVHGSEEVEDPTVDSTRSPGIRILRWWVMGSLHIQFLGSVVKLFDGHNGFSAAIYSKENLLNNVLSAIPPYLNRDEWIATLPRALVDGLVKTDKDFQEKGLDNSFLLVFALSIFCLRGNSCTST

SEQ ID NO: 231386 - protein, 454 aa, Glycine max
  Coding DNA Sequence Number=SeqID_114608
  Gene Ontology: Mol. function=nucleic acid binding; Cellular component= chromatin; Biological process=DNA integration
MNNAFLNGFLNEIVYMSQPPGFKASDPSLVCKLKRALYGLKQAPRQWGALLYLTITRPEISFAVANPLETHWAAVKHILRYLRGTVLYDLHLRPATLGQPYCRRALYDADWVSDIDDRRSTSVLMQISKPNPTTAEISWIKTLLTELKVPFRTPVIFCDNQSDVAPTHNLVLHARTEHMEIDIFFVRENVFTKQLVVHPIPALDQWANALTKPLSPTRFIFLRGKLNVVDTLIVSTFLSLRRVHHGGAGTTAAGLKAACPTTIVPFFGDQPFWGERVHVRGVGPPPIPVDEFSLPKLVDALKLMLDPKVKERAIELAKAMENEDGVTGAEDVLVVPDSNAVGLGWNRVRATRPNPHLGIRVETTLDDLNSKTTQDLGNPRWCAFPWRHWPMMRDRHRGGGDATKTRRKENRRKLANGPARRRDSMERSNITKGKKTKTEGRKNRRREEGERKGE

SEQ ID NO: 231387 - protein, 226 aa, Glycine max
  Coding DNA Sequence Number=SeqID_114609
  Gene Ontology: Mol. function=RNA-directed DNA polymerase activity; Biological process=RNA-dependent DNA replication
MLGQNLLSHKTTHQSPQVAKTKEQEAQMIWEIATNLGVTGIEKQGRIVEKLMQMEDRDQKEETKKESIGRSMCQAMWGDTTVSWEVQPAINSAGGMLCMWTENTFTLQRKVAGNGFICLTGLWIKEALQSKRVLWETIKQLKTANQGGQWCIMGDFNNIRDPVERMGVKGCRLGTKAIPGPGLLASRQIFQVNSEGMLAVPTAEWVGWIRVERKNKEVEGKAEDME

SEQ ID NO: 231388 - protein, 77 aa, Glycine max
  Coding DNA Sequence Number=SeqID_114610
MAMNMTEGNKSRSERRMWWLGKDVWGLLSTGSWTTPMVSGAGKAWETELAGAADVAPEMAEVAVESMAESTAKAVMV

SEQ ID NO: 231389 - protein, 184 aa, Glycine max
  Coding DNA Sequence Number=SeqID_114611
MSTDEVLEQEMKKAKKEELSRKRFQGALLDSSNELKLRKAERDKSMMENVMLKDELRNYRESKESLKEQLTKTEKDMLITIYQYKEKENLAAINGQVLRDEQAKVSALRVEKEAREEVIELLHEESMKWMDKFALTLNESQEFLKLLAKAQVMADVYSTPDEVHSLFYKYQHMIELMTCIIKNR

SEQ ID NO: 231390 - protein, 115 aa, Glycine max
  Coding DNA Sequence Number=SeqID_114612
MEMQRKTKERRYTPPPFMEELTEEHCREKVLPNMGKTSPSTTIPSMVVNDDNTNVANQGKPPQGQASNMFGMRTIRAPKNGSPTTVVNILFQGRDNHALIVAQQQEMNTLKQKNA

SEQ ID NO: 231391 - protein, 64 aa, Glycine max
  Coding DNA Sequence Number=SeqID_114613
MEANLPHGCNKLIIDLYDKLSDLDEHVDTLVTQMNLFMNDDAVILCKKSSTTLDELRARATRFI

SEQ ID NO: 231392 - protein, 141 aa, Glycine max
  Coding DNA Sequence Number=SeqID_114614
  Gene Ontology: Mol. function=RNA-directed DNA polymerase activity; Biological process=RNA-dependent DNA replication
  Homolog annotation: Hit_ID=Q1S4V6; Match level="QueryCoverage=90%, HitCoverage=20%, E-value=2e-13, Identity=27%"; Hit description =Ribonuclease H
DTSNERRVQWVSWESLCLPKELRGLGLRQARHVNDAFILKVAWELCTTDDALWVQVIRSKHGCSGRGFPVGNLSYGCGILFWLQNWIPELGPLVEFATRELNGKDLTKTITELVVHEGGSNSDYLGSSLMRTLKLKDPHKN

SEQ ID NO: 231393 - protein, 110 aa, Glycine max
  Coding DNA Sequence Number=SeqID_114615
MDVENIAWSASDIFGVTQRVQTWSANGPKACGGIIRDHKDMFHGAFSWRIKTCPVLNVELWAIFHGINMAKERGFKDPSDHQKVIVDAIKASILPHTRDHFAHVYRYCNK

SEQ ID NO: 231394 - protein, 59 aa, Glycine max
  Coding DNA Sequence Number=SeqID_114616
MECESTIRVSKESSKEEDDLLRRSNMKVKRKADEGENPLEMEEALEMFSRGQSVGEENR

SEQ ID NO: 231395 - protein, 256 aa, Glycine max
  Coding DNA Sequence Number=SeqID_114617
MGKGGVKGKVNGGNARNSTNDHVMHDEADMKWVVPELSNKNDTKGNKNQNGASTLGPKQGVDEAKKDSSLNNLDMIHALHNTKSGFMFSAKFINNNSGKSMFILDEETMRLIQVKTKILLKRGSSSLPPDGKGSEVVVIKEMSVSYAMETNVVSVANAMKIEVVVQNKTRATRPDKSRGLWCLRNPNLWRVKVLEEAAQILHLEESKRIGGTESLNHKGRRAFREVMDYCHMLDAAWLTQPELRMVVDGNWKKDEE

SEQ ID NO: 231396 - protein, 123 aa, Glycine max
  Coding DNA Sequence Number=SeqID_114618
  Subcellular localization annotation: CTP_CleavageSite=82; ConfidenceScore=5.40e-01
MYDSYPSSEGKRVFSLFFLGPSSHRPAFGSPGPPNNFKAKGLARLGELIASRLSFRGGLLPINRHPRGFLRGSKGQRWRELREERKKNKKEEETKLRRYQIASAIIPCVVFLFRALRATVDWF

SEQ ID NO: 231397 - protein, 46 aa, Glycine max
  Coding DNA Sequence Number=SeqID_114619
MDKNIISDLDNFPEEDKQRMSTMADQLQIRDSCIEMFMFIGAFLVR

SEQ ID NO: 231398 - protein, 80 aa, Glycine max
  Coding DNA Sequence Number=SeqID_114620
MPEPGAPSTSARPAVEEPRHAVEVCHRIAKRLERHLSLGVVTPGLSTHEVIEECLRMARSVTQDQLLYVRSRRRQRTDQA

SEQ ID NO: 231399 - protein, 136 aa, Glycine max
  Coding DNA Sequence Number=SeqID_114621
  Gene Ontology: Mol. function=catalytic activity; Biological process =cellular metabolic process
  Homolog annotation: Hit_ID=Q1T6L3; Match level="QueryCoverage=97%, HitCoverage=53%, E-value=3e-55, Identity=67%"; Hit description =Ribosome-binding factor A
MAPSFDQSASTVCVMDASGNEQLNGISADPNRLKIFHLDPFDYHSITDALRGCSGLFYVFEPPQDQPYYDEYIADVEVRAAHNVIEACAQTETIDKVVFTSSATAVVWREDRKAMESNMDEKHWSDINFCRKFKSK

SEQ ID NO: 231400 - protein, 107 aa, Glycine max
  Coding DNA Sequence Number=SeqID_114622
  Gene Ontology: Mol. function=dihydrofolate reductase activity; Cellular component=nucleus; Biological process=one-carbon compound metabolic process
  Homolog annotation: Hit_ID=P51820; Match level="QueryCoverage=55%, HitCoverage=11%, E-value=5e-26, Identity=88%"; Hit description =Bifunctional dihydrofolate reductase-thymidylate synthase (DHFR-TS) [Includes: ...
  Homolog annotation: Hit description=Dihydrofolate reductase (EC 1.5.1.3); Thymidylate synthase (EC 2.1.1.45)]
  Pfam annotation: Domain name=Thymidylat_synt; Domain location=1-107; Score=-150.3; E_value=0.059; Accession=PF00303.9; Description =Thymidylate synthase
MEALEVGGVVVVVVASEEAEKKQSSLPPEKKSLSWSSVKKLRLVKKWDAHVYHNHVRPLQEKLHNQPKPFPTLEINPKMKDIDSFVAVDFKLIGYDPHQKIDMKLAV

SEQ ID NO: 231401 - protein, 66 aa, Glycine max
  Coding DNA Sequence Number=SeqID_114623
MDNHQNGNHTDPAQARMNRKRIRQYKVDDLAQNIHSNVSDSLEDEGSKSTQGFASVSLPENQNCMS

SEQ ID NO: 231402 - protein, 464 aa, Glycine max
  Coding DNA Sequence Number=SeqID_114624
  Gene Ontology: Mol. function=protein binding; Cellular component =integral to membrane; Biological process=protein amino acid phosphorylation
  Homolog annotation: Hit_ID=Q949G9; Match level="QueryCoverage=87%, HitCoverage=86%, E-value=2e-59, Identity=32%"; Hit description =HcrVf1 protein
  Pfam annotation: Domain name=LRRNT_2; Domain location=64-104; Score =48.4; E_value=2.4e-11; Accession=PF08263.3; Description=Leucine rich repeat N-terminal domain
  Pfam annotation: Domain name=LRR_1; Domain location=155-180; Score =11.1; E_value=2.4; Accession=PF00560.23; Description=Leucine Rich Repeat
  Pfam annotation: Domain name=LRR_1; Domain location=182-204; Score =16.5; E_value=0.094; Accession=PF00560.23; Description=Leucine Rich Repeat
  Pfam annotation: Domain name=LRR_1; Domain location=206-231; Score =11.6; E_value=1.9; Accession=PF00560.23; Description=Leucine Rich Repeat
  Pfam annotation: Domain name=LRR_1; Domain location=233-255; Score =14.0; E_value=0.54; Accession=PF00560.23; Description=Leucine Rich Repeat
  Pfam annotation: Domain name=LRR_1; Domain location=257-278; Score =4.3; E_value=44; Accession=PF00560.23; Description=Leucine Rich Repeat
  Pfam annotation: Domain name=LRR_1; Domain location=308-329; Score =10.0; E_value=3.8; Accession=PF00560.23; Description=Leucine Rich Repeat
  Pfam annotation: Domain name=LRR_1; Domain location=334-356; Score =5.8; E_value=23; Accession=PF00560.23; Description=Leucine Rich Repeat
  Pfam annotation: Domain name=LRR_1; Domain location=358-383; Score =4.7; E_value=38; Accession=PF00560.23; Description=Leucine Rich Repeat
  Pfam annotation: Domain name=LRR_1; Domain location=385-407; Score =14.7; E_value=0.33; Accession=PF00560.23; Description=Leucine Rich Repeat
  Pfam annotation: Domain name=LRR_1; Domain location=409-431; Score =11.4; E_value=2.1; Accession=PF00560.23; Description=Leucine Rich Repeat
  Pfam annotation: Domain name=LRR_1; Domain location=433-455; Score =12.9; E_value=1.1; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1; Domain location=64-104::155-180::182-204::206-231::233-255::257-278::308 -329::334-356::...
  Pfam module annotation: Domain location=358-383::385-407::409 -431::433-455
MKVKKKTGQGSSINNRSLMIYMQNQQLHLFSIYSCVIMNSSSIYILVFVQLWLLSLPCRESVCIPSERETLFKFKNNLNDPSNRLWSWNHNNSNCCHWYGVLCHNVTSHLLQLHLNTTFSAFEYHYDYHYLFDEEAYRRWSFGGEISPCLADLKHLNYLDLSGNYLLGEGTSIPSFLGTMTSLTHLNLSHTGFNGKIPPQIGNLSKLRYLDLSGNYLLGGGMSIPSFLGTMTSLTHLDLSYTRFMGKIPSQIWNLSNLVYLDLAYAANQTIPSQIGNLSNLVYLGLGGDYVVEPLFAENVEWLSSMWKLEYLHLSYANLSKAFHWLHTLQSLPSLTHLYLYGCTLPHYNEPSLLNFSSLQTLHLSDTSYSPAISFVPKWIFKLKKLVSLQLSYNEINGPIPGGIRNLTLLQNLDLSGNSFSTSIPDCLYGLHRLKSLDLSSCDLHGTISDALGNLTSLVELDLS

SEQ ID NO: 231403 - protein, 234 aa, Glycine max
  Coding DNA Sequence Number=SeqID_114625
  Gene Ontology: Mol. function=transporter activity; Cellular component= integral to membrane; Biological process=transport
  Homolog annotation: Hit_ID=P96064; Match level="QueryCoverage=89%, HitCoverage=85%, E-value=2e-62, Identity=56%"; Hit description=PhnU
  Subcellular localization annotation: CTP_CleavageSite=36; ConfidenceScore=5.24e-01
MDPAAAAGAGDAVFLSAGADRQTGVYRRSGAVQRRRAAAGVRIPTLCRRPAQHAADCAAGDAGLPGARHPAVAAAGVHAVPRQPADRLGDRYLYRHADLPDHLGLHLYLRLRRPAERYADGDLRFYSAAGRLSLLHLGRDPGGNHRVYAAGNASADGGAVADRSQPARSRQHPRRPAGARGAPGRHHAADDGLLQSDSGVGLCRRLRDRRRDIALSLGLFSLYRYAAARAGLRN

SEQ ID NO: 231404 - protein, 89 aa, Glycine max
  Coding DNA Sequence Number=SeqID_114626
MGDEVGQGWDGTVGTVAFKAEAVELGEGGEVENGVGEVEVFKDEAGNMVVVVVVEVGDIVSGLLAVQRTTCFISLKVLVLANGTVLFVI

SEQ ID NO: 231405 - protein, 270 aa, Glycine max
  Coding DNA Sequence Number=SeqID_114627
MQEEEERPLIRKRKLPTTSTKSADQTEAGNSQAQMPKKKKKVKQVEPEPSVAAEGGEPAKKKKKKTKSSKEQGDNQPVDVQPPSPDIDGTEVETAPPIAEMGNPVDQPDSPQEQPAVEVQQNVSAEEIPSCARTSPAPEADAVNVEEWGEGQGIGSSSPHGWAEVDDHHEPNQSDNTIPHESSQKSSSEGNFFDEDAIKEAEAGGSDIYPVSSTSKLSASIGIAEDTFIQMQNEDPAAALRLLLNTSQANTSSDKNPGASDPSDAEINSS

SEQ ID NO: 231406 - protein, 111 aa, Glycine max
  Coding DNA Sequence Number=SeqID_114628
  Subcellular localization annotation: CTP_CleavageSite=20; ConfidenceScore=5.30e-01
MGRKISSQQGRRSSATRTPSTGSKSALATTTLEPLSTFFISFIVLLHTPPILGFCFCFMEHSHSITEHIQVMDVPLLLDKLALDLINNEPSLANTSKHTQKKANQRQPLRG

SEQ ID NO: 231407 - protein, 78 aa, Glycine max
  Coding DNA Sequence Number=SeqID_114629
MIDGGAKPNARPQCHQSKAPKHNAGTNRGVGAEEEDNGARRSRATQEELKKNSHVREEKWGGAGCRREMGRRWDICAA

SEQ ID NO: 231408 - protein, 182 aa, Glycine max
  Coding DNA Sequence Number=SeqID_114630
MKLSLFNPVWSIIIKRQRSKSRCQVQKPKKFHEQRPEDSYEEGLEDDNLEDEYLKDFLESRPKLKGTAERPPKHLVMPPKSPGRVELNENHHIKRPKPIGTENITFNREENEETLTLKLQVLAVEIGTIASESAADYKGGVSQNLEDSHFDFTRCQGDKLIASLGNFFNTLKHLRDTPQECN

SEQ ID NO: 231409 - protein, 77 aa, Glycine max
  Coding DNA Sequence Number=SeqID_114631
MDSKAIIRNLHRKPPNLTATINPSLALDVLNNAIISDTVEAYVASFMQGQGPCITALLADSVTHARIGATREGTVRQ

SEQ ID NO: 231410 - protein, 91 aa, Glycine max
  Coding DNA Sequence Number=SeqID_114632
MDGDQWMYDSIMSEKVDMDDQNEQEFGVNEPHVDCSNAFNTSQVFGTRDDVLQWAQSIAHENGFVAVIIRSNTHTGSKGRTSFVLIGCERS

SEQ ID NO: 231411 - protein, 72 aa, Glycine max
  Coding DNA Sequence Number=SeqID_114633
MPYQKRKTLDEASLLSSESETQHNHRLTSTPYVLHRPGLIRQALKSVVFHLLAKPISWLSERLLSATLMGKA

SEQ ID NO: 231412 - protein, 111 aa, Glycine max
  Coding DNA Sequence Number=SeqID_114634
  Subcellular localization annotation: CTP_CleavageSite=71; ConfidenceScore=5.35e-01
MEKVAWPGAQPSLMREGGGCSNSASASDRASSIKRATMDLSTRISGFRLSACFSRSADGWKRSSFFQILPRAQSRSVVLSGWLAKLEDWLSEQMKISTSQTCLINMKLGGN

SEQ ID NO: 231413 - protein, 136 aa, Glycine max
  Coding DNA Sequence Number=SeqID_114635
MENVFVVVYCDGDILSSSEGILFECPSGPKVVIISEDMSLDALRKTIMDAIGDCKIYIDFFTANMFMQVMVVLNASEREINKIQFALASKSSLHLVDSLPVAAQAVAVLGWAVNIYARPRGGCLSSGGMTWGWETL

SEQ ID NO: 231414 - protein, 506 aa, Glycine max
  Coding DNA Sequence Number=SeqID_114636
  Gene Ontology: Mol. function=DNA binding; Cellular component=nucleus; Biological process=regulation of transcription
  Homolog annotation: Hit_ID=Q2LMF2; Match level="QueryCoverage=98%, HitCoverage=95%, E-value=1e-131, Identity=49%"; Hit description=MYB4
  Pfam annotation: Domain name=Myb_DNA-binding; Domain location=109 -155; Score=55.2; E_value=2.1e-13; Accession=PF00249.21; Description =Myb-like DNA-binding domain
  Pfam annotation: Domain name=Myb_DNA-binding; Domain location=161 -206; Score=49.9; E_value=8.3e-12; Accession=PF00249.21; Description =Myb-like DNA-binding domain
  Pfam annotation: Domain name=Myb_DNA-binding; Domain location=57-103; Score=49.6; E_value=1.1e-11; Accession=PF00249.21; Description=Myb -like DNA-binding domain
  Pfam module annotation: Pfam domain module=Myb_DNA-binding::Myb_DNA -binding::Myb_DNA-binding; Domain location=109-155::161-206::57-103
  Subcellular localization annotation: CTP_CleavageSite=73; ConfidenceScore=5.28e-01
MAEEKSEQHCSENKQTNANSSSSVSEGSGSAMPKSSTERKSALPSNRRTTGPVRRARGGWTEEDDDTLTNAVQVFNGKNWKKIAEFLPGKSEVQCLHRWQKVLHPELVKGPWTQEEDDKIIEMVSTHGPKKWSLISKSLPGRIGKQCRERWCNHLNPDIKKDPWTQEEELALMDAHRIHGNKWAEIAKVLHGRTDNSIKNHWNSSLKKKMNFYLATGRLPPIVSSSKTTDINLGNSDKNQLESSETVREFGDSSNVPAKGSADSDCIECNRSSNKGFSCSNLEPVFGDYFRINSEPKFENPGLNDNPRVDHCMSNGENKSCSLTRNFYSKESQTLGSFCYEPTLPLDSYYSNISGLQQNELFASPMMSSVGYLTPPPVKGSELCSESPESILKKAAKTFPTPSILRKRSVVKRPVTPSAVAKGVNDSHAYNEQERTNDITGSEVVRLPVSPVNNCYGSNIPHNKAFNTTSPYRSRSRQTAIKCLEKQLDFAFEKEKHARKMKKCDD

SEQ ID NO: 231415 - protein, 76 aa, Glycine max
  Coding DNA Sequence Number=SeqID_114637
MAFIIWRTGVAEGVAAHPDADFVESLEIIIIIGEDAGAASSSEEDGSATRDGGSVGTGSTCAGVGSGGAASPGLTC

SEQ ID NO: 231416 - protein, 522 aa, Glycine max
  Coding DNA Sequence Number=SeqID_114638
  Homolog annotation: Hit_ID=Q2QNC7; Match level="QueryCoverage=91%, HitCoverage=57%, E-value=1e-15, Identity=23%"; Hit description =Expressed protein
MARDANCSSGSAQGQNQNEIKHFKNLKQKIEHVTGESRKEKLRVTMDAVIDKLPQGHEISNDLKKEFFKKLTNSNMTREGEYCPERCNGNDHSTPLFTKHGKHNIRRILSLQEPLEIYYQLHENSFNVEPNELQSKQLKLRSEKAHSPLRMFSLPLQRMLSLPNLQSFSFAYQNGEFPDISSVTEPKPIMVSGDGTMKSDIVAPQTKRLHLNLHSKGQLPLDTPVENLIQKHLVSVGENGLVITDIVEPGSDCSCEINGKVIMTTDDFGHSYSKNGGTFNDQDIETIKEYMTTITSDSKLNMRPGDRLDNMAEQQESIMDSVKVKETTENAKKMEIQSKQLNYGIPLVDINNKDKAEFNYVKYILEISGLIGKDSISAWHSSDHPVDPLLYEEMEGDPDFCNYGGSGQCNHHVLFDLINETLLELSGRSYCYCSIPLSSSLPYTHPISKGCHPLHQVWTHMRKSLCLRSEVGLTIDDHVSRDLARLDGWVNPQLFAQCVSLELEDLILHDLLEEITCDLACI

SEQ ID NO: 231417 - protein, 106 aa, Glycine max
  Coding DNA Sequence Number=SeqID_114639
MVPNKAYIRLPMCDEGKKKGFKLYFNKEMPSRVTILSHGESKGCACRNLPFCGRARRGSRVDKSGALAPTYPPPKRKSDLRSSFKRGESSDSFYLEGGHLRRWTLK

SEQ ID NO: 231418 - protein, 138 aa, Glycine max
  Coding DNA Sequence Number=SeqID_114640
MSDLHKFVLFHLMDKIPFDLPHTIYINILRNMKTLGGVDEIYYAALINKLLWEYEVFHVFERMDEDSKQAIINKGTFIARQQHFSAINLKAMKTRLYKPLALLKRYKGFLGSRRARSKPGSKPNNKRKKKKLSPRSNQ

SEQ ID NO: 231419 - protein, 158 aa, Glycine max
  Coding DNA Sequence Number=SeqID_114641
  Gene Ontology: Mol. function=RNA-directed DNA polymerase activity; Biological process=RNA-dependent DNA replication
MDQISCQPLRTTTTHLIDPELLTETMREYFGIQLRPMARPMCKKLYLEWVNRTMPLPEGVAFTWYSNLPLNLVQNWDDMERCFHDRFYRPLPKVTIADLMNMRQIVKESTIDFKERFKKAKSRCSVQLPEIECTAMAVGNMHPQLKEKLVAQEYSDLS

SEQ ID NO: 231420 - protein, 105 aa, Glycine max
  Coding DNA Sequence Number=SeqID_114642
MGDQEEIQEQMKADMSALKGQMASMMDAMLGMRQLMENNVATAVAVSSAAKADPTLPATAHHPLPNVVAYPYGLPPNYTPLVMRDDAGHVPSPILEGEPPRQSDE

SEQ ID NO: 231421 - protein, 462 aa, Glycine max
  Coding DNA Sequence Number=SeqID_114643
  Gene Ontology: Mol. function=chitin binding; Cellular component =extracellular region; Biological process=chitin metabolic process
  Homolog annotation: Hit_ID=UPI00006A17C9; Match level="QueryCoverage =95%, HitCoverage=100%, E-value=1e-50, Identity=31%"; Hit description= UPI00006A17C9 related cluster
RTARPHHQKSARPSLQRTTRHSPSEGCTPSPSEDYTSSPSEGSKVLACRGLHVQAIRGLHAITFRGLHVHAIRGLHAFAIRGLHVLAIRGLHALTFRGLHVLAIRGLHVLAKRELHVLAIKGLHALTFRGLHVLAIRGLHALTFRGLHVLSIKGLHALTFRRLHVFTIKGLQHLAFRDLHVLAIRGLHALSFRGLHLHTLAIRELHILAITGLHPLTLRRIHVLAIRELDVLASRRLHALTFRGLHVLTIKGLHALSYRALHVLAIGGLQTLTFRGLHVLASRGLHTLIFRGLQVLAMRGLHALTSRGLHVLTIRGLHAFTFRGLHVIAIRGLHTLAFRGLHVLAIRGLHPLTLRGLHVLTIRGLHTLTLTGLRVLAIRELDALTFRGLHVLIIKRLHALIFRGLHVLAITGLQALTFRGLHVLAIRGLHTLAFRGLHVLAFKGQHVLTIRGLHALNFRGLH

SEQ ID NO: 231422 - protein, 104 aa, Glycine max
  Coding DNA Sequence Number=SeqID_114644
MATLGLEICVESASSVILKMILSFDLAFALIPLLKFSSSKVTSSTSIEEPYLPTTTGARATVVETSKNNDGVLTTDVDILQETKQIRVLCIPDVDMDNNNDESC

SEQ ID NO: 231423 - protein, 93 aa, Glycine max
  Coding DNA Sequence Number=SeqID_114645
ILSVSSSSHTFKGGEVEAGGGEGASNCNGNSKAAAFKGGSVEDTVAAFFQSLLLLIQENGERAFPATSLAASSQSLGSMFNNLLLATTDSLNS

SEQ ID NO: 231424 - protein, 357 aa, Glycine max
  Coding DNA Sequence Number=SeqID_114646
  Gene Ontology: Mol. function=binding; Cellular component=nucleus; Biological process=protein kinase C activation
  Homolog annotation: Hit_ID=Q1SZI6; Match level="QueryCoverage=87%, HitCoverage=68%, E-value=8e-94, Identity=38%"; Hit description =Tetratricopeptide-like helical
  Pfam annotation: Domain name=PPR; Domain location=11-45; Score=9.0; E_ value=0.64; Accession=PF01535.11; Description=PPR repeat
  Pfam annotation: Domain name=PPR; Domain location=143-177; Score =41.6; E_value=2.6e-09; Accession=PF01535.11; Description=PPR repeat
  Pfam annotation: Domain name=PPR; Domain location=77-111; Score=9.8; E_value=0.51; Accession=PF01535.11; Description=PPR repeat
  Pfam module annotation: Pfam domain module=PPR::PPR::PPR; Domain location=11-45::143-177::77-111
MESKGVSPDVYSMNSVLHACACSNSLDKGRDVHNYIRKDNMTLRFPVSNGLMDMYAKCGSMEKAYLVFSQIPVKDIVSWNTMIGACGSLAALEIGRGIHGRILRNGYSSELHVANALIDMYVKCGSLVHARLLFDMIPEKDLITWTVMIAGYGMHGFGNEAIATFQMMRIAGIKPDAITFPSIFMLAVILDYSIRDLLARTGNLLKAHSFIETMPIKPDATIWGALFCGCRIHHDVELAEKVAEHVFELEPDNTGYYKLAMAFGILNFPSGRTISVTKNLRVCDDCHEMAKFMSKTTRREIIVRGSNRFHHFKDGFCSCRDFWGSLIGVEKQYAYMENRLSEYCNWGRQRGEALSLP

SEQ ID NO: 231425 - protein, 835 aa, Glycine max
  Coding DNA Sequence Number=SeqID_114647
  Homolog annotation: Hit_ID=Q6DXT5; Match level="QueryCoverage=22%, HitCoverage=46%, E-value=6e-55, Identity=64%"; Hit description =Putative leucine-rich repeat family protein
MEPENELEAKERFLSEIRSPMEGGISPAREGNAAFEAVVGEIDVSEVGVEVAGEGSGEVGVGDGEGFELGHAGEDDEGAGGLDVDVGDGEVGEVQEVGEPDAGEFAEAVDAGEGGEGEGEVDGEADGGDGAVEEGEGLEGGEGLEGGEGEGEVGGAVGQAEGDEVAEGLGGVAEGGIVEGGCWDWEVEVHIPNKVNKKIQQLRKKREVSSDTLGFAVHFQTSKLQRMMKKNQSKQVNSLTTTRYPFLESPKEYDFDGFGEDFSSPSYSPLCHGKQGEGDSHESLFHKGKHAVDGVSPCPESAGTSTIVAEDLPSNSKGLMHSANESISVPLSNFKVSPLKLPITELPSAKNTSQNQSSKNLGESDSDVDSPCWKGTMAFCLTPIENSGSIQISNVEKATEKHNSLNPLAPQFFPGIGYVKDDFGSSISCTPVATNLLSGEDMLIKTVMAESPVEPRKGIELQSSSNTCGREKAFNMFNNPKNSSVDPVLNLHCMVTQSSSKEDCSISNGKLETVVDVDNFVKGTKDSRVCNAFPAKGHFPFPTQAALSSGVNAVPDPLKTFEGLSKTLIKSPKPDVGTIVSAIHVLSELLVQTSMDGVDSNSEHGHDEIMIQQIINNLNDFSTKRCGLRIPTLDSTPTDNPFGPDRSLEGSKSGQRFLASSSEHQDKGNEIAQVIRRSLGKTLHFDKHMHPEASLFLNLWLDSEAERCYRKYKTYHCLMEAGLDVNCTTVADVRLHARHMKTVSTVDSDKGKFQFSAYTFYAFSTISLGVHTDNHDLLFLVQLNDESGNPIWKHRVESWKENDNKKRKKKVAPKAENETPIPPEQQMEGMQLSSM

SEQ ID NO: 231426 - protein, 211 aa, Glycine max
  Coding DNA Sequence Number=SeqID_114648
  Gene Ontology: Mol. function=methyltransferase activity; Biological process=metabolic process
  Homolog annotation: Hit_ID=O80543; Match level="QueryCoverage=99%, HitCoverage=70%, E-value=6e-77, Identity=68%"; Hit description =Uncharacterized protein At1g22800
  Pfam annotation: Domain name=Methyltransf_11; Domain location=18-96; Score=22.8; E_value=0.00031; Accession=PF08241.2; Description =Methyltransferase domain
MVDSLTRPSSSHRRSKSLGPLAGGVEKLIVMDASYDMLQACKNAHHNATVETHFLVADEDSVDLVVSCLGLHWTNDLPGAMIQSRLALKPDGLFLAAILGGETLKELRIACTLAQMEREGGISPRVSPLAQAYAGNLLTRAGFTLPGVDVDDYVVKYESALELIEHLRAMGETNALYQMNNILKRDTALATAAIYDSMFSAEDGTVPATFQ

SEQ ID NO: 231427 - protein, 131 aa, Glycine max
  Coding DNA Sequence Number=SeqID_114649
  Homolog annotation: Hit_ID=Q9SZM0; Match level="QueryCoverage=42%, HitCoverage=3%, E-value=5e-16, Identity=75%"; Hit description =Guanine nucleotide-exchange protein-like"
MVYLEHCLLPRVNAYSRIVNGLLKTALGPPTGSTTALSPAQDITFRHESVKCLVSIIKSMETASHFFFCSAKITYYIKDEYQRQSSTDKRWEVLWIALSLIIWNHRNSLVFNNQPSNPKKVMDEALFHTWS

SEQ ID NO: 231428 - protein, 227 aa, Glycine max
  Coding DNA Sequence Number=SeqID_114650
  Homolog annotation: Hit_ID=Q6DXT1; Match level="QueryCoverage=82%, HitCoverage=31%, E-value=7e-48, Identity=53%"; Hit description =Putative growth regulator
MGKQGSHKSLRPEFQGWHSKTLLLHGLKSDSSKCSYCRGLYVGKKHIRAIVVMFGLLGCLFLLDSLIISYFEFTNLQPSTASNNSIVFQGRDSYIYSKRSPVYMYERLLNLASSALAEKEFKQESSNLWVETFRQASLWKPCSERKTQTNPRKPVQNNGYILVSANGGLNQQRVAICNAVAVASLLNATLVIPKFLYSNVWKDPSKSFHLFTSVDLDVNAETLINVI

SEQ ID NO: 231429 - protein, 326 aa, Glycine max
  Coding DNA Sequence Number=SeqID_114651
  Gene Ontology: Mol. function=nucleotide binding; Cellular component =microtubule; Biological process=defense response to fungus
  Homolog annotation: Hit_ID=Q9SDX4; Match level="QueryCoverage=86%, HitCoverage=30%, E-value=1e-145, Identity=92%"; Hit description =Dynamin homolog
  Pfam annotation: Domain name=Dynamin_M; Domain location=105-321; Score=-139.7; E_value=0.0068; Accession=PF01031.10; Description =Dynamin central region
MDESLVSEYAEHNDAILLVIVPAAQAPEIASSRALKYAKEYDGEGTRTIGIISKIDQAASDQKALAGVQALLLNQGPAKTSDIPWIALIGQSVSIATAQSGSAGSENSLETAWRAESESLKSILTGAPPSKLGRIALVDALAHQIQNRMKLRLPNLLSGLQGKSQIVQDELARLGESMVTTSEGTRAIALELCREFEDKFLQHITTGEGAGWKIVSCFEGRFPDRMKQLPLDRHFDINNVKRIVLEADGYQPYLISPEKGLRSLIKGVLELAKEPSRLCVDETAIIEEGRIGNNMNVHVIEHNRILGWKEIVGDGMQLGRNGLMGI

SEQ ID NO: 231430 - protein, 740 aa, Glycine max
  Coding DNA Sequence Number=SeqID_114652
  Gene Ontology: Mol. function=protein-tyrosine kinase activity; Cellular component=large ribosomal subunit; Biological process =protein amino acid phosphorylation
  Homolog annotation: Hit_ID=Q1SMM2; Match level="QueryCoverage=46%, HitCoverage=99%, E-value=1e-139, Identity=72%"; Hit description =Protein kinase; Ribosomal protein S2
  Pfam annotation: Domain name=LRR_1; Domain location=138-160; Score =16.6; E_value=0.093; Accession=PF00560.23; Description=Leucine Rich Repeat
  Pfam annotation: Domain name=LRR_1; Domain location=162-185; Score =4.3; E_value=45; Accession=PF00560.23; Description=Leucine Rich Repeat
  Pfam annotation: Domain name=LRR_1; Domain location=189-209; Score =9.2; E_value=5.5; Accession=PF00560.23; Description=Leucine Rich Repeat
  Pfam annotation: Domain name=LRR_1; Domain location=211-232; Score =23.7; E_value=0.00065; Accession=PF00560.23; Description=Leucine Rich Repeat
  Pfam annotation: Domain name=LRR_1; Domain location=235-256; Score =12.6; E_value=1.2; Accession=PF00560.23; Description=Leucine Rich Repeat
  Pfam annotation: Domain name=LRR_1; Domain location=258-280; Score =17.0; E_value=0.067; Accession=PF00560.23; Description=Leucine Rich Repeat
  Pfam annotation: Domain name=LRR_1; Domain location=282-305; Score =8.5; E_value=7.3; Accession=PF00560.23; Description=Leucine Rich Repeat
  Pfam annotation: Domain name=Pkinase; Domain location=461-730; Score=- 8.4; E_value=4.6e-08; Accession=PF00069.15; Description=Protein kinase domain
  Pfam annotation: Domain name=Pkinase_Tyr; Domain location=461-730; Score=22.6; E_value=7.4e-14; Accession=PF07714.7; Description =Protein tyrosine kinase
  Pfam module annotation: Pfam domain module=LRR_1::LRR_1::LRR_1::LRR _1::LRR_1::LRR_1::LRR_1::Pkinase::Pkinase_Tyr; Domain location=138 -160::162-185::189-209::211-232::235-256::258-280::282-305::461 -730::461-730
MTPFFLLHYHYNRELSHFTNNYIPPSVPFFSLFAFFLSIHTHHWGIIGTRHCNGGVKKMKPCCTFFILLSLVVILVESSCKNEDHELVSKAFQSVSGFNSSWFETGSNCSNAVIKGINLSSKNLSGNISWKYLRNMSKLEVLDLSGNFLQGQVPNWFWRSSTLLVVNLSSNRFGGSINPATSQNSSFSSLQNLNLSHNRFTNQLHLSGFSNLKSLDLSHNNLGTLPSGFQNLTTNLHHLDLSNCNIKGNVKPISSLTKLSSLDLSNNTLNGSFPSDFPPLNNIKFLNISHNNFKASTTLDRFIKFGKSAFIHAGNNFNYYNASKTPKLRSTPTPTPPHQQPHHIHAKKKKRPKEKQKSKHKTRTMMIVASALVVVVALCMCWVWCCRRKRQLAKRSKWAISKPVPLSMKIMEKSGPFAFETESGTSWVADLKEPSSAAVVVFEKPLMKLTFVDLLAATSHFGKDSLLAQGRCGPVYRAVLPGDIHVAIKVLENARDVHHHDAVALFVDISQLKHPNLLPLSGYCIAGKEKLVLYEFMSNGDLGRWLQELPTGETNVEDWSGDTWDIIHNGAVSRASPPEKMGWLIRHRIAVGVARGLAFLHHAGSRPVVHGHLVTSNVLLGDDFEPRIADFGFRKLGRESAAANCSTETDVYCFGVVLMELLTGKAGTAETVVWVRKAVREGHAVRTLDERLKLGGDSESEMVESLRVAYLCTAESPGKRPTMQQVLGLLKDIHPSHGLD

SEQ ID NO: 231431 - protein, 512 aa, Glycine max
  Coding DNA Sequence Number=SeqID_114653
  Gene Ontology: Mol. function=protein serine/threonine kinase activity; Cellular component=cytoplasm; Biological process=protein amino acid phosphorylation
  Homolog annotation: Hit_ID=Q6DXR4; Match level="QueryCoverage=93%, HitCoverage=98%, E-value=0.0, Identity=73%"; Hit description =Putative serine-threonine kinase
  Pfam annotation: Domain name=NAF; Domain location=350-407; Score =96.6; E_value=7.3e-26; Accession=PF03822.5; Description=NAF domain
  Pfam annotation: Domain name=Pkinase; Domain location=31-285; Score =346.8; E_value=3.7e-101; Accession=PF00069.15; Description=Protein kinase domain
  Pfam annotation: Domain name=Pkinase_Tyr; Domain location=31-283; Score=59.7; E_value=3.9e-16; Accession=PF07714.7; Description =Protein tyrosine kinase
  Pfam annotation: Domain name=RIO1; Domain location=44-193; Score= -97.0; E_value=0.08; Accession=PF01163.12; Description=RIO1 family
  Pfam module annotation: Pfam domain module=NAF::Pkinase::Pkinase _Tyr::RIO1; Domain location=350-407::31-285::31-283::44-193
MADVVSKSPTPTSNLISPNKKETSNLLLGRFEIGKLLGHGTFAKVYYARNIKTGEGVAIKVIDKEKILKGGLVAHIKREISILRRVRHPNIVQLFEVMATKSKIYFVMEYVRGGELFNKVAKGRLKEEVARKYFQQLISAVGFCHARGVYHRDLKPENLLLDENGNLKVSDFGLSAVSDQIRQDGLFHTFCGTPAYVAPEVLARKGYDGAKVDLWSCGVVLFVLMAGYLPFHDQNVMAMYKKIYRGEFRCPRWFSPDLSRLLTRLLDTKPETRIAIPEIMENKWFKKGFKQIKFYVEDDRLCNVVDDDGLMDNDDDTASIVSVASFSDYSVSESDSEIETRRRINAPLPRPPSLNAFDIISFSPGFNLSGLFEEKEDETRFVTAAPVNRIISKLEEIAQLVRFSVRKKDCRVSLEGTREGVRGPLTIAAEIFELTPSLVVVEVKKKGGDRAEYERFCNDELKPGLQNLMVEESATSSELSTPIQPSLLRGLSEPVPDISSDIETPLCIPSDD

SEQ ID NO: 231432 - protein, 87 aa, Glycine max
  Coding DNA Sequence Number=SeqID_114654
  Homolog annotation: Hit_ID=Q5DMX3; Match level="QueryCoverage=43%, HitCoverage=4%, E-value=2e-07, Identity=71%"; Hit description=DRP
MAWELMLKCMNLEVVMCQRFLLKKSAKTNGWSRRWFVLNEKTGKTRKGNRPNSPELIKKWQSTAIRCQLVYRELPENVRQPLKVKSG

SEQ ID NO: 231433 - protein, 337 aa, Glycine max
  Coding DNA Sequence Number=SeqID_114655
  Gene Ontology: Mol. function=protein serine/threonine kinase activity; Cellular component=cytoplasm; Biological process=protein amino acid phosphorylation
  Homolog annotation: Hit_ID=Q9LWM4; Match level="QueryCoverage=99%, HitCoverage=71%, E-value=1e-120, Identity=64%"; Hit description =Putative CBL-interacting protein kinase 2
  Pfam annotation: Domain name=Pkinase; Domain location=12-266; Score =364.5; E_value=1.7e-106; Accession=PF00069.15; Description=Protein kinase domain
  Pfam annotation: Domain name=Pkinase_Tyr; Domain location=12-264; Score=52.6; E_value=1.1e-15; Accession=PF07714.7; Description =Protein tyrosine kinase
  Pfam annotation: Domain name=RIO1; Domain location=25-183; Score= -95.4; E_value=0.061; Accession=PF01163.12; Description=RIO1 family
  Pfam module annotation: Pfam domain module=Pkinase::Pkinase _Tyr::RIO1; Domain location=12-266::12-264::25-183
MDNKATILMQKYEVGHFLGQGNFAKVYHARNLKTGQSVAIKVFNKESVIKVGMKEQLKREISLMRLVRHPNIVQLHEVMASKTKIYFAMEMVKGGELFYKVSRGRLREDVARKYFQQLIDAVGHCHSRGVCHRDLKPENLLVDENGDLKVTDFGLSALVESRENDGLLHTICGTPAYVAPEVIKKKGYDGAKADIWSCGVILFVLLAGFLPFNDKNLMQMYKKIIKADFKFPHWFSSDVKMLLYRILDPNPKTRIGIAKIVQSRWFRKGYVQLEAFQLPPLSPRNAKDISDVQAAFASSSDSDSDGSPMSNKEDSPMKLYRFNAFDLISISSGFDLS

SEQ ID NO: 231434 - protein, 124 aa, Glycine max
  Coding DNA Sequence Number=SeqID_114656
  Gene Ontology: Mol. function=nucleotide binding; Cellular component =microtubule
  Homolog annotation: Hit_ID=Q9SDX4; Match level="QueryCoverage=82%, HitCoverage=11%, E-value=4e-48, Identity=96%"; Hit description =Dynamin homolog
  Pfam annotation: Domain name=GED; Domain location=7-100; Score=11.8; E_value=0.00026; Accession=PF02212.8; Description=Dynamin GTPase effector domain
MARRPADPEEELRWMSQEVRGYVEAVLNSLAANVPKAVVLCQVEKAKEDMLNQLYSSVSAQSTAKIEELLLEDQNVKRRRDRIQKQSSLLSKLTRQLSIHDNRAAAASGWSNGSAVPKLVITDD

SEQ ID NO: 231435 - protein, 484 aa, Glycine max
  Coding DNA Sequence Number=SeqID_114657
  Gene Ontology: Mol. function=protein-tyrosine kinase activity; Cellular component=integral to membrane; Biological process=protein amino acid phosphorylation
  Homolog annotation: Hit_ID=Q1SMM8; Match level="QueryCoverage=97%, HitCoverage=75%, E-value=1e-161, Identity=61%"; Hit description =Protein kinase
  Pfam annotation: Domain name=Pkinase; Domain location=200-453; Score=- 50.7; E_value=1.5e-05; Accession=PF00069.15; Description=Protein kinase domain
  Pfam annotation: Domain name=Pkinase_Tyr; Domain location=203-453; Score=-67.4; E_value=2.4e-08; Accession=PF07714.7; Description =Protein tyrosine kinase
  Pfam module annotation: Pfam domain module=Pkinase::Pkinase_Tyr; Domain location=200-453::203-453
MSLLKHLLKLRKSAFHGHENNYCDLLPSSNVPEIAHNVPKHVNYARRMLLQSSDNNFAAAPFNGESTIEISFVPITFSSGAFSAISNANKKQNQTPTPSHSPFDSPHDVSNENQTSRQDATNGASRNLWKYIISVVVVLIIIIIIILYTSRKQAAKVIGPWKTGISGQLQKAFITGVPKLNRAELEIACEDFSNIVNLYYEGCTIYKGTLSNGVEIAVVSTLITSPQDWSKDMEIKYHKKIDILSRINHKNFVNLIGYCEEEEPFTRMLVFEYAPNGNVFEHLHVEEMERLDWSERVRIIMGIAYCLQYLHHDLSPPMIHSSLASNMIFLTDDFAAKMAVVTFRDIVSPTETIGDSKKPQVSSQGNLESNVFDFGKLLLEIISGKLPYFEEQGTLVNWVGNYFNDKCNINYLIDPTLKSFKENELNLICEVIQDCIHLDPKLRPTMRDVTSKLKEALGVSPEQAFPRLSPLWWAEFEILSVEAT

SEQ ID NO: 231436 - protein, 242 aa, Glycine max
  Coding DNA Sequence Number=SeqID_114658
  Gene Ontology: Mol. function=protein binding; Cellular component =cytoplasm; Biological process=apoptosis
  Homolog annotation: Hit_ID=Q9LGR1; Match level="QueryCoverage=80%, HitCoverage=78%, E-value=1e-68, Identity=63%"; Hit description =Putative phosducin-like 3
  Pfam annotation: Domain name=Phosducin; Domain location=11-216; Score= -57.2; E_value=2.3e-06; Accession=PF02114.7; Description=Phosducin
MGDYHFVYKDLEGASTQWDDIQRKLGNLPPKAPAFKPPPFTPASDDQPKDKTWIDSKTSEELEDLEDNLDDDRFLQEYRKKRLAEMQEAAKVLRFGSVIPISGSDFVREVSQAPSDVWVVVILYKEGIPECGLLMQSIEELALRYPSTKFVKIISTDCIPNYPDRNLPTLLVYNNGAVKGNYVGLHSFGRRCTPEGKEVPAEGCEEYRMREENDLLAGLLLVFYNGLEIKEVRLIEHETDEK

SEQ ID NO: 231437 - protein, 107 aa, Glycine max
  Coding DNA Sequence Number=SeqID_114659
  Gene Ontology: Mol. function=catalytic activity; Biological process =metabolic process
  Homolog annotation: Hit_ID=Q1SUU0; Match level="QueryCoverage=51%, HitCoverage=9%, E-value=8e-18, Identity=69%"; Hit description=AMP -dependent synthetase and ligase
MVSILIVVLVGRVGLPPSGWGFRQQQEDEEMLVPHTNLAENNHQPMEGPGAVNFIIDHGELDFVFVQDRKVIHLLNPDCKSTQRLKEEEKDKAISIGVKPYLWVTYS

SEQ ID NO: 231438 - protein, 207 aa, Glycine max
  Coding DNA Sequence Number=SeqID_114660
  Homolog annotation: Hit_ID=Q9SJI9; Match level="QueryCoverage=97%, HitCoverage=76%, E-value=4e-50, Identity=51%"; Hit description =Expressed protein
  Pfam annotation: Domain name=DUF1637; Domain location=1-207; Score =164.1; E_value=3.6e-46; Accession=PF07847.3; Description=Protein of unknown function (DUF1637)
MPAELKPSNVGLEQEAQLVRGWKGSLNGTNGKKWRNGSYHYPPSIKYIHLHECDKFSLSFYVPFLSTACDSLLMEIFCRSPGSVIPLHNHPGMTVLSKLLITCKVICWVYSGFDDPSQARPAKLMKDCLMSAPCNTTVLHPSKGGNIHCFKALTPSALFDILSPPYSSEDGRHCSYFRKSTRKDLPGVEHDQLSGVKPSEITWSEEI

SEQ ID NO: 231439 - protein, 75 aa, Glycine max
  Coding DNA Sequence Number=SeqID_114661
MGPSGDKDALQWLLNFEKSNEPRWSWVGSNVNLDRKCHLTLYRKSKRSSFLSTQQHICVTDQRNSIPEHLNKGKN

SEQ ID NO: 231440 - protein, 221 aa, Glycine max
  Coding DNA Sequence Number=SeqID_114662
  Gene Ontology: Mol. function=DNA binding; Biological process =regulation of transcription
  Homolog annotation: Hit_ID=Q1SMM7; Match level="QueryCoverage=86%, HitCoverage=50%, E-value=4e-56, Identity=58%"; Hit description =Homeodomain-related
  Pfam annotation: Domain name=Myb_DNA-binding; Domain location=88-139; Score=41.3; E_value=3.4e-09; Accession=PF00249.21; Description=Myb -like DNA-binding domain
MSEGYEIHNNEETSSGCSQKCSSFDLNEELACSTEDNTDTKECYELTTTNEKAKDEGTSANGSSISSREGNERRGTTVRQYVRSKMPRLRWTPELHHSFAHAVERLGGQERATPKLVLQLMNVRGLSIAHVKSHLQMYRSKKLDEAGQVLSQTYRSNQEVVRRPLILHQSISPQQHLKMGNGGIILASNFNKHSHFPSLLQPSFSLSRSLTNDTDSRFPLI

SEQ ID NO: 231441 - protein, 156 aa, Glycine max
  Coding DNA Sequence Number=SeqID_114663
  Gene Ontology: Mol. function=DNA binding; Biological process =regulation of transcription
  Homolog annotation: Hit_ID=Q1SMM7; Match level="QueryCoverage=99%, HitCoverage=42%, E-value=8e-22, Identity=41%"; Hit description =Homeodomain-related
HQHWYINHQAFRIPIASGQIQPKDTRGRIAPMRPSQLLEEKRWPPLEILNNHQSKFQKLPSIDSPKIGSQAIQPAEWSSFMNNTSIIDYLSNNSNEPRNNSNSLKLEFGPPFRIKKDEQQFLDLQLGLSHTCTVGTDGKMDHYRETPEISTKLSLS

SEQ ID NO: 231442 - protein, 82 aa, Glycine max
  Coding DNA Sequence Number=SeqID_114664
MMEKGAASGLLARTREGVSIGIRLCCCQCNNTCNKATNKNVKVFCGLHQLKVLVFMSCKQQQRINQIQILNYSINSCQMDKQ

SEQ ID NO: 231443 - protein, 118 aa, Glycine max
  Coding DNA Sequence Number=SeqID_114665
  Gene Ontology: Mol. function=ATP binding; Biological process=defense response
  Homolog annotation: Hit_ID=Q93VS9; Match level="QueryCoverage=80%, HitCoverage=8%, E-value=1e-24, Identity=66%"; Hit description=NBS -LRR resistance-like protein B8
MAAEFVGGALLSAFLQVAFDRLASPKVLDFFCPRKLDEMLLSKLNIMLLSIDAPADDAEQKQFNDPRVRGWLFAVKDALFDAEDLLDEIDYELTKSNDVDMLQEVDIGVGISSAESMP

SEQ ID NO: 231444 - protein, 409 aa, Glycine max
  Coding DNA Sequence Number=SeqID_114666
  Pfam annotation: Domain name=DUF688; Domain location=1-403; Score= -205.6; E_value=0.00041; Accession=PF05097.3; Description=Protein of unknown function (DUF688)
  Subcellular localization annotation: CTP_CleavageSite=9; ConfidenceScore=5.36e-01
MKNKAILPPASEVVKPNKSSHIRSFSPVPAVKKIKTKKLLCTLQSFCRSAFSSDIVFNIFTYYNHEYFLQAWEAIHKSKSSSRAASPDKQEGKPKWTSGSNRFTYFGELLPGRLSPFRRSRAAAAGISPCRSKPQSPFRGAKLPGDTKEAENYMFGKVKFHSGVLGNVHDVLSQGAKRTSYSGNLTIEKTLYVDTASTAKLSSSNISSLDINQRVDTVVADLDRSRGKGSNSSFGSSQVIKQVHAVEEKVTFDTDVLSSLDSIPPSLYSYLNLAAKENKDLGLTTDQNISQKPVSLQSVQGTFAEDSKTNTQQIVLANDSGKGSAESIVSSLPPPLPKSPSESWLWRALPLVSVKNSFLHSSQGTQSKAKRHDSNTSGNLKWETIVKTSNLHHDHVRYSQELPTRKSQH

SEQ ID NO: 231445 - protein, 64 aa, Glycine max
  Coding DNA Sequence Number=SeqID_114667
MFEILTVGNVYPKRLDGPSQAVTTNTNIHSSEGSSTFKKNFVPHCPEALRYAKKEEDGLVTVVE

SEQ ID NO: 231446 - protein, 783 aa, Glycine max
  Coding DNA Sequence Number=SeqID_114668
  Gene Ontology: Mol. function=ATPase activity, coupled to transmembrane movement of ions, phosphorylative mechanism; Cellular component=integral to membrane; Biological process=phospholipid transport
  Homolog annotation: Hit_ID=Q1T3B5; Match level="QueryCoverage=97%, HitCoverage=64%, E-value=0.0, Identity=83%"; Hit description=ATPase, E1-E2 type; Peptidase M, neutral zinc metallopeptidases, zinc- binding site
  Pfam annotation: Domain name=Hydrolase; Domain location=289-760; Score=20.6; E_value=0.00096; Accession=PF00702.16; Description =haloacid dehalogenase-like hydrolase
DIEANNRKVQVYGRNYTFVETRWKKLRVGDIIKVYKDEYFPADLLLLSSSYDDGVCYVETMNLDGETNLKLKHALEVSIHLQDEKSLQKFKAVVKCEDPNENLYSFIGTLQYDGKEYPLSLQQILLRDSKLKNTDYIYGVVIFTGHDTKVMQNSTDPPSKRSKIERKMDKIIYILFSTLVLISFIGSVFFGVETKRDISSGRYRRWYLRPDNTTVFYDPRRATLAAVLHFLTALMLYGYLIPISLYVSIELVKVLQSIFINHDQEMYYEETDRPARARTSNLNEELGQVDTILSDKTGTLTCNSMEFVKCSIGGIPYGRGMTEVEKALARRGKDVESEVDGGSSDLLGQSNDFVDSRHPIKGFNFRDERIMNGQWVNEPYTDFIQRFFRVLAICHTAIPDVDKESREISYEAESPDEAAFVIAARELGFEFFARTQTSISLHELNYESGKKVDRVYQLLHVLEFSSSRKRMSVIVRNEENQLLLLCKGADSVMFERLSQHGRQFEAETRDHIKRYSEAGLRTLVITYRELDEEEYKLWDNEFSKIKTTVTEDRDALVDAAADKMERDLILLGATAVEDRLQKGVPECIEKLAQAKIKLWVLTGDKMETAVNIGYACSLLRQDMKQIVITLDSPDILSLEKQGDKEALSKASIESIKKQIREGISQIKSAKESSNTTGFGLIIDGKSLDYSLNKNLERAFFELAINCASVICCRSSPKQKARVTKLVKLGTGKTILSIGDGANDVGMLQEADIGVGISGAEGMQEAFGRACREFEFKEIAYKLF

SEQ ID NO: 231447 - protein, 97 aa, Glycine max
  Coding DNA Sequence Number=SeqID_114669
  Homolog annotation: Hit_ID=Q1T3B5; Match level="QueryCoverage=70%, HitCoverage=6%, E-value=8e-10, Identity=50%"; Hit description=ATPase, E1-E2 type; Peptidase M, neutral zinc metallopeptidases, zinc- binding site
MQVTRLVKLGTGKTTFSIGVAALQHIACLLNAMLLHVETESDFSIAQFHFLECLLLVHSHWSHRKISMMLYEQAGLKLFRKVGFYQFRSMILYGESK

SEQ ID NO: 231448 - protein, 231 aa, Glycine max
  Coding DNA Sequence Number=SeqID_114670
  Pfam annotation: Domain name=DUF688; Domain location=1-231; Score= -251.9; E_value=0.033; Accession=PF05097.3; Description=Protein of unknown function (DUF688)
MAERRLNINAPLMSVRRSSATPPSLTEAKKKILEKRHTLPYYKSDTSSDQVTEPVAVPFNWEHIPGRRKGNGGSEPQPPKANSITPSPRLPPGKSINATKQTLEKESKTANKFKSSNKSKSFNVSVVKVDSDKERKAEKIVESRRSNVKFDDDDDNDAYSDALENLSPTESFSMNCSVSGVSGLDNLDANKFGTFSTDQQTRDFMMSRFLPAAKAMTLQPPQYSSKKQSVL

SEQ ID NO: 231449 - protein, 1142 aa, Glycine max
  Coding DNA Sequence Number=SeqID_114671
  Gene Ontology: Mol. function=binding; Cellular component=spliceosome; Biological process=nuclear mRNA splicing, via spliceosome
  Homolog annotation: Hit_ID=Q9FMF9; Match level="QueryCoverage=94%, HitCoverage=84%, E-value=0.0, Identity=85%"; Hit description=Nuclear protein-like
  Pfam annotation: Domain name=HEAT; Domain location=385-421; Score =5.3; E_value=9.6; Accession=PF02985.12; Description=HEAT repeat
  Pfam annotation: Domain name=HEAT; Domain location=456-492; Score =4.4; E_value=13; Accession=PF02985.12; Description=HEAT repeat
  Pfam annotation: Domain name=HEAT; Domain location=497-533; Score =25.0; E_value=0.00027; Accession=PF02985.12; Description=HEAT repeat
  Pfam annotation: Domain name=HEAT; Domain location=580-616; Score =2.0; E_value=25; Accession=PF02985.12; Description=HEAT repeat
  Pfam annotation: Domain name=HEAT; Domain location=661-696; Score =4.7; E_value=11; Accession=PF02985.12; Description=HEAT repeat
  Pfam annotation: Domain name=HEAT; Domain location=744-780; Score =19.9; E_value=0.0095; Accession=PF02985.12; Description=HEAT repeat
  Pfam annotation: Domain name=HEAT; Domain location=786-822; Score =2.2; E_value=23; Accession=PF02985.12; Description=HEAT repeat
  Pfam annotation: Domain name=HEAT; Domain location=829-864; Score =12.5; E_value=1.3; Accession=PF02985.12; Description=HEAT repeat
  Pfam annotation: Domain name=HEAT; Domain location=875-906; Score =1.1; E_value=31; Accession=PF02985.12; Description=HEAT repeat
  Pfam annotation: Domain name=HEAT; Domain location=982-1017; Score =14.2; E_value=0.47; Accession=PF02985.12; Description=HEAT repeat
  Pfam annotation: Domain name=SF3b1; Domain location=137-273; Score =227.5; E_value=3e-65; Accession=PF08920.1; Description=Splicing factor 3B subunit 1
  Pfam module annotation: Pfam domain module=HEAT::HEAT::HEAT::HEAT::HEA T::HEAT::HEAT::HEAT::HEAT::HEAT::SF3b1; Domain location=385-421::456 -492::497-533::580-616::661-696::744-780::786-822::829-864::875 -906::982-1017::137-273
MREEALKREKEETLKAIAKKKKEEEEAAKDAPQQQQQKRRNRWDQSQDDGGAAAAAAAKKAKTSDWDMPDTTPGRWDATPTPGRVTDATPGRRNRWDETPTPGRVADSDATPAGGATPGATPAGMTWDATPKLSGMATPTPKRQRSRWDETPATMGSATPLPGATPAAAYTPGVTPVGGIELATPTPGALQGSITPEQYNLLRWERDIEERNRPLTDEELDAMFPQEGYKVLDPPASYVPIRTPARKLLATPTPLGTPLYQIPEENRGQQFDVPKEAPGGLPFMKPEDYQYFGALLNEENEEELSPDEQKERKIMKLLLKVKNGTPPQRKTALRQLTDKAREFGAGPLFNRILPLLMQPTLEDQERHLLVKVIDRVLYKLDELVRPFVHKILVVIEPLLIDEDYYARVEGREIISNLSKAAGLATMIAAMRPDIDNIDEYVRNTTARAFSVVASALGIPALLPFLKAVCQSKKSWQARHTGIKIVQQIAILIGCAVLPHLRSLVEIIEHGLNDENQKVRTISALSLAALAEAAAPYGIESFDSVLKPLWKGIRQHRGKVLAAFLKAIGFIIPLMEALYASYYTKEVMLILIREFQSPDEEMKKIVLKVVKQCVSTEGVEAEYIRNDILPEFFKNFWVRRMALDRRNYKQLVETTVEIANKVGVADIVGRIVEDLKDESEPYRRMVMETIEKVVTNLGASDIDARLEELLIDGILYAFQEQTSDDANVMLNGFGAVVNSLGQRVKPYLPQICGTIKWRLNNKSAKVRQQAADLISRIAVVMKQCHEEQLMGHLGVVLYEYLGEEYPEVLGSILGALKSIVNVIGMTKMTPPIKDLLPRLTPILKNRHEKVQENCIDLVGRIADRGAEFVPAREWMRICFELLEMLKAHKKGIRRATVNTFGYIAKAIGPQDVLATLLNNLKVQERQNRVCTTVAIAIVAETCSPFTVLPALMNEYRVPELNVQNGVLKSLSFLFEYIGEMGKDYIYAVTPLLEDALMDRDLVHRQTAASAVKHMALGVAGLGCEDALVHLLNYVWPNIFETSPHVINAVMEAIEGMRVALGAAVVLNYCLQGLFHPARKVREVYWKIYNSLYIGAQDALVASYPALEDEQNNVYSRPELMIHLHCQNAGEMDESVKRLQNYQD

SEQ ID NO: 231450 - protein, 193 aa, Glycine max
  Coding DNA Sequence Number=SeqID_114672
  Gene Ontology: Biological process=response to biotic stimulus
  Homolog annotation: Hit_ID=Q8S8E3; Match level="QueryCoverage=79%, HitCoverage=73%, E-value=8e-43, Identity=53%"; Hit description =Expressed protein
  Pfam annotation: Domain name=Bet_v_I; Domain location=28-176; Score= -41.8; E_value=0.0086; Accession=PF00407.9; Description=Pathogenesis -related protein Bet v I family
  Pfam annotation: Domain name=Polyketide_cyc; Domain location=33-166; Score=8.6; E_value=0.054; Accession=PF03364.10; Description =Streptomyces cyclasedehydrase
  Pfam module annotation: Pfam domain module=Bet_v_I::Polyketide_cyc; Domain location=28-176::33-166
QDLETPTIKAMLNTYHASKLSSNQCGSSLVQTIDAPLPLVWSLIRRFEYPQGYKLFVKKCNLLDGDGGIGSVREVMITSGLPAGVSVERLDKLDDDKHVLKFSIIGGDHRLVNYSSTITLHEEEEEYGGKTVAIESYAVDVPAGSSGDDTCSFANTIIACNLRSLAKITEEKVVSSCQKFISFEESKYKNGKT

SEQ ID NO: 231451 - protein, 86 aa, Glycine max
  Coding DNA Sequence Number=SeqID_114673
MNSLMVGKLSILRNKFRRDTRTFAPDSEILEALQQISVGKLGLDQETGPEDVEILSAADADSLARALLLNQNPPSPGNPTLIFLKQ

SEQ ID NO: 231452 - protein, 73 aa, Glycine max
  Coding DNA Sequence Number=SeqID_114674
MSTNGCKIATITESRVLTQNDIQLMQDVMVASVTNKGWLSNHGFKRTEGETKFKLGVQPSGWLCVASLEDFGV

SEQ ID NO: 231453 - protein, 115 aa, Glycine max
  Coding DNA Sequence Number=SeqID_114675
AGVVGSSAGGELTGTGVGGELIGTGVGGELTGVTVGGVVVGGVAARGVATGGVVVGAGAATLDGGDAAMGDEMAGGVAVGALGDEAGGYEVREVTGAVDFGLEEAMVGDAINTFF

SEQ ID NO: 231454 - protein, 347 aa, Glycine max
  Coding DNA Sequence Number=SeqID_114676
  Gene Ontology: Mol. function=DNA binding; Cellular component=nucleus; Biological process=regulation of transcription
  Homolog annotation: Hit_ID=Q8W3M8; Match level="QueryCoverage=80%, HitCoverage=80%, E-value=4e-61, Identity=48%"; Hit description=6b -interacting protein 1
MPDFHDSLLTTTPPPSRPVPVREDCWSEEASSTLVDAWGRRYLELNRGNLRQKDWQDVADAVNALHGHTKKTHRTDVQCKNRIDTIKKKYKIEKARVSASNGTLSSSWPFYERLDALIGPNFSAKKSTSSPSPSPPVALPLLPHRKNQNQNQNPSSSPAIAVPPTAVALPQKRSSAAAMDEGYFRRNYSAVAAAAAAAEADEDDEEEDEEEAEDLEEEEEEECEEEGRGSEVEEGDKEREGMRRLAKAIERFGEVYERVEAQKLRQMVDLEKQRMQFAKDLEVQRMEMFMDTQVQLERIKRGKRSGSNVFCFQRMNDVLDLRISGSLEDYSPLIEIEPCMFWVVVVG

SEQ ID NO: 231455 - protein, 449 aa, Glycine max
  Coding DNA Sequence Number=SeqID_114677
  Gene Ontology: Mol. function=transferase activity, transferring glycosyl groups; Cellular component=cytoplasm; Biological process =metabolic process
  Homolog annotation: Hit_ID=Q5CAZ5; Match level="QueryCoverage=98%, HitCoverage=99%, E-value=1e-132, Identity=49%"; Hit description=UDP -xylose phenolic glycosyltransferase
  Pfam annotation: Domain name=Glyco_tran_28_C; Domain location=279 -430; Score=-28.7; E_value=0.097; Accession=PF04101.6; Description =Glycosyltransferase family 28 C-terminal domain
  Pfam annotation: Domain name=UDPGT; Domain location=13-449; Score= -72.4; E_value=5.7e-07; Accession=PF00201.9; Description=UDP -glucoronosyl and UDP-glucosyl transferase
  Pfam module annotation: Pfam domain module=Glyco_tran_28_C::UDPGT; Domain location=279-430::13-449
MEKKSMVKKRAHCLVLAYPAQGHINPMLQFSKLLENQGVRITLVTTRFYYNNLQRVPPSIALETISDGFDKGGPGEAGGSKAYLDRFRQVGPETFAELLEKLGKSNDHVDCVIYNSLLPWALDVAKRFGIAGAAYLTQNMAVNSIYYHVQLGKLQAPLIEQEISLPALPKLHLQDMPSFFFYEDLSLLDLVVSQFSNIDKADWILCNTFYDLDKEITDWFMKIWPKFKTIGPNIPSYFLDKQCEDDQDYGITQFKSEECMEWLDDKPKGSVVYVSFGSLVTFGEEQMKELVCCLRECSNYFLWVVRASEQIKLPKDFEKRTDKGLVVTWCPQVKILAHEAVGCFVTHCGWNSILETLCLGVPIVAIPCWSDQSTNAKLIADVWKIGIRAPVDEKKVVRQEALKHCIKEIMDKGKEMKINALQWKTLAVRGVSKGGSSYENAVEFVNSLL

SEQ ID NO: 231456 - protein, 61 aa, Glycine max
  Coding DNA Sequence Number=SeqID_114678
MAPFTPLKLPLLLTLFFALSQKQSLCSTLKSEEGLALLALRERVVSDPQGTLSSWSGADGD

SEQ ID NO: 231457 - protein, 353 aa, Glycine max
  Coding DNA Sequence Number=SeqID_114679
  Gene Ontology: Mol. function=superoxide dismutase activity; Biological process=superoxide metabolic process
  Homolog annotation: Hit_ID=Q9LXE9; Match level="QueryCoverage=98%, HitCoverage=81%, E-value=3e-77, Identity=49%"; Hit description=Ids-4 protein-like
  Pfam annotation: Domain name=SPX; Domain location=1-218; Score=94.1; E_value=4.3e-25; Accession=PF03105.10; Description=SPX domain
MKFGKEFKTHLEDTIPEWRDKFLCYKPLKKLLKQNLPSITTAITDIPINLPLHLLQQPSSPQLLQAWFVRILNEELEKFNDFYVDKEEEFVIRFQARVVMGICMLTDVWYHGVVDENDMVLQLRLMRGTLVALTTFKELKERIECLKEKSSQGEVYTSDCEFSEEMMDIRKDLVTIHGEMVLLKNYSSLNFAGLVKILKKYDKRTGGLLRLPFTQLVLRQPFFTTEPLTRLVHECEENLELLFPLQAEVIQSTPPPENQSRPPVDSATNALPEASSTLGDETVYIYRSTLAAMRAIKGLQKASSTSNPFSFSSLFSNQDGDGTGAVTAENSAANSPATLQNEESVGKEETDSV

SEQ ID NO: 231458 - protein, 457 aa, Glycine max
  Coding DNA Sequence Number=SeqID_114680
  Gene Ontology: Mol. function=transferase activity, transferring glycosyl groups; Cellular component=cytoplasm; Biological process =metabolic process
  Homolog annotation: Hit_ID=Q5CAZ5; Match level="QueryCoverage=96%, HitCoverage=98%, E-value=1e-137, Identity=51%"; Hit description=UDP -xylose phenolic glycosyltransferase
  Pfam annotation: Domain name=UDPGT; Domain location=12-455; Score= -79.0; E_value=1.2e-06; Accession=PF00201.9; Description=UDP -glucoronosyl and UDP-glucosyl transferase
MEEKNMARRAHCLVLAYPLQGHINPILQFSKLLEHQGSRITLVTYRFYQNNLQRVPPSFAIETISDGFDQGGPIHAESHKAYMDRSTQVGSESLAELLEKLGQSKNHVDCVIYDSFFPWALDVAKSFGIMGAVFLTQNMTVNSIYYHVHLGKLQVPLTEHEFSLPSLPKLQLEDMPSFLLTYVEHPYYLDFFVDQFSNIDKADWVLCNTFYELDKEVANWITKIWPKFRNIGPNIPSMFLDKRHEDDKDYGVAQFESEECIEWLNDKPKGSVVYVSFGSIAMLGGEQMEELAYGLNECSNYFLWVVRASEEIKLPRGFEKKSEKGLIVTWCSQLKVLAHEAIGCFVTHCGWNSTLETLCIGVPTIAIPHWSDQTTNAKLMADVWKIGIRAQTNEKKIVRRETLKQCIRDVMESEEGKVIKSNVIQWKTLALKAIGEGGSSYQNIIEFTNNLFCSQAS

SEQ ID NO: 231459 - protein, 199 aa, Glycine max
  Coding DNA Sequence Number=SeqID_114681
  Gene Ontology: Cellular component=integral to membrane; Biological process=red or far red light signaling pathway
  Homolog annotation: Hit_ID=Q2HT55; Match level="QueryCoverage=73%, HitCoverage=23%, E-value=4e-35, Identity=48%"; Hit description=SPX, N-terminal; EXS, C-terminal
MEQIMRRKAHFGFFRRECHFTIYILMHICYCFEGRSSLLMDLIHEIEMSSESHLKDGSATSFQGFRPAHLEILFYVKINVVTLETPVSTLRGLLLASNHDHLSFSKKELWKLLELDGILKNHEEVTARNASKEYLKVVGISYFGNTDEVNRLMDKVESAFIKHFGNGNRRKGMTADWLLTCSHCDPYGTHKFKKTSKYK

SEQ ID NO: 231460 - protein, 89 aa, Glycine max
  Coding DNA Sequence Number=SeqID_114682
MGMRRVGYEYCLPNPLSRLLNISPYSYPIPDEFEFIVSSPYPSSIGVGTGLVIPYQYPYPTFGYRRKPEPVPIPGQLGYYPSKSGRIQA

SEQ ID NO: 231461 - protein, 87 aa, Glycine max
  Coding DNA Sequence Number=SeqID_114683
  Homolog annotation: Hit_ID=O23627; Match level="QueryCoverage=67%, HitCoverage=8%, E-value=2e-12, Identity=64%"; Hit description=Glycyl- tRNA synthetase 1, mitochondrial precursor
MGEFAFRGFDEAIYVTHRRCHTQGEDVGLDGAAGRTIAKEASDIVVDLEIGDVEKAAFKGVHHRLTEGLVGVGAAKEGALNRGFFRA

SEQ ID NO: 231462 - protein, 132 aa, Glycine max
  Coding DNA Sequence Number=SeqID_114684
MTPGWKEKKGTKDRHVISTYLLQTKCEFPDLNPDYMPPNFSINGKGALYLERQGRHIWMKNLLDITLNITFPPLLSWVPEYVLQNIVQSICDAKVGCSQVLENYAEDINNGFAVGLLADYNSFKRNKARYSV

SEQ ID NO: 231463 - protein, 54 aa, Glycine max
  Coding DNA Sequence Number=SeqID_114685
MAFPEVKSTYILGKRNKNEGARGDVVACDGHRGGWLLKEMPSWEVLELKGEGRC

SEQ ID NO: 231464 - protein, 102 aa, Glycine max
  Coding DNA Sequence Number=SeqID_114686
MVFGNNYPSKRIILQEYLYPYEMPVPETGSKEWIKTSTTLSSTCFVPSMSVGRRVGEENNWKGGLDLRCGKKRRMVVATEKEEEENRRIGWSFQNMKRLGYI

SEQ ID NO: 231465 - protein, 69 aa, Glycine max
  Coding DNA Sequence Number=SeqID_114687
MEFGRCVFPTKLRSFCGGLLRDACPRDVICSFAVFLVQPVEADAMALCKAMSWVHDSTIRIRSGFYYYE

SEQ ID NO: 231466 - protein, 380 aa, Glycine max
  Coding DNA Sequence Number=SeqID_114688
  Gene Ontology: Mol. function=carboxypeptidase activity; Cellular component=proton-transporting two-sector ATPase complex; Biological process=ATP synthesis coupled proton transport
  Homolog annotation: Hit_ID=Q8RV74; Match level="QueryCoverage=85%, HitCoverage=85%, E-value=2e-73, Identity=42%"; Hit description=Leaf senescence protein-like
  Pfam annotation: Domain name=DUF231; Domain location=224-372; Score =72.0; E_value=1.9e-18; Accession=PF03005.6; Description=Arabidopsis proteins of unknown function
MSGNIPKGAFLLPLTLFLILLLLPLFRNFIQPSPKTYATNLETKETRRCNIFSGNWVPYPKEPYYNNETCPFILDQINCIKNGRPDRDFLKLRWKPHDCELPLFDATQFLELVRGKSMAFVGDSMATNQLESLLCLINTVAHPEDITAKYTSNDNIFFRWWFVLDYNFTVTTMWSPFLVKFNDSDPTGLGSYSPTKLYLDEADEAWSSKIKDFDFVVFSSGQWFFRPLTFYENRQVVGCQKCENSSELNYYGYKKAFRTAFRTIRKLEGFKGLAFLVTHSPEHFENGAWNEGGSCNRTKPLEEKGVYENGDIVEALHQIQLEEFNIAIEKGLRFGLIDITDAMGMRTDAHPGRFRPVGGAVDTWNEFLLYLMKLEAEKHR

SEQ ID NO: 231467 - protein, 56 aa, Glycine max
  Coding DNA Sequence Number=SeqID_114689
MGCDFMNSMMAMVKRDNMLKSRKQLGGYVELCGASEAANGKHDFDAISKTHLLVAK

SEQ ID NO: 231468 - protein, 110 aa, Glycine max
  Coding DNA Sequence Number=SeqID_114690
  Homolog annotation: Hit_ID=Q8H2I6; Match level="QueryCoverage=40%, HitCoverage=11%, E-value=1e-10, Identity=58%"; Hit description=Leaf senescence protein-like
MAMRSDGHPCRYGKVVDKNVTINDCVHWCMTGPIDTWNEFLLYVMKLEGENELWGVYNIYHGLRIAVTLGFTRIIVESASKVPIHLQVITTSFNFMQVFNNKYMRTFSIL

SEQ ID NO: 231469 - protein, 96 aa, Glycine max
  Coding DNA Sequence Number=SeqID_114691
MDLFSSLFNVYWLSLGEVREAHFLILDPGPPPRLTFPHQICALRSTSHLHDQHHRHDTQDQKGVARPPPIQSALCTTLTLVRLRTMRTNLFMREGI

SEQ ID NO: 231470 - protein, 102 aa, Glycine max
  Coding DNA Sequence Number=SeqID_114692
MGEPPVKLASSWQESTAYLIGCVCRLRAAVGETGAEGRTRHWCRRVATLVQGRTRQFDWRVELQIFFFIKREIWDSREVLNLICTVLTLHYVFFIRALNCYS

SEQ ID NO: 231471 - protein, 90 aa, Glycine max
  Coding DNA Sequence Number=SeqID_114693
MATIALSSRYGSKLAYDTGIWGESYRLFAAKFISWLVFFLEWQSQHGFLPHPHPLYLPQFSHSSKQDDQICLFSDPHRSFHWQRPNPQSF

SEQ ID NO: 231472 - protein, 137 aa, Glycine max
  Coding DNA Sequence Number=SeqID_114694
  Homolog annotation: Hit_ID=Q51614; Match level="QueryCoverage=31%, HitCoverage=83%, E-value=1e-09, Identity=72%"; Hit description=, complete genome
GAGAYGKTPATRPFYGSWPFAGLLLTCSFLRYPLILWITVLPPLSELIPLAAAERPSAARNSYDHDYEFELGTPPIIDYVAPTYTPIPPTPMADYVFPSASNMDYTSPIVQPDDFLSNVFGTDYGTPTSAHVYMHSL

SEQ ID NO: 231473 - protein, 83 aa, Glycine max
  Coding DNA Sequence Number=SeqID_114695
MSIASSTASTRMRYPIVRPPAIIQFRATLHNDQKYPYSTMNNGHRITHKRFGSNTMEQPTQYESNNTEADIFLQMDSQTSGQI

SEQ ID NO: 231474 - protein, 160 aa, Glycine max
  Coding DNA Sequence Number=SeqID_114696
  Gene Ontology: Mol. function=zinc ion binding; Cellular component =nucleus; Biological process=regulation of transcription
  Homolog annotation: Hit_ID=Q0GLE9; Match level="QueryCoverage=60%, HitCoverage=100%, E-value=9e-51, Identity=97%"; Hit description=Dof3
  Pfam annotation: Domain name=zf-Dof; Domain location=37-99; Score =128.0; E_value=2.6e-35; Accession=PF02701.6; Description=Dof domain, zinc finger
MAEESQGIKLFGAMITLNRGEVNKGEKGSEYERVEKRAEKIIPCPRCKSMETKFCYFNNYNVNQPRHFCKSCQRYWTAGGALRNVAVGAGRRKVKSPCHGAGVYESTSEDENKFEMGQGHVAMPNTGFRQIFQAKRQRITSDADIDEMLVKGQRDIELKK

SEQ ID NO: 231475 - protein, 65 aa, Glycine max
  Coding DNA Sequence Number=SeqID_114697
MASLVEVHCCGGSLAVCGSRHGWGTHDDNDNNDNTTKKMIHKMVKMNKGVTAAQQIQKKATRGKE

SEQ ID NO: 231476 - protein, 118 aa, Glycine max
  Coding DNA Sequence Number=SeqID_114698
MKRKKEINARVIREESLNKKFGDPAGGSEFALEKLQSYGGGDDFVGDGGEEEGWWKKGVGGGGRRWVCAYAGVNILATWIRVVGPSGLDHHEEEGWWKEEVGGTTHRIFNFFFFKSYM

SEQ ID NO: 231477 - protein, 83 aa, Glycine max
  Coding DNA Sequence Number=SeqID_114699
MGTRICHHTWETQVGDIPFRDLSSHGCIMKNVGVKMGAPLMKNLEFKKVERFCTTSTKCSATKGIKEVDRLMTLMALGCNFIQ

SEQ ID NO: 231478 - protein, 497 aa, Glycine max
  Coding DNA Sequence Number=SeqID_114700
  Gene Ontology: Mol. function=binding
  Homolog annotation: Hit_ID=Q1SXA3; Match level="QueryCoverage=52%, HitCoverage=57%, E-value=1e-23, Identity=29%"; Hit description=IMP dehydrogenase/GMP reductase
  Pfam annotation: Domain name=Arm; Domain location=111-151; Score =15.2; E_value=0.15; Accession=PF00514.13; Description=Armadillobeta -catenin-like repeat
  Pfam annotation: Domain name=Arm; Domain location=214-254; Score=3.3; E_value=4.7; Accession=PF00514.13; Description=Armadillobeta-catenin -like repeat
  Pfam annotation: Domain name=Arm; Domain location=257-296; Score =16.0; E_value=0.12; Accession=PF00514.13; Description=Armadillobeta -catenin-like repeat
  Pfam annotation: Domain name=Arm; Domain location=297-335; Score=3.0; E_value=5.1; Accession=PF00514.13; Description=Armadillobeta-catenin -like repeat
  Pfam module annotation: Pfam domain module=Arm::Arm::Arm::Arm; Domain location=111-151::214-254::257-296::297-335
  Subcellular localization annotation: CTP_CleavageSite=34; ConfidenceScore=5.39e-01
MSTPSSSSSSSSIWVLSNIKLQFFGRIRRFLQSKATKKRYDPSDRFDTAKSKVEHNNKVENLETVQVMEKHKEEEEESVIMLQRTVKMLHFGSWEEKEVAAKEIEKLAKEDVKVRKLITELGVVPVLVSMVASPVASRRRAGLTALIHLADGTYTWFGLLILYYTNCTNPIKRRKYELNKKTSTVGVVLFVSDLTLTELKHAFLPYLTYLLRSFFRNKALIVEAGILSKLPKTIDLVDESTTSKLVELLLSLSSLANTQFPLAILDFLPLLRNILEKGSSFDTKNSCLGALHNLSTVLENACPLVSSGVVPILLEVSSIKEISEKALATLGNLSVTLMGKKTIENNSMVPETFIEILSWEDKPKCQELSVYILMILAHQSSLQRKKMAQAGIVPVLLEVVLLGSNLAQKRAMKLLQWFKDERQTKMGPHSGPQTPRFAMGSPVNQREAKEGKRLMKSLVKQSLNRNMEIITQRANAAGESSKLKSLIISTSSKSLPY

SEQ ID NO: 231479 - protein, 104 aa, Glycine max
  Coding DNA Sequence Number=SeqID_114701
  Gene Ontology: Mol. function=rRNA binding; Cellular component =ribonucleoprotein complex; Biological process=translation
  Homolog annotation: Hit_ID=Q9MTP1; Match level="QueryCoverage=43%, HitCoverage=22%, E-value=8e-15, Identity=89%"; Hit description =Chloroplast 30S ribosomal protein S4
MRKRELEGLVNKKAERQLLKYVRIAGKAKGSTGQVLLQLLEMPLDNILFRLGMTATIPQSYFVPIHFCCNKKRGSVPPAKIRNRRSMRDNEVCTRVVLSVNVTN

SEQ ID NO: 231480 - protein, 83 aa, Glycine max
  Coding DNA Sequence Number=SeqID_114702
  Gene Ontology: Mol. function=protein serine/threonine kinase activity; Biological process=protein amino acid phosphorylation
  Homolog annotation: Hit_ID=Q1T089; Match level="QueryCoverage=59%, HitCoverage=5%, E-value=4e-17, Identity=82%"; Hit description =Protein kinase
MKASPGAAVKLCLGDLLVMGSNPETASLHMQGNQRCDMFIKEYIAWLKITMHYFEWRVMVQIGHSLSYITADSYQLNHIQSLS

SEQ ID NO: 231481 - protein, 375 aa, Glycine max
  Coding DNA Sequence Number=SeqID_114703
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=O22960; Match level="QueryCoverage=85%, HitCoverage=83%, E-value=1e-139, Identity=68%"; Hit description =Expressed protein
  Pfam annotation: Domain name=DUF231; Domain location=218-373; Score =296.7; E_value=4.4e-86; Accession=PF03005.6; Description=Arabidopsis proteins of unknown function
  Subcellular localization annotation: CTP_CleavageSite=35; ConfidenceScore=5.06e-01
MEWNAKNISVHPVKWITTTLSLLCLFWFLSLHQARAAKFHNVSGLRGNNLVVANGCNLFLGSWVVDTSYPLYNSSTCPFIDPQFDCQKYGRPDKQYLKYAWKPESCALPRFDGVDFLNRWRGKKIMFVGDSLSLNMWRSLTCVIHASVPNAKTGFLRNESLSTVTFQDYGLTIQLYRTPYLVDIIRENVGPVLTLDSIVAGNAWKGMDMLIFNSWHWWTHTGKSQGWDYIRDGHNLVKDMDRLEAYNKGLTTWAKWVEQNVDPSKTKVFFQGISPGHYQGKDWNQPKKTCSGELQPISGSAYPAGLPPATTTLNNVLRKMSTPVYLLDITLLSQLRKDAHPSAYSGSHKGNDCSHWCLPGLPDTWNQLLYAVLTR

SEQ ID NO: 231482 - protein, 113 aa, Glycine max
  Coding DNA Sequence Number=SeqID_114704
MPKQIPNCESLNGTLIRQPQAPGTTENTNNLSSASSIVGNGENVSDAGGEILELLDDAVEGGPTGKDEQSGLRVAIEDEEEENDDERILVQVGKERGRVLQKRRTPLCATFKL

SEQ ID NO: 231483 - protein, 769 aa, Glycine max
  Coding DNA Sequence Number=SeqID_114705
  Homolog annotation: Hit_ID=Q84UR3; Match level="QueryCoverage=38%, HitCoverage=33%, E-value=3e-71, Identity=50%"; Hit description =Proline-rich protein family-like
  Subcellular localization annotation: CTP_CleavageSite=41; ConfidenceScore=5.82e-01
MVAGKAKLSMGFPKSPAPPTPPHSTPGRSSFTRSFGAYFSRSSSQVQPRPSEVLDLLRLVEDLRERESRLKTELLEHKLLKETLAIVPVLENEISIKNSQIESNAKKMEQLEAENEKLGNELQELKLRMKEEKTENLRKIQALENEIAELKKTASDHVCKALVNNEHSSLECKSLENDEHLQTTSILQAHLEVPVRPNFIRSLKKTALDYRSLNHKQFEATVVVADFKQEVAESQRPRRDSEELIDSIESNLTRSRAPRVPKPPPRRSLPSSTLHSSSSDSKNGNVEKEPVILQLPRVAPPPPPPPPMAASKAAPPPPPPPPKGSRQVSAKVRKIPEVVEFYHSLMRRESQSRRESLSGVVEVPPAAANPRDMIGEIENRSSHLLAVSVCPDFAENCDFATGVSVKCKVLTNIKTDVETQGDFIRCLIKEVEGAAFTDIEDVVLFVKWLDDELSYLVDERAVLKHFDWPEQKADALREAAFGYCDLKKLESEASSFRDDPRQPCGPALKKMQALFEKLEHGVFNISRMRESATNRYKVFHIPVQWMLDNGFVSQMKLASVKLAMKYMKRVSGELETSGGGGPEEEELIVQGVRFAFRVHQFAGGFDVETMRAFQELRDKARSCNLQCHSQQQKFFCSDILLVNTNRMAIILPGHESHARHVHSLPLPSQRYHEDLSSLTQLRLGDATRWDEREGNGHEGHKGRECHGVQPCLGGIKGRDGGGKVRRQREGEALRGEVEAEGGSSGEEVAVLRCGRVGIVVHEVVRRSGR

SEQ ID NO: 231484 - protein, 172 aa, Glycine max
  Coding DNA Sequence Number=SeqID_114706
GRGTWLGPPLVDVPDKLPLVVAPGAPPLLVAPGAPPLMVVPGRPPLPPLSHRPVKPRHVSRSGGTRPSENSNPNILHPHLTAMVAGKAKLSMGFPKSPTPPTPPHSTPGRSSFTRSFGAYFSRSSSRCISNHQNNANEMNETTNLIKSVNPQSRECRGGKSKPQTVKKPYKQ

SEQ ID NO: 231485 - protein, 308 aa, Glycine max
  Coding DNA Sequence Number=SeqID_114707
  Homolog annotation: Hit_ID=Q6ZCS3; Match level="QueryCoverage=68%, HitCoverage=29%, E-value=1e-07, Identity=26%"; Hit description=F-box protein family-like
  Pfam annotation: Domain name=F-box; Domain location=3-50; Score=32.3; E_value=1.7e-06; Accession=PF00646.23; Description=F-box domain
MTRDWSNLPRDLVSQIVSGLGLIDFLSFRGVCEDWRVASSTLSSEVKESLRCDPWFLIYEEEEDSHSQCSLLSPENKRYTINIPELHGAACLASYKGWLLLFRHGSLFFFSPFSRATIELPNCPFAEATNEHVAAFSSAPTSKDCIVTVVNRISDSELELFFICRGESEWSTRCYDGYKLSTMTTALFCEGKEFHFLDVDNRLAIFDSETKEWNRYNYRICRERSRDQPASSVRTLSYVVRKNVFQDKNTRKMGLLEENDSISTCGTAIPHPKGEFHRIVIKSESIEAAATQPESRHLKGDYCKMLAK

SEQ ID NO: 231486 - protein, 67 aa, Glycine max
  Coding DNA Sequence Number=SeqID_114708
MVTSLLPRATIELPNCPFAEATTEHVQALSSAPTSQDCIVVVVNRISDSELELFRNRRGENQWVRFK

SEQ ID NO: 231487 - protein, 132 aa, Glycine max
  Coding DNA Sequence Number=SeqID_114709
MGMEDIRIRVFWLVVSFISFALFWWFDMHREEEREKYAPKERVKEDLPGVECGGVGGVGDLGKPIESLALPATIAVKWGWRILGLEFSERDTWRGLTGRWDRGGSGGLPGTTISGGAPGATSSGGAPGATTS

SEQ ID NO: 231488 - protein, 87 aa, Glycine max
  Coding DNA Sequence Number=SeqID_114710
MTWMTLLTSRLEVSLNQGVTVREEQGFSTILTASCSVEEMSRVRYKLVLVLMFGNGGCREDRVINEFFVNNNCYIVDLAANESVVIS

SEQ ID NO: 231489 - protein, 694 aa, Glycine max
  Coding DNA Sequence Number=SeqID_114711
  Gene Ontology: Mol. function=RNA-directed DNA polymerase activity; Cellular component=chromatin; Biological process=chromatin assembly or disassembly
  Pfam annotation: Domain name=Chromo; Domain location=425-473; Score =21.5; E_value=0.0029; Accession=PF00385.14; Description='chromo' (CHRromatin Organisation MOdifier
  Pfam annotation: Domain name=LRR_1; Domain location=575-597; Score =10.9; E_value=2.6; Accession=PF00560.23; Description=Leucine Rich Repeat
  Pfam annotation: Domain name=LRR_1; Domain location=599-621; Score =10.0; E_value=3.9; Accession=PF00560.23; Description=Leucine Rich Repeat
  Pfam annotation: Domain name=LRR_1; Domain location=623-642; Score =13.6; E_value=0.71; Accession=PF00560.23; Description=Leucine Rich Repeat
  Pfam annotation: Domain name=LRR_1; Domain location=665-688; Score =11.6; E_value=1.9; Accession=PF00560.23; Description=Leucine Rich Repeat
  Pfam annotation: Domain name=rve; Domain location=162-275; Score= -0.8; E_value=0.0069; Accession=PF00665.16; Description=Integrase core domain
  Pfam annotation: Domain name=zf-H2C2; Domain location=103-144; Score =17.3; E_value=0.0018; Accession=PF09337.1; Description=His(2)-Cys(2) zinc finger
  Pfam module annotation: Pfam domain module=Chromo::LRR_1::LRR_1::LRR _1::LRR_1::rve::zf-H2C2; Domain location=425-473::575-597::599 -621::623-642::665-688::162-275::103-144
MGYDYHIQYRSGSHNQAADALSRLPEGASQAFLILSVPCLTFLDELHDQSRTNSTFQQKMLDVQNHPDHHPEFSIADKLLLYKGRIWLPSDIPIITTLLTEYHATPTGGHAGVAKTVARLMTNFYWPGLQDDVSRFVAQCVDCQVTKYETKKLAGLLCPLPVPSQPWYDLSLDFITSLPAYRGNTVILVVVDRFSKGIHLGMLPQSHSALTVARLFLEIVELFKASGTQLRMSSAYHPQSDGHTEVMNRVTSMGGVVLNTSWMANTGTTPYEITFGRRPFNFPEYLAGSSKVDAVDDLLIERDKTFQLIHKKLLKAQSKMKLYADKHRRDVQFVPGDWVLVRLRPYRQSSAKGDPSTNVKLARRYYGPFQVTAKIGPVAYRVNFPAGVRIHPVFHCSNLKPFRGEPGSTPAIPLPPNFHENQPLIFPLAILGSRRATAEPHNPWQVLVQWQGLSPEETSWEDWDQLRQDYHLEDKVILQGPGDDTGIGYEEEDAEEEEDQSSAQEKKKGINSGSNLVEGTVQSTEFHGKENAGMVNGKKSLISFMSCIVSDPQNAIETWKSPGGTISPAIANISSLQIVHLSGNCLVGNIRKELGYLVQVGQLSLSGNFLQGHIPSEFGSLHNLYYLDLGSNDFEGDIPPNLSFVFLSSNKLVGQLPLALANSTSLKWLHLEFNMLSGELPSKIVSNWLQLQFL

SEQ ID NO: 231490 - protein, 86 aa, Glycine max
  Coding DNA Sequence Number=SeqID_114712
MAPPPPADPNKKNVNSFAQMLQKGEIEGDGCWKKERNFEQLMEVVGNLKHKNVVELEGYLPPKIKTENIELKGTPKPRKGCHLISE

SEQ ID NO: 231491 - protein, 396 aa, Glycine max
  Coding DNA Sequence Number=SeqID_114713
  Gene Ontology: Mol. function=triacylglycerol lipase activity; Cellular component=chromatin; Biological process=lipid metabolic process
  Homolog annotation: Hit_ID=O49523; Match level="QueryCoverage=98%, HitCoverage=94%, E-value=1e-141, Identity=62%"; Hit description =Lipase-like protein
  Pfam annotation: Domain name=Lipase_3; Domain location=135-296; Score= 207.3; E_value=3.4e-59; Accession=PF01764.16; Description=Lipase (class 3)
MNSSIAKKWRQLSGQDHWKGLIDPLDIDLRRYIILYGEMAQAAYDAFNTEKASKYAGSCRYAKKSFFSKVALVNGNPYTYSVTKFLYATSEIDVPDAFIIKSFSREAWSRESNWIGYVAVATDEGKAALGRRDIVIVWRGTVQTLEWVNDLQFLLVPAPKVFGKNTDPKVHQGWYSIYTSEDPRSPFNQTSARSQVLSEVRRLVELYKNEEISITITGHSLGAAIATLNAVDIVTNGYNKPNDPSLKASPVTAIVFASPRVGDINFQKVFSGYKDLTTIRIRNELDIVPNYPLVGYSDVGEELKIDTRKSMYLKSPGNPSSWHNLEAYLHGVAGTQGSKGGFNLEVHRDIALVNKTLDALKDELLVPVSWRIEKNKGMFQQNDGSWKLMDHEEDDF

SEQ ID NO: 231492 - protein, 227 aa, Glycine max
  Coding DNA Sequence Number=SeqID_114714
MRCKKHLPDLTSTIGVCASCLRERLQPLLAAQAQSERSTNSDVDNNNHRRRKPKLKPEENPLPLNFPRSVSPYVTHRKSDCERRRERLFYGTPQMNAAACDGGAASENRRHGGRFWILSNLFRARSNKTESSPSHPPPSWFSTILHARRHNKCRHADRGLSPLTEVENFTEFSADTAQDRSDSGISSEDSPAKQNPTPETAHRRSRMGPAGKGLASMAFCLSPLVRA

SEQ ID NO: 231493 - protein, 816 aa, Glycine max
  Coding DNA Sequence Number=SeqID_114715
  Gene Ontology: Mol. function=GTPase activity; Cellular component =mitochondrion; Biological process=defense response to fungus
  Homolog annotation: Hit_ID=Q8S7E5; Match level="QueryCoverage=81%, HitCoverage=99%, E-value=0.0, Identity=73%"; Hit description =Putative phragmoplastin
  Pfam annotation: Domain name=Dynamin_M; Domain location=227-564; Score=223.5; E_value=4.7e-64; Accession=PF01031.10; Description =Dynamin central region
  Pfam annotation: Domain name=Dynamin_N; Domain location=42-218; Score= 296.3; E_value=5.7e-86; Accession=PF00350.13; Description=Dynamin family
  Pfam annotation: Domain name=GED; Domain location=572-665; Score =119.8; E_value=7.5e-33; Accession=PF02212.8; Description=Dynamin GTPase effector domain
  Pfam annotation: Domain name=MMR_HSR1; Domain location=40-219; Score =3.0; E_value=0.00052; Accession=PF01926.13; Description=GTPase of unknown function
  Pfam module annotation: Pfam domain module=Dynamin_M::Dynamin _N::GED::MMR_HSR1; Domain location=227-564::42-218::572-665::40-219
MTSMESLIGLVNRIQQACTVLGDYGAADNSAFSSLWEALPSVAVVGGQSSGKSSVLESIVGRDFLPRGSGIVTRRPLVLQLHKVDGRAKEYAEFLHMPGQKITDYAFVRQEIQNETDRVTGRTKQISPVPIHLSIYSPHVVNLTLIDLPGLTKVAVEGQPETIAQDIENMVRSFVEKPNCIILAISPANQDIATSDAIKLSREVDPSGERTFGVLTKLDLMDKGTNALDVLEGRSYRLQHPWVGVVNRSQADINKNVDMIVARRKESEYFETSPDYGHLANKMGSVYLAKLLSQHLESVIRARIPNITSLINKTIEELESEMNQIGRPIAADAGAQLYTILELCRAFDRIFKEHLDGGINLILCFFSEKLLCTAMQRHGKDLMYPPEYGKAILNDSYGVSSLSDSQVERRPGGDRIYNVFDNQLPAALRKLPFDRHLSLQNVRKVVSEADGYQPHLIAPEQGYRRLIEGALGYFRGPAEASVDAVHFVLKELVRKSIAETQELRRFPTLQAEIAAGTNEALERFREESKKTVIRLVDMEASYLTVEFFRKLPQEMEKAGNPANQPTPNVDRYGEGHYRRIGSNVSSYIGMVSDTLRNTIPKAVVYCQVREAKLSLLNHFYTQIGKKEAKQLSQLLDENPALMERRQQCAKRLELYKAARDEIDSDSDGANDCFLSVENGNSVERTLVQTKSENISLKTWNYFLHPLLASSTIKTDLNGCRYPSPCTSTPPPPPPQTPSPPMMPSSVLSTNALRAFSQSTPNCAHPSPYVSYLIFISNMLAFLTNNGMVMPLESETKDKEKFGRVLGLGMGSISYEG

SEQ ID NO: 231494 - protein, 152 aa, Glycine max
  Coding DNA Sequence Number=SeqID_114716
  Gene Ontology: Mol. function=phosphotransferase activity, phosphate group as acceptor; Cellular component=cytoplasm; Biological process =nucleobase, nucleoside, nucleotide and nucleic acid metabolic process
  Homolog annotation: Hit_ID=O04905; Match level="QueryCoverage=99%, HitCoverage=69%, E-value=9e-62, Identity=80%"; Hit description =Uridylate kinase
  Pfam annotation: Domain name=ADK; Domain location=1-123; Score=69.0; E_value=1.6e-17; Accession=PF00406.12; Description=Adenylate kinase
MIQNMIKEGKIVPSEVTIKLLQKAMQESGNDKFLIDGFPRNEENRAAFEKVTGIEPAFVLFFDCPEEEMERRLLSRNQSSLETFFSIIIKGREDDNIETIRKRFKVFLESSLPVINYYDAKGKVRKIDAARPIEEVFETVKAIFGPKNDKAD

SEQ ID NO: 231495 - protein, 79 aa, Glycine max
  Coding DNA Sequence Number=SeqID_114717
MESIFGHALTKSLDVKAHEAGLHSFDMYSIRTKRYLMQYTLKRNALSAIHLIFHTNTSKPSTYISDEYCSAIIIVNKSA

SEQ ID NO: 231496 - protein, 54 aa, Glycine max
  Coding DNA Sequence Number=SeqID_114718
MFSLHPYLGNRQSKLRFQHRLEIASFTGGTLLNLKSPAAAAGCHPRVRCPRCRQ

SEQ ID NO: 231497 - protein, 83 aa, Glycine max
  Coding DNA Sequence Number=SeqID_114719
  Homolog annotation: Hit_ID=Q9LYR6; Match level="QueryCoverage=71%, HitCoverage=9%, E-value=5e-14, Identity=68%"; Hit description =Peptide transporter-like protein
  Subcellular localization annotation: CTP_CleavageSite=40; ConfidenceScore=5.21e-01
MNTFLPIWGISLLTTIDIPLCMHRLLGSSFLTRVAQVLVVAFRKKNASFGSSGFIGLYEVPGRQPPIKGSRKITHVDEVAVSS

SEQ ID NO: 231498 - protein, 74 aa, Glycine max
  Coding DNA Sequence Number=SeqID_114720
MAEQALTFYKITVLSTCSRRKTTTYECAGVSNDVEIRYFSTSLLRRETMLKAQVITSVLTRNDVESAGYYIGVD

SEQ ID NO: 231499 - protein, 275 aa, Glycine max
  Coding DNA Sequence Number=SeqID_114721
  Gene Ontology: Mol. function=nucleic acid binding; Biological process= DNA integration
  Homolog annotation: Hit_ID=Q1ST43; Match level="QueryCoverage=63%, HitCoverage=12%, E-value=5e-18, Identity=31%"; Hit description =Integrase, catalytic region; Peptidase aspartic, catalytic
  Pfam annotation: Domain name=zf-CCHC; Domain location=107-124; Score =8.3; E_value=0.042; Accession=PF00098.13; Description=Zinc knuckle
  Pfam annotation: Domain name=zf-CCHC; Domain location=59-76; Score =6.8; E_value=0.074; Accession=PF00098.13; Description=Zinc knuckle
  Pfam module annotation: Pfam domain module=zf-CCHC::zf-CCHC; Domain location=107-124::59-76
MCIKSSSSCILEEMQQSGGFSACPLGFTLDKERQINSNELMGSMSLINAAGNNSSNSRPSCTYCGKDNHTIDRCYKKNGFSHNYASRGGKGTQSNPGRGNSGVKGNKVCTYCGFSNHTINDCYKKHGYPPGHKLYKVQNPNINNASSIREEGDGSPLDRNQETRNEDVRLTTQQYKALMSLPQQPLVQNNSQINQIGTATNKGSILSVTCSVSKTSQDEWILDSRAKDHATAFPHLFSLCKKIKPIMVKLLNGHTLTTILVGRIQITQFLYLEES

SEQ ID NO: 231500 - protein, 88 aa, Glycine max
  Coding DNA Sequence Number=SeqID_114722
MGGERNFNGGDGMGEEGKGGEKHYCMMGFTKNLVLKWDLGNFRRQLAEKLFKSCESAIGEEKQDFTIFLSSYSCIKDIVGMKYEVSKG

SEQ ID NO: 231501 - protein, 50 aa, Glycine max
  Coding DNA Sequence Number=SeqID_114723
MLENLQVPPSTTESTPVLKCYAPPNQRNVSANRRKSSVIYLRVELEKLKY

SEQ ID NO: 231502 - protein, 792 aa, Glycine max
  Coding DNA Sequence Number=SeqID_114724
  Gene Ontology: Mol. function=hydrolase activity, acting on ester bonds; Cellular component=cellular_component; Biological process =lipid metabolic process
  Homolog annotation: Hit_ID=Q9C6U9; Match level="QueryCoverage=99%, HitCoverage=83%, E-value=2e-91, Identity=49%"; Hit description =Lipase, putative
  Pfam annotation: Domain name=Lipase_GDSL; Domain location=111-419; Score=158.5; E_value=1.8e-44; Accession=PF00657.12; Description=GDSL- like LipaseAcylhydrolase
  Pfam annotation: Domain name=Lipase_GDSL; Domain location=434-792; Score=133.6; E_value=5.3e-37; Accession=PF00657.12; Description=GDSL- like LipaseAcylhydrolase
  Pfam module annotation: Pfam domain module=Lipase_GDSL::Lipase_GDSL; Domain location=111-419::434-792
FAEYYHHELQSELDKLRGLYPRANIIYADYYNAAFTLYRDPTKFGFTDLKVCCGMGGPYNYNTTADCGNPGVSACDDPSKHIGWDNVHLTEAAYRIIAEATILAACPYKSIFSFGDSFADTGNLYFSSHPPSHHCFFPPYGQTFFHRVTGRCSDGRLIIDFIAESLGLPLLKPYLGMKKKNVVGGANFAVIGATALDLSFFEERGISIPTHYSLTVQLNWFKELLPSLCNSSADCHEVVGNSLFLMGEIGGNDFNYLLFQQRSIAEVKTFVPYVIKAITSAVNELIGLGARTLIVPGNIPLGCSITYLTIYETMDKNQYDQYGCLKWLNKFAEYYNQKLQSELHRLQGLHSHANIIYADYYNAILSLYRDPTMFGPYNYNASADCGDPGVNACDDPSKHIGWDGVHLTEAAYRIIAQVLLLLLAATVTACYTSLFSFGDSLTDTGNLYFISPRQSPDCLLPPYGQTHFHRPNGRCSDGRLILDFLAESLGLPYVKPYLGFKNGAVKRGNIEQGVNFAVAGATALDRGFFEEKGFAVDVTANFSLGVQLDWFKELLPSLCNSSSSCKKVIGSSLFIVGEIGGNDYGYPLSETTAFGDLVTYIPQVISVITSAIRELIDLGAVTFMVPGSLPLGCNPAYLTIFATIDKEEYDQAGCLKWLNTFYEYHNELLQIEINRLRVLYPLTNIIYADYFNAALEFYNSPEQFGRSILLAFCVISTFLGCNLQSDTRIYFDVITGFGGNVLKVCCGGGGPYNYNETAMCGDAGVVACDDPSQYVSWDGYHLTEAAYRWMTK

SEQ ID NO: 231503 - protein, 753 aa, Glycine max
  Coding DNA Sequence Number=SeqID_114725
  Gene Ontology: Mol. function=RNA-directed DNA polymerase activity; Cellular component=nucleus; Biological process=RNA-dependent DNA replication
KPLIDIKVKLQEAREKLTHAQMELTLDRLNKDKIDRTKDCTEAVIKWIEMEEQMLQQRAKIRWLRLGDGNNAYFHASLKAKYTQTSIKKLYMNDGNFVTTQKEIKDEIMRFYGDLMGREEPNLDSVDINIMRKGCQLNFDQRKYLIGRITDEEIDKALKSIGDLKVPGIDGYGAKFFKDAWSIIKSDFTDAIREFFEKGKMYEPINTSLVILIPKNQEAKYARDYRSISCCTTIYKVISKVLTTRLSRVIKSIVHQSQATFVPGQKIHDQILLAYELIQGYERKGGTPRCMLQLDIQKAYDTVDWKALELIMREVGIPRQFINWVMKTVTIVTYKFVVNGEYTHSLKAKRGLRQGDPLSPLLFVIVMEYLHRSLQELRYTPNFNFHAKCEKLNIISLSFADDVLMFTRGDKISVDLLMQAFMNFSKSTGLVINPSKCKVYFGAVESCIKEEIKHITAFQEGSLPFRYLGVPLTGKKLSVNHYMSLIDKIVARITHWSAKLLSYAGRLQLIRSTTYAITNYWMTCFPFPKKVIKKINAICRSFLWTGGTTISRKSPISWKQVCTPKNQGGLNLINLEIWNAVTMMKLLWNVCNKKDSLWIKWINCYYMKNGDVMSMGIKDSCSWILKGILKQRQKIQSLTSWSTLLQKDRFVSKIMYNELQDVSSRVPWRKLFFSNLARPRAKFVFWTACHGRLATKDVWIQILEWQKINHQPKKWIEELSWAMAQGKGKGHRATLLKTALTETVYELWKYRNE

SEQ ID NO: 231504 - protein, 71 aa, Glycine max
  Coding DNA Sequence Number=SeqID_114726
  Gene Ontology: Mol. function=pyruvate decarboxylase activity
  Homolog annotation: Hit_ID=Q684K0; Match level="QueryCoverage=77%, HitCoverage=9%, E-value=2e-24, Identity=96%"; Hit description =Pyruvate decarboxylase isozyme 1
MAGLCLVVSEKACYFVRTEDDLTEAIAKATGPQKDSLCFIEVFVHKDDTSKELLEWGSRVAAANSRPPNPQ

SEQ ID NO: 231505 - protein, 209 aa, Glycine max
  Coding DNA Sequence Number=SeqID_114727
MTRGRGQPPKKKVFASPKNREGTSPRSDNGETPPEGEEASEGKNDDEIPRETLIDVEDGEAKKMKETEHNEVPKLWTDIISGNRVMENGMQLSYVAPKKVDGGYEVEIEDEDVEEELKYWESALIIYVIGGELSMNAVKNFMIKFWNFIQLPEVYYNDEGYFILRFKAMKDKEEVLKRGPYTIQRMTMFLIEWKEDFSMEKDMMRTLSI

SEQ ID NO: 231506 - protein, 157 aa, Glycine max
  Coding DNA Sequence Number=SeqID_114728
  Homolog annotation: Hit_ID=Q2HRL0; Match level="QueryCoverage=54%, HitCoverage=16%, E-value=2e-14, Identity=39%"; Hit description=RNA -processing protein, HAT helix
MIGKPMFTDECTANKLRVSYARILVEVDITQKMVDVITINKKGQRRQQKIEYEWKPLFCERCQKIGHRCTNSVNTKQGQRKQWSIKSVEADEPKTTTETTIEECEIPEASHRGEWNDVNKRGTGKKRNNHLVRAVHCENGFGALEIGNDHLGPVDNT

SEQ ID NO: 231507 - protein, 130 aa, Glycine max
  Coding DNA Sequence Number=SeqID_114729
  Homolog annotation: Hit_ID=Q10KZ6; Match level="QueryCoverage=88%, HitCoverage=20%, E-value=5e-34, Identity=62%"; Hit description =Proline-rich family protein, putative, expressed
MVILAKEPCAEVVVTQTGSDHPNESIHVLHVGKMRMKLCKGKTTIAKEYYSSFMQLCGVRGGGNAAAQAVFWQPKQGLSFVLAFESERERNAAIMLARRFAFDCNLSSTSYTLPFKIILAGPDHKAPLET

SEQ ID NO: 231508 - protein, 184 aa, Glycine max
  Coding DNA Sequence Number=SeqID_114730
MVEASGNRLPVCVIDYTEEWVTGNRLPVRCNRLHSAFLQIMMAAQLIHDRVEMECLEGAWETLEGNTRCRFRGTIRFTATSLVHPDEPARTLQRTMEWILPTPTPYRLVEPVQVIEVTSSEEDPEEDLEELPPEPAVDALDFLEGDEDPLLEVDSPEEVMSASEADSTEDSGPGEMAISGGSSS

SEQ ID NO: 231509 - protein, 49 aa, Glycine max
  Coding DNA Sequence Number=SeqID_114731
MDKGVYDGQLVLIDDIPKDASLSVQDYEDANDEKGEAHGVDAQNDDEDS

SEQ ID NO: 231510 - protein, 88 aa, Glycine max
  Coding DNA Sequence Number=SeqID_114732
MALTQHLQGFLGIIKLKANLRKVESFLNFTLNANITLASANAYLKGRVSNFEGEMKAIELSMIKGVTNDIKEDFSPIMVWFEDKLGKN

SEQ ID NO: 231511 - protein, 198 aa, Glycine max
  Coding DNA Sequence Number=SeqID_114733
  Homolog annotation: Hit_ID=Q1S159; Match level="QueryCoverage=69%, HitCoverage=39%, E-value=4e-33, Identity=55%"; Hit description=SH3
MKKGYGMLVLLETQAIDVSKCQEKVRETPGNIENSMKLEAAETKLQDLKTNMAILGKEAAAAMAAVEAQQQRLKQNVPIINEYSKYLISLRERKIISERQQSKAPLTPSVDNNMTPPPSYEKVNGVCAYQAHNGSTDSMGYFLGEVLFPYHGKADSIASNPIWAFNAARKGIPVSSKPNKSTLNELITLQKAFNSKGG

SEQ ID NO: 231512 - protein, 162 aa, Glycine max
  Coding DNA Sequence Number=SeqID_114734
  Homolog annotation: Hit_ID=Q1SSD6; Match level="QueryCoverage=18%, HitCoverage=4%, E-value=2e-07, Identity=83%"; Hit description =Protein kinase PKN/PRK1, effector
  Pfam annotation: Domain name=DUF547; Domain location=13-155; Score= -52.5; E_value=0.065; Accession=PF04784.5; Description=Protein of unknown function, DUF547
MINANCVQESLHSVSNGNLSFVGNLEKEQRRKGYAGEEGSMLMLLEGEIGVGVEGSELGGDGHGGAGTIKEAYNIGGHIISANAIEQAIFCFQTPHIGRGCLMVRIKRWIIKLYQSRQRYKLDKLLSYLVFGEVMGMAVTRAGVVTEALVAAMVLAASEKEE

SEQ ID NO: 231513 - protein, 73 aa, Glycine max
  Coding DNA Sequence Number=SeqID_114735
MTDEVWGVDSSDFSNFLDHLQEKVTDNIRVADGKVGTVEKNSCVSFEKETEEKGEGSFDHSLKEVPPKCWRVQ

SEQ ID NO: 231514 - protein, 73 aa, Glycine max
  Coding DNA Sequence Number=SeqID_114736
  Gene Ontology: Mol. function=structural constituent of ribosome; Cellular component=large ribosomal subunit; Biological process =translation
  Homolog annotation: Hit_ID=Q2HVI3; Match level="QueryCoverage=97%, HitCoverage=29%, E-value=1e-17, Identity=59%"; Hit description =Peptidase, cysteine peptidase active site; Ribosomal protein L30
MNMLHIVEPYVTYGYPNLKSVKELLYKRGYGKLNKQRTSLIDNSIIEQVLLIHNSVLLAGVLQWLFKAIEPHE

SEQ ID NO: 231515 - protein, 144 aa, Glycine max
  Coding DNA Sequence Number=SeqID_114737
MARKPRQDFSVSKVRFFSLFVAEYESQSKGKVSPSCSTQMETFTWMLGKLGRIDGDPVLRETRIWATWEYVSSVRGGQQGMVGLYALCGCGKLVVHHRPTATYGTWRYVAGVRRPWGRQASSWQSTDKRNKDHKARRLVVADQL

SEQ ID NO: 231516 - protein, 176 aa, Glycine max
  Coding DNA Sequence Number=SeqID_114738
  Homolog annotation: Hit_ID=Q10KZ6; Match level="QueryCoverage=76%, HitCoverage=20%, E-value=4e-27, Identity=51%"; Hit description =Proline-rich family protein, putative, expressed
MDQNKHCREGVHSRDGWGVNGNTLITKYGIVEALAVQLTQREGELIQEKSEVKKLTNFLKQASEDAKKLVNEERAFARFEIENARAAVQRVEEALQEHERMSQASGKQKLSNKKNSSIIMILIGCIENITVDIAVLHQDLEQLMKEVQEARRIKMLHQPSKRLDWSLGGGDEILEI

SEQ ID NO: 231517 - protein, 164 aa, Glycine max
  Coding DNA Sequence Number=SeqID_114739
  Homolog annotation: Hit_ID=UPI000034EE59; Match level="QueryCoverage =73%, HitCoverage=15%, E-value=6e-19, Identity=41%"; Hit description =transcription factor
MTRMTRDFGDTMQKDAVPAVSADIIFASLRFPNYKIGVNNQIMETKDSPKVLSMKEVVARETAQLLDQQKRLSVRDLASKFEKGLAAAAKLSEEARLREAASLEKHVLLKKLRDALQSLKGRVAGRNKDDVAEAIAMVGSFFRSGFSNLFSYLINNSYEADNIM

SEQ ID NO: 231518 - protein, 61 aa, Glycine max
  Coding DNA Sequence Number=SeqID_114740
MEKLDLKLATGYLNPLIDSEALLSIYIKEQCIKHDNHDTTSYLKKDVFKEHIDGNHYYHLP

SEQ ID NO: 231519 - protein, 195 aa, Glycine max
  Coding DNA Sequence Number=SeqID_114741
  Gene Ontology: Mol. function=hydrolase activity, acting on ester bonds; Biological process=lipid metabolic process
  Homolog annotation: Hit_ID=Q5VMA7; Match level="QueryCoverage=54%, HitCoverage=43%, E-value=2e-30, Identity=63%"; Hit description =Putative CPRD49
  Pfam annotation: Domain name=Lipase_GDSL; Domain location=6-165; Score=27.9; E_value=9.3e-06; Accession=PF00657.12; Description=GDSL -like LipaseAcylhydrolase
MTRPKIYLFGDSITEESFSVGGWGASLAHHFSRTADVVLRGYSGYNTRWALKVLERVFPASHGGDGGTGTAPIALSVFFGANDACVPDRCSAFQHVPLHEYKQNLHSIVSFFKSFDSCGVDKRALVAYIACHERVNYLSFGGVKCYDDFLVNMVVGFHELRSERWFQLTHVRGRGYGKCGCCLPLDHKIRCHKGP

SEQ ID NO: 231520 - protein, 522 aa, Glycine max
  Coding DNA Sequence Number=SeqID_114742
  Gene Ontology: Mol. function=binding; Cellular component=nucleus; Biological process=metabolic process
  Homolog annotation: Hit_ID=Q1SVE9; Match level="QueryCoverage=93%, HitCoverage=64%, E-value=2e-82, Identity=30%"; Hit description =Tetratricopeptide-like helical
  Pfam annotation: Domain name=PPR; Domain location=103-137; Score =28.4; E_value=2.5e-05; Accession=PF01535.11; Description=PPR repeat
  Pfam annotation: Domain name=PPR; Domain location=177-211; Score =27.9; E_value=3.6e-05; Accession=PF01535.11; Description=PPR repeat
  Pfam annotation: Domain name=PPR; Domain location=239-274; Score=5.6; E_value=1.6; Accession=PF01535.11; Description=PPR repeat
  Pfam annotation: Domain name=PPR; Domain location=341-375; Score =34.0; E_value=5e-07; Accession=PF01535.11; Description=PPR repeat
  Pfam annotation: Domain name=PPR; Domain location=37-71; Score=4.6; E_ value=2.1; Accession=PF01535.11; Description=PPR repeat
  Pfam annotation: Domain name=PPR; Domain location=377-411; Score =19.1; E_value=0.016; Accession=PF01535.11; Description=PPR repeat
  Pfam annotation: Domain name=PPR; Domain location=413-446; Score =11.3; E_value=0.34; Accession=PF01535.11; Description=PPR repeat
  Pfam annotation: Domain name=PPR; Domain location=480-514; Score =14.6; E_value=0.14; Accession=PF01535.11; Description=PPR repeat
  Pfam module annotation: Pfam domain module=PPR::PPR::PPR::PPR::PPR::PP R::PPR::PPR; Domain location=103-137::177-211::239-274::341-375::37 -71::377-411::413-446::480-514
  Subcellular localization annotation: CTP_CleavageSite=35; ConfidenceScore=5.08e-01
MKNAIFRPFFSSRGFCTSLISHHQPFPQNHDFIPPSTSFSNALQLYINSETPSHGQKIHSSILKSGFVPNTNISIKLLILYLKCNCLRYARQVFDDLRDRTLSAYNYMISGYLKQDQVEESLGLVHRLLVSGEKPDGFTFSMILKASTSGCNVALLGDLGRMVHTQILKSDIERDEVLCTALIDSYVKNGRVAYARTVFDVMSEKNVVCSTSLISGYMNQGSIEDAECIFLKTMDKDVVAFNAMIEGYSKTSEYAMRSLEVYIDMQRLNFRPNVSTFASVIGACSMLAAFEIGQQVQSQLMKTPFYADIKLGSALIDMYAKCGRVVDARRVFDCMLKKNVFSWTSMIDGYGKNGFPDEALQLFGKIQTEYGIVPNYVTFLSALSACAHAGLVDKGWEIFQSMENEYLVKPGMEHYACMVDLLGRAGMLNQAWEFVMRMPERPNLDVWAALLSSCRLHGNLEMAKLAANELFKLNATGRPGAYVALSNTLAAAGKWESVTELREIMKERGISKDTGRSWVGAD

SEQ ID NO: 231521 - protein, 323 aa, Glycine max
  Coding DNA Sequence Number=SeqID_114743
  Gene Ontology: Mol. function=protein binding
  Homolog annotation: Hit_ID=Q6L4C3; Match level="QueryCoverage=63%, HitCoverage=76%, E-value=1e-75, Identity=69%"; Hit description=RIKEN cDNA 1500006O09, related
  Pfam annotation: Domain name=DUF783; Domain location=106-302; Score =249.9; E_value=5.4e-72; Accession=PF05615.3; Description=Protein of unknown function (DUF783)
MENADLIAFTYAAMLCYDVDAILGKDNGRVGKGENEQRVLGAEWYFSLEGRSSPHWKRNHHSDLLTRYTTFPPFRLAAVIEMLGKTRKVSARGESVAANYAFGPSEDDVIIKHRLLTRTTTTRGDPPLKKLQKKFTSFVSEVDKDEDNNYNECDKLARAFLQELTTFEIPLLKSKAIVEANIREKENFNELKEEMNRQILQAQDDIEDLKKQLEESKVERRHKEECEAIRKLIAMQPPRSETMKVISELENEIAALDAENTAGSRLLELRKKQFALLLHVVLSGKGWPDTNFGSVVTGFGMDGWGKTNELLVETDSWQHGVEK

SEQ ID NO: 231522 - protein, 79 aa, Glycine max
  Coding DNA Sequence Number=SeqID_114744
MCCCSEDCECRPLGFLLGLPFAFLSLLISLVGVVVWIVGLLLTCICPCCLCVTIIVEFALALIKAPIVVMEWFISKIPC

SEQ ID NO: 231523 - protein, 353 aa, Glycine max
  Coding DNA Sequence Number=SeqID_114745
  Homolog annotation: Hit_ID=Q0WNP8; Match level="QueryCoverage=96%, HitCoverage=99%, E-value=8e-63, Identity=43%"; Hit description =Putative SF16 protein
  Pfam annotation: Domain name=IQ; Domain location=101-121; Score=20.7; E_value=0.0054; Accession=PF00612.17; Description=IQ calmodulin -binding motif
  Subcellular localization annotation: CTP_CleavageSite=25; ConfidenceScore=5.06e-01
MGSGDWFKTIISLRKSKQGRSKKAKAASIPSITKYDNLFCMRAIVMRMFLSLSGHILRQGILAQEKLNASKSNSYPGKESGGLANGTKSENLVSAGVSVETIAAKRIQTAFRAYKARKALRRMKGFTKLKILTEGFSVKKQASTAITYLHSWSKIQVEIRARRICMVTEDKIRRKKLESQLKLEAKLHDLEIFSSNALSNGSALLSVYLMKVEWCGGSETKEEILGRIHDREEAAVKRERAMAYAFSHQWRANSSQSQLLGNYELSKANWGWSWKERWIAARPWESRVPSLSITPKKSQHKQPSPSKVQKDKNTSTPKTPVSVKPPSANAKGTSKARRLSYPTTEKTVVQGVQ

SEQ ID NO: 231524 - protein, 223 aa, Glycine max
  Coding DNA Sequence Number=SeqID_114746
  Gene Ontology: Mol. function=manganese ion binding; Cellular component=mitochondrion; Biological process=acetyl-CoA catabolic process
  Homolog annotation: Hit_ID=Q8GYB1; Match level="QueryCoverage=81%, HitCoverage=63%, E-value=1e-52, Identity=57%"; Hit description=Nudix hydrolase 15, mitochondrial precursor
  Pfam annotation: Domain name=NUDIX; Domain location=34-167; Score =69.4; E_value=1.2e-17; Accession=PF00293.18; Description=NUDIX domain
  Subcellular localization annotation: CTP_CleavageSite=57; ConfidenceScore=5.24e-01
MGSNSTETGGIHNSPSSSNDLITKSKLTVLKKNKRAAVLICVFEGGDGNLRVFLTQRASSLSTHSGEVSLPGGKREEGDADDVQTALREAKEEIGLDPSLVSVLTLLPPFHTKYGVTIIPVVGVLSDKDAFSPILNSTEVEAIFDVPLEMFLKNDNRRAEEREWMGEKHLVHYFDYEDGNNKYVIWAITAAILIRAATLLLQRPPAFLEQRPKIWGGMTENGI

SEQ ID NO: 231525 - protein, 229 aa, Glycine max
  Coding DNA Sequence Number=SeqID_114747
  Gene Ontology: Mol. function=ATP-dependent helicase activity; Cellular component=nucleus; Biological process=mRNA processing
  Homolog annotation: Hit_ID=UPI0000162AB8; Match level="QueryCoverage =71%, HitCoverage=23%, E-value=8e-58, Identity=66%"; Hit description =ATP binding / ATP-dependent helicase/ RNA helicase/ helicase/ nucleic acid binding
  Pfam annotation: Domain name=Helicase_C; Domain location=126-220; Score=66.0; E_value=1.2e-16; Accession=PF00271.21; Description =Helicase conserved C-terminal domain
MVLLVTATLLGAVAGRCFAGSCCCRSSLLVVVAAGCGCWFAAVLFLFVAAALFKIYYRVGLGQGRGFNVQINYSEEPVQDYVQAAVSTVLLIHEREPAGDVLVFLTGQDDIDASVQLLNDEVQTTGKHSSGLIVLPLYSGLSRAEQELVFSQAPRGKRKVIISTNIAETSLTLEGIVYVVDSGFSKQRFYNPISDIENLVVAPISRASARQRAGRAGRVRPGKCYRCSS

SEQ ID NO: 231526 - protein, 272 aa, Glycine max
  Coding DNA Sequence Number=SeqID_114748
  Gene Ontology: Mol. function=RNA-directed DNA polymerase activity; Cellular component=intracellular; Biological process=RNA-dependent DNA replication
MREVVRKEVVKLLKARMIYPISDSQWMLERLADQQFYCFLDGYSGYNQITVNPEDQEKITFTCLFDVFAYRNMPFSLCNALATFQHCMLAIFSDLVEKSIEVFMDDFSVFGSSFDLCLSNLDTIVKRCVETNLVPNWVKYHFMVIEGTVLGHKIFVHGIEVDKAKVEVVEKLPLPTNVKGIKSFLGMLGFTKFDLEIKDKNGSENHVADNLSRLTIDEVTTQGPEIQQEFPYEKLFNIAKRPWFIEMTNFKAASALPDDLTWHQKKEISQGL

SEQ ID NO: 231527 - protein, 96 aa, Glycine max
  Coding DNA Sequence Number=SeqID_114749
MYKDKWTQPWPMGSEIYPEVHENPRTFFSSSSPILLELLAHGSVVPPSDLLRELRIITLYYLDSSFLEEEPIFDQIKMVLVLLVVHQQQNLQVEMC

SEQ ID NO: 231528 - protein, 88 aa, Glycine max
  Coding DNA Sequence Number=SeqID_114750
MGKEEDEQRLGDASERKSWKSLKRQRLGGERPPRGVELGRWWRKGECFTTATWRPRGNMEELRKRRRRCSLVPTAGSTRQWQGGGFVI

SEQ ID NO: 231529 - protein, 772 aa, Glycine max
  Coding DNA Sequence Number=SeqID_114751
  Gene Ontology: Mol. function=ionotropic glutamate receptor activity; Cellular component=membrane; Biological process=ion transport
  Homolog annotation: Hit_ID=Q69L11; Match level="QueryCoverage=94%, HitCoverage=80%, E-value=1e-112, Identity=32%"; Hit description =Putative Avr9/Cf-9 rapidly elicited protein 141
  Pfam annotation: Domain name=ANF_receptor; Domain location=56-398; Score=121.7; E_value=2.1e-33; Accession=PF01094.18; Description =Receptor family ligand binding region
  Pfam annotation: Domain name=Lig_chan; Domain location=571-772; Score= -13.8; E_value=5.4e-10; Accession=PF00060.17; Description=Ligand -gated ion channel
  Pfam annotation: Domain name=SBP_bac_3; Domain location=458-772; Score=-78.2; E_value=0.0067; Accession=PF00497.10; Description =Bacterial extracellular solute-binding proteins, family 3
  Pfam module annotation: Pfam domain module=ANF_receptor::Lig _chan::SBP_bac_3; Domain location=56-398::571-772::458-772
MHFLSTIPQTLAMIWLFYLLISLGLISGYQNEATNANNKVISIGAIIDVNSRIGKEQQVALDIAAQSYNSTSRTYKLALYFRNSTKDPLRAITLVEEMIYKQKVQVIIGMHKWSEAALVAEIGSQAQVPIIAFAEPTITPPLMTERWPFLVRLANSSTTYIKCIADIVQTYNWQRVVAIYEDDAYGGDYGMLALLSEALQDVGSMIEYHLVLPPISSLHDPGGLVREELLKLWQTQSRVFIVLQSSFEMAIHLFKEASKMGLVDKESVWIHPESITNLLDSVNKSSISYMEGALGIKTYYSENSTEYQDFEAQFRKKFWPKNAEEDNRYPGFYALQAYDSIKIVTQAVDRMAGRNTSSPKNLLREILSSNFLGLSGQIQFEDGQLLQNPILRIVNVAGRSYKEVCFWSQQHGFTTNLPIGQGGYNVAGNTKCFNGVRWPGDLKHDPKGWKMPTKQNPLRIAVRNRTSFSKFVNYDQNKKIYSGFCIDIFQSVLPLLGYDLPYQYYPIDGTYNDLVQLVYNKTYDAVVGDMTILEERMQYVDFTVPYAESGLSMIVPSKSEESAWMFTKPFTWELWMVTGAILIYTMLAVWYLERESNPEFHGNWKSQISTALWFTFSSLFFAHREKMSCNLTRMVMVSWLLLVLILTSCYTASLSSMLTVKQLQPNVTDIQWLKRNNMKIGCDGDSFVRSFLEKVENFKPENIINVTDEYNYDGAFKNNSIAAAFLELPYEKVFISECCNRYIGFTPRTRFGGLGFLFFSSSQSINNKIGFF

SEQ ID NO: 231530 - protein, 82 aa, Glycine max
  Coding DNA Sequence Number=SeqID_114752
MAEKIQELRQSYSNPFPFSWRFTFLFVDHNGDTAMVGATDTMRRFKEQHRPYEGGSVRMVDGKNRKVEEEVKTKERPVENHL

SEQ ID NO: 231531 - protein, 926 aa, Glycine max
  Coding DNA Sequence Number=SeqID_114753
  Gene Ontology: Mol. function=ionotropic glutamate receptor activity; Cellular component=membrane; Biological process=ion transport
  Homolog annotation: Hit_ID=Q84QE2; Match level="QueryCoverage=91%, HitCoverage=89%, E-value=2e-98, Identity=29%"; Hit description =Avr9/Cf-9 rapidly elicited protein 141
  Pfam annotation: Domain name=ANF_receptor; Domain location=57-397; Score=124.8; E_value=2.4e-34; Accession=PF01094.18; Description =Receptor family ligand binding region
  Pfam annotation: Domain name=Lig_chan; Domain location=575-837; Score= 179.3; E_value=9.8e-51; Accession=PF00060.17; Description=Ligand -gated ion channel
  Pfam annotation: Domain name=SBP_bac_3; Domain location=460-795; Score=-13.9; E_value=3.8e-07; Accession=PF00497.10; Description =Bacterial extracellular solute-binding proteins, family 3
  Pfam module annotation: Pfam domain module=ANF_receptor::Lig _chan::SBP_bac_3; Domain location=57-397::575-837::460-795
MNFHAQTYKAGKYLLLWPSLKILLLLFKCLIGAQVAYSFQNTSVGVVIDANSEVGKQQKRAMHIAAQTFNNNSKNHNNIILFFHDSGGIPLQAASAAEELIMKKKVKVIVGMGTWQEAALAADLGNKAQIPIISFSSPSIVPPLMQHRWPFLIQMAKDQAAHMNCIADIIHAYNWQKVIAIYEDNPYSGDSGLLSLFSEALQKGNAQIENRLVLPHFTSLSDPKGVVLDELLKLLPLKSRVFVVLQASFPMVTHLFREAKKIGFLGKDSAWIINEGITSMLDFANKSVLSSMEGTLGIKTYYSTNSTAYTHLQENFQSEHAETAGTKPGSDALRAYDSVIIITEALEKMNRKSSNSKPRVFLEKILSSNFNGLSGNIRFQGSHLSNTAVLRVINVVNREYKELDFWTPKFKFAGSLEILKDRETRGDYATNNLAGPVVWPGGLISADPIGWKMPTDTERLKVAIPTNPAFVNFLKEDSQKQYSGFCIDLFHEARKILSDKYSGMPYEFHPFNESYDKLLQNVINKSHDVIVGDVTILAERSKDVWFTQPYTESGLSLILPIETEGSAWLFMKPFSSEMWIATIGILIYTMFIVWFLEHHLNPDFGGPLKNQISTTLWFAFSSLFFAHKEKINSNSARVVVGVWLFLVFVLTSSYTANLSSLLTVKRLKSGRDVEWLKQNNLSVGCDNSSSFVKNYMINVYNFTPQQIIEVDGEHDIVDKFKSKNISALFLESPYEKVFLNKYCKDYTAITATYKFGGLGFVFQKGSPMAKDFSEAFLTLAENGALKTLEEKWLTPSKECSNGSTSPETESLTLHNFWGLYIICAAISTICFVMALLKNHLNKHNHIEEEDQHQDSATADDDSVWKKALRIGTGFYNNVNNKTLGRAATFGGMQLTRRRNSSRWQSISTSDDVANPQSSQSAVKDML

SEQ ID NO: 231532 - protein, 914 aa, Glycine max
  Coding DNA Sequence Number=SeqID_114754
  Gene Ontology: Mol. function=ionotropic glutamate receptor activity; Cellular component=integral to membrane; Biological process=ion transport
  Homolog annotation: Hit_ID=Q8LGN0; Match level="QueryCoverage=91%, HitCoverage=90%, E-value=1e-99, Identity=29%"; Hit description =Glutamate receptor 2.7 precursor
  Pfam annotation: Domain name=ANF_receptor; Domain location=54-393; Score=131.9; E_value=1.8e-36; Accession=PF01094.18; Description =Receptor family ligand binding region
  Pfam annotation: Domain name=Lig_chan; Domain location=563-824; Score= 165.1; E_value=1.8e-46; Accession=PF00060.17; Description=Ligand -gated ion channel
  Pfam annotation: Domain name=SBP_bac_3; Domain location=448-782; Score=-39.2; E_value=1.8e-05; Accession=PF00497.10; Description =Bacterial extracellular solute-binding proteins, family 3
  Pfam module annotation: Pfam domain module=ANF_receptor::Lig _chan::SBP_bac_3; Domain location=54-393::563-824::448-782
MNFHAQTSKALSNLLLWPSLTTLLLLIIGAQVAYSFQNISVGVVIDVNSVAGKQQRRAMQIASQSFNNYSKNHNINLFFSNSGGIPLQAASAAEELIMKKKVKVIVGMGTWQEAALVADLGNKAQIPIISFSSPSIVPPLMQHRWPFLIQMAKDQAAHMNCIADIIHAYNWQKVIAIYEDNPYSGDSGLLSLFSEALQKGNAQIENRLVLPHFTSLSDPKGVVLDELFKLLPLKSRVFVVLQASFPMVTHLFREAKKIGFLGKDSAWIINEGITSMLDFANKSVLSSMEGTLGIKTYYSTNSTAYTHLQENFQSEHAETAGTKPGSDALRAYDSVIIITEALEKMNRKSSNSKPRVFLEKILSSNFNGLSGNIRFQGNHLSNTAVLRVINVVNRDYKELDFWTPKFKFAGSLGGDYATNNLAGPVVWPGGLISADPIGWKMPTDTEPLKVAIPTNPAFVNFLKEDSQKQYSGFCIDLFHEARKILSDKYSGMPYVFHPFNESYDKLLLNVINKSHDVIVGDVTILAERSKDVWFTQPYTESGLSLILPIETEGSAWLFMKPFSWEMWIATIGILIYTMFIIWFLEHHLNPDFGGPLKNQFSTTLWFAFSSLFFAHKEKINSNSARVVVGVWLFLVFVLTSSYTANLSSMLTVKRLNSGRDIDWLKQNNLSVGCDISSFVKNYIINVYDFHPQQIIEVNGEDDILNKFKSKNISALFLESPYEKVFMNKYCKDYTAVTAANKFGGLGFVFQKGSPMARDFSGAILTLAEMGKLKTLEEIWLTPPNECSNGSTSPETESLTLHNFWGLYIISAAISTICFVRALLTKWLHDDHNHYHHEEKAQLQGNITANDDNSVWKKAIIISTGFYNTMNNKTLGRAATFSGTHRQNSSRWESISTSDDVANLQRSMSAVKDML

SEQ ID NO: 231533 - protein, 50 aa, Glycine max
  Coding DNA Sequence Number=SeqID_114755
MEEDELYRFVERTASSHQAHRFSPSAEREKSAMRKFTNRLELEAGAVLRA

SEQ ID NO: 231534 - protein, 134 aa, Glycine max
  Coding DNA Sequence Number=SeqID_114756
MGGFHQQTLLPRGENTETFSSLTSYPELRRSEFLIGGYVGAKASLLSTAPLSVTMTQELVARGDTLRLSAPRHSVTPSVIDEQRPMWSSAPFPEMSAFSDGDFSSLTSYPELRRSEFLIGGYVGTRALLLSAAP

SEQ ID NO: 231535 - protein, 193 aa, Glycine max
  Coding DNA Sequence Number=SeqID_114757
MTEFSNNLMQMFQKGSPLARDVSKAILHLSEKKAELKRLEEKWLITSPASCSNVTSDDTDSLKLRSLWILYVISGATSTICVLLSAIQSLVKSCHQCQAVAPEGNDTPSDHKVWEKVITHAKQIFNKKINNSSEAQEQVVTDCSLRWDRVNMTVSPEHQQEMASPLPGILMLPSPPPEVQMTTHDLGITNTSK

SEQ ID NO: 231536 - protein, 212 aa, Glycine max
  Coding DNA Sequence Number=SeqID_114758
  Homolog annotation: Hit_ID=Q8VZ75; Match level="QueryCoverage=31%, HitCoverage=65%, E-value=3e-13, Identity=46%"; Hit description=RNA helicase-like protein
  Pfam annotation: Domain name=Tyr_Deacylase; Domain location=62-171; Score=2.0; E_value=1.2e-09; Accession=PF02580.7; Description=D-Tyr -tRNA(Tyr) deacylase
  Subcellular localization annotation: CTP_CleavageSite=70; ConfidenceScore=5.31e-01
MRKSNSTQRFNDKDELKMQLQLVPPCRVPRVGDIHRIETSTSTSTVTVRRRRRRNAVTTAMRAVVQRVASASVEVEGRIVSEIGPGLLVLVGSTTLIPTPTPITLSQFTLYGFLKGNKPDFHVAMAPQRAKPFYASLVDRDKKGTALGEGCSQTLTSVPIRTSSIKQLLDLSAPEGSLSETDSLSERFFNPLSKCLAKQLSGSVSLSESSAT

SEQ ID NO: 231537 - protein, 481 aa, Glycine max
  Coding DNA Sequence Number=SeqID_114759
  Gene Ontology: Mol. function=signal peptidase activity; Cellular component=integral to membrane; Biological process=signal peptide processing
  Homolog annotation: Hit_ID=Q9SEL8; Match level="QueryCoverage=76%, HitCoverage=45%, E-value=9e-95, Identity=51%"; Hit description =Putative protease SppA
  Pfam annotation: Domain name=Peptidase_S49; Domain location=226-413; Score=-1.0; E_value=3.6e-06; Accession=PF01343.9; Description =Peptidase family S49
  Subcellular localization annotation: CTP_CleavageSite=62; ConfidenceScore=5.83e-01
MSKLLLLPTPPLTTSIHRFNTSSSASALQFQCRFSLSLLSRLHHSPTSFRSLVRRTRDLPLRAFDSSSDANSEEKEEVKENEEGVDNRSGSRIADEDYPSGQFDFEPVTGWRSFLVKLKMLVAFPWERVQKGSVLTMKLRGQKKVMHSQCNTVFAFVESFQTTICDWMMISDQVKSRFSPGLSLPQICENFLKAAYDPRISGIYLHIDSLNCGWGKVEEIRRHILDFKKSGKFVLAYVPLCQEKEYYLASACEEIYAPPSAYFSLFGLTVQASFLKACPTCVRVCICIAMGVYILERDLLGVLDNIGIEPQVERIGKYKSAGDQLARRTMSEENCEMLTTLLDNIYTNWLDKVSSAKGKTREDIENFINEGVYQVDKLKEEGLISNINYDDEDVNTSQAKTITAMLKERLGVKSDKDLRMVDYRHPVPSAPSPLHHNHIQKVRRDEGWRERKRERERSRERGRQNVSERESSRERGRYRVR

SEQ ID NO: 231538 - protein, 157 aa, Glycine max
  Coding DNA Sequence Number=SeqID_114760
  Gene Ontology: Mol. function=hydrolase activity, acting on ester bonds; Biological process=lipid metabolic process
  Homolog annotation: Hit_ID=Q8LFP6; Match level="QueryCoverage=62%, HitCoverage=26%, E-value=7e-37, Identity=72%"; Hit description=GDSL -motif lipase/hydrolase-like protein
  Pfam annotation: Domain name=Lipase_GDSL; Domain location=14-154; Score=-6.1; E_value=0.0056; Accession=PF00657.12; Description=GDSL -like LipaseAcylhydrolase
  Subcellular localization annotation: CTP_CleavageSite=60; ConfidenceScore=5.06e-01
MAKVEASNQKLSGFYVFGDSTVDPGNNNYIKTPFRSNFPPYGRDFSNQVPTGRFTNGRLATDYIASYVGLKKDVLPPYLDPNLRIEELMTGVSFASAGSGFDPLTPSMTTCSAGPKTVSFTISFLLLYASSHIYWDIYLGTHYLIVHLVIIKKEKNL

SEQ ID NO: 231539 - protein, 282 aa, Glycine max
  Coding DNA Sequence Number=SeqID_114761
  Homolog annotation: Hit_ID=Q1T1F7; Match level="QueryCoverage=45%, HitCoverage=25%, E-value=2e-14, Identity=32%"; Hit description=IMP dehydrogenase/GMP reductase
MEIELFLIFLGVPYMSWVILLLRDFSQSGSYAWGVVALVHTYDHLNDACKSSGRQLAGYITLLQCWIYEHFPTVHESVIDPEYDEMSPRACWWLTTKAYSKGFPASTYQTRIDALMILDVCWMPYGEHRGVRAFDLISCFQGELRWDPVVVTHRPERMVDALLGPSSSRGTNLSYAWLAVDPPRHPPIPHHDTYVEPDIPVVPATPEAGPSHAPSDVEQPRHAVDACQVIAERLERLLNLRIVTVGTEIHEVMEDCIRIARGVTTDGSVYVRAQRRRCTDQS

SEQ ID NO: 231540 - protein, 79 aa, Glycine max
  Coding DNA Sequence Number=SeqID_114762
  Subcellular localization annotation: CTP_CleavageSite=57; ConfidenceScore=5.33e-01
MKFKHKRYATIILRLKPTCNVVPFFSEKPRRAPRRRPVRVTLFCENAPTMWDRHRLTGALKPDDPQGLHSEQSVSASPS

SEQ ID NO: 231541 - protein, 39 aa, Glycine max
  Coding DNA Sequence Number=SeqID_114763
MVYGVRPIVDEYDKLIEYVCLEGLDWEMAEKLHEEMKGS

SEQ ID NO: 231542 - protein, 86 aa, Glycine max
  Coding DNA Sequence Number=SeqID_114764
MEAETQTTQQKGEEVYLDSRQEEPSKHHEHNNNNAEEEQKKKINRAWAEQEEGALAIAEEEEAGCTNFFKKRQGYFRLLSLSAGCT

SEQ ID NO: 231543 - protein, 43 aa, Glycine max
  Coding DNA Sequence Number=SeqID_114765
MRHWALDSMNQTAQHYCCCVRGALKVLLFRQDMHCATLLSTVE

SEQ ID NO: 231544 - protein, 265 aa, Glycine max
  Coding DNA Sequence Number=SeqID_114766
  Gene Ontology: Mol. function=transcription factor activity; Cellular component=nucleus; Biological process=regulation of transcription, DNA-dependent
  Homolog annotation: Hit_ID=O49515; Match level="QueryCoverage=81%, HitCoverage=68%, E-value=6e-24, Identity=36%"; Hit description=EREBP - like protein
  Pfam annotation: Domain name=AP2; Domain location=121-186; Score =152.1; E_value=1.5e-42; Accession=PF00847.10; Description=AP2 domain
MDIHSNHGATSEGILENVWAKIMSSDGADGRKGDAAESSNSWEELPNLDGREGSMEILQRLPSLGRWISMGADFWEEVLDGIILPNTSNREDSSHNNLEIGSANETRNKVEDALRIEKAITKHYRGVRRRPWGKYAAEIRDSSKKGARVWLGTFDTAEEAALAYDKAALRIRGPKAYLNFPLERGANALACDHKGTNHLACTCIGNKEKLINSRKRASMEREAFDDMVNEQPATKKLECMVENELGAFVFQDLGSDYLDSLLSSF

SEQ ID NO: 231545 - protein, 83 aa, Glycine max
  Coding DNA Sequence Number=SeqID_114767
MSNNTVNSDDAMHRLLSMMCATAYYHNLPHDGTTKAYMDKPKHSSPREKMSGVTTNVYSRKTLEKPKRAFNLFKDNFTTLVIS

SEQ ID NO: 231546 - protein, 161 aa, Glycine max
  Coding DNA Sequence Number=SeqID_114768
MSLTNRDLDVRAKVERLEGQLQVKDKDIATITRTVDAYESKNQELVAENDDLRALLRSMQRFAILENNQAQTDYDQVDRLINQSEIIHSSSANAVFRSDKKKSILLNPTMMLPDIITAIQSSIRDDDVTPIITAFWYRCHIYQFNGRVEYRAIQIIDKEGV

SEQ ID NO: 231547 - protein, 262 aa, Glycine max
  Coding DNA Sequence Number=SeqID_114769
  Gene Ontology: Mol. function=chitin binding; Cellular component =extracellular region; Biological process=chitin metabolic process
  Homolog annotation: Hit_ID=UPI000044A8F0; Match level="QueryCoverage =98%, HitCoverage=100%, E-value=3e-36, Identity=29%"; Hit description= PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
MTSPSEGYTPSPLEGYTPSPTEDYTSSPLEGYTPSPSEDYTSSPSKGYTPSPLEGYVPSPPEDYTSSPSEDYTSSPSEGYTSSPSEDYMSLPSAGYTSSPSEGCTPSPSEDYTYLPSEGCTPSSSEDYPSSPSEGYTPSSLRGLIVLALRGLYDLTFRGLHALTFRGLHVLAYRGLHVLTFIRLHVLAIRGLHVLTIRGLHVLPFRGLHALAFRGLHALAFRGMHGLTFRGPHALSFRGLHVLAFRGLHDLAFRGLHALAFK

SEQ ID NO: 231548 - protein, 57 aa, Glycine max
  Coding DNA Sequence Number=SeqID_114770
  Subcellular localization annotation: CTP_CleavageSite=29; ConfidenceScore=5.27e-01
GMDQSSALSRMTLHSAQMHNSSFFQILPRAQSRSVASSGWLAKLEDWLSERMKINIS

SEQ ID NO: 231549 - protein, 264 aa, Glycine max
  Coding DNA Sequence Number=SeqID_114771
  Gene Ontology: Mol. function=metalloendopeptidase activity; Cellular component=extracellular region; Biological process=proteolysis
  Homolog annotation: Hit_ID=Q99132; Match level="QueryCoverage=56%, HitCoverage=42%, E-value=8e-66, Identity=79%"; Hit description =Extracellular metalloprotease precursor
  Pfam annotation: Domain name=Peptidase_M4_C; Domain location=34-196; Score=72.0; E_value=1.8e-18; Accession=PF02868.6; Description =Thermolysin metallopeptidase, alpha-helical domain
MVFGDGDGEIFNRFTIAIDVVAHELSHGVTETEAGLIYFEQSGALNESLSDVYGSLVKQYHLKQTADKADWLIGEGLLAKGINGKGLRSMSEPGTAYDDPLLGKDPQPAHMKDFIMTREDNGGVHLNSGIPNRAFYLAATAIGGYAWKKRVPELTDDAVVELAREGGVAFIPKLSGQRTIALSSLNEAQRQRLVSILEQAFPRGQPPGQASSPGSGDQRYFRIQIIWTGQNQAHYTDIIVLVPEQEAPESLVELWKKGEGCVCD

SEQ ID NO: 231550 - protein, 91 aa, Glycine max
  Coding DNA Sequence Number=SeqID_114772
MNALLEPKLLNPRKTMIYWQPNPITSLESSSDSIFVSRICPLDLMMKYVQFQLSSAHQWAKRASTAKCSDENPETGQIQAKCPSGEGRRPK

SEQ ID NO: 231551 - protein, 266 aa, Glycine max
  Coding DNA Sequence Number=SeqID_114773
  Gene Ontology: Mol. function=oxidoreductase activity; Biological process=amino acid metabolic process
  Homolog annotation: Hit_ID=Q8PMS6; Match level="QueryCoverage=56%, HitCoverage=41%, E-value=7e-72, Identity=86%"; Hit description =Leucine dehydrogenase
  Pfam annotation: Domain name=ELFV_dehydrog_N; Domain location=111 -233; Score=197.0; E_value=4.4e-56; Accession=PF02812.8; Description =GluLeuPheVal dehydrogenase, dimeri
AISAEGSASPCRLAAAAATACRDTAANRDGAATVERASQPRSDRHQAGVIAARPVVVVPLPSLTALPLHANPATRRRRSIGRTFIFFNRKFAADRAIGDAMLFETLATTGHEQVVFCHNHDAGLKAIIAIHNTTLGPALGGVRMRPYASTDEALADALRLSRTMTYKNALAGLNVGGGKAVIIGDPKVDKTEVLFRAFGRYVDSLGGRYITAEDVGTDVNDMENIYLESQFVTGVHQVHGGSGDPAPFTAYVRCSTDGVDALQVRP

SEQ ID NO: 231552 - protein, 140 aa, Glycine max
  Coding DNA Sequence Number=SeqID_114774
MVMGDPISRLSFPVEKTPRLFQVSQVIQNYVEAADPMIHGDTLRLSAPFCHPEAAGPMTSRDQVWSFCTLVSSRGGGPDDTRRYLTVIRTLLSSRGGGPDDKQRPNLVILSLSNLLRNFAKVSTVLRRSSFVLHRSSIFN

SEQ ID NO: 231553 - protein, 165 aa, Glycine max
  Coding DNA Sequence Number=SeqID_114775
  Subcellular localization annotation: CTP_CleavageSite=36; ConfidenceScore=5.09e-01
AKFDIAEATKVKTKVMSTVATRWRQFKSTLTSKFVFAKSEGQQTQDVVTKYGLDPEAWKQFEETRLTPNWEGIRKRAQSIHKHNDCPHVLSRGGYDLLEKKLLDEKRKRIQEEALLSENSASLDEPPSPIKRHVKWKVARTRAVGNMTSESAQEIADKIDSLEEQ

SEQ ID NO: 231554 - protein, 205 aa, Glycine max
  Coding DNA Sequence Number=SeqID_114776
  Homolog annotation: Hit_ID=Q9FLU4; Match level="QueryCoverage=82%, HitCoverage=73%, E-value=3e-18, Identity=33%"; Hit description =Arabidopsis thaliana genomic DNA, chromosome 5, TAC clone:K18P6
  Pfam annotation: Domain name=DUF599; Domain location=4-192; Score =135.3; E_value=1.7e-37; Accession=PF04654.3; Description=Protein of unknown function, DUF599
MSISLTLQSWDLRTMTREFGLKELCRQAEKRDVSTALSVIQSNTTAATFLASVSLTLCSLIGAWIANRSNIFFQSQLIYGDTSPNTISIKYICLLTCFLVAFSCFVQSARHFVHANYLISTPDSFIPVSSVEIAVIRGGDFWSLGLRALYFALDLLLWFFGPIPMFICSVVMVLVLLYLDSNSRPLHSNQSQGNQFQMAKRGGFN

SEQ ID NO: 231555 - protein, 173 aa, Glycine max
  Coding DNA Sequence Number=SeqID_114777
  Gene Ontology: Mol. function=4-alpha-hydroxytetrahydrobiopterin dehydratase activity; Biological process=tetrahydrobiopterin biosynthetic process
  Homolog annotation: Hit_ID=Q6QJ72; Match level="QueryCoverage=94%, HitCoverage=70%, E-value=5e-40, Identity=51%"; Hit description =PCD/DCoH-like protein 2
  Pfam annotation: Domain name=Pterin_4a; Domain location=31-128; Score= 23.9; E_value=8.6e-06; Accession=PF01329.9; Description=Pterin 4 alpha carbinolamine dehydratase
DPPGVSSVHTSSTFCTTNKDLSTENCVPCNTKDLQPMTEDAARTMLQQWNLVNEDGVLKLRRSWKVKTFTKGLEFFRIIAGLAEAEGHHPDLHLVGWNNVTIEIWTHSVETQSNYICELHQRANMAISNPLPTPMVPGLKLSALGGLTQNDFILAAKINELNLHDLLRRKTSN

SEQ ID NO: 231556 - protein, 63 aa, Glycine max
  Coding DNA Sequence Number=SeqID_114778
MCLLGDLENLFYPGILKIICGKECIRKREMEDIDIPGVLSNGREITVKRLSKNSEQGLQEVQN

SEQ ID NO: 231557 - protein, 1164 aa, Glycine max
  Coding DNA Sequence Number=SeqID_114779
  Gene Ontology: Mol. function=DNA binding; Cellular component=beta -galactosidase complex; Biological process=DNA integration
  Homolog annotation: Hit_ID=Q1SH28; Match level="QueryCoverage=80%, HitCoverage=95%, E-value=1e-164, Identity=38%"; Hit description =Integrase, catalytic region
  Pfam annotation: Domain name=rve; Domain location=510-669; Score= -8.4; E_value=0.03; Accession=PF00665.16; Description=Integrase core domain
  Pfam annotation: Domain name=zf-CCHC; Domain location=286-303; Score =6.7; E_value=0.077; Accession=PF00098.13; Description=Zinc knuckle
  Pfam module annotation: Pfam domain module=RVT_2::Retrotrans _gag::rve::zf-CCHC; Domain location=694-937::107-212::510-669::286-303
  Subcellular localization annotation: CTP_CleavageSite=73; ConfidenceScore=5.61e-01
SAFPSQMLDTPPISPKKSSSSPKHDAGSGTVTTDPTLNPSSPYFIHPSEGPSSVSITPILDGTNYHSWSKAFRMALISKNKMAFLLGTLPVPLVADPLHSAWERCNTLIMSWILKSISPSIAQSVIFLECAVDIWDDLRERFSQGDLLHIAELQDEIYGMSQNNRTVSEFYTALKTMWEELDNYLPFPVCTYDAKKYHQQDFIIRFLKGLDDRFSVVCSQILLMDPLPTINRVFSMVVQQERQLRVPSSASPEPNSFVNAAVNSFQGKGRGGYGSTSTIKGAVSSKKCAYCHRAGHTVDVCWGKHGYPPGHPRYPGRPRFNNRDSSSSANSVAVDEVVEGGCSDFGTSSSNPINLTQAQYQSLMALIQPMQLKSTSDSTGPHSPHQANLLHAIPNGPKRVSESNGATDHITSSLDYFTSYSKIKPIKINLPNGDSVTAYFSGTERSMLRMIGLAKLKQGLYQLDVNQEAKAILPTTSFTNKNVVCTISSSNLWHYRLGHLSGNRLNISNRASKVFDLVHMDIWGPFSKVSIHGEKYFLTIVDDYSRYTWVVLLKSKSEMGYAKNLTQGPNKEFFLVFKLEQKQPNLPLLLDKPPSHHHLFQNSQTPFLHLFPPHILLQFTLQHLNLHLTTKFLSFLDAHPVLTNLPFVLPITSASALSYSHVSESDRHYLMNFSSEIEPRNYQEAISQQCWHDAMRDEIAALKLNNTWEIVDTPANVKPIGCKWVYKIKRNSDGSVERYKARLVAKGFSQVEGIDFFETFSPIVKMTTVCVILALASIYRWDLQQLDVSNAFLHGDLSEEVYMSIPPGLQGHGSPQCCKLKKSLYDLKQASRKWYEKFSTLLMSSGYQQAHSDHSLFVKHYNGTITALLIYVDDIVLTGNSLTEMAQIKSILRSNFRIKDLGPLKYFLGLEFNTLDSSMRLRQNDSSDFLDDPLSYRRLVGRLIYLTTTRPDIVYATQQLSQFMAHPTKSHLGAARRVLRYLKSCPSKGLFFKRDSPTHLIGFSDADWATCVDTRRSITAEYRALATSTCELQWLSYLLDDLKITRTKSAVLYCDNQSALYIAANPVFHERTKYLEIDCHLVREKSQAGVMRLLPVPSCYQLADMFTKALPPRSFTSNVSKLELVDLYTPPASDIMRKRLVISVKEGLAPGLGAQHCSISVLHS

SEQ ID NO: 231558 - protein, 1174 aa, Glycine max
  Coding DNA Sequence Number=SeqID_114780
  Gene Ontology: Mol. function=protein-tyrosine kinase activity; Biological process=protein amino acid phosphorylation
  Homolog annotation: Hit_ID=Q5XTZ4; Match level="QueryCoverage=22%, HitCoverage=82%, E-value=1e-110, Identity=75%"; Hit description=Salt- inducible protein kinase
  Pfam annotation: Domain name=PB1; Domain location=177-264; Score =99.0; E_value=1.4e-26; Accession=PF00564.15; Description=PB1 domain
  Pfam annotation: Domain name=Pkinase; Domain location=939-1166; Score= 146.6; E_value=6.4e-41; Accession=PF00069.15; Description=Protein kinase domain
  Pfam annotation: Domain name=Pkinase_Tyr; Domain location=939-1174; Score=148.1; E_value=2.3e-41; Accession=PF07714.7; Description =Protein tyrosine kinase
  Pfam module annotation: Pfam domain module=PB1::Pkinase::Pkinase_Tyr; Domain location=177-264::939-1166::939-1174
MEPKNEEFQSGSQSVIQDHMDGMHTIRRPSDYNMSDVKPVLNYSIQTGEEFALEFMRDRVNLRKPVFSNVSDSNSNYATGCMELKGVLGISHAASESGSDISMLSKAEKGPTEFNRQSTSLHGEGSNYGSIRSIPRTSLNQENSRFVCEYGSSVGSDSSSTMMKCLCSFGGRILPRPSDGKLRYVGGQTRILRLRKDISWQELLQKALVMYNLVHVLKYQLPGEDLDALVSVSSEEDLQNMMEECNLLDNRERSQKLRLFLFSLSDLEDAQFVLSSIGGDSEIQYVLAVNAMDFGSINSSTPLGVSFSADDLNELERQTAERETSRVAAESIGVSNAPLTNKSDSSLTIHSSQPVLPNASNAYEINQLSYGDQMMQVWEYSRQYFIHHGLNSSHNPVVGETSIPMAPHLLNSQQGVLNEDNLSSGLQIQNSQLSTVQVKQGSDPGKVLSSETPSPAISQPIDSYLKSNFPEAPVVVSMPEGLPPSLPSTKKVQHKDYEQVSSTSSSAFVPSYVDSHTNAIDLSCLHPPPLPERVYYSERTPREQVELLNRSSKSDDTHNSQIHVSDLLSDVNPENPVTESGDNLHDGKMLNPTEELGTVAKPLLADGLTIDNGFSKNQMSKPLPDTNSLVKSKLSEHTDPELKSVLPSNEGTENYRKDNHTKLLVDETETKGGKSDLPALHHVSSGKRLDDLASNLPEIDWGEASGKESNDGCMVQELPVSVTGNITKDIYQDFPPTVVSEQSQGDILIDIDDRFPREILSDMFSKAILGEDPSSLHPLPGDGVGLSINMENHEPKRWSYFHKLAQEGIDNVSLIDQDHAGFSPVIGKAGDNRTHHVTLLTNDGHPLHHEDSHLDFNEENQEDLHRRIGTETTVLKSNYNQSQLKENESMQFDAMMENLRMQESEFEDGKFDAKNSNLPPLDSSFGDLSTVQVIKNEDLEELRELGSGTFGTVYHGKWRGTDVAIKRIKKSCFTGRSSEQERLTVEFWREADILSNLHHPNVVAFYGVVQHGPGGTMATVAEYMVDGSLRHVLLRKDRYLDRRKRLIIAMDAAFGMEYLHSKNIVHFDLKCDNLLVNLKDPLRPICKVGDFGLSKIKRNTLVTGGVRGTLPWMAPELLNGSSNKVSEKVDVFSFGIVLWEILTGEEPYANMHYGAIIGNILCSSFICTVVEPEL

SEQ ID NO: 231559 - protein, 164 aa, Glycine max
  Coding DNA Sequence Number=SeqID_114781
MWEGMHAYVHVILTLITYIHDPNANTLLSPPLGPPSMQGSKLHDITTHHPTKPHIIYTIILLICGSQPLLDHNITSSKNLLHLLILTKQGPRKQLERRVQLTRHVIRLICTRPNGEEATFVISVEVGPARGLPKGTRPVFVSIRGCRLPSSGLRSDGHDSSKLN

SEQ ID NO: 231560 - protein, 536 aa, Glycine max
  Coding DNA Sequence Number=SeqID_114782
  Gene Ontology: Mol. function=transcription factor activity; Cellular component=nucleus; Biological process=regulation of transcription, DNA-dependent
  Homolog annotation: Hit_ID=Q8RZ73; Match level="QueryCoverage=70%, HitCoverage=71%, E-value=1e-80, Identity=43%"; Hit description =Gibberellin response modulator-like protein
  Pfam annotation: Domain name=GRAS; Domain location=141-445; Score =276.3; E_value=6.2e-80; Accession=PF03514.5; Description=GRAS family transcription factor
MDESVNHDFAIRRYCPARMEQEQGGDKCQDQEALVFYDTELCSSDATSSTPCLASSEVDDFVDSFINMDQYEYVNEDQGFQEKHRSFDHFVVNDEDEADAYSIVNGVFEYVPTTLEDSELEIYEDVTTAMLEEEVAMNGSFCAIPEFVVPCTQEANLGVDQGLDLVHMLLACAEAVGCRDNQQAELLLSRIWALASPSGDSLQRVSYCFAKGLKCRLSLLPHNVIANATLSSMDVPFITRENKLEAFQLLYQTTPYIAFGFMAANEAICQASQGKSSIHIVDLGMEHTLQWSSLIRALSSRPEGPPTLRITGLTGNEENSKLQASMNVLVEEASSLGMHLEFHIISEHLTPCLLTMEKLNLRKEEALCVNSILQLHKYVKESRGYLKEILLSIKKLGPTALTVVEQDTNHNGPFFLGRFLESLHYYSAIFDSLEASMTRNSQHRMKIERLHFAEEIQNVVAYEGPDRIERHERVDQWRRQLGRAGFQVMPLKCTSQVRMMLSVYDCDGYTLSYEKGNLLLGWKGRPVMMASAWQVA

SEQ ID NO: 231561 - protein, 385 aa, Glycine max
  Coding DNA Sequence Number=SeqID_114783
  Gene Ontology: Mol. function=DNA binding; Cellular component=nucleus; Biological process=regulation of transcription, DNA-dependent
  Homolog annotation: Hit_ID=Q2LAJ4; Match level="QueryCoverage=94%, HitCoverage=48%, E-value=1e-137, Identity=64%"; Hit description =Auxin response factor 3
  Pfam annotation: Domain name=Auxin_resp; Domain location=284-366; Score=164.1; E_value=3.6e-46; Accession=PF06507.4; Description=Auxin response factor
  Pfam annotation: Domain name=B3; Domain location=157-262; Score =111.0; E_value=3.4e-30; Accession=PF02362.12; Description=B3 DNA binding domain
  Pfam module annotation: Pfam domain module=Auxin_resp::B3; Domain location=284-366::157-262
  Subcellular localization annotation: CTP_CleavageSite=37; ConfidenceScore=5.22e-01
MGLIDLNTTEDDEAAPLSASSPASYSSSSSHSGISTSASTLVVPPTPPSVCLELWHACAGPLISLPKKGSVVVYLPQGHFEHVQDFPVTAYDIPPHVFCRVLDVKLHAEEGSDEVYCQVLLVPESEQVEQSLREGEIVADGEEEDTEAIVKSTTPHMFCKTLTASDTSTHGGFSVPRRAAEDCFPPLDYSQQRPSQELVAKDLHGLEWRFRHIYRGQPRRHLLTTGWSAFVNKKKLVSGDAVLFLRGDDGELRLGIRRAAQLKSAGSFAVPSGQQLNPATLKGVVNALSTRCAFSVCYNPRFSSSEFIIPVHKFLKSLDCSYSVGMRFRMRFETEDAAERRCTGLIAGISDVDPVRWLGSKWRCLLLILERYSPYSSGDLQLMIF

SEQ ID NO: 231562 - protein, 96 aa, Glycine max
  Coding DNA Sequence Number=SeqID_114784
MSKSLRVEIPSNTNNNNRLLYLTKVANFSSHKQNPTKEGFDRSRFVRCLPWWAEIALMVAAWIGQNQKARPMVAEIYLRGGGAERVREPGRAKAPE

SEQ ID NO: 231563 - protein, 356 aa, Glycine max
  Coding DNA Sequence Number=SeqID_114785
  Gene Ontology: Mol. function=GTPase activity; Cellular component =intracellular; Biological process=immune response
  Homolog annotation: Hit_ID=Q6K2Y3; Match level="QueryCoverage=92%, HitCoverage=30%, E-value=1e-150, Identity=77%"; Hit description =Putative guanylate binding protein
  Pfam annotation: Domain name=GBP; Domain location=4-235; Score=317.4; E_value=2.5e-92; Accession=PF02263.9; Description=Guanylate-binding protein, N-terminal domain
MLLALMLFFLSLLGRTSGFQVASTHRPCTKGLWLWSAPLKRTALDGTEYNLLLLDSEGIDAYDQTGTYSTQIFSLAVLLSSMFIYNQMGGIDEAALDRLSLVTQMTKHIRVRASGGRSSTSELGQFSPIFVWLLRDFYLDLVEDNRKITPRDYLEIALRPFQGSGKDITAKNEIRDSIRALFPDRECFTLVRPLNDENDLQRLDQISLEKLRPEFRSSLDTLTKFVFERARPKQVGATMMTGPVLIGITESYLDALNHGAVPTISSSWQSVEEAECRKAYDSAAEIYMSSFDCTKPPEEAALREAHEKAVRISMAAFTASAVGVGSVRTKYEGMLQKFLKKAFECHLLEAQPCPKS

SEQ ID NO: 231564 - protein, 290 aa, Glycine max
  Coding DNA Sequence Number=SeqID_114786
  Gene Ontology: Mol. function=RNA-directed DNA polymerase activity; Cellular component=chromatin; Biological process=RNA-dependent DNA replication
MDQLPVLCKSQELRPKFGRILNKAAQIGLKGPVGNLGLSVRLWVVGTSIGQGSPMDSKQFSPKMANKELIPITANRMGHVVQHVEGHDKELKMAISSSKSYFESIFWCNWDMKPILDSYGIGSSIINTKMPSVIFLANQKNREGERADARSNDALFQHLLNHVCHDLLLTVRVTIRLDIHWGGVGHRVQVSGIKVGRRVNGRELGNRRLHNIMSASRIYEYGNNQLTIRLESVETTTNGPGLVGSVVEVLASSSSIGFSSDSNRQQGWMGMAVWVVFGLEVGGAGPRNLG

SEQ ID NO: 231565 - protein, 350 aa, Glycine max
  Coding DNA Sequence Number=SeqID_114787
  Gene Ontology: Mol. function=calmodulin binding; Cellular component =integral to membrane; Biological process=cell death
  Homolog annotation: Hit_ID=Q5BMD0; Match level="QueryCoverage=73%, HitCoverage=44%, E-value=9e-88, Identity=58%"; Hit description=MLO1
  Pfam annotation: Domain name=Mlo; Domain location=1-312; Score=209.8; E_value=6.1e-60; Accession=PF03094.6; Description=Mlo family
NFINFITCFGSVDPRRFQLTRQTPFGKRHLNYWSNNSVMYWPVCLVRQFYRSVPKVDYFTLRHGFIMAHFSEESNFDFQKYIERALENDFGVVVGLSWWIWIFSVLYIFFNANAFYSHFWLPFIPLMVLLLVGTKLQSIITDMCLDSHDKSHMIKGTLLVRPSDHFFWFGWPKLLLHLISFILFQNSFQLAFFTWTSIRFGIRSCFHEEIENIIIRVAMVVSVQILCGYVTLPLYALVTQMGTSMRKVVFTENVIRGIQIWQDKAKKNMALRNPYSQGTSLDTSLSLETSLEASPSFRLGASLSNFMDRPLDVNKHMNVNITQGEIVSEQQESENQASNLSSFQGFNLQL

SEQ ID NO: 231566 - protein, 66 aa, Glycine max
  Coding DNA Sequence Number=SeqID_114788
MVRDVDKASRSRDGVGGDQQRGGRGFFHGVVGDDRWKVVGVVVVGIAGEVRMSSRPYEQQKRVGNL

SEQ ID NO: 231567 - protein, 262 aa, Glycine max
  Coding DNA Sequence Number=SeqID_114789
  Gene Ontology: Mol. function=protein kinase activity; Cellular component=integral to membrane; Biological process=protein amino acid phosphorylation
  Homolog annotation: Hit_ID=Q1T5L7; Match level="QueryCoverage=89%, HitCoverage=27%, E-value=2e-86, Identity=69%"; Hit description =Protein kinase
  Pfam annotation: Domain name=LRR_1; Domain location=107-128; Score =20.1; E_value=0.0078; Accession=PF00560.23; Description=Leucine Rich Repeat
  Pfam annotation: Domain name=LRR_1; Domain location=130-152; Score =15.3; E_value=0.22; Accession=PF00560.23; Description=Leucine Rich Repeat
  Pfam annotation: Domain name=LRR_1; Domain location=154-176; Score =9.8; E_value=4.2; Accession=PF00560.23; Description=Leucine Rich Repeat
  Pfam annotation: Domain name=LRR_1; Domain location=178-200; Score =11.3; E_value=2.2; Accession=PF00560.23; Description=Leucine Rich Repeat
  Pfam annotation: Domain name=LRR_1; Domain location=202-224; Score =12.1; E_value=1.6; Accession=PF00560.23; Description=Leucine Rich Repeat
  Pfam annotation: Domain name=LRR_1; Domain location=227-248; Score =11.0; E_value=2.5; Accession=PF00560.23; Description=Leucine Rich Repeat
  Pfam annotation: Domain name=LRR_1; Domain location=82-105; Score =4.5; E_value=41; Accession=PF00560.23; Description=Leucine Rich Repeat
  Pfam module annotation: Pfam domain module=LRR_1::LRR_1::LRR_1::LRR _1::LRR_1::LRR_1::LRR_1; Domain location=107-128::130-152::154 -176::178-200::202-224::227-248::82-105
MFRNPNRAIEGGALESTRNITIDNGEGLSDYIKHLASQQPNTDEFFVSEFLKKMGLASSQCYNFSASVCSWQGVSCDANGEHIVDLVFSGMDLSGTMPDNTIGKLSKLQSLDLSHNKITGLPSDFWSLSSLKSLNLSSNQISGSLTNNIGNFGLLESIDLSSNNFSEEIPEAVSSLLSLRVLKLDHNRFAHSIPSGILKCQSLVSIDVSSNQLNGTLPEGFGAAFPKLRVLNLSGNNMYGHVSDISGLQSIVNLNISGNSFQ

SEQ ID NO: 231568 - protein, 151 aa, Glycine max
  Coding DNA Sequence Number=SeqID_114790
MGETHEIPHHNLADFEPWLGYATEGQAVGGIPFENTLEGPQYHPQLHLLHSTTSKNPNAMAEMGKLDHLEERLRAIEGGEDYAFANLKELFLEPNIITPPKFKVLDLDKYKGTTCPKNHLKMYCQKMGEYAKDEELLIHSFQESLTGVAVT

SEQ ID NO: 231569 - protein, 429 aa, Glycine max
  Coding DNA Sequence Number=SeqID_114791
  Gene Ontology: Mol. function=chitin binding; Cellular component =extracellular region; Biological process=chitin metabolic process
  Homolog annotation: Hit_ID=UPI00006A17C9; Match level="QueryCoverage =93%, HitCoverage=100%, E-value=1e-51, Identity=29%"; Hit description= UPI00006A17C9 related cluster
DLQGLHVLTFRGLYVLGFRRLHVLTFRGLRVLTFQGLHILAFRGLHILGFRGQHILTFKGLHVLAFRGLHTLAFRGVHALAIRGLHALNFRGLHVLTFRGLHVLTIRRLHALTFRGLHVLAIGGLHALTLRGLHVLTIRGLHALAIRGLHVLAIRALHVLAFRRLHALAFRGLHVLAFRGLHILGFRGLHVLAFKGLPVLLFRGLRVLGFRGLHVLGFRGLHALGFRGLHVLPFRGLHVLAFRGQHALAFRGLHVLTFRELHVLTFIGLFALAFRGLHALAFRRLHILTFIKLHILAFRGLHVLTFRGLYILIFRELHALTFVGLHALTFRGLHVLGFKGLQGLAFIGLQALTFRGLHVLAFRRLHVLAFRGLHALAFRGLHVFPSEGYTPSPLEDYTSSHSEGYTPSPLEDYTFSTSEDYTSLPSEDY

SEQ ID NO: 231570 - protein, 272 aa, Glycine max
  Coding DNA Sequence Number=SeqID_114792
  Gene Ontology: Mol. function=chitin binding; Cellular component =extracellular region; Biological process=chitin metabolic process
  Homolog annotation: Hit_ID=UPI000044A8F0; Match level="QueryCoverage =99%, HitCoverage=99%, E-value=9e-41, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
LHALSFRGLHVHAIRGLRVLTFRGLHVLAFRGPHALAFRGLHVLTFRGLHVLANKGLHALTLRGLHVLSFRGLHIAAFIGLYVLAIRGLHLLAFIGLHALTIRGLHTLTFRGLHVLAFRGLHTLEFKGLHVLALRGVHVLPFQGLHILAFRGLHILTIRGLHVLAIRGLHVLPFRVLHVLLFRGLHALAFRGLHVLPFRGLHVLSFRGLHVLAFRGLHAHKGLHILAFKGLHLLAIRGLHVLTFRGLHVLTFRGLHALNFRGLHVLTFRGVH

SEQ ID NO: 231571 - protein, 158 aa, Glycine max
  Coding DNA Sequence Number=SeqID_114793
MGLFVVVGQNIVLAGLGKVFENSSTIHNVRYENDVVKVQVVRTYMPHAEVPIPTSEVHYLEQAVGTFVAWPTHLVREVTNEVVVGPDKPPSKSVGEPNRLTSVATDDPLGELVKKSYVVYTKPMELAWDGAKFGLSNASNGFFITHADVTEIILGDKC

SEQ ID NO: 231572 - protein, 173 aa, Glycine max
  Coding DNA Sequence Number=SeqID_114794
LFVLQTAKKNVYTENHSGISACQRDSNVSMTDLVSAENDINLRVSTGLSAAIDEVRRRRCQSSHAIRLFVLQTAKKNVYTDNHSGISARQRDSNVSMTDLVSAEDDTAKKNVYTDNHSRISARQHDSNVTLTDLVSVEDDVNLRVLFVLQTAKKNVYTDDHSGISARQYDINV

SEQ ID NO: 231573 - protein, 58 aa, Glycine max
  Coding DNA Sequence Number=SeqID_114795
MTTQMQCMNDDTIWVYMRESMWLMERNILDEQAWDNDNISSKRKTLDEVSLSSSKSVT

SEQ ID NO: 231574 - protein, 201 aa, Glycine max
  Coding DNA Sequence Number=SeqID_114796
MVGWWVNCPFFKTYLKVTSTGISQPLSGCVDGIIDPPSPVRRHDSFEEQASQGSFVPHRRQDVLTIAIGCPEHPGRVHVAGAGVTIMKYFRSAPRMSRNSSSLPLEELHQLTQQIRDQLEELITEKVTRQLMTSFSQMQSHFRSQMQSQGLALPPEPLVGSSGPRVSTIESCVDPSGNDPETGDSDRCGLYIEAKVGVEEV

SEQ ID NO: 231575 - protein, 302 aa, Glycine max
  Coding DNA Sequence Number=SeqID_114797
  Homolog annotation: Hit_ID=UPI00005F8D0C; Match level="QueryCoverage =43%, HitCoverage=100%, E-value=1e-45, Identity=70%"; Hit description= COG1516: Flagellin-specific chaperone FliS
  Pfam annotation: Domain name=FliS; Domain location=70-197; Score =167.9; E_value=2.5e-47; Accession=PF02561.5; Description=Flagellar protein FliS
  Pfam annotation: Domain name=FliT; Domain location=183-301; Score =92.8; E_value=1e-24; Accession=PF05400.3; Description=Flagellar protein FliT
  Pfam module annotation: Pfam domain module=FliS::FliT; Domain location=70-197::183-301
PNCNKALDEKSADVVSFLSGDGKTTGFATQNSNYLDQILGTNGSVQNATDGINKTLKKLSDDYDRELNMYAKSGIQAYAQVGLESAVLSASPHQLVVMLFDGALSAMKKATILMDQGDIPGKGQALTKAINIITNGLRAGLNHEVGGELSANLDDLYEYMTRRLLEANLRNDPQAIAEVEALLSNIAEAWKQIGPNQQQDSNAMLAQARGGQWDDLIACEMTYLRNVESVTRDQDTNALSSGLRLKIRPMLKQVLDNESEIKTLLTQRMDELRSLVQTTSQQQKVTSAYGRFSNKVLYPGNL

SEQ ID NO: 231576 - protein, 148 aa, Glycine max
  Coding DNA Sequence Number=SeqID_114798
MHKALRANAPLPYPHLVTLFLHHFKIPLEDEPFVQVKRSFAIGVGAIILFGYRKDDDGQWVRKQDLPQPIPDERTLSPPPQRVDSSSLLNDVLSELHSLRAFVGDRFDAMDTPLDAMDAHFDGMDTRITRLEDDMSFIRRCFDPPANP

SEQ ID NO: 231577 - protein, 158 aa, Glycine max
  Coding DNA Sequence Number=SeqID_114799
MPISPCRWIAPTKTPGGPEEVQQGPGESHPQRHPVDPEKSNWALGFPALVTGLCSPTGCLFPPTRSRHHDIDTQWTRRSPTGSWSCQALITGLCQFYGVPVTSSKGIRPPTNRAFIKKYCVPRQAQGETPQPPGDGQQRATDAPPSPLEFNSAHPQKG

SEQ ID NO: 231578 - protein, 96 aa, Glycine max
  Coding DNA Sequence Number=SeqID_114800
MGIAPTKTLNGPKEVQQALGFPALVTGLCRPYRAPVPPSKDCARKTPSGPEEGQQGSACRPQQGHQAPPTNRAFIKKYCAPRQAQGETPQQHWDGR

SEQ ID NO: 231579 - protein, 136 aa, Glycine max
  Coding DNA Sequence Number=SeqID_114801
MTVSRGRRSDFCLGDNTGRAHSTGAGSQRRGRDAKGDRGGHREDKRRPGPLASIGGPGLGLWQARVGTARRIMRACAGQEHRDDRHADAQQAPGDNGQPARQALGGFRCTTATDPQQQREQVPVHRRERRSPDAHG

SEQ ID NO: 231580 - protein, 156 aa, Glycine max
  Coding DNA Sequence Number=SeqID_114802
  Gene Ontology: Mol. function=pyruvate dehydrogenase (acetyl -transferring) activity; Cellular component=membrane fraction; Biological process=glycolysis
  Homolog annotation: Hit_ID=Q398J0; Match level="QueryCoverage=84%, HitCoverage=14%, E-value=5e-64, Identity=85%"; Hit description=2-oxo- acid dehydrogenase E1 component homodimeric type
MQAGGRQRAHYLIDQLSDLDAQQHGDLHTRAWTAYVNTIPPERQPAYPGDLAIERRLNAMIRWNAMVMVLRAGKHSNVGGHIATYQSAAVLYDVGFDHFFRGRTDTFDGDMIYIQGHSAPGIYGRAYVEGRIDPARMTTSAAKPAAKACPRIHTHA

SEQ ID NO: 231581 - protein, 113 aa, Glycine max
  Coding DNA Sequence Number=SeqID_114803
FLKFLDDHEGHGPITVLSTHGRIKEAQGSYLPSVSNSFKASKLVINQPVMEIQEFNEGLAELGIEARSVFKSHGEGSTQLSGSIQLSSKEPFFGKAEAKTIDDINTISEVIIL

SEQ ID NO: 231582 - protein, 83 aa, Glycine max
  Coding DNA Sequence Number=SeqID_114804
  Homolog annotation: Hit_ID=Q664H8; Match level="QueryCoverage=36%, HitCoverage=15%, E-value=2e-08, Identity=96%"; Hit description =Possible MarC family transporter
MAGDFSAILLIGKDAAGKAEAFSRSRGHHDRDDFRYGIAVFNYGSAGQPADFHVGAQASGTAPPPGSADPRAADRPADDADLP

SEQ ID NO: 231583 - protein, 360 aa, Glycine max
  Coding DNA Sequence Number=SeqID_114805
  Gene Ontology: Mol. function=oxidoreductase activity, acting on the aldehyde or oxo group of donors, NAD or NADP as acceptor; Cellular component=cytoplasm; Biological process=lysine biosynthetic process via diaminopimelate
  Homolog annotation: Hit_ID=Q7BK13; Match level="QueryCoverage=79%, HitCoverage=97%, E-value=1e-130, Identity=73%"; Hit description =Aspartate semialdehyde dehydrogenase
  Pfam annotation: Domain name=Semialdhyde_dh; Domain location=3-122; Score=128.2; E_value=2.4e-35; Accession=PF01118.15; Description =Semialdehyde dehydrogenase, NAD binding domain
  Pfam annotation: Domain name=Semialdhyde_dhC; Domain location=144 -328; Score=-37.7; E_value=0.013; Accession=PF02774.9; Description =Semialdehyde dehydrogenase, dimerisation domain
  Pfam module annotation: Pfam domain module=Semialdhyde_dh::Semialdhyde _dhC; Domain location=3-122::144-328
MKNVGFIGWRGMVGSVLMQRMTEERDFDAIRPVFFSTSQHGSAAPAFGGQQGTLQDAYDIDALSALDIIITCQGGDYTNEVYPKLRASGWQGYWIDAASSLRMQDDAIIILDPVNHAVIQQGLDNGIKTFVGGNCTVSLMLMSLGGLFANDLVEWASVATYQAASGGGARHMRELLTQMGMLHADVAKELQDPASAILDIERKPDPVDRQAARQRPEPRRVERPGGNQQDSEHRQRDPADHARTDAGGGDRHAEYAGRPSAQAEYGAGVPVGVHRGRPAAVGRGRAAAPHAAYSAVNPHFLGAGYFQPPKALFSTFLFAASASGNVIASPASMSCTPHISSSAAACRRRQAGSFLNEEFS

SEQ ID NO: 231584 - protein, 261 aa, Glycine max
  Coding DNA Sequence Number=SeqID_114806
  Homolog annotation: Hit_ID=Q1SDS1; Match level="QueryCoverage=35%, HitCoverage=18%, E-value=8e-12, Identity=41%"; Hit description=IMP dehydrogenase/GMP reductase
KKEHLSTGFLDGRKEEPDGVLISCRGFSNVPLMGIRGCISYNPVLAIRQLGYPMRGEPLKEELAPIIARGFNKTNVEALQKVRKAWETVQKKDKKLRGSNNGPICGYCKWLKAHVQGLDWLPSLRTAKREEVEAPEEDEEVQALRAELEQAQNSQRKGLVREEHGWEQVPRGSVGQLTTSLSSRERKGTNRGVDSLILKDEVKPCSRSKRSLSQRLCETETNMLAIINKYQEEVNLATTHEHRVAEEYAQVYAEKKRLEEG

SEQ ID NO: 231585 - protein, 142 aa, Glycine max
  Coding DNA Sequence Number=SeqID_114807
  Gene Ontology: Mol. function=nucleic acid binding
MAEDHPQRMTLEDYSSLATPQYFTSIARPDVQATNISYPHSLIQLIQGNLFHGLPSEDPYIRTPGHIHRDLQHGEDSRSEAKRWLHSFKGNSLRTWEEMVEKFLKKYFPKSKTAEWKVEISFNHVEENTNNNSSTLNKSVHK

SEQ ID NO: 231586 - protein, 75 aa, Glycine max
  Coding DNA Sequence Number=SeqID_114808
MWNATVFGVFNKEFSLYIEREDLSEIAHGGQCLGISFIQLWILHMTETSMRAGNIDVYGFLEPQSIQRFGQSQFE

SEQ ID NO: 231587 - protein, 134 aa, Glycine max
  Coding DNA Sequence Number=SeqID_114809
MIRGDTLWLFAPFCHPEAAGPMTSRDQVWSFCTLVSSRGGGPDDTRRYLMVIRTLLSSRGGGPDDKRRYLTVIRTLVSSRGGGPDDTRRYLTVIRTLVSSRGGGPDDTRKYPSGYLYKHSFAICKTERLIACRG

SEQ ID NO: 231588 - protein, 161 aa, Glycine max
  Coding DNA Sequence Number=SeqID_114810
MVQPKPSVGLKGRPHQHAFTFLTSCISKKSKAWVTRPKSYFGIYPNFCILSPHQKNGNHTCTNPIYKQHLQTYVQTPLRNFTEHLVGALLGTNNRGWGQCGLPHCRNVPFCERAKARLTGALSKGGKMRGVATNVYLWKTPGKPKETGQNENSKFGSCIYV

SEQ ID NO: 231589 - protein, 171 aa, Glycine max
  Coding DNA Sequence Number=SeqID_114811
HPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEVVPETTGAVAKASLHRAIVTAYGPEPGSEPTDVEESADELWLGVKCHSNPELA

SEQ ID NO: 231590 - protein, 323 aa, Glycine max
  Coding DNA Sequence Number=SeqID_114812
  Gene Ontology: Mol. function=triacylglycerol lipase activity; Cellular component=cytoplasm; Biological process=metabolic process
  Homolog annotation: Hit_ID=Q7N4Q6; Match level="QueryCoverage=78%, HitCoverage=88%, E-value=6e-53, Identity=42%"; Hit description =Similar to lipase
MAPRQAFSVALPAGLAKRRAGTAAGVDLPPPPAGSGQRLAQQIARALYRHASGNSHALQVDAGMDHPRQPLQRAVDTRSLQAVRVLLGLVAQRIVLAAEYGGWRQSLQITQIGLPAALHQFGAEVVARGVVAVGIAAHAGIQRRVQQQLVARLRQGPFAQQQAAGGGEVATGAVAADRQPLRVQVEALGVVLQPLPGVGDVMQWNRERVFRRQPVAHGHNHAATGIGQRTAGTVIDRQRALEPAAAVGEQQGRRWSVGQTFRCVEADVQRLPVACDHRVFDHMRNRLRRTLQLWQRALADRPQFAQLLRQRMRRDGVDKLLQP

SEQ ID NO: 231591 - protein, 143 aa, Glycine max
  Coding DNA Sequence Number=SeqID_114813
MASRKRKAPASGSQAQFDRLRFTSQEAWDRYSDIVIGRKILPERNVMIYHKEFDEFKAKLERRNWHKELTNFMDGSIDVAIVKEFYANLYDPEENSPKCFEYFSEDPCDHRGRGRATFILQILSSKARSTGTSSPIMHPWEGI

SEQ ID NO: 231592 - protein, 165 aa, Glycine max
  Coding DNA Sequence Number=SeqID_114814
  Gene Ontology: Mol. function=oxidoreductase activity, acting on NADH or NADPH, quinone or similar compound as acceptor; Cellular component=integral to membrane; Biological process=ATP synthesis coupled electron transport
  Homolog annotation: Hit_ID=A0A380; Match level="QueryCoverage=83%, HitCoverage=25%, E-value=4e-57, Identity=82%"; Hit description=NADH -plastoquinone oxidoreductase subunit 2
  Pfam annotation: Domain name=Oxidored_q1; Domain location=23-156; Score=-100.7; E_value=0.013; Accession=PF00361.10; Description=NADH -Ubiquinoneplastoquinone (comple
MAITEFLLFILTATLGGMFLCGANDLITIFVALECFSLCSYLLSGYTKKDVRSNEATTKYLLMGGASSSILVHGFSWLYGSSGGEIELQEIVNGLINTQMYNSPRNFNCTFIHHCRNWVQAFPQPLSHQWTPDVYEGVRCYIVGSHPSETTSIIGASVNKRITLR

SEQ ID NO: 231593 - protein, 44 aa, Glycine max
  Coding DNA Sequence Number=SeqID_114815
MENVNGHAKFIEWDPLAQKSVPAVGVVLSIPFHHGKFQLTALSH

SEQ ID NO: 231594 - protein, 145 aa, Glycine max
  Coding DNA Sequence Number=SeqID_114816
MAIFRGGFDDYIINVNLHKCVYKIMKHGIHGPLISGVATYPSAGGRRVTRGLRVPRKEYARSRHQRLFEENIGKTGKDAIYELLSERFGSCIYARGRENVSVDITISRVSTSGLCSYDLMHENRLRVCKRKPVIMLDVMYDKQRR

SEQ ID NO: 231595 - protein, 189 aa, Glycine max
  Coding DNA Sequence Number=SeqID_114817
  Gene Ontology: Mol. function=chitin binding; Cellular component =extracellular region; Biological process=chitin metabolic process
  Homolog annotation: Hit_ID=UPI00006A17C9; Match level="QueryCoverage =73%, HitCoverage=100%, E-value=3e-20, Identity=34%"; Hit description= UPI00006A17C9 related cluster
LHALTFRGLHAVAFRGLDVLAFRGLHAFAFRGLHVLAIRGLHVLAFAFVGLHALTFTGLHVLAFRGLHALTSRGLHVLASEGMHTLVFRGLYVLPLRGLHVLTFEGLHAFAFRGLHVPLFRRLHALVFRGRHVLAFRGDCARKTPSGPGEAQQGPRVSSSGYGPLDCARKTPSGPGEVQQGPGVSNSNY

SEQ ID NO: 231596 - protein, 86 aa, Glycine max
  Coding DNA Sequence Number=SeqID_114818
AHENLRAFSYISGPIFLNSSIQCPWGVGLHQAQTIQKQNIAPHVLSCGGYEFLEKKLMEEKKKKQLKEAAKSGSTYTVIDCKSKAS

SEQ ID NO: 231597 - protein, 231 aa, Glycine max
  Coding DNA Sequence Number=SeqID_114819
  Gene Ontology: Mol. function=ferric-transporting ATPase activity; Cellular component=membrane; Biological process=ferric iron transport
  Homolog annotation: Hit_ID=Q92WJ0; Match level="QueryCoverage=100%, HitCoverage=65%, E-value=1e-79, Identity=64%"; Hit description =Ferric cations import ATP-binding protein fbpC 1
  Pfam annotation: Domain name=ABC_tran; Domain location=1-132; Score =94.5; E_value=3.3e-25; Accession=PF00005.17; Description=ABC transporter
MVFQSYALFPHMSALENIMYGLQSSGMSKKEAQDRAREGLKLVGLESQGQRLPSELSGGQQQRIAVARALVLEPQVLLLDEPFSNLDERLRRRVRTDIRDLQQRLGFTAVYVTHDQEEALAVSDKIIVMKEGDIAQQGAPESLYHAPNSVFIADFMGEANILPCEVEQVEGSEALVRLGRQRYRVRGNGVATGSAQLSVRPQFITLHSGAEGALRGEVTHANWLGDHIEYE

SEQ ID NO: 231598 - protein, 220 aa, Glycine max
  Coding DNA Sequence Number=SeqID_114820
  Homolog annotation: Hit_ID=Q1SKD7; Match level="QueryCoverage=57%, HitCoverage=33%, E-value=7e-10, Identity=27%"; Hit description =Ankyrin
MAPKKLSTKRSRRDAIGEGSSATPEFDSHRFRSVKHHQCFEAIRGWSFHKERRVQLREDEYTDFLEEIARRRWTPLVTPMAKFDPEIVLEFYANAWPTDDGVWDMRSWVKGQWIPFDADALSQFLGSHRPAVVHTRVGFHPDRCREAGADHAHQHDHFDPDMGDTAAQQRMTPTRHPLDPNKSNRALGFSALITGLYQSYGVPVTPGDAHQAAGIPPPPR

SEQ ID NO: 231599 - protein, 44 aa, Glycine max
  Coding DNA Sequence Number=SeqID_114821
MKFGGAIPFLIPMTRGGGHNPLFEDSPSECGGGATTVRYGLISK

SEQ ID NO: 231600 - protein, 150 aa, Glycine max
  Coding DNA Sequence Number=SeqID_114822
MEKMNVHIITKGPLRVHRSHSILKNKTNQLSHEEHRTRNNIGIDHGCDSRKSHFGAVEARPGELKLSPEVMSLARRVGCLAMKLFHGPDELDASLGELGSGKIQRKRPFCPLPWYLFVFLIKTLSDSLLRTITGVNHHNSTNKNKNISER

SEQ ID NO: 231601 - protein, 127 aa, Glycine max
  Coding DNA Sequence Number=SeqID_114823
GTSFVVQVEGTSTWVVVTENKRGYISCGSILVEVTSTRLFKENKGGYIPCGSLLVETLTSLHLPSKNRFSCYMGCPFSCVKPTYLTPFAFMDQTFTFTERELRQQQHRSKTERVRYVSKKGEERAQN

SEQ ID NO: 231602 - protein, 159 aa, Glycine max
  Coding DNA Sequence Number=SeqID_114824
  Homolog annotation: Hit_ID=Q1STT2; Match level="QueryCoverage=33%, HitCoverage=11%, E-value=1e-10, Identity=49%"; Hit description =Lipocalin
MKSLIMSVLSVSTQIGSRRYLGLPSIIDKIRRVVFCFLKDRIWKRINQWSGKHLSKAAATDVEWVGFYSGSKAKTDVEWYMTTTKKEERNGNTDVCMNQSYDRQGHKERVLLKPNQQTGISGSPENTGLNKGKTIANRWSNKWTDWKCKCFPFSLMKFP

SEQ ID NO: 231603 - protein, 102 aa, Glycine max
  Coding DNA Sequence Number=SeqID_114825
MIVMISSLSYRCLVVGKKVSKAPKIQRLVTPLTLQRNRARIADKKKRIAKAKSEAAEYQKLLASKKISLVQVSVLTSECLVKHCCYNSAMELRKFQLAQNNT

SEQ ID NO: 231604 - protein, 91 aa, Glycine max
  Coding DNA Sequence Number=SeqID_114826
  Gene Ontology: Mol. function=ribonuclease H activity; Biological process=DNA integration
  Homolog annotation: Hit_ID=Q1SYR3; Match level="QueryCoverage=92%, HitCoverage=5%, E-value=4e-31, Identity=53%"; Hit description=RNase H, putative
MVVTYKDWHEMLPYALHGYRTSVRTSTGATPFLSWCMRMKQAFDKKVRPRVFQEGDLVLKKVLSFQPDSRGKWTPNYEGPYVVKRLSLVVH

SEQ ID NO: 231605 - protein, 219 aa, Glycine max
  Coding DNA Sequence Number=SeqID_114827
  Gene Ontology: Mol. function=RNA-directed DNA polymerase activity; Cellular component=exocyst; Biological process=RNA-dependent DNA replication
MVNWRKKNNTIKGLIMNGKWSEEPLLVKEEVILKEGTFKTINEEANDMLTQAFSEEEIKGAVWECDAKILTLRLKRVMGDIIDERQSTFIGERNNLDRVLIANEIVHEAKVKKEGFIVFKADFEKAYYSVKWDFLTYMLHRIRFCQGLSGLIRVVEPKSLIQGVKIGDRCVKVSLLQFVDDNIFFLKDDMNESFSLKAALRSFEIASGLKVNIQESSVT

SEQ ID NO: 231606 - protein, 63 aa, Glycine max
  Coding DNA Sequence Number=SeqID_114828
MNGKSEAWTSFVCMTFTPLTKRILKREIDKKLKKSETLIWLDFGECPKVQDEKMEDLDMDLME

SEQ ID NO: 231607 - protein, 149 aa, Glycine max
  Coding DNA Sequence Number=SeqID_114829
MPISPCGSISRSCHRDIGKDRAHKTHSGPGGAQEGLGISDSGYGPLLVLQGARSPQQGIAPARHPVDPKKSNRVLELPALITGLCQFYGVPVAPSKAIRPPTNRAFIKKYCAPKQAQGETSQQPGDGQQRATDAPLPPLEFTSALPQKG

SEQ ID NO: 231608 - protein, 111 aa, Glycine max
  Coding DNA Sequence Number=SeqID_114830
MEAMKEQMTTMMETMMSMKKIMEVNAVAIAATSAVAKVNPMPPSGLNQMNHPTSDMVGNDLGSTSIPHYAQIQNKHAFLPYGLPPNYTPPNVAYTPNENVNNSTSILIESQ

SEQ ID NO: 231609 - protein, 94 aa, Glycine max
  Coding DNA Sequence Number=SeqID_114831
ISAYHVCRMTKLGLCVPTDTTVSEWQRGADNRKVSPRIIMTKLGLCVPTDTTVSEWQRGADNRKVSPRIIMTKLGLCVPTDTTVSEWQGVRITV

SEQ ID NO: 231610 - protein, 84 aa, Glycine max
  Coding DNA Sequence Number=SeqID_114832
MTRGGNPGSLNHNIGFMTVFEGRLFYIGCLATTDVEWVGFYGGSKAETDVEWVGFYIGYQSTDVENERMGTNGKVSTSVFNQPM

SEQ ID NO: 231611 - protein, 56 aa, Glycine max
  Coding DNA Sequence Number=SeqID_114833
MGCSGRRGSKNLRELASGDYPTFDALIWRSEPHVENTLTELNYIVAQCTVQLHCPY

SEQ ID NO: 231612 - protein, 285 aa, Glycine max
  Coding DNA Sequence Number=SeqID_114834
  Gene Ontology: Mol. function=DNA binding; Cellular component=nucleus; Biological process=regulation of transcription
  Homolog annotation: Hit_ID=Q5QMP4; Match level="QueryCoverage=85%, HitCoverage=80%, E-value=1e-84, Identity=60%"; Hit description=No apical meristem (NAM) protein-like
  Pfam annotation: Domain name=NAM; Domain location=26-168; Score =190.1; E_value=5.2e-54; Accession=PF02365.6; Description=No apical meristem (NAM) protein
MAKQRFDMLTAYSTGTHGGIHDLPGLPAGVKFDPNDQEILEHLEAKVASDACKLHPLIDEFIPTLEGENGICYTHPEKLPGVSKDGQIRHFFHRPSKAYTTGTRKRRKVHTDDEGIETRWHKTGKTRAVFASGGAVKGFKKILVLYTNYGRQKKPEKTYWVMHQYHLGNTEEEKDGELVVSKVFYQTQPRQCVNPIIIKDPYEKMLNGGSVQDSTNTSITKTTATLLDCYNAPYIDYDHAHASHNRESSSQLIIPSSVVQVDGSYIRSTMDAKKARFESNTGKSF

SEQ ID NO: 231613 - protein, 59 aa, Glycine max
  Coding DNA Sequence Number=SeqID_114835
MVKELSIQLIIGLYAKCPTLGCGPGSDGCPRNLCTVLPPSPPSLPSFNPFLVSFVSFLI

SEQ ID NO: 231614 - protein, 557 aa, Glycine max
  Coding DNA Sequence Number=SeqID_114836
  Gene Ontology: Mol. function=protein serine/threonine kinase activity; Cellular component=chloroplast thylakoid membrane; Biological process=embryonic development ending in seed dormancy
  Homolog annotation: Hit_ID=Q9FNL2; Match level="QueryCoverage=83%, HitCoverage=98%, E-value=1e-169, Identity=61%"; Hit description=Salt- inducible protein-like
  Pfam annotation: Domain name=PPR; Domain location=129-163; Score =12.5; E_value=0.25; Accession=PF01535.11; Description=PPR repeat
  Pfam annotation: Domain name=PPR; Domain location=164-198; Score =11.5; E_value=0.33; Accession=PF01535.11; Description=PPR repeat
  Pfam annotation: Domain name=PPR; Domain location=199-233; Score =18.9; E_value=0.019; Accession=PF01535.11; Description=PPR repeat
  Pfam annotation: Domain name=PPR; Domain location=234-269; Score =19.2; E_value=0.015; Accession=PF01535.11; Description=PPR repeat
  Pfam annotation: Domain name=PPR; Domain location=270-304; Score =51.3; E_value=3.3e-12; Accession=PF01535.11; Description=PPR repeat
  Pfam annotation: Domain name=PPR; Domain location=305-339; Score =55.6; E_value=1.7e-13; Accession=PF01535.11; Description=PPR repeat
  Pfam annotation: Domain name=PPR; Domain location=340-374; Score =33.8; E_value=6.1e-07; Accession=PF01535.11; Description=PPR repeat
  Pfam annotation: Domain name=PPR; Domain location=375-409; Score =49.8; E_value=9.2e-12; Accession=PF01535.11; Description=PPR repeat
  Pfam annotation: Domain name=PPR; Domain location=410-444; Score =25.4; E_value=0.0002; Accession=PF01535.11; Description=PPR repeat
  Pfam annotation: Domain name=PPR; Domain location=452-486; Score =12.7; E_value=0.24; Accession=PF01535.11; Description=PPR repeat
  Pfam annotation: Domain name=PPR; Domain location=487-521; Score =36.9; E_value=6.8e-08; Accession=PF01535.11; Description=PPR repeat
  Pfam module annotation: Pfam domain module=PPR::PPR::PPR::PPR::PPR::PP R::PPR::PPR::PPR::PPR::PPR; Domain location=129-163::164-198::199 -233::234-269::270-304::305-339::340-374::375-409::410-444::452 -486::487-521
MTRRAQEPAAIIIGVVTPAGKIAGPVEWLKGEEIKPTLPRTMAVHYKRLRQHFCGINIYTSILFATIVPITITMLHSQKTSKTLFKWPKQITNSLVVQLIKAEKDVHKAVNMFDSATAEYGNGFRHDHETFGLIISRLVTVNQFRPAEGMLERMKQEKCMVTEDIFLSICRGYGRVHRPLDAIRVFHKMEGFQLRPTQKAYLTILDILVEENHVKRAIGFYREMRELGIPSSVVSLNILIKALCKNKETVDSALRIFQEMPNRGCQPDSYTYGTLINGLCRLGNISEAKELFKEMEQKGFSASVVTYTSLIHGLCQSNNLDEAIGLLEEMKRNDIEPNVFTYSSLMDGLCKGGHSSQAMQLLEVMDKKHHLPNMVTYSTLINGLCKERKLREAVEILDRMRIQGLKPNAGLYGKIISGLCAAGSYQEAANFIDEMVLGGISPNRASWSLHVRMHNMVVQGLCNNVDPPRAFQLYLSMRTRCISVEIDTFDCLVKCFCKRGDLHKAARILEEMVLDGCIPDEGVWNVVIGGLWDRKKVREATEQLLVELQQKFVEAES

SEQ ID NO: 231615 - protein, 1000 aa, Glycine max
  Coding DNA Sequence Number=SeqID_114837
  Gene Ontology: Mol. function=protein serine/threonine kinase activity; Cellular component=integral to membrane; Biological process=protein amino acid phosphorylation
  Homolog annotation: Hit_ID=O82432; Match level="QueryCoverage=97%, HitCoverage=97%, E-value=0.0, Identity=67%"; Hit description=Leucine- rich receptor-like protein kinase
  Pfam annotation: Domain name=LRRNT_2; Domain location=22-62; Score =56.3; E_value=9.8e-14; Accession=PF08263.3; Description=Leucine rich repeat N-terminal domain
  Pfam annotation: Domain name=LRR_1; Domain location=116-138; Score =10.3; E_value=3.3; Accession=PF00560.23; Description=Leucine Rich Repeat
  Pfam annotation: Domain name=LRR_1; Domain location=140-162; Score =18.1; E_value=0.031; Accession=PF00560.23; Description=Leucine Rich Repeat
  Pfam annotation: Domain name=LRR_1; Domain location=164-186; Score =7.7; E_value=10; Accession=PF00560.23; Description=Leucine Rich Repeat
  Pfam annotation: Domain name=LRR_1; Domain location=188-211; Score =13.8; E_value=0.63; Accession=PF00560.23; Description=Leucine Rich Repeat
  Pfam annotation: Domain name=LRR_1; Domain location=213-235; Score =19.1; E_value=0.016; Accession=PF00560.23; Description=Leucine Rich Repeat
  Pfam annotation: Domain name=LRR_1; Domain location=237-259; Score =16.1; E_value=0.13; Accession=PF00560.23; Description=Leucine Rich Repeat
  Pfam annotation: Domain name=LRR_1; Domain location=261-283; Score =5.5; E_value=27; Accession=PF00560.23; Description=Leucine Rich Repeat
  Pfam annotation: Domain name=LRR_1; Domain location=285-307; Score =11.2; E_value=2.3; Accession=PF00560.23; Description=Leucine Rich Repeat
  Pfam annotation: Domain name=LRR_1; Domain location=308-330; Score =11.3; E_value=2.2; Accession=PF00560.23; Description=Leucine Rich Repeat
  Pfam annotation: Domain name=LRR_1; Domain location=332-354; Score =10.7; E_value=2.9; Accession=PF00560.23; Description=Leucine Rich Repeat
  Pfam annotation: Domain name=LRR_1; Domain location=356-378; Score =6.8; E_value=15; Accession=PF00560.23; Description=Leucine Rich Repeat
  Pfam annotation: Domain name=LRR_1; Domain location=380-402; Score =7.0; E_value=14; Accession=PF00560.23; Description=Leucine Rich Repeat
  Pfam annotation: Domain name=LRR_1; Domain location=404-426; Score =5.9; E_value=22; Accession=PF00560.23; Description=Leucine Rich Repeat
  Pfam annotation: Domain name=LRR_1; Domain location=428-450; Score =5.1; E_value=32; Accession=PF00560.23; Description=Leucine Rich Repeat
  Pfam annotation: Domain name=LRR_1; Domain location=452-477; Score =8.0; E_value=9.2; Accession=PF00560.23; Description=Leucine Rich Repeat
  Pfam annotation: Domain name=LRR_1; Domain location=500-522; Score =10.6; E_value=3; Accession=PF00560.23; Description=Leucine Rich Repeat
  Pfam annotation: Domain name=LRR_1; Domain location=524-546; Score =7.9; E_value=9.3; Accession=PF00560.23; Description=Leucine Rich Repeat
  Pfam annotation: Domain name=LRR_1; Domain location=548-570; Score =13.3; E_value=0.87; Accession=PF00560.23; Description=Leucine Rich Repeat
  Pfam annotation: Domain name=LRR_1; Domain location=571-594; Score =12.8; E_value=1.2; Accession=PF00560.23; Description=Leucine Rich Repeat
  Pfam annotation: Domain name=LRR_1; Domain location=67-90; Score=3.3; E_value=68; Accession=PF00560.23; Description=Leucine Rich Repeat
  Pfam annotation: Domain name=LRR_1; Domain location=92-114; Score =5.4; E_value=28; Accession=PF00560.23; Description=Leucine Rich Repeat
  Pfam annotation: Domain name=Pkinase; Domain location=685-967; Score =120.5; E_value=4.6e-33; Accession=PF00069.15; Description=Protein kinase domain
  Pfam annotation: Domain name=Pkinase_Tyr; Domain location=685-967; Score=81.8; E_value=2.1e-21; Accession=PF07714.7; Description =Protein tyrosine kinase
  Pfam module annotation: Pfam domain module=LRRNT_2::LRR_1::LRR_1::LRR_ 1::LRR_1::LRR_1::LRR_1::LRR_1::LRR_1::LRR_1::LRR_1::LRR_1::LRR_1::LRR_ 1::LRR_1::LRR_1::LRR_1::LRR_1::LRR_1::LRR_1::LRR_1::LRR _1::Pkinase::...
  Pfam module annotation: Pfam domain module=Pkinase_Tyr; Domain location=22-62::116-138::140-162::164-186::188-211::213-235::237 -259::261-283::285-307::308-330::332-354::356-378::380-402::404 -426::428-450::452-477::...
  Pfam module annotation: Domain location=500-522::524-546::548 -570::571-594::67-90::92-114::685-967::685-967
MLQLLPVFLLLLLEQASLISGLNQDGLYLYEWKQSLDDPDSSLSSWNNRDATPCNWAGVTCGPSNTTVTALDLSNFNLSGPFSASLLCRLPNLTSIILFNNSINQTLPLQISLCTPLLHLDLSQNLLTGFLPHTLPLLPNLLHLDLTGNNFSGPIPPSFATFPNLQTLSLVYNLLDDVVSPSLFNITTLKTLNLSFNPFLPSPIPHSLGNLTNLETLWLSGCNLVGPIPESLGNLVNLRVLDFSFNNLYGPIPSSLTRLTALTQIEFYNNSLSAEFPKGMSNLTSLRLIDVSMNHLSGTIPDELCRLPLESLNLYENRFTGELPPSIADSPNLYELRLFGNKLAGKLPENLGKNAPLKWLDVSTNRFSGGIPESLCEHGELEELLMLENEFSGEIPASLGGCRRLSRVRLGTNRLSGEVPAGMWGLPHVYLLELGNNSFSGPIARTIAGARNLSLLILSKNNFSGVIPDEIGWLENLQEFSGADNNFNGSLPGSIVNLGQLGTLDLHNNELSGELPKGIQSWKKLNDLNLANNEIGGKIPDEIGILSVLNFLDLSNNEISGNVPLGLQNLKLNLLNLSYNRLSGRLPPLLAKDMYRASFMGNPGLCGDFKGLCDGKGDDDNSKGFVWILRAIFIVASLVFVVGVVWFYFRYRNFKNAGRSVDKSKWTLMSFHKLGFSEDEILNCLDEDNVIGSGSSGKVYKVVLTSGESVAVKKIWGGVKKEIDSGDVEKGHQFRQDSSFDAEVETLGKIRHKNIVKLWCCCTTRDSKLLVYEYMPNGSLGDLLHSNKGGLLDWPTRYKIAVDAAEGLSYLHHDCVPSIVHRDVKSNNILLDGDFGARVADFGVAKVVDATGKGTKSMSVIAGSCGYIAPEYAYTLRVNEKSDIYSFGVVILELVTGRRPIDPEFGEKDLVMWACNTLDQKGVDHVIDSRLDSCFKEEICKVLNIGLMCTSPLPINRPAMRRVVKMLQEVGTENQTKPAKKDGKLSPYYYDDGSDHGSVA

SEQ ID NO: 231616 - protein, 279 aa, Glycine max
  Coding DNA Sequence Number=SeqID_114838
  Gene Ontology: Mol. function=RNA binding; Cellular component=nucleus; Biological process=rRNA processing
  Homolog annotation: Hit_ID=Q28F42; Match level="QueryCoverage=99%, HitCoverage=91%, E-value=2e-54, Identity=45%"; Hit description=Novel protein
  Pfam annotation: Domain name=GCD14; Domain location=1-275; Score =508.8; E_value=6.3e-150; Accession=PF08704.1; Description=tRNA methyltransferase complex GCD14
  Pfam annotation: Domain name=Methyltransf_11; Domain location=83-181; Score=23.2; E_value=0.00028; Accession=PF08241.2; Description =Methyltransferase domain
  Pfam annotation: Domain name=Methyltransf_12; Domain location=83-179; Score=7.1; E_value=0.097; Accession=PF08242.2; Description =Methyltransferase domain
  Pfam module annotation: Pfam domain module=GCD14::Methyltransf _11::Methyltransf_12; Domain location=1-275::83-181::83-179
MKAVTVSEGSVLQNRFGVFKHSEWIGKPFGSKVVSSKGGFVYLLAPTPELWTLVLNHRTQILYIADISFVIMYLEIVPGCVVLESGTGSGSLTTSLARAVAPSGHVYTFDFHEQRAASARADFERTGLSSLVTVQVRDIQGEGFPDTFTGMADSVFLDLPQPWLVIPSAAKVLRHDGTLCSFSPCIEQVQRTCETLRTCFTDIRTFEVLLRTYEVREEKMQSLCGDGNGSLPSKRRQCSDGSYVLSSSSPSISSVMARPCGEARGHTGYLTFARVKSLS

SEQ ID NO: 231617 - protein, 73 aa, Glycine max
  Coding DNA Sequence Number=SeqID_114839
  Subcellular localization annotation: CTP_CleavageSite=10; ConfidenceScore=5.20e-01
MLTQINSRVVKRLKKNQVAPSPLFATTTFSPIFLTRSLQPELEGNQARLNHRIIENTYRRRKSGTLEADIVGK

SEQ ID NO: 231618 - protein, 206 aa, Glycine max
  Coding DNA Sequence Number=SeqID_114840
  Gene Ontology: Mol. function=heat shock protein binding; Cellular component=nucleus; Biological process=protein folding
  Homolog annotation: Hit_ID=Q1RY14; Match level="QueryCoverage=88%, HitCoverage=54%, E-value=8e-77, Identity=73%"; Hit description=Heat shock protein DnaJ
  Pfam annotation: Domain name=DnaJ_C; Domain location=86-204; Score =28.1; E_value=9.4e-09; Accession=PF01556.9; Description=DnaJ C terminal region
MRGGSFGGIFGDDIFSSFGEGRTMSRQGTRKAPPIEKTLPCTLEELYKGTTKKMKISREIVDASGKTLPVEEILTIEIKRGWKRGTKIMFPEKGNEQSNVIASDLVFVIDEKPHPVFTRDGNDLVVTQKVSLAEALTGYTVHLSTLDGRVLNIPVNNVIHPTYEEMVPREGMPIPKDPSKRGNLRIKFPAKLTSEQKVGIKKLLPY

SEQ ID NO: 231619 - protein, 61 aa, Glycine max
  Coding DNA Sequence Number=SeqID_114841
MDTGCSSDNKIVDNSGGGNTNGISTGDDNNDGIGVVAKVVAVFAIMVVINSGDGESSRGGC

SEQ ID NO: 231620 - protein, 156 aa, Glycine max
  Coding DNA Sequence Number=SeqID_114842
MQGKEENDENEKKDGEDGDEDENAQEEDEEDINDDDYNQDSRWFSLISMMYNNTFYPQKLTQQNFQIEVKEDIQKTPLIFKLIVEASFLAVAVYHLDLPLFFIGEIKSLININNLGKLGFMIVQDPADPTDDSLAIHNCFAPSDPKQNIKPKKIKE

SEQ ID NO: 231621 - protein, 1694 aa, Glycine max
  Coding DNA Sequence Number=SeqID_114843
  Gene Ontology: Mol. function=sequence-specific DNA binding; Cellular component=nucleus; Biological process=regulation of transcription, DNA-dependent
  Homolog annotation: Hit_ID=UPI0000162EFD; Match level="QueryCoverage =93%, HitCoverage=94%, E-value=0.0, Identity=45%"; Hit description=HB- 1; transcription factor
  Pfam annotation: Domain name=DDT; Domain location=580-638; Score =99.1; E_value=1.3e-26; Accession=PF02791.7; Description=DDT domain
  Pfam annotation: Domain name=Homeobox; Domain location=41-97; Score =78.8; E_value=1.7e-20; Accession=PF00046.19; Description=Homeobox domain
  Pfam module annotation: Pfam domain module=DDT::Homeobox; Domain location=580-638::41-97
MEAEAENNDVKKEENSNDNNNNNNNNESNSKIGNSSEGLSKPKRQMKTPFQLETLEKAYAVENYPSETMRVELSEKLGLSDRQLQMWFCHRRLKDKKELPSKKPRKAAALPDSPVEEPKLGPEVGVEYGSGSGSGSSPFARSELRNVVPRGYYESPQTIMELRAIACVEAQLGEPLREDGPILGVEFDPLPPDAFGAPLAVTEQQKRPSLAYDSKIYERHDARANKPWQSRVEARFRVFVKMTEVWACGSWTIWAHAIARTFHEYPFLPNQSGIRSDVYGQLNLPHLHDPMDGPTRTPFPLGNEQQPRVHAPQSHSSHVRLLSQQQDKLVITYPSPPRDNDVAPKREPHTNITSTGMNSHLTDHPIVGQDNPYALAGGQVSHNDAVLRMERKRKSDETKVAKEVEAYEMRMRKELEKQDNLRRKSEERMRKEMERQDRERRKEEERLMREKQREEERSRREQRREMERREKFLLKEHLRAEKRRQKEEIRKEKEEERRKAALEKANARRIAKESMELIEDEQLELMELAAASKGLSSIIHIDLDTLQNLESFRDSLCIFPPKSVKLRKPFAIQPWIDSEQNIGNLLMVWRFLITFADVLDLWPFTLDEFVQAFHDYDSRLLGEIHVVLLKVIIKDIEDVARTPSTGLGMNQNGAANPGGGHPEIVEGAYAWGFDIRNWQKNLNQLTWPEVFRQLALSAGLGPQLKKRNITWSYAIDKDEGKSCKDIISTLRNGSAAESAVAKMQERGLLAPRRSRHRLTPGTVKFAAFHVLSLEGSKGLTVLELAEKIQKSGLRDLTTSKTPEASISVALTRDTKLFERIAPSTYCVRDAFRKNPADADSILSEARKKIQIFENGFLAGEDADDVEREEESESDEVDEDPEDDDLVNPSSANQNSEQYEDTNICSSNGKENLGHNVDLIQKEFDTDLPCFPKNGSKDADCPISVTRQPVACEDLNASNLDQDNMEIDESKSGESWILGLTEGEYSDLSVEERLNALVALVGVANEGNSIRVVLEDRLESANALKKQMWAEAQIDKVRLKDDNISKLDFPSLTGNKVETPYTYPAMEGNLSPMLDININNINNEASPSTAENQKGDPVAQSMPMEKCSSIQDFGSGTGADISQTQVSAQYSKRSRSQLKSYIAHIAEEMYVYRSLPLGQDRRRNRYWQFVASASSNDPGSGRIFVEYHDGKWRLIDSEEAFDALLTSLDSRGIRESHLRLMLLKIENSFKENVRKRNACCAKNGSRGEFSIKIEANEACSIPEHNAGSGSPSSTLHDLNADPSETSSSFKIELGKTESEKKAALRRLLKVLLACMEVSVLSEAFETNWINDVRKHWGIKLSKSSSVEELLQILTLFERSLRRDFLSLNFSTTDELLGSSSMSERSVQASTDPESVAVLPWVPLTTAALSLRLFEIDSSISYVKLERLEPCEEKEAREYIKLPSRYTHMKSNREVEPAEFVHDEFTKDKSVPKKIVRNGNKRGRGTNEQGRGKKLAKRVCNSKRDGGRKNAKVTDNLSHRLKQQARGTQGQGAGRGRRTIRKRRMGKRAVEDLLLGHTTASHSYKIDREPVRNLDEEWDGEKASPMTPVHIGVAADNSNSAEEVESDDDNAQAVEYDQGNWEVGFNGVPPNRWSRGLVGMSDEDVDAFEELNDNGIEENEEEDSEADVMSEGSDGIPNTVVNVGGSDSALSEDSSD

SEQ ID NO: 231622 - protein, 99 aa, Glycine max
  Coding DNA Sequence Number=SeqID_114844
MVRITPEWCGDKLILEELYQIRDSGHRNAEYGLKVVIPVWMGRSLGNTLNFSFCSIQKYPYFTYLFEEIKHADLLILYTVKFCSSMNAVQFYLCSHIEQ

SEQ ID NO: 231623 - protein, 100 aa, Glycine max
  Coding DNA Sequence Number=SeqID_114845
  Gene Ontology: Mol. function=nucleoside transporter activity; Cellular component=membrane; Biological process=transport
  Homolog annotation: Hit_ID=Q69S29; Match level="QueryCoverage=55%, HitCoverage=13%, E-value=4e-12, Identity=58%"; Hit description =Putative equilibrative nucleoside transporter ENT8 splice variant
MKYALRNLVIVLSTEGYASGGSPPNRCSKCFANCIAGDSTLLFLAISTFFELVCIIVYAIYFTKLPIVKYYRSKAMSEGSKNVAVDLAIVGVTPSIPTYI

SEQ ID NO: 231624 - protein, 446 aa, Glycine max
  Coding DNA Sequence Number=SeqID_114846
  Gene Ontology: Mol. function=pyridoxal phosphate binding; Cellular component=cytoplasm; Biological process=carbohydrate metabolic process
  Homolog annotation: Hit_ID=Q2VA41; Match level="QueryCoverage=85%, HitCoverage=34%, E-value=1e-121, Identity=54%"; Hit description=PhoB
  Pfam annotation: Domain name=Phosphorylase; Domain location=124-442; Score=-215.4; E_value=6e-19; Accession=PF00343.10; Description =Carbohydrate phosphorylase
MAATARSRPGLAEAIGERRAKAERMFSLMDGFLKNDPLTLQKDILNHVEYTVARSRFSFDDFEAYQALSHSVRDRLIERWHDTHVYVKRTKPKRLYFLSLEFLMGRSLSNSVINLGIQDQYAEALSQLGFEFEVVAEQEGDAALGNGGLARLSACQMDSLATLDYPAWGYGLRYEYGLFRQIIVDGFQHEQPDYWLNYGNPWEIERIHVTYEVKFYGTVEEVEMNGEKHQVWVPGETNIISNNFRSMPTATCVALLLDLWNVHNVDEELVLPELQVEAVAYDNPIPGYGTRNTINLRLWAAKPSNKFDLEAYNTGDYINSVVNRQRAETISNVLYPDDRNHQGKELRLKQQYFFVSASLQDIIRRFKEAHNNFDELPDKFTYFLNVPVMVRSDSVPLGFMEFSGYPRLDMGYSEFLGREKRKMEKECFGSVQCLQNYEESKERILF

SEQ ID NO: 231625 - protein, 151 aa, Glycine max
  Coding DNA Sequence Number=SeqID_114847
MGDIVNEQWIQVQHLEQALHITKMRTLKAQRLTSVTRCTFMKFINVLLDDLRALHSYVFGERTIVSSLISQTLDQLKRCSSLTKKYHHQLQGFIKDLMERNELTASIANDELVFFLLQTADNFLRTFLLQECFSVMVDYCSFDLVSVYGCK

SEQ ID NO: 231626 - protein, 76 aa, Glycine max
  Coding DNA Sequence Number=SeqID_114848
MVMKNTDEIHVCMFALIEKKKFGKLREMGMEWKHALPGQKGAFVLGSGSYAMGVLKGKARVARAYAIVLVPLELDI

SEQ ID NO: 231627 - protein, 318 aa, Glycine max
  Coding DNA Sequence Number=SeqID_114849
  Gene Ontology: Mol. function=pyridoxal phosphate binding; Cellular component=chloroplast; Biological process=carbohydrate metabolic process
  Homolog annotation: Hit_ID=Q2VA41; Match level="QueryCoverage=99%, HitCoverage=28%, E-value=2e-85, Identity=50%"; Hit description=PhoB
  Pfam annotation: Domain name=Phosphorylase; Domain location=1-313; Score=-151.2; E_value=1.4e-21; Accession=PF00343.10; Description =Carbohydrate phosphorylase
MRLAEYIETMSGVKVSLDAMFDVQVKRIHEYKRQLLNILGIIHRYDCIKNMDKNDRRKVVPRVCIIGGKAAPGYEIAKKIIKLSHAVAEKINNDTDIGDLLKLASFKSQLFICVFIPDYNVSVAELVIPGADLSQHLSRGGAGGCAGYELNMSPLGTAGHEASGTGSMKFMMNGCLLLATADGSTIEIIEEIGSDNLFLFGAKVQEVAELREKGSTLKVPLQFARVLRMVRDGYFGHKDYFESLCDTVEIGNDFYLLGPDFGSYLEAQAAADKAFVEPEKWIKMSILSVAGSGRFSSDRTIQDYAERTWKIDPCRCPL

SEQ ID NO: 231628 - protein, 295 aa, Glycine max
  Coding DNA Sequence Number=SeqID_114850
  Gene Ontology: Mol. function=acyl-CoA binding
  Homolog annotation: Hit_ID=Q4L0H4; Match level="QueryCoverage=33%, HitCoverage=29%, E-value=2e-25, Identity=52%"; Hit description =Membrane acyl-CoA binding protein
  Pfam annotation: Domain name=ACBP; Domain location=192-274; Score =15.5; E_value=8e-08; Accession=PF00887.9; Description=Acyl CoA binding protein
MELLWELAFTIALSLLLPLVFLKLLSVTPNLEANEKVALLGRDHDHGIKSDSKSWETDKVVRIGGKIDEFRDKPIVGKLIVPEIVDVSCGSPKIHNSEKIDEYSVYDEIELVDLAEDPVVDEGNDGVVNIDEVEVELMECDSRENKVEEVEISQCERNYNEIDESSMNEEIGENKGSVVDEDDWEGIESTELERRFGAAVVFVGSKSNANLSNDVKMKLHGYHRIATQGPCHEPQPMALKFSARAKWIARRQLGIMSPEEAMEQFISLLSESIPDWIEENPYDNAKPASATNLVI

SEQ ID NO: 231629 - protein, 288 aa, Glycine max
  Coding DNA Sequence Number=SeqID_114851
  Gene Ontology: Mol. function=protein serine/threonine kinase activity; Cellular component=protein kinase CK2 complex; Biological process=protein amino acid phosphorylation
  Homolog annotation: Hit_ID=Q08467; Match level="QueryCoverage=88%, HitCoverage=96%, E-value=1e-100, Identity=92%"; Hit description =Casein kinase II subunit alpha-1
  Pfam annotation: Domain name=Pkinase; Domain location=34-254; Score =126.3; E_value=8.3e-35; Accession=PF00069.15; Description=Protein kinase domain
  Pfam annotation: Domain name=Pkinase_Tyr; Domain location=34-253; Score=-159.3; E_value=0.011; Accession=PF07714.7; Description =Protein tyrosine kinase
  Pfam module annotation: Pfam domain module=Pkinase::Pkinase_Tyr; Domain location=34-254::34-253
MSKARVYTDVNVLRPKEYWDYESLTLQWGDQDDYEVVRKVGRGKYSEVFEGINVNSNERCIIKILKPVKKKKALDYCHSQGIMHRDVKPHNVMIDHELRKLRLIDWGLAEFYHPGKEYNVRVASRYFKGPELLVDLQDYDYSLDMWSLGCMFAGMIFRKEPFFYGHDNHDQLVKIAKVLGTDELNAYLNKYHLELDPQLDALVGRHSRKPWSKFINADNQHLVSPEAIDFLDKLLRYDHQDRLTAREAMVSSFALQSQIVSQNCQIATGTLYSHPVLVQPAYPALFSI

SEQ ID NO: 231630 - protein, 149 aa, Glycine max
  Coding DNA Sequence Number=SeqID_114852
MIIVVINNDDGYKDISDGCGGNNNGGGGNANNGGNDNVVVVVALMVATNGGGGGGDGYGGGISDGDGSDIVDRGGGSNNVGRDAKDDDGDDNDNGSGSCGGDNGMDLETRVKATEKSKIRDVAGVVVVMMAMVVATKNIMSNVKNVFFK

SEQ ID NO: 231631 - protein, 80 aa, Glycine max
  Coding DNA Sequence Number=SeqID_114853
  Homolog annotation: Hit_ID=O64818; Match level="QueryCoverage=98%, HitCoverage=100%, E-value=9e-20, Identity=62%"; Hit description =Expressed protein
  Pfam annotation: Domain name=DUF1909; Domain location=4-76; Score =58.9; E_value=1.7e-14; Accession=PF08927.1; Description=Domain of unknown function (DUF1909)
MGGGNGQKAKMAREKNIEKQKAASKGSQLDSNKKAMSIQQHWNSLLNINNVVIDDCSAREHAEAKHPKSDVYACFPHLKK

SEQ ID NO: 231632 - protein, 522 aa, Glycine max
  Coding DNA Sequence Number=SeqID_114854
  Gene Ontology: Mol. function=ribonuclease III activity; Biological process=RNA processing
  Homolog annotation: Hit_ID=Q1SEC6; Match level="QueryCoverage=86%, HitCoverage=88%, E-value=0.0, Identity=69%"; Hit description =Ribonuclease III
  Pfam annotation: Domain name=Ribonuclease_3; Domain location=196-286; Score=55.6; E_value=1.7e-13; Accession=PF00636.16; Description=RNase3 domain
  Subcellular localization annotation: CTP_CleavageSite=53; ConfidenceScore=5.69e-01
MELSSSFLLSPKPCSSPPPNFSFSSSLSPFPIQLLIRNGNSKFPQTPPFRIIAVALEPQQDFPSGNSPQRLLKELAERKKATSPKKGPPRRFILRPPIDDNKLAERFLNSPQLSLKSFPLLSSCLPSSRLNNADKLWIDEYLLEAKQALGYSLEPSETLGDDNDNPAKQFDTLLYLAFQHPSCERTKARHVRSGHSRLSFLGQYVLELALTEFFLQRYPRESPGPMRERVFGLIGKRNLPKWIKAASLHNLVFTFDDMDKIRRTEKEGPVKSVFWALFGAIYLCFGMPEVYRVLFEVFGMDPDAEDCQPKLRRQLEDVDFPPADALFEHPRLFRACVPPGMHRFRGNIWDYDTRPHVMKTLGYPLEMADRIPEITEARNIELGLGLQLCFMHPSKYKFEHPRFCYERLEYVGQKIQDLVMAERLLMKHLDAPGLWLQERHRHLLMNKYCGRYLRAKHLHRVIIFDDKVQDTYEHNRRKRNPATTAVQQALHGLSYLVYGKRDVRRLMFEVFDFEQIQPKEVV

SEQ ID NO: 231633 - protein, 106 aa, Glycine max
  Coding DNA Sequence Number=SeqID_114855
  Subcellular localization annotation: CTP_CleavageSite=59; ConfidenceScore=5.53e-01
MNALSAPAALSRFITTGKFLDFQMIALSQRALRGRARASLTSALSKGGRCTESPPTFICGKRRKNRRKPVKMKILSSGVVFTFEEGRQKRGFCSYVPSIEEEIRPT

SEQ ID NO: 231634 - protein, 70 aa, Glycine max
  Coding DNA Sequence Number=SeqID_114856
MHSGRRRATSTNGDRGRGTSTNGGRETINEHQQRKRKRKTKMKEEEEDEEAASEEKKRRRRRRSGARTKN

SEQ ID NO: 231635 - protein, 187 aa, Glycine max
  Coding DNA Sequence Number=SeqID_114857
MNTFSSEICSSGCESGWTLYLENSFLNQNAAASHRGGTEGFYEEEHKDKRFKGEEEDLSMVSDASSGPPHFPDYDEAYFNEEVNGCFYSASNKAVKLAKSGAKKQKVKENQQHLQDQQHLPSFLHDTASSPVVDFSTNSVNEANQQTSIGSMLDYSQGFSATYFEGRPSFQGEHFGFLQSGNELQGN

SEQ ID NO: 231636 - protein, 73 aa, Glycine max
  Coding DNA Sequence Number=SeqID_114858
MGIEFKKIKPPNTNQEGSNVWNVDAALKFLLGAQGVVNFLNLSASPFWFCYGWMSDTVVLCLTKFNEFISKIK

SEQ ID NO: 231637 - protein, 46 aa, Glycine max
  Coding DNA Sequence Number=SeqID_114859
MADQQVTKSEAKGKQKYYVRDRQVIKRPAQDVKEALLGGNLVVKIP

SEQ ID NO: 231638 - protein, 88 aa, Glycine max
  Coding DNA Sequence Number=SeqID_114860
  Homolog annotation: Hit_ID=Q2HS45; Match level="QueryCoverage=82%, HitCoverage=9%, E-value=5e-07, Identity=35%"; Hit description=RNA -directed DNA polymerase
MAMKKEARVVKKGFQWRIDNGNSIYAGPNLGLRMKVGDLIDHNICAWKKDLMKENFNQLDAEKIQSLPLLNMMQNDKVFWKFSPTVNI

SEQ ID NO: 231639 - protein, 132 aa, Glycine max
  Coding DNA Sequence Number=SeqID_114861
IAPTRHLVDLKKSNRALGFPAPVMGLCQSYRVPVPPARSCHRDIGIAPTRHPVDPEKSNRVLGFPALITDLCQFYGVPVAPIKGETPQQPEDGRQRAIDAPPPPPEPPSSSIKVGALPTTRGRPAGDQVQSQ

SEQ ID NO: 231640 - protein, 125 aa, Glycine max
  Coding DNA Sequence Number=SeqID_114862
MATMMEAMMSMKRIMEANVVAVAATSTVAKVNPMPPSDLNQMNHPISDMVGKDLGSTDGPMMCKFKTSTPSRHTACLPTIHHPMWHTLPMRMSITPLPYSLRADNLILYMSLNPWGRYMKFPTII

SEQ ID NO: 231641 - protein, 45 aa, Glycine max
  Coding DNA Sequence Number=SeqID_114863
MYRGPRGSFGVEGRSKVGPSGQAEGIYTNAPDPIKTPQLSVLGRE

SEQ ID NO: 231642 - protein, 108 aa, Glycine max
  Coding DNA Sequence Number=SeqID_114864
MCASSSRWRAFMSNSKVEASQVKAQAKKSLALEPRTQINKLEAKIPWVTERDRNRDTEHCSSKEEEQRKTWIMKEPQGWVPNATMELMLLVVSLKAQAHCSHAKSSHG

SEQ ID NO: 231643 - protein, 93 aa, Glycine max
  Coding DNA Sequence Number=SeqID_114865
MVAGTNKERSRLVRETESSGRWSDLYRTAEQCILNQFHKLRQFKENKAAHIPTNHHLTTANKNANHKNKCKFHLRQTGAWERKGCPHHSAAVG

SEQ ID NO: 231644 - protein, 78 aa, Glycine max
  Coding DNA Sequence Number=SeqID_114866
MASKSVTETAIGTLNWHIKYHLVLDATWLHLVLSVQFVGNAKLLVWNSYNNNSTDDFMPYDHILWFIDLANWCQKSNS

SEQ ID NO: 231645 - protein, 763 aa, Glycine max
  Coding DNA Sequence Number=SeqID_114867
  Gene Ontology: Mol. function=nucleic acid binding; Cellular component= chromosome, pericentric region; Biological process=regulation of transcription, DNA-dependent
  Homolog annotation: Hit_ID=Q9XFH4; Match level="QueryCoverage=98%, HitCoverage=96%, E-value=0.0, Identity=68%"; Hit description =SWI2/SNF2-like protein
  Pfam annotation: Domain name=DEAD; Domain location=193-363; Score= -18.4; E_value=0.0002; Accession=PF00270.19; Description=DEADDEAH box helicase
  Pfam annotation: Domain name=Helicase_C; Domain location=552-631; Score=99.8; E_value=8.1e-27; Accession=PF00271.21; Description =Helicase conserved C-terminal domain
  Pfam annotation: Domain name=ResIII; Domain location=189-357; Score= -21.4; E_value=0.0029; Accession=PF04851.6; Description=Type III restriction enzyme, res subunit
  Pfam annotation: Domain name=SNF2_N; Domain location=195-496; Score =390.4; E_value=2.6e-114; Accession=PF00176.13; Description=SNF2 family N-terminal domain
  Pfam module annotation: Pfam domain module=DEAD::Helicase _C::ResIII::SNF2_N; Domain location=193-363::552-631::189-357::195-496
MEAKNKVKIDDSTAESPTSVLEDEAVCAPKEEVKLEEEVTADIKDDGTSLISKTMVEEEENLIEARMKEEEVQCEEVPDLNDTQFNKLDELLTQTKLYSEFLLEKMDDITLAVGEQENREEQESNPSAKKKGCGSKRKAASQYNTRKAKKAVTAMLTRSEESEKTEDTNMTEEERVEKEQKELMPLLTGGKLKTYQLKGVKWLISLWQNGLNGILADQMGLGKTIQTIGFLSHLKAKGLDGPYMIIAPLSTLSNWVNEISRFAPSLPAVIYHGDKKQRDEIRRKHMPTRTIGPEFPIVITSYEIALNDAKKYFRSYNWKYIVVDEGHRLKNSQCKLVKALKFINVENKLLLTGTPLQNNLAELWSLLNFILPDIFASLEEFESWFNLSGKCNNEATKEELEEKRRSQVVAKLHAILRPFLLRRMKSDVEIMLPRKKEIIIYANMTEHQKNLQDHLVNKTLGNYLKENMSSGLSVPAIMIRNLAIQLRKVCNHPDLLESAFDDSYLYPPLEEIVGQCGKFHLLDRLLQRLFSRNHKVLIFSQWTKVLDIMDYYFSEKGFAVCRIDGSVKLEERKQQIQDFNDVNSNCRVFLLSTRAGGLGINLTVADTCILYDSDWNPQMDLQAMDRCHRIGQTKPVHVYRLSTAQSIEGRMLKRAFSKLKLEHVVIEKGQFHQERTKPASMDEIEEDDVLALLRDEETAEDKKIHTDISDEDLEKLLDRSDLIVNDSNDDNFKAPVSAFPLKGPGWEVVIPTATGGMLSTLNC

SEQ ID NO: 231646 - protein, 459 aa, Glycine max
  Coding DNA Sequence Number=SeqID_114868
  Gene Ontology: Mol. function=protein serine/threonine kinase activity; Cellular component=membrane; Biological process=protein amino acid phosphorylation
  Homolog annotation: Hit_ID=Q1S4F8; Match level="QueryCoverage=90%, HitCoverage=63%, E-value=1e-168, Identity=72%"; Hit description =Protein kinase
  Pfam annotation: Domain name=Pkinase; Domain location=116-351; Score =95.8; E_value=1.3e-25; Accession=PF00069.15; Description=Protein kinase domain
  Pfam annotation: Domain name=Pkinase_Tyr; Domain location=116-389; Score=140.6; E_value=4.1e-39; Accession=PF07714.7; Description =Protein tyrosine kinase
  Pfam module annotation: Pfam domain module=Pkinase::Pkinase_Tyr; Domain location=116-351::116-389
MNCMRMMWYIQITKGNAYTHQPWNHNNYYNSGQHPSYYGGPHGDHVVRMQQNGMGPGGGGGWGAPPPPPMMMNSADFSSNYSTGPPPLPPPSPTLALGLKGGTFSYEELAAATNGFNDANLIGQGGFGYVHKGVLPSGKEVAVKSLKAGSGQGEREFQAEIDIISRVHHRHLVSLVGYSISGGQRMLVYEFIPNNTLEYHLHGKGRPTMDWATRMRIAIGSAKGLAYLHEDCHPRIIHRDIKAANVLIDDSFEAKVADFGLAKLTTDNNTHVSTRVMGTFGYLAPEYASSGKLTEKSDVFSFGVMLLELITGKRPVDHTNAMDDSLVDWARPLLTRGLEEDGNFGELVDAFLEGNYDAQELSRMAACAAGSIRHSAKKRPKMSQIVRILEGDVSLDDLRDGIKPGQNVVYNSSPSSNQYDTMQYNADMQKFRKAVFSNSDEFGTSSGSSGEVSQKQQRL

SEQ ID NO: 231647 - protein, 561 aa, Glycine max
  Coding DNA Sequence Number=SeqID_114869
  Gene Ontology: Mol. function=nucleic acid binding; Cellular component= ribonucleoprotein complex
  Homolog annotation: Hit_ID=Q94LP1; Match level="QueryCoverage=54%, HitCoverage=51%, E-value=2e-62, Identity=48%"; Hit description =Putative U1 small nuclear ribonucleoprotein
  Pfam annotation: Domain name=RRM_1; Domain location=240-296; Score =16.6; E_value=0.0042; Accession=PF00076.12; Description=RNA recognition motif. (a.k.a. RRM, R
  Subcellular localization annotation: CTP_CleavageSite=20; ConfidenceScore=5.15e-01
MGDNNSNNDAFMRNQNAAVQARTKAQNRSNVLQLKLIGQSHPTGLTANLLKLFEPRPPLEYKPPPEKRKCPPLSGMAQFVSKFAEPGEPEYAPPVPETETPAQKRARIHKLRLEKGAAKAAEELEKCDESYIANLLIFHDFMFSGCHSYIGFYADDPHNDPNVSGDPYKTLFVAKLSYETTESRIKREFESYGPIKRVVAPPTSIEWIFRYWFQFPLSSSVDLCGLRDLLRAWVPLGIMLAVGIVSKNTSLVRLVADKDINKPRGYAFIEYLHTRDMKAAYKQADGRKIDGRRVLVDVERGRTVPNWRPRRLGGGLGTTRVGGSNNSLVLKNRECERTDTLIDHLETGKYHVKEVGTKTENGSDHVNILMKGSGIVIIGRIGTTETGIGTGTETETGKEIEIVGVIEIEHGTVIVSEGGTVIGIENMIDIVRGIEIMKLVTLIEDAHVIGSLIMIVLNLNMGKGIMTMNLRMIVVGITSMNMDVGMQTLIMTLSGMTTTIMEMTMVTITISIVTMMGWKMTTMLDVQHLNRMKRREVMMWTVNINAQRDHIPGSMIIRTWA

SEQ ID NO: 231648 - protein, 191 aa, Glycine max
  Coding DNA Sequence Number=SeqID_114870
  Gene Ontology: Mol. function=protein binding; Cellular component =nucleus; Biological process=regulation of transcription, DNA -dependent
  Homolog annotation: Hit_ID=Q9ZSM8; Match level="QueryCoverage=96%, HitCoverage=22%, E-value=5e-30, Identity=36%"; Hit description =Probable Polycomb group protein EZA1
MGEKTIDSTSKHREQHGEAKDVVRRTLKTKIKQLTNQILVERGQSVKEKIQRHWEHLELLFSIVMSIIFERGSLETEKNVNMLSSRIHNPLCKLSGFPKGIVEKNQINNVDLSPTKSIRIPHTDKLPQYTSWVYVARNERMVDDQSVIGKYQMYHDKNKGEMVICSDNEEEIVDPEDVKHEFTEVEDKFLR

SEQ ID NO: 231649 - protein, 174 aa, Glycine max
  Coding DNA Sequence Number=SeqID_114871
MTKIRSTLPTPSTAPTMALLLPSPPLSLPPPLLLPLPLPEFLEDGGESKDLCGGDGDSKEGGECDDPGGEGDCEDPLGDGGLGLFDVGGEGEGGGDDEDDGGGDRGGGDDGGGDEGGGDDGGGDEGGGDDGGGDDGGGDDGGGDCDGGDELSESSGVELSGVALSGLESSGEEL

SEQ ID NO: 231650 - protein, 60 aa, Glycine max
  Coding DNA Sequence Number=SeqID_114872
  Subcellular localization annotation: CTP_CleavageSite=23; ConfidenceScore=5.32e-01
PSLPRSATFKPNTVAFQKALEPRQQLVNAFFAVSCRIAFLFMVKESPSKQRKEEEKALFA

SEQ ID NO: 231651 - protein, 141 aa, Glycine max
  Coding DNA Sequence Number=SeqID_114873
  Gene Ontology: Mol. function=protein binding; Cellular component =nucleus; Biological process=regulation of transcription, DNA -dependent
  Homolog annotation: Hit_ID=Q9ZSM8; Match level="QueryCoverage=87%, HitCoverage=13%, E-value=4e-24, Identity=45%"; Hit description =Probable Polycomb group protein EZA1
MTLEEYGCTEEVLNVVKKFVKTTNSEIQERYEKLKEKNMEILDQHCEDCHCRGCENHLGLCLEKSLSVTLETFNNLLCRQCLIFDCPMHGINKPLVYHSENQPVWLEPEGDKKPCSDQCYLMLKDARILSKNSTQWSFQDK

SEQ ID NO: 231652 - protein, 153 aa, Glycine max
  Coding DNA Sequence Number=SeqID_114874
  Gene Ontology: Mol. function=RNA-directed DNA polymerase activity; Cellular component=chromatin; Biological process=chromatin assembly or disassembly
MTYKVTLKDNRKNMTYKVTLKGNRKNMTYKITLKGNRNFRATERKREKFADNASAEIWEGERKVEEMLLNWGKANDKIEGKVLPNSGGNCKRLKETSWFPGLVFRLLTDKALEYIVVDIIPHVNPEEILLELLQGFCNSHMVVLRGGMEFLQQ

SEQ ID NO: 231653 - protein, 50 aa, Glycine max
  Coding DNA Sequence Number=SeqID_114875
MGSRTAGVMAVAEEAAREMDKRLITTRFAGTYDLIISATSKPLLNLKPYC

SEQ ID NO: 231654 - protein, 333 aa, Glycine max
  Coding DNA Sequence Number=SeqID_114876
  Gene Ontology: Mol. function=carbohydrate binding
  Homolog annotation: Hit_ID=Q10NJ9; Match level="QueryCoverage=83%, HitCoverage=75%, E-value=7e-44, Identity=33%"; Hit description =Lipase, putative, expressed
  Pfam annotation: Domain name=DUF620; Domain location=79-295; Score =229.0; E_value=1e-65; Accession=PF04788.3; Description=Protein of unknown function (DUF620)
MGNNVALRWQNMLTWMKAQTEDKLATPTVASRLNELRFLLYLVGCPLIPLQEASTAKYIVQQYIAATGGQPALNAVDSMCVTGQIKISASDFYHTGQSIEVKKTSEEMGGSFCPVVRFVAAAMARSRGAIPLTNKPPFKEVPLDLYVVSFRATANLFLDAACIGEKIINDEECFILKLETSPAIRDAQSGPNFEIIHHTIWGYFSQRSGLLVQFEDCRLHSMRTKDDNDIFWQTSLESVIEDYKYVDGINVSHSGKTRVTVSRYGEQSANHKKELEERWKIEELQWPTQGSKKKSKLASIIIQESANTFHAYILEVDSGYDFFIIVVSYTCYH

SEQ ID NO: 231655 - protein, 480 aa, Glycine max
  Coding DNA Sequence Number=SeqID_114877
  Gene Ontology: Mol. function=sugar porter activity; Cellular component=integral to membrane; Biological process=carbohydrate transport
  Homolog annotation: Hit_ID=Q1XF09; Match level="QueryCoverage=99%, HitCoverage=96%, E-value=1e-170, Identity=63%"; Hit description =Putative polyol transporter protein 2
  Pfam annotation: Domain name=MFS_1; Domain location=21-433; Score =100.2; E_value=6.2e-27; Accession=PF07690.6; Description=Major Facilitator Superfamily
  Pfam annotation: Domain name=Sugar_tr; Domain location=17-475; Score =293.2; E_value=4.8e-85; Accession=PF00083.14; Description=Sugar (and other) transporter
  Pfam module annotation: Pfam domain module=MFS_1::Sugar_tr; Domain location=21-433::17-475
MENGGCHRRLNKYTCATVLAASIVSAMFGYVTGVMSGALIFIQEDLQINDLQIQLLVGASHLCALPGSLVAGRTSDYIGRCYTITLASIAFLLGSILMGYGPSYPILMIGNCIVGVGVSFAMVVAPLYSTEISPPSSRGFFTSLPTLSVNTGFLLGYMSNYFFEKLPHKLGWRMMVAVPAIPSLCLIILMLKLVESPRWLVMQGRVGDALKVLLLISTTKEEAEQRLRQIKCVVGIDENCTLDIAQVPQKTSSGKGALKELFCKSSPPVRRIFITAVGLHLFLRIGGSAAILLYSPRVFERTGITDKSTLMLATVGIGISKVVFAFISIFLSDRFGRRILLLVSAVGVTVTMLGLGICLTIVEKSIEKLLWASCLTVILTYIFVASMSIGIGPVTWVYSSEIFPLRFRAQGLSVCVIVNRMMTVAVVTSFISTYKAITMGGIFFMFAAINAVALVFYYFLPETKGISLEDMETIFERNSN

SEQ ID NO: 231656 - protein, 71 aa, Glycine max
  Coding DNA Sequence Number=SeqID_114878
MTDLWFPSTVGTMFSQAHICDCSTVIEDTNPVLVIARVADNNYEEVVATINFEDVGMERVGAFLYYNARQL

SEQ ID NO: 231657 - protein, 497 aa, Glycine max
  Coding DNA Sequence Number=SeqID_114879
  Gene Ontology: Mol. function=sugar porter activity; Cellular component=integral to membrane; Biological process=carbohydrate transport
  Homolog annotation: Hit_ID=Q1S4G3; Match level="QueryCoverage=98%, HitCoverage=99%, E-value=0.0, Identity=72%"; Hit description=Sugar transporter superfamily; Major facilitator superfamily MFS_1
  Pfam annotation: Domain name=MFS_1; Domain location=24-437; Score =120.8; E_value=3.9e-33; Accession=PF07690.6; Description=Major Facilitator Superfamily
  Pfam annotation: Domain name=Sugar_tr; Domain location=20-478; Score =409.6; E_value=4.6e-120; Accession=PF00083.14; Description=Sugar (and other) transporter
  Pfam module annotation: Pfam domain module=MFS_1::Sugar_tr; Domain location=24-437::20-478
MEIERGNNNEHKGSRYAVACAVVTSMISIIFGYDTGVMSGALIFIKEELGISDTQQEVLAGILNICALFGSLVAGRTADYIGRRYTITLASILFMVGSVLMGYGPNYAILMTGRCVAGIGVGFALLIAPVYAAEISSTKSRGFVTSLPELCIGIGILLGYIVNYLFGKLILRLGWRLMLGIAAVPSLALALGILAMPESPRWLVMQGHLGKAKKVLLQVSDTEEEAELRLKDIKSAAGIDENCTEEIVKLPQKDNGEAVWKELIFRPSYSVRWMLIAAVGIHFFEHATGIEAVMLYSHRIFKKAGVTSKDKLLLTTIGVGLTKVICLIIATFFIDKVGRRPLLLVSVGGMVCSLGVLGFSLTMVDTSHEELLWALILSIVATYIYVAFFNLGLGPITWVYSSEIFPLKLRAQGASIGVAVNRLTNAAISMSFISIYNAITIGGAFFMFAGISVIAWAFFYFFMPETKGVALEEMEMLFSKNKGNNVTTTEIDLRQIL

SEQ ID NO: 231658 - protein, 472 aa, Glycine max
  Coding DNA Sequence Number=SeqID_114880
  Gene Ontology: Mol. function=sugar porter activity; Cellular component=integral to membrane; Biological process=carbohydrate transport
  Homolog annotation: Hit_ID=Q1XF09; Match level="QueryCoverage=99%, HitCoverage=94%, E-value=1e-161, Identity=61%"; Hit description =Putative polyol transporter protein 2
  Pfam annotation: Domain name=MFS_1; Domain location=26-440; Score =102.8; E_value=1e-27; Accession=PF07690.6; Description=Major Facilitator Superfamily
  Pfam annotation: Domain name=Sugar_tr; Domain location=22-470; Score =278.6; E_value=1.2e-80; Accession=PF00083.14; Description=Sugar (and other) transporter
  Pfam module annotation: Pfam domain module=MFS_1::Sugar_tr; Domain location=26-440::22-470
MENGIGENENSHGSLNKYACSSVMAASIISAVFGYVVGVMSGALVFIKEDLQISDLQVQLLAGMLHLCALPGCMAAGRTSDYKGRRYTIILASTIFSLGSILMAWGPFYLILMIGNCILGVSVGFALIIAPVYSAEISPPSYRGFLTSLPELSINIGLLLGYVSNYFFEKLSLKLGWRMMVGVPAIPSLCLIILMLKLVESPRWLVMQGRVGEARKVLLLVSNTKEEAEQRLKEIKGVVGIDENCTLGIVQVPKKTRSGAGALKELFCKSSPPVRRILISAIGVHVFLQIGGIGAILLYGPRIFERTGISDKSKLMLATVGIGVSKVIFAFISIFLMDRVGRRILFLVSAGGMVVTLLGLGVCLTIVERSTEKVVWAISFTIIVTYLVVAFMTIGIGPVTWVYSTEIFPLRFRAQGLGVSVAVNRITNVIVVTSFISVDKAITMGGVFILFAAINALALWYYYTLPETKGRS

SEQ ID NO: 231659 - protein, 281 aa, Glycine max
  Coding DNA Sequence Number=SeqID_114881
  Gene Ontology: Mol. function=DNA binding; Cellular component=nucleus; Biological process=regulation of transcription, DNA-dependent
  Homolog annotation: Hit_ID=Q76I94; Match level="QueryCoverage=85%, HitCoverage=31%, E-value=2e-71, Identity=60%"; Hit description=PHCLF3
MEASTLVYNVCLEAMTMVKVIALKPRGHSCLIAITLLPGLKTCLEVARAFQVSNFVFPNKEGCLLLDMQKGLSCTFEFMTKKCHQDHDRNEKKENLKSSIILESLLASHLDGEKLLMGKTCVISNILLVGAMEYVERNVPVLLMELAVKNIAGVQNTAVIDLEDAVAQKVNAKVDHVHVLQPTVNVTQMFVKIVGCGDDSLGRLPRHEDAKCGNMNLLLGQKERNPISKNVCLGEYTGELIPPKEAEKRGKLYDRINTSFLFNLNDQASVLINYIFSRALF

SEQ ID NO: 231660 - protein, 547 aa, Glycine max
  Coding DNA Sequence Number=SeqID_114882
  Gene Ontology: Mol. function=sugar porter activity; Cellular component=integral to membrane; Biological process=carbohydrate transport
  Homolog annotation: Hit_ID=Q1S4G3; Match level="QueryCoverage=89%, HitCoverage=98%, E-value=0.0, Identity=77%"; Hit description=Sugar transporter superfamily; Major facilitator superfamily MFS_1
  Pfam annotation: Domain name=MFS_1; Domain location=21-434; Score =122.8; E_value=9.7e-34; Accession=PF07690.6; Description=Major Facilitator Superfamily
  Pfam annotation: Domain name=Sugar_tr; Domain location=17-475; Score =408.2; E_value=1.2e-119; Accession=PF00083.14; Description=Sugar (and other) transporter
  Pfam module annotation: Pfam domain module=MFS_1::Sugar_tr; Domain location=21-434::17-475
MEIGGEKDQFNKYACACAVVASMISIIFGYDTGVMSGAMIFIKEELGISDTQQEVLAGILNLCALVGSLAAGRTSDYIGRRYTIALASVLFMGGSILMGYGPNYAILMLGRCVAGIGVGFALLIAPVYSAEISSAKSRGFLASLPELCIGIGILLGYVANYFLGKLTLKLGWRLMLGIAAVPSLALAFGILAMPESPRWLVMQGHLGKAKKVLLKVSNTEQEADLRFKDIKIAAGIDENCPEEMVKLPQKNHGEGVWKELIVRPSNSVRWMLIAAVGIHFFEHATGIEAVMLYSPRIFKKAGVTTKDKLLLTTIGVGLTKIFFLIIASFLLDRFGRRRLLLTSTGGMVCSLAVLGFSLTMVHTSQEKLSWALTLSIVATYSFVASFNIGLGPVTWVYSSEIFPSKLRAQGASIGVAVNRVMNAAVSMSFISIYKTITIGGTFFMFAAISILAWLFFYFFLPETKGVALEGMEMVFSKNYSRNVAAETDQRQNAIIFKPILHQHATSLQLYPHYKQVARKSKTTSILTEPGKSTSKRQVADYIQFGAK

SEQ ID NO: 231661 - protein, 596 aa, Glycine max
  Coding DNA Sequence Number=SeqID_114883
  Gene Ontology: Mol. function=sugar porter activity; Cellular component=integral to membrane; Biological process=carbohydrate transport
  Homolog annotation: Hit_ID=Q1XF08; Match level="QueryCoverage=71%, HitCoverage=89%, E-value=1e-138, Identity=58%"; Hit description =Putative polyol transporter protein 3
  Pfam annotation: Domain name=MFS_1; Domain location=1-401; Score =70.8; E_value=4.5e-18; Accession=PF07690.6; Description=Major Facilitator Superfamily
  Pfam annotation: Domain name=Sugar_tr; Domain location=1-422; Score =259.2; E_value=8.4e-75; Accession=PF00083.14; Description=Sugar (and other) transporter
  Pfam module annotation: Pfam domain module=MFS_1::Sugar_tr; Domain location=1-401::1-422
MAGALIFIKEDLQISDLQVQLLAGILDVFAVSGAMAAGRTSDYIGRRYTVILASLIFLLGSILMGYGPSYSILIIGRCIVGIGVGFALIIVPVYSTEISSPSKRGFLTSLPDLCINLGFLLGYVSNYLFEKLPLKLGWRIMVALPAIPSLILVILMLNSVESPRWLVMQGRIAEARKVLLLVSNTNEEAKQRLNEIEVSVGIVENCTLDIVQVPRETRSGAGALKELFCKPSPPVRRILIAAIGVHVFQQSSGIEGILVYSPRVFERTGISDKSKLMLVTVGMGISKTVSTLVATFLLDRVGRRILFLVSSGGMVVALLGLGVCMTTVESSTEKLLWTTSIAIIATYVYVAFMAIGIGPVTWVYSTEIFPLRLRAQGIGICVAVNRTTNLAVVTTINALAWCFYYFLPETKGRSLEDMESIFGENSKSKYGHSKVTAALEDKHKEYSKTEFSNNIRELGKLSAVGHNQLLREYSSAAGGLLHEVLGSNWVSLMFSWACYGFVLYCYQHPFLEKQSCPQGCGLWTKCPNVPRWCPLVVSLAIGPTPAWMRGMNCDVASVRRHQTPGEFWWSPVVGVDKHQGCQVPGSRRGHIIAWAT

SEQ ID NO: 231662 - protein, 461 aa, Glycine max
  Coding DNA Sequence Number=SeqID_114884
  Gene Ontology: Mol. function=sugar porter activity; Cellular component=integral to membrane; Biological process=carbohydrate transport
  Homolog annotation: Hit_ID=Q1XF08; Match level="QueryCoverage=96%, HitCoverage=89%, E-value=1e-146, Identity=60%"; Hit description =Putative polyol transporter protein 3
  Pfam annotation: Domain name=MFS_1; Domain location=1-401; Score =99.2; E_value=1.3e-26; Accession=PF07690.6; Description=Major Facilitator Superfamily
  Pfam annotation: Domain name=Sugar_tr; Domain location=1-441; Score =282.8; E_value=6.6e-82; Accession=PF00083.14; Description=Sugar (and other) transporter
  Pfam module annotation: Pfam domain module=MFS_1::Sugar_tr; Domain location=1-401::1-441
MAGALLFIKEELQISDLQVGLLAGILNVCALPACMVAGRTSDYLGRRYTIILASVIFLLGSLLMGYGPSYSILIIGRCIVGIGVGFALIIAPVYSAEISSPSYRGFLISLPDVSLNFGLLLGYVSNYFLGKLSLKLGWRTMLVVPAVPSLVLVILMFKLVESPRWLIMQGRVGEARKVLLLVSNTKEEAEKRLKEIKGAAGIDEKCTEDIVHVPKQIRSGAGALKELLCKPSLPVRNILVAAIGVHVFQQVCGIESILLYSPRVFEKTGIMDKSMLLLATVGMGISQAVFTFISAFLLDRVGRRILLLISAGGVVVTLLGLGFCMTMVENSKEKQLWAMGFTIVFTYIFVAFVAIGIGPVTWVYSSEIFPLRLRAQGLAIGVTVNRIANVVVVTSFISIYKKITLGGTFFMYVGITALAWWFYYSLPETKGRSLEDMETIFGKNSKSEIQVKPELWISCMK

SEQ ID NO: 231663 - protein, 91 aa, Glycine max
  Coding DNA Sequence Number=SeqID_114885
MVDVQDGHSLMALILARYGATPEADTMCLSSVGHNQLLREYSSAAGGLLHEVPEVSFAEPTNMCCLVDQWKHYPKVHLFMVEYRKYRGRFF

SEQ ID NO: 231664 - protein, 232 aa, Glycine max
  Coding DNA Sequence Number=SeqID_114886
  Gene Ontology: Mol. function=serine-type endopeptidase activity; Cellular component=periplasmic space; Biological process=proteolysis
  Homolog annotation: Hit_ID=Q84DH8; Match level="QueryCoverage=48%, HitCoverage=24%, E-value=3e-51, Identity=94%"; Hit description =Serine protease
  Pfam annotation: Domain name=PDZ; Domain location=38-117; Score=34.7; E_value=3.2e-07; Accession=PF00595.14; Description=PDZ domain (Also known as DHR or GLGF)
TALADCTTEPGAKVKLGLIRDGKPLSVEVTLDKSTSSSASAELIAPALQGATLSDGQLKDGTKGITIDTVEKSSPAAQAGLHQDDVIIGVNRNRVQSIAELRKLLEGKPAVIALQLLRSIVIGLIVAGLLLLALPSLRQFNKLSAPQFDSTDETPATYNQAVRRAAPAVVNVYNRGLNTSAHNQLEIRTLGSGALLVGSDSLTDLAVLKINATGGLPVIPINRKRTPHIGDV

SEQ ID NO: 231665 - protein, 112 aa, Glycine max
  Coding DNA Sequence Number=SeqID_114887
MDDWNIPEIPQDQLYVPETIKDKHNFDYIIKTIENNIPLGQEVGEEFHLLSKNSIYEHSRKYKYLHIGCVQVAIKPLIDMGIDAAVLMCLRDIRHNQFEDSLIGTVETSLGQ

SEQ ID NO: 231666 - protein, 403 aa, Glycine max
  Coding DNA Sequence Number=SeqID_114888
  Gene Ontology: Mol. function=protein kinase activity; Cellular component=cytoplasm; Biological process=protein amino acid phosphorylation
  Homolog annotation: Hit_ID=Q10R62; Match level="QueryCoverage=91%, HitCoverage=84%, E-value=1e-123, Identity=58%"; Hit description =Serine/threonine-protein kinase NAK, putative, expressed
  Pfam annotation: Domain name=Pkinase; Domain location=63-365; Score =156.9; E_value=5.2e-44; Accession=PF00069.15; Description=Protein kinase domain
  Pfam annotation: Domain name=Pkinase_Tyr; Domain location=63-365; Score=124.0; E_value=4.2e-34; Accession=PF07714.7; Description =Protein tyrosine kinase
  Pfam module annotation: Pfam domain module=Pkinase::Pkinase_Tyr; Domain location=63-365::63-365
  Subcellular localization annotation: CTP_CleavageSite=57; ConfidenceScore=5.40e-01
MEIMRLLRSESGSTKCQSKTKQNSNSSERKAPLKTSASNVGKPISNSLKSFTFNDLREATKNFRQENLIGEGGFGFVYKGWIDENTCTPTKPGTGIVVAIKKLKPESFQGHREWLAEVNYLGQLHHENMVKLIGYCTDGKNRLLVYEFMQKGSLENHLFRKGVQPIPWITRINIAVAVARGLTFLHTLDTNVIYRDLKASNILLDSVCDTESLACRFVKKTAPAVLHDFNAKLSDFGLARDGPTGDNTHVSTRVIGTHGYAAPEYVATGHLTPRSDVYSFGVVLLELLTGRRVVEDDRPGFSEETLVDWARPFLSDSRRILRIMDSRLGGQYSKKGARAAAALVLQCLNTDPKYRPTMVTVLAELEALHSSNSFPRTPKSGTENHTTEHSSHSHKSATSSNKL

SEQ ID NO: 231667 - protein, 649 aa, Glycine max
  Coding DNA Sequence Number=SeqID_114889
  Homolog annotation: Hit_ID=Q9FMQ0; Match level="QueryCoverage=96%, HitCoverage=96%, E-value=2e-99, Identity=39%"; Hit description =Genomic DNA, chromosome 5, P1 clone:MXC9
  Pfam annotation: Domain name=UBA; Domain location=158-197; Score =33.8; E_value=6.1e-07; Accession=PF00627.21; Description=UBATS-N domain
  Pfam annotation: Domain name=UBA; Domain location=221-260; Score=9.0; E_value=0.34; Accession=PF00627.21; Description=UBATS-N domain
  Pfam module annotation: Pfam domain module=UBA::UBA; Domain location =158-197::221-260
  Subcellular localization annotation: CTP_CleavageSite=36; ConfidenceScore=5.39e-01
MSPASRSKSKDRKPSKEAQKASAKPTGSGNVAAGVPASAYNPLLGTFHTLDMSPTPTSPIHSNGRFRNIDETDEHPVSSVVAGVEYDSVSNNGSWSGESEEHKEKSSNVSVRPESVPGADNDKREKIRQKNERKHQRQKERRAQELHERCTGYLMSRKLEALSQQLVAMGFSHERATMALILNEGRVEESVAWLFEGGEDADGNKDTNIGRGNLKIDISGELARIADMVTKYDCSKQEVERVIVNCEGDLDRAAETLREFKLDPPSAPPKPEETGDPPIINNVKQSGVASQNSRPQTKPVPLPNQPKKDDKDFNYTKAALTIGVSSDSSNRNTQPLKRIQPKSEWAKPQQATVPADKRWPSAESNPSISYSLASPLQMSPQPAKSEAQYMPAGGDFKNLQPGVAREPLIMMQQPQTVNEEQVPATSMISSPPEIAAGRYPTNSSDAVRSNNGFISHAPSTRSLSPNYLNSNQMDHQLQYQPQQQFVGSSSNSVDHQGNRIWNRTDAIAPLAAATSLGLFSGLGSAGSSGASSPVDWSTGGTVQFDYTNIDWSLDRSLASPRSNGLWLGFSPFSRSSSAQMYDSNALGVVAESSMRPVPTNRSMNAPRPGLQDGVASAETSAAGSREWGSPFEGKDLFSLPRQFVSSPSQ

SEQ ID NO: 231668 - protein, 87 aa, Glycine max
  Coding DNA Sequence Number=SeqID_114890
MCILNRHQLSNTQEQVISPKNHHHHRLVPLDSLSLWLLHPSPHRRPRPPPPLTSDNEDNDQSGFETTTKKQKQMSRSVNDCSNAPMY

SEQ ID NO: 231669 - protein, 239 aa, Glycine max
  Coding DNA Sequence Number=SeqID_114891
  Gene Ontology: Mol. function=translation elongation factor activity; Cellular component=eukaryotic translation elongation factor 1 complex; Biological process=translational elongation
  Homolog annotation: Hit_ID=Q9SCX3; Match level="QueryCoverage=99%, HitCoverage=100%, E-value=1e-68, Identity=58%"; Hit description =Elongation factor 1-beta 2
  Pfam annotation: Domain name=EF1_GNE; Domain location=150-239; Score =173.7; E_value=4.5e-49; Accession=PF00736.9; Description=EF-1 guanine nucleotide exchange domain
MAVTFSDPHTEEGIKSLDQFLSGKTYISGDQLTKDDIKVYAAVVEKPGDSFPNAAKWYDAVSSQLAPSFPGHAQGVRFSGAAAPAEAAPAKADLALAVAVLTAGNSAPAATAEEDDDDLDLFGDETEEDKKAAEEREAAKKPAKKKESGKSSVLLDVKPWDDETDMKKLEEAVRSIEMPGLLWGASKLVPVGYGIKKLQIMMTIVDDLVSVDTLVEERLTVEPCNEYIQSCDIVAFNKI

SEQ ID NO: 231670 - protein, 164 aa, Glycine max
  Coding DNA Sequence Number=SeqID_114892
MPENSTFEQQDNSDKQVMHPPHLQIMHRSHEQLQDSLPNDYIKFQGDYMSCDDKCSSGISLPSFDDDLLRMGEDPPTQTHDQYYEPRSPRSNGYLESIFCPPPKIVEGSDDCSMQGESSLGNGENLDPIMNQDTLGDTWVENYDKDQYALKDTLFSIIYPFFPH

SEQ ID NO: 231671 - protein, 55 aa, Glycine max
  Coding DNA Sequence Number=SeqID_114893
MAPEELKQLTQQIRDQQEESITEKIQSQGLALPPELEVGASAARVTQRGVVLIPQ

SEQ ID NO: 231672 - protein, 106 aa, Glycine max
  Coding DNA Sequence Number=SeqID_114894
  Gene Ontology: Mol. function=transferase activity, transferring acyl groups; Cellular component=endoplasmic reticulum membrane; Biological process=GPI anchor biosynthetic process
  Homolog annotation: Hit_ID=Q1S3P2; Match level="QueryCoverage=99%, HitCoverage=19%, E-value=3e-16, Identity=50%"; Hit description=GWT1
MDIIGQNKEWIFSIFGENYLKAIRYWGMYLLGVHLGTILSSEAIPLDLEVADGNLVWIMSTALNLFPFHDPHVRLLTVLLDRHVERISRRMCNLPYVTMVVTDNLQ

SEQ ID NO: 231673 - protein, 78 aa, Glycine max
  Coding DNA Sequence Number=SeqID_114895
  Subcellular localization annotation: CTP_CleavageSite=45; ConfidenceScore=5.04e-01
GLVGACALSATLARLAFISEFQLSARLFAQRMDSSGALSEISPRLANMHSSSFFQILPRAQLKECCAQRMDRQARRLA

SEQ ID NO: 231674 - protein, 111 aa, Glycine max
  Coding DNA Sequence Number=SeqID_114896
MDSQSSDKMTQLIFWPEDIHTRGPPNLPTMTKLEPIGLMDNSQPLQRRQREIVDRFGMGLNVARREAVEKIHAIFPRKGPITKAMSKRLQEDWARVVEEGPRVLMNLMVDF

SEQ ID NO: 231675 - protein, 183 aa, Glycine max
  Coding DNA Sequence Number=SeqID_114897
MNWMIVESFDGELGKVSCELRDKVEFSLRSLFEEYSDDENEFEASSHEAPLNEGGHDDPYGKFRLIPNSFKHGKRCACYICVDYGLSPTLMPEEEFFIHIIVRLHCKWWKHLFACKIESKDHHHHCLRIKLIEEFLEFERVEEVAQVARSYVLLVATRILKLIFRQCHLGHMRKVFNGSGPPF

SEQ ID NO: 231676 - protein, 181 aa, Glycine max
  Coding DNA Sequence Number=SeqID_114898
  Homolog annotation: Hit_ID=Q6Z2L7; Match level="QueryCoverage=39%, HitCoverage=8%, E-value=5e-07, Identity=39%"; Hit description =Putative pentatricopeptide (PPR) repeat-containing protein
MEGVLGFSGDGVADDEDVVEAAPVVEDAAAEGVEEFEDEGLEVGAGEDFEDGDEGGAGVVEVGLAAGPVEELEAGENVAAGGAGGERGGEILVVGGGEDLVDAVQEGEVEAEEDDDAREVYGAWSEHGSRIEEMKDLDLRRCLGSIAFQVFVFMSLCVSIPATSQYFLLRGLRVYGGFHPP

SEQ ID NO: 231677 - protein, 655 aa, Glycine max
  Coding DNA Sequence Number=SeqID_114899
  Gene Ontology: Mol. function=binding; Cellular component =mitochondrion; Biological process=metabolic process
  Homolog annotation: Hit_ID=Q6Z2L7; Match level="QueryCoverage=99%, HitCoverage=73%, E-value=1e-116, Identity=37%"; Hit description =Putative pentatricopeptide (PPR) repeat-containing protein
  Pfam annotation: Domain name=PPR; Domain location=115-149; Score =16.9; E_value=0.075; Accession=PF01535.11; Description=PPR repeat
  Pfam annotation: Domain name=PPR; Domain location=172-206; Score =17.6; E_value=0.046; Accession=PF01535.11; Description=PPR repeat
  Pfam annotation: Domain name=PPR; Domain location=207-241; Score=2.3; E_value=4; Accession=PF01535.11; Description=PPR repeat
  Pfam annotation: Domain name=PPR; Domain location=242-276; Score =19.6; E_value=0.012; Accession=PF01535.11; Description=PPR repeat
  Pfam annotation: Domain name=PPR; Domain location=309-343; Score =22.8; E_value=0.0012; Accession=PF01535.11; Description=PPR repeat
  Pfam annotation: Domain name=PPR; Domain location=378-412; Score =31.1; E_value=4e-06; Accession=PF01535.11; Description=PPR repeat
  Pfam annotation: Domain name=PPR; Domain location=413-446; Score=0.8; E_value=6.1; Accession=PF01535.11; Description=PPR repeat
  Pfam annotation: Domain name=PPR; Domain location=447-481; Score =22.3; E_value=0.0017; Accession=PF01535.11; Description=PPR repeat
  Pfam annotation: Domain name=PPR; Domain location=45-79; Score=0.6; E_ value=6.3; Accession=PF01535.11; Description=PPR repeat
  Pfam annotation: Domain name=PPR; Domain location=482-516; Score=1.5; E_value=5; Accession=PF01535.11; Description=PPR repeat
  Pfam annotation: Domain name=PPR; Domain location=586-619; Score =19.5; E_value=0.012; Accession=PF01535.11; Description=PPR repeat
  Pfam annotation: Domain name=PPR; Domain location=620-653; Score =19.9; E_value=0.0089; Accession=PF01535.11; Description=PPR repeat
  Pfam annotation: Domain name=PPR; Domain location=80-114; Score=1.7; E_value=4.7; Accession=PF01535.11; Description=PPR repeat
  Pfam module annotation: Pfam domain module=PPR::PPR::PPR::PPR::PPR::PP R::PPR::PPR::PPR::PPR::PPR::PPR::PPR; Domain location=115-149::172 -206::207-241::242-276::309-343::378-412::413-446::447-481::45 -79::482-516::586-619::620-653::80-114
MRFHGLDLDSFAYHVLLEALVEKNYLNAFDIIMRQIRARGYENHMTNVIVVKHLCKERRLEEAEDFLNGLMCRGEELKGPEVSFLIDALCESYRFERAVELVKQFGSSGLVPLDHAYGVWIKGLVRGGRVDEALEFFSQKKDSEGLLQENRFREVYDLLVDMNESCIPPDVVTMNAVLCFFCKVGMADVAFELYHSRSDFGLSLNHLACKYLILTLCWDGGAEEAFKVLRSSAQRSYFPDGRTFCTLASALCREHKIDEMKELLYLAVGKNFVPPTSMYDKYILALCRAGRVEDGYLVHGELKSVAARTSYVKMIKSFVKSGRGDIAARLLVEMKGKGHKLIRPWCRDVICRLLEMDNSRGRFFNLLEMLTRYQHSCQTYNFFLDGAGHAMKPELAREVFELMQRNGIKPNLSSLILMLHVYLLSGRISDALNFFNGVRRQGLATKKLYVALITGLCKFNKIDISREYFFSMLRVGLNPSLECYELLVQKLCSLQKYSEAIHIINVSQKMGRPVSSFIGNVLLYHSLISPQLYDTCNYLRGAEEGVFSGNSTLCWMIGAFSGRLRVSHYIADLERLVERCFPPNIFTYNLLLKQVAKSDMDKARLLFARMCQRGYQPNCWTYDIMVRGFSIHGRKHEARRWLEEMFRKGFYDENQ

SEQ ID NO: 231678 - protein, 95 aa, Glycine max
  Coding DNA Sequence Number=SeqID_114900
MWRLLAAVARNLQNTRKSSKVADESMFEAGNGVELFGHERGRRQHGWGLVCSILQAPISILSCVSQPQVNNGSDGVWVTGEFSQVSEMNHLMEIL

SEQ ID NO: 231679 - protein, 458 aa, Glycine max
  Coding DNA Sequence Number=SeqID_114901
  Gene Ontology: Mol. function=ferredoxin-NADP+ reductase activity; Biological process=electron transport
  Homolog annotation: Hit_ID=Q6CZ84; Match level="QueryCoverage=54%, HitCoverage=100%, E-value=1e-109, Identity=76%"; Hit description =Ferredoxin--NADP reductase
  Pfam annotation: Domain name=DUF1454; Domain location=263-458; Score =329.2; E_value=7.1e-96; Accession=PF07305.2; Description=Protein of unknown function (DUF1454)
  Pfam annotation: Domain name=FAD_binding_6; Domain location=17-111; Score=15.6; E_value=1.2e-05; Accession=PF00970.14; Description =Oxidoreductase FAD-binding domain
  Pfam annotation: Domain name=NAD_binding_1; Domain location=121-234; Score=68.5; E_value=2.2e-17; Accession=PF00175.11; Description =Oxidoreductase NAD-binding domain
  Pfam module annotation: Pfam domain module=DUF1454::FAD_binding _6::NAD_binding_1; Domain location=263-458::17-111::121-234
KETNYQSSGANMAEWVNAEVKEVKNWTDALFSLRVTAPIDPFTAGQFAKLALEVDGERVQRAYSYVNAPQDPLLEFYLVTVPEGKLSPRLQALQPGDQVMVTKEAAGFFVLDEIPDCQTLWMLATGTAIGPYLSILQQGEGLERFDNIVLVHAARYAADLSFLPLMQQLQQRYQGKLHIQTVVSREQMPGSLHGRVPQLIESGELENAVGLPMLADTSHVMLCGNPQMVRDTQQLLKETRDMRKHFKRKPGHMTSEHYWAEAMKNLPVALLLSVALTFPAWAEDAPAQDRNDHLPAAPYLLAGAPTFDMTIAQFREKYNAANPDLPLQEYRAIDNRDDKSHLTRAASKISETLYASTALEQGTGKIKTLQITWLPVPGPDMKAAQTRAMDYMTALLRFFVPGLSAEEGHKKLDGLLSAGKGARYFSRTEGALRFVVADNGDKGLTFAVEPIKLALASP

SEQ ID NO: 231680 - protein, 413 aa, Glycine max
  Coding DNA Sequence Number=SeqID_114902
  Gene Ontology: Mol. function=triose-phosphate isomerase activity; Cellular component=membrane fraction; Biological process=fatty acid biosynthetic process
  Homolog annotation: Hit_ID=Q8ZJK9; Match level="QueryCoverage=59%, HitCoverage=96%, E-value=1e-119, Identity=87%"; Hit description =Triosephosphate isomerase
  Pfam annotation: Domain name=TIM; Domain location=18-260; Score =459.5; E_value=4.2e-135; Accession=PF00121.9; Description =Triosephosphate isomerase
MAALFHESRYAEERMRHPLVMGNWKLNGSKHMAGELIEGLRKELSGVEGCGVAIAPPAIYLDQAKHAISGSHIALGAQNVDVNLSGAFTGETSAEMLKDIGAKYIIIGHSERRTYHKESDEFIAKKFAVLKAAGLVPVLCIGETEAENEAGKTEEVCARQIDAVLETQGAAAFEGAVIAYEPVWAIGTGKSATPAQAQAVHKFIRDHIAKKDAAIAEQVIIQYGGSVNDKNAAELFTQPDIDGALVGGASLKADAFAVIFFRRTAIQLQPVALQRQQRQASIRQPGQRQPVFAHLTARMRHLLSQPDKYALLRQFGGAQRANQPGMPQQRCRLPLRIQLRRQRIQLLTHIRSQAGDMNVQLILCTTILRVDGKRQHAVVDRRTALLRQQAALLPGGSKQVRRGGFEEDWALHA

SEQ ID NO: 231681 - protein, 55 aa, Glycine max
  Coding DNA Sequence Number=SeqID_114903
MPLRTLFLLPHQALLPEVSRIGSNGQVGNIKGTPETGLQIPGFHKQRNRSGGIAA

SEQ ID NO: 231682 - protein, 98 aa, Glycine max
  Coding DNA Sequence Number=SeqID_114904
MKTKLWRPLNSLKGFKGSLESIREMSRLGSKPRNKKKKKKKRHEESRPSHPVQSQRTRPQTTSVRKSQRQIAEKATKAQKLRDMSETEDEDPLIIPRK

SEQ ID NO: 231683 - protein, 266 aa, Glycine max
  Coding DNA Sequence Number=SeqID_114905
  Gene Ontology: Mol. function=hydrolase activity; Cellular component =chloroplast; Biological process=isoprenoid biosynthetic process
  Homolog annotation: Hit_ID=Q5H5I9; Match level="QueryCoverage=87%, HitCoverage=61%, E-value=3e-48, Identity=45%"; Hit description=NADH pyrophosphatase
MHFTHHGLLEGLAGFDEAGQHRVTPRCPVGLPAQQQPALVFHGDDHGGVDARVVLGGTLRATTDEAAAGKRHGAAAHTAEAGARVPVGHAAGIAEGGRIGHRPQQSGLAQVEATWCGDGDAGGFNREPRLFPAQAEEDRGAGTTPDVGTGQRQRLVVIAGEGASVLIEHENARARPQARQCIGIVAQGIGALQRFANEGKTGKRRRSIGHPASVPPIDAGGKVGAVRNLLLWAGGHRASTHGVDLRIRSGRCPPWLAHPGHRALTC

SEQ ID NO: 231684 - protein, 53 aa, Glycine max
  Coding DNA Sequence Number=SeqID_114906
MVQLSTHRCAKPNIFTVSACCRKIFGVAESAKHRCCAKPQILTGSYNFKLGLV

SEQ ID NO: 231685 - protein, 80 aa, Glycine max
  Coding DNA Sequence Number=SeqID_114907
MMAKPDLDGGDVGEVGVISRERGEGGRDRFTTMRGDVDGVRDERGGGSTIRNGDVCVSVSLRFIQNQRNKSLVEKSQLTF

SEQ ID NO: 231686 - protein, 432 aa, Glycine max
  Coding DNA Sequence Number=SeqID_114908
  Gene Ontology: Mol. function=ubiquitin-protein ligase activity; Biological process=ubiquitin cycle
  Homolog annotation: Hit_ID=Q1SI59; Match level="QueryCoverage=90%, HitCoverage=84%, E-value=0.0, Identity=78%"; Hit description=Zinc finger, PHD-type; Zinc finger, N-recognin
  Pfam annotation: Domain name=PHD; Domain location=139-201; Score =23.9; E_value=0.00023; Accession=PF00628.19; Description=PHD-finger
  Pfam annotation: Domain name=zf-UBR; Domain location=51-120; Score =90.0; E_value=7.2e-24; Accession=PF02207.10; Description=Putative zinc finger in N-recognin (U
  Pfam module annotation: Pfam domain module=PHD::zf-UBR; Domain location=139-201::51-120
MTVFPTSSGLLEMKPFKSPEIFLNSIVSSTVLSIRTGQCEADLVLGGDDGKECTYSKGYMKRQAIFSCLTCTPDGNAGVCTACSLSCHDGHQIVELWTKRNFRCDCGNSKFGEFYCKIFPNKDVENVENSYNHNFKGSYCTCGRPYPDPDAEEQVEMIQCCLCEDWFHEEHLGLESSAEIPKDDEGEPMYEEFICKACSEVCFFLKLYPEEIWAAGKQPDATVQISKDKGVLEDILSTCRSEKPTCDTSCCSPKVDDVQATVDSKSISDGKSLSQGENCNGSMASNQCTKSTDLHVNCLLSVNIITVSPVLPGKPMFLSKNWRLALCKCNNCLEFYEQKKIAFLLDKEDSIAEYEQMAKQKREEKLQQQEGAELSFFNKLGHVEKVEILKGIEEMKDGLRAFLESADSSKPITAADVHQFFDDIKNKRRRVQ

SEQ ID NO: 231687 - protein, 104 aa, Glycine max
  Coding DNA Sequence Number=SeqID_114909
MGNCMETYTIGEKQQQQKEEEERGSLSNEEKNGLSMKVVLTKEELKWLILELNKKGEAGGVRLEEMLEEIERGREEKVDQNERGWKPSLESILEAPELLEMDTT

SEQ ID NO: 231688 - protein, 207 aa, Glycine max
  Coding DNA Sequence Number=SeqID_114910
MAAKPLTTEAIALTEKKMDMTLDDIIKMSKNPKNKKQRRVPDKSAKVQRYMESRSSLRQGALAKRRSNFQGNQFPAAVEVARKAVTAPLHNRVPNRNRVANWNKTRPNCWVLVQTHQDDVATSRFQVPVGQRRAANGGFAAKQPLPSPQKQQENVDIMPKQKPQTLDSLFANMKEQRMRVLSMQNNAVQRNGGGNRRLPWGRGRFGN

SEQ ID NO: 231689 - protein, 226 aa, Glycine max
  Coding DNA Sequence Number=SeqID_114911
  Gene Ontology: Mol. function=transcription factor activity; Cellular component=nucleus; Biological process=regulation of transcription, DNA-dependent
  Homolog annotation: Hit_ID=Q9C7W2; Match level="QueryCoverage=92%, HitCoverage=62%, E-value=5e-39, Identity=47%"; Hit description=AP2 -containing DNA-binding protein; 51686-52693
  Pfam annotation: Domain name=AP2; Domain location=134-198; Score =135.7; E_value=1.2e-37; Accession=PF00847.10; Description=AP2 domain
MEGMRDTKSQLEIQDQEGTNIGSSLSKLILASGSGTNTLDSIFSNCPQTTNGSTSSNSVLDDLEPFRSSGCESLGSSVYLRQRDILQKFYQESRGNGNNNGSYNIPRSLANTSINSVCRSSSLSCYSLTKPCKKKLYRGVRQRHWGKWVAEIRLPQNRMRVWLGTYDTAEAAAYAYDRAAYKLRGEYARLNFPNLKDPTKLGFGDSARLNALKSSVDAKIQAICQK

SEQ ID NO: 231690 - protein, 143 aa, Glycine max
  Coding DNA Sequence Number=SeqID_114912
MSNLKLILQTFIIDLLSNKTNNSRVIMTFQATDTIQQQQQSQKRQQATEAHPQPSLEELVRQMTFQNMCRNMPFCGRARRGSRVRFPKEERCAESPPTFICGKRRKNRRKPVKMKILSSGVVFTFEEGISTSHVCLKGQQPIF

SEQ ID NO: 231691 - protein, 113 aa, Glycine max
  Coding DNA Sequence Number=SeqID_114913
MTTQALESPTTMHRLHTRFQIARTLALGVVLGGTQRQERTIRRDYYGNQSVESGQQWSSSSGGVAAHGGACTARAVVRGGAWGSVRLRLVRCSSILRSTVFLLSDFTSYTSIY

SEQ ID NO: 231692 - protein, 61 aa, Glycine max
  Coding DNA Sequence Number=SeqID_114914
MQGAWMHLDLKEYRKNGLDDRGISISNLEKAKENSISCFSSTQLRSPCDFAEKNRQADRTG

SEQ ID NO: 231693 - protein, 121 aa, Glycine max
  Coding DNA Sequence Number=SeqID_114915
MPPLALARMLLMWLGAASTNCGSRCAATSSSEILADRATRQYQWRDICNVDRSRHWFLRDQRGYHACEVLPSRLHTPATRALVLPSRLHTPATRALFAEMITHASCKLPLNKSICKNKISH

SEQ ID NO: 231694 - protein, 67 aa, Glycine max
  Coding DNA Sequence Number=SeqID_114916
LEPSSLGVWGAPYAYQGAESSQATVRSQDKSMAKINQGRQMEDRIATDQSSPLPGARPAENIAARQP

SEQ ID NO: 231695 - protein, 81 aa, Glycine max
  Coding DNA Sequence Number=SeqID_114917
MYMIRLGLLALNGYGCEVVDILIGRVCNIGWCIVGKQAIWWEGMLTLDLHKMGAARTSQFFASLTYHIQDWMCWIKWPRNN

SEQ ID NO: 231696 - protein, 161 aa, Glycine max
  Coding DNA Sequence Number=SeqID_114918
MDSVKFESRASSLDVSVASVDAIGHTNRTGNNKERYSESSDNKGSASNATLMATKLRGLGPKEGASTYTSERGCLAHGQNVCEGMSMSRKGCHQWCCVDWRTVILTMVSVPEKVVGRRWQFVGNFSRNSVDKLKCEPERKGSWIAKKNSSGDSGSSGQARF

SEQ ID NO: 231697 - protein, 157 aa, Glycine max
  Coding DNA Sequence Number=SeqID_114919
  Homolog annotation: Hit_ID=Q2QYN3; Match level="QueryCoverage=86%, HitCoverage=27%, E-value=5e-49, Identity=67%"; Hit description =Expressed protein
MNNRKIISDDYSISVATLVEGRILTVAGVTTAICSAPFVGLLNLVALAVWPKWVVVAICETLRKVVTYVVTRPGRELLFTVVSEDEKYKAKVCIDVLVQRLGDAAAAGMYKMLFGTLNGNPSTVPLYGLPVCLFWIVTAFSLGRRQVQLSKHQISST

SEQ ID NO: 231698 - protein, 100 aa, Glycine max
  Coding DNA Sequence Number=SeqID_114920
MNHHSQFLIRLKHKKPASRATADPRLIHNSQAFLHYLKKGKSSTSYQYLTNWYQQSLSFKNNLLRSILNNSKDPFSYIVVKTFPQHKSKEFEEKIIIERL

SEQ ID NO: 231699 - protein, 88 aa, Glycine max
  Coding DNA Sequence Number=SeqID_114921
  Homolog annotation: Hit_ID=Q0KIN0; Match level="QueryCoverage=86%, HitCoverage=4%, E-value=1e-11, Identity=42%"; Hit description =Integrase core domain containing protein
MVTTTVPGPPMALCGLLVLGTKTISPVIPHLPLSVHIGRKLMPNYAAPSSPPYTLHSSPFFDHMALVNQFGPRHALFPLITLVYTNQH

SEQ ID NO: 231700 - protein, 137 aa, Glycine max
  Coding DNA Sequence Number=SeqID_114922
  Gene Ontology: Mol. function=transferase activity
  Homolog annotation: Hit_ID=Q1RZV6; Match level="QueryCoverage=51%, HitCoverage=16%, E-value=3e-24, Identity=76%"; Hit description=IMP dehydrogenase/GMP reductase
MGSSIGVWRTMVRCMGTPMGLPSPPLCSLVDGNAGGGVTGWKGRWSGSQKRVNSRWKEFGETEGQKSDSKNENKTDEIQKTEHTPRGFPKSSTLVKLPFWPILEGLWLILSSTYLLHVSLFIWLSAVVSSFFYFQVR

SEQ ID NO: 231701 - protein, 157 aa, Glycine max
  Coding DNA Sequence Number=SeqID_114923
MECRIVDVSRVKTRSGTCRITHLASRDKIRLRRPSLLPPPRDLNHPARALRSCPLLRLSSSGVFEGLNSENGAEAETASAAALSRSKWHSDDEDDGDAEHEASAFQEVKEAKQKKSKKPKVTVAEAASRISADDLDAFLAEITVSVSFSQLICCLVQ

SEQ ID NO: 231702 - protein, 286 aa, Glycine max
  Coding DNA Sequence Number=SeqID_114924
  Homolog annotation: Hit_ID=Q38810; Match level="QueryCoverage=90%, HitCoverage=96%, E-value=1e-18, Identity=30%"; Hit description =Arabidopsis thaliana Col-0 cDNA-5-encoded protein
  Subcellular localization annotation: CTP_CleavageSite=72; ConfidenceScore=5.07e-01
MADPASFIASWLTPSYLFILVNLVIGTIAITSRFSSTPKNQQAHHPQPLSSFNTHHHQPNCTQPQLLPIPSLLQRVTSFNLSLHKHQPTPPETQHLHPEPQPQPEKPPELLRTPSLLERLRSFHNLSLHKHVQPEPEPEPEPEPEKPELVRSPSLLQRIQSINFSHLYRSDFSHRDDEDPDSGSDPGRGSGKAAEMRKSASVRGGLTDSEWEEVEKRRPQTARPVETTTSWREDEEVDAKADDFINRFKKQLRLQRIDSLLRYRGVLRATRLVWQSSCLSNHVMFV

SEQ ID NO: 231703 - protein, 200 aa, Glycine max
  Coding DNA Sequence Number=SeqID_114925
MTVPTNQHDIFQCVHMFSMKHLEGHSKEECSVLKDKIKDLIMLGLLKDFVHKPQTYQSNNGYKQGKRARRGFMDDEQQLRHERDPYNKYGRSTWFLHTKRRTCCQLHSPWLTLKAINPIQDDIMVISVKITNCIVRTTLVDQGSSVDILFWNTFKRMGITEFKILPHDDPYLAVSEKGLGRKEVFGCIPSLTIKDHYKKT

SEQ ID NO: 231704 - protein, 120 aa, Glycine max
  Coding DNA Sequence Number=SeqID_114926
MGAEKREGLEPENQKKIHKLFPHSHVAFLLPFSSTIEASIKAPNFAHHFYSKLQKEAIFRVVKLTSTLWDFKFQVEKCEILRVREAKFGVSVNGSLKTCGKAWTEQMRKMSDQSESKSHF

SEQ ID NO: 231705 - protein, 60 aa, Glycine max
  Coding DNA Sequence Number=SeqID_114927
ARSETRQAILALVIAIYAQKKLASCHLLLPLQAALHITRFTNENGGMQDQPISPVAPTTS

SEQ ID NO: 231706 - protein, 101 aa, Glycine max
  Coding DNA Sequence Number=SeqID_114928
  Homolog annotation: Hit_ID=Q00NU9; Match level="QueryCoverage=40%, HitCoverage=6%, E-value=9e-12, Identity=78%"; Hit description=Heat shock protein 90
MYVPELYSIRGKEVNIDNQRLEKGDYSEVEDVDKEKEKEENNLKKIKEVSHFFFLSKEVSHECSLVNKHKAIWMTEPEEITKEEYYAFYKSLTNDWKSICL

SEQ ID NO: 231707 - protein, 266 aa, Glycine max
  Coding DNA Sequence Number=SeqID_114929
  Gene Ontology: Mol. function=helicase activity; Biological process =viral genome replication
  Homolog annotation: Hit_ID=Q1SRJ5; Match level="QueryCoverage=98%, HitCoverage=31%, E-value=9e-73, Identity=50%"; Hit description =Probable helicase [imported]-Arabidopsis thaliana-related
MFQPRTLLDANGYPVYHRRNDGRIISKNSVIIDNRHNVPYNPKLLKKYQAHVNIEWCNQSASIKYLFKYINKGYDRVIAVMLYDGNDEIQNATNQKDEIKEYIDGKYISPCEAAWRIFDFPIHARKPAVERLYFHLPGQHNVLYEEHDDIDDVLSNPSISDSKFLAWMNANKCSSEGRTLTYSEFVSKFVYNQKTRSWHLRKKGYTIGKLIWVPPTTGELFYLRMMLTACKGATSFEDIRTITNIQYPTYREACFAMGFLQDDITR

SEQ ID NO: 231708 - protein, 117 aa, Glycine max
  Coding DNA Sequence Number=SeqID_114930
MQSQGLALPPEPEVGPSAARVSTKGSCVDPLLTDPETGDSDKCRLYIKANPSHLVALLRVYEGSTTVHNVPLLHGQVKIGVEEVKDAKARVPVPTDKLCIQQSLQIGQILRLMIPCI

SEQ ID NO: 231709 - protein, 52 aa, Glycine max
  Coding DNA Sequence Number=SeqID_114931
MVILVFLYQAGLIITGIVYKRAEKVGSVERLRRNKANSWWANAKWKSVCGGC

SEQ ID NO: 231710 - protein, 86 aa, Glycine max
  Coding DNA Sequence Number=SeqID_114932
MPSELSTDSTKTSTSSDSSTATSKIEYPTYTNPLILPFTAVFHNDMDIIEVPTFYHQQWAPEYPEFVNFRYDGTIYQIRLRQHRAK

SEQ ID NO: 231711 - protein, 186 aa, Glycine max
  Coding DNA Sequence Number=SeqID_114933
  Gene Ontology: Mol. function=cytokinin dehydrogenase activity; Cellular component=endoplasmic reticulum; Biological process =electron transport
  Homolog annotation: Hit_ID=Q9FUJ2; Match level="QueryCoverage=92%, HitCoverage=33%, E-value=5e-42, Identity=48%"; Hit description =Cytokinin dehydrogenase 4 precursor
  Pfam annotation: Domain name=FAD_binding_4; Domain location=41-184; Score=43.1; E_value=9.5e-10; Accession=PF01565.13; Description=FAD binding domain
AQSRTWSFLQAPKEITLKLIRDPVTLSLASTDYGHIVHDNPFAIFAPSSISDISLLINFSNSLAIPITIAPRGQAHSIHGQAMTNDGVVVNMTELNGFRNGDGIIVVSDDTTATTIGPYADVGGEQIWIDVLHATLERGLTPLSWTDYLYLSVGGTLSNAGISGQTFRFGPQISNVHELDVVTGMY

SEQ ID NO: 231712 - protein, 165 aa, Glycine max
  Coding DNA Sequence Number=SeqID_114934
MDCCHKITKTWTALSTRFNHHRKSRVSGGPVAGAGAGEYSADCDGISRGLLKLRDDVQMCGYRDAEVMWNMLNVTLQRDQMEAPRSSKNAKFRKQRSISRVLFWTSHNSVMNIMKFLLGSFAPPMIAVLVSYAIQVTVHFVALCAVMILACICGGVSSSSHSRPK

SEQ ID NO: 231713 - protein, 426 aa, Glycine max
  Coding DNA Sequence Number=SeqID_114935
  Gene Ontology: Mol. function=protein binding; Cellular component =protein complex; Biological process=biological_process
  Homolog annotation: Hit_ID=Q6H592; Match level="QueryCoverage=95%, HitCoverage=99%, E-value=1e-164, Identity=70%"; Hit description =Proteasome protein-like
  Pfam annotation: Domain name=PCI; Domain location=296-412; Score =38.7; E_value=2e-08; Accession=PF01399.17; Description=PCI domain
MAVTSEATVLRLRSNYMSMGEAHRRITEYLNRFSDAISSQDGATFKSLFALSSNSPFLLSLGDALNLFQDPNRLIKQSDNYSQFADILVPLFRSLLNYRQNNLLEAYNAFEKTANAFIQEFRNWESAWALEALYVIVYDIRVLAEKADKELASNGKSPEKLKGAGSVLMKFFGTLAGKGSKRVGALYVTCQLFKIYFKLGTVHLCRSVIRSIETARIFDFEEFPKRDKVTYMYYTGRLEVFNENFPAADYKLSYALKHCNPQSEANIRMILKHLIPVKLSIGILPKNSLLEKYNLLEYSKIVQALRRGDLRLLRCALQDHEDRFLRSGVYLVLEKLELQVYQRLVKKIYIIQKQKDPGRAHQVKLEVIVKALKWLEIDMDVDEVECIVAILIYKNLMKGYFAHKSKVVVLSKQDPFPKLNGKPVNS

SEQ ID NO: 231714 - protein, 314 aa, Glycine max
  Coding DNA Sequence Number=SeqID_114936
  Gene Ontology: Mol. function=sequence-specific DNA binding; Cellular component=nucleus; Biological process=regulation of transcription, DNA-dependent
  Homolog annotation: Hit_ID=Q5HZ36; Match level="QueryCoverage=95%, HitCoverage=97%, E-value=2e-28, Identity=29%"; Hit description=GATA transcription factor 24
  Pfam annotation: Domain name=GATA; Domain location=178-213; Score =73.6; E_value=6.3e-19; Accession=PF00320.17; Description=GATA zinc finger
MIPAYRHSVSSVMPLDLNEDQNHEFFSPIHHPSSSFSSLSSSYPILFNPPNQDQEARSYDWETTKHLPSHEEEAEKIIPTSGSWGHSVEESEHKVTVWRKEERNENLAEDGSVKWMPSKMRIMRKMLVSNQTDAYTSDNNTTHKFDDHKQQLSSPLGIDDNSSNNYSDKSNNSIVRVCSDCHTTKTPLWRSGPRGPKSLCNACGIRQRKARRAMAAAAAAALGDGAVIVEAEKSVKGKKLQKKKEKKTRIEGAAQMKMKRKLGVGAKASQSRNKFGFEDLTLRLRKNLAMHQVFPQDEKEAAILLMALSYGLVH

SEQ ID NO: 231715 - protein, 82 aa, Glycine max
  Coding DNA Sequence Number=SeqID_114937
  Subcellular localization annotation: CTP_CleavageSite=66; ConfidenceScore=5.34e-01
MAVWHNRFFKKCHQIAVALRVSYDSRHSLNDRGRTAEMGMSSTSRNSNMRTPAAPRERYAAPCTTTATTANSTATTTPAPRT

SEQ ID NO: 231716 - protein, 98 aa, Glycine max
  Coding DNA Sequence Number=SeqID_114938
MEINRRTAQKSHKGKASVEVSPESITSSIDFNYNDFFVPVTTPVKVQAPIPEEQCEIFQWMLEEKRKLKPKNPLEKKQIDEDKAILKHFLRAKSIPKF

SEQ ID NO: 231717 - protein, 318 aa, Glycine max
  Coding DNA Sequence Number=SeqID_114939
  Gene Ontology: Mol. function=hydrolase activity, acting on glycosyl bonds; Cellular component=beta-galactosidase complex; Biological process=carbohydrate metabolic process
  Homolog annotation: Hit_ID=O65736; Match level="QueryCoverage=89%, HitCoverage=41%, E-value=1e-152, Identity=81%"; Hit description=Beta- galactosidase
  Pfam annotation: Domain name=Glyco_hydro_35; Domain location=47-318; Score=472.1; E_value=6.7e-139; Accession=PF01301.10; Description =Glycosyl hydrolases family 35
  Pfam annotation: Domain name=Glyco_hydro_42; Domain location=50-318; Score=-242.4; E_value=0.014; Accession=PF02449.6; Description=Beta -galactosidase
  Pfam module annotation: Pfam domain module=Glyco_hydro_35::Glyco _hydro_42; Domain location=47-318::50-318
MGPSSRLQGLSVALDFQMYIRELQPPHKSTHLNYHFTASVTYDHKAIVMWPDLIQKAKDGGLDVIQTYVFWNGHEPSPGKYYFEDRYDLVKFIKLVQQAGLSVHLRIGPYICAEWNFGGFPVWLKYVPDIAFRTDNEPFKAAMQKFTEKIVSMMKAEKLFQTQGGPIIMSQIENEYGTVEWEIGAPGKAYTKWFSQMAVGLDTGVPWIMCKQQDTPDPIIDTCNGYYCENFTPNKKYKPKMWTENWTGWYTEFGGAVPRRPAEDMAFSVARFVQNGGSFVNYYMYHGGTNFDRTSSGLFIATSYDYDGPIDEYGMQSI

SEQ ID NO: 231718 - protein, 293 aa, Glycine max
  Coding DNA Sequence Number=SeqID_114940
  Gene Ontology: Mol. function=oxidoreductase activity; Cellular component=peroxisome; Biological process=electron transport
  Homolog annotation: Hit_ID=Q84XG2; Match level="QueryCoverage=98%, HitCoverage=51%, E-value=7e-74, Identity=50%"; Hit description =Putative polyamine oxidase
LGRKVTRIEWQPDRHEAMNLENGRTCSRPVMLHFCDGSIMSADHVIVTVSLGVLKASIRDDDSGMLMFNPPLPSFKAEAISRLGFGVVNKLFIQLSEPPHERKDEHEHSKGFPFLQMVFHSPQSELRHKKIPWWMRRTATLCPIYNNSSVLLSWFAGEEALALESLKEEEIIEGISDTISCFLSHSLEFCNGNVNSEKYSHEYKVKFSKVLKSQWGTDPLFLGSYSHVAVGSSGDDLDTMAEPLPKCHISASPPLQILFAGEATHRTHYSTTHGAYFSGLREANRLLQHYSLC

SEQ ID NO: 231719 - protein, 474 aa, Glycine max
  Coding DNA Sequence Number=SeqID_114941
  Gene Ontology: Mol. function=hydrolase activity, acting on glycosyl bonds; Cellular component=beta-galactosidase complex; Biological process=carbohydrate metabolic process
  Homolog annotation: Hit_ID=P48980; Match level="QueryCoverage=99%, HitCoverage=56%, E-value=0.0, Identity=69%"; Hit description=Beta -galactosidase precursor (EC 3.2.1.23) (Lactase) (Acid beta- galactosidase) (Exo-(1-->4)-beta-D-galactanase)
  Pfam annotation: Domain name=Gal_Lectin; Domain location=396-473; Score=141.6; E_value=2.1e-39; Accession=PF02140.8; Description =Galactose binding lectin domain
VHVFKTSGACAAFLANYDTKSSAAVKFGNGQYDLPPWSISILPDCKTAVFNTARLGAQSSLMKMTAVNSAFDWQSYNEEAASSNEDDSLTAYALWEQINVTRDSTDYLWYMTDVNIDANEGFIKNGQSPVLTVMSAGHALHVFINGQLSGTVYGGLDSHKLTFSDSVKLRVGNNKISLLSITVGLPNVGPYFETWNAGVLGPVTLKGLNEGTRDLSKQKWSYKIGLKGEALNLNTVSGSSSVEWVQGSLLTKKQPLTWYKTTFSTPAGNDPLALDMISMGKGQVWINGRSIGRHWPGYIARGSCGDCYYAGTYTDKKCRTNCGEPSQRWYHIPRSWLNPSGNYLVVFEEWGGDPTGISLVKRTTASVCADIFEGQPTLKNRQMLDSGKVIRPKAHLWCPPGQKISKIKFASYGLPHGTCGNFREGSCHAHKSYDAPQKNCIGKQSCLVTVAPEVFGGDPCPGIAKKFSLEALCS

SEQ ID NO: 231720 - protein, 75 aa, Glycine max
  Coding DNA Sequence Number=SeqID_114942
  Pfam annotation: Domain name=UPF0197; Domain location=14-75; Score =22.0; E_value=0.00028; Accession=PF05251.3; Description =Uncharacterised protein family (UPF0197)
MSYLGQTDIDRCRGKMGGFIVLCCLALSNLVRQSYEATSSRKSRSLVQELTTGAVASVFLGFGSLFLLLASGVYV

SEQ ID NO: 231721 - protein, 977 aa, Glycine max
  Coding DNA Sequence Number=SeqID_114943
  Gene Ontology: Mol. function=protein serine/threonine kinase activity; Cellular component=integral to plasma membrane; Biological process=protein amino acid phosphorylation
  Homolog annotation: Hit_ID=Q5NAH9; Match level="QueryCoverage=47%, HitCoverage=61%, E-value=1e-129, Identity=54%"; Hit description =Protein kinase CDG1-like
  Pfam annotation: Domain name=Pkinase; Domain location=809-976; Score =10.5; E_value=3.5e-09; Accession=PF00069.15; Description=Protein kinase domain
  Pfam annotation: Domain name=Pkinase_Tyr; Domain location=809-976; Score=15.0; E_value=2.2e-13; Accession=PF07714.7; Description =Protein tyrosine kinase
  Pfam module annotation: Pfam domain module=Pkinase::Pkinase_Tyr; Domain location=809-976::809-976
  Subcellular localization annotation: CTP_CleavageSite=92; ConfidenceScore=5.44e-01
PFYKPPKTFPPSTTAPSPQKIKDIEPSKSPSPSTIALSPPYAVVPLPSAVQGNKPPPVKTSPPQREAPTVRPPFSTPTAPAPVAISSDRSPKISPVSQPIEHGHLTPDVDNRNANNSHLAESFSPAPGAVPSANLPKNSSASQPTENGTFPPKEAPVAVNLPKESPVSQPPEHASLPPIVHQRNANMGHNLKPVSPASVAIPPTTYKITSMDSEPTTQHGSIPPNVHKRNSNKGHTSETVSPGSTEPVASPPWKVENSPPETHPIVPTITPSTLTAPVTSPPSAFPLKPPLVHPIVPVASPSKLPEKDFGDVCVQDVCIIRQKICYWTCWRKCYFATPVSSPTPLRSFNWKKGGAPVVAPLSRNPKPLPAVIHSPAQAPVAQKARQLHHAPEPLISSPKSSSNKEYHYPPLSPTSSFYKHPHTREIIGSPSPASSSMVSPPTSKHQEAAIPPLLPPRSGQRHHVSPPINSSSSVSPFSSPIHSNTGQVSPAPSPSIKFASHPTGSTIFPPKVAPSESSSKRPKMPLLPQVQVLPPPPPNEDCISTVCTEPYTNSPPGEPCRCVWPMRVGLRLSVSLYTFFPLVSELASEIATGVFMKQSQVRIMGANAADQQPEKTVVLIDLVPLGEEFDNTTAFFTSDRFWHKMVIIKAFYFGDYDVLYVSYPGLPPSPPLPPSSLNMFNGGPYSTDGNNGRTIKPIGVDILKRQQKVGLSRGIISTIAVSVSLAVVLCAAAAWVMFKFRDHVSQSASTPRQLSPPSLTKEPGTAGSLRGAGAGVGSVSTSFRSSIAAYTGSAKTFSTNDIKKATDDFHASRILGEGGFGLVYSGILEDGTKVAVKVLKREDHHGDREFLAEVEMLSRLHHRNLVKLIGICIENSFRSLVYELVPNGSVESYLHGVDRGNSPLDWGARMKIALGAARGLAYLHEDSSPRVIHRDFKSSNILLEDDFTPKVSDFGLARTATDEENKHISTRVMGTFG

SEQ ID NO: 231722 - protein, 72 aa, Glycine max
  Coding DNA Sequence Number=SeqID_114944
MGVVLALMLQLCIIAFAVTAQEFKGSIISPSPAFLPVVPPGEETLGPIYHGEGSKAPNLPSDGDGISHTKWP

SEQ ID NO: 231723 - protein, 642 aa, Glycine max
  Coding DNA Sequence Number=SeqID_114945
  Gene Ontology: Mol. function=nucleic acid binding; Cellular component= nucleus; Biological process=meiosis
  Homolog annotation: Hit_ID=Q69NK8; Match level="QueryCoverage=96%, HitCoverage=96%, E-value=1e-165, Identity=50%"; Hit description=CwfJ / zinc finger(CCCH-type)-like protein
  Pfam annotation: Domain name=CwfJ_C_1; Domain location=393-509; Score= 135.4; E_value=1.6e-37; Accession=PF04677.5; Description=Protein similar to CwfJ C-terminus 1
  Pfam annotation: Domain name=CwfJ_C_2; Domain location=538-641; Score= 64.9; E_value=2.6e-16; Accession=PF04676.4; Description=Protein similar to CwfJ C-terminus 2
  Pfam annotation: Domain name=zf-CCCH; Domain location=333-359; Score =18.2; E_value=0.0052; Accession=PF00642.15; Description=Zinc finger C-x8-C-x5-C-x3-H type (and similar)
  Pfam annotation: Domain name=zf-CCCH; Domain location=367-391; Score =13.4; E_value=0.022; Accession=PF00642.15; Description=Zinc finger C- x8-C-x5-C-x3-H type (and similar)
  Pfam module annotation: Pfam domain module=CwfJ_C_1::CwfJ_C_2::zf -CCCH::zf-CCCH; Domain location=393-509::538-641::333-359::367-391
  Subcellular localization annotation: CTP_CleavageSite=34; ConfidenceScore=5.30e-01
PGRSDATVSLVSVKRFRHRHGPQNPTMRRRFRPPESAFQARLIGPFDALLCVGQFFPDSPEQLEDFTKYIEGGSHFPLPTYFVGDYGVAAPKLLLQASKDSANQGFKMDGFKVCHNLYWLKGSGKFSLFGLSVAYLSGRKSSSAQQFGTYTEDDVDALRAIAEEPGIVDLFLTYPSIHVHYSPDSDIPAGLSDAAGGDSTVSELVQEIKPRYHIAGTKGIYYAREPYSNVDAVHVTRFIGLASVGNKDKQCCNILFASTFQKFIHAISPTPASTMSSTEIAMKTTNTTLSPYTYEEKRTSPMDSTKRSSDSISDPQYWRYDVSQKRQKHEAGHGDKLCFKFVSSGSCPRGEKCNFRHDTDAREQCMRGVCFDFLNKGKCERGPDCNFKHSLQDEGGRLPSRRPGSGSPNVESHLIISIGENYYLALAKGPLVEDHVLIIPVEHMPSTLSMSSESEIELSRFQNSLKSYCKSQEKEVIFFEWVSVRGTHANIQAIPIPSSKAIMAEKIFNLAAQKLGFEFVTKKWGVFDFLLHSYVVLLCNSVDSISEGRKFLKAQIDGDSSLFYAQIPGGTILLHHVEEKEKFPAQFGREIELTLVNMNQVLAGLLNMADNADWRNRKHSKDEEMKIVEVFKSRFQEYDPNC

SEQ ID NO: 231724 - protein, 139 aa, Glycine max
  Coding DNA Sequence Number=SeqID_114946
  Gene Ontology: Mol. function=ribonuclease H activity; Biological process=DNA integration
MSHGRLYQQRIKNAFDKKVCPCKFNEGDLVLKKISHAVKDNRGKWAPNYEGPFVVKRAFSGGALVLTNMDGIPVRCYCLATVFKRREYGSEASVLTLGQNRLRQRSEVETRSKAETNQGTYGRTQGEARVMTNRSSSFA

SEQ ID NO: 231725 - protein, 96 aa, Glycine max
  Coding DNA Sequence Number=SeqID_114947
  Gene Ontology: Mol. function=nucleoside-triphosphatase activity; Cellular component=nucleus; Biological process=regulation of transcription, DNA-dependent
  Homolog annotation: Hit_ID=Q1SA78; Match level="QueryCoverage=61%, HitCoverage=7%, E-value=6e-21, Identity=81%"; Hit description=MCM; Nucleic acid-binding, OB-fold
MRITEQAGVVLSLDPKPIEGDWNGVGCHTNYRMLHVKKTGRGQKRDMLTIKFLKKFIHYAKHRIQPELTDEASENIATAYVELRNSSSNAKVSIGN

SEQ ID NO: 231726 - protein, 162 aa, Glycine max
  Coding DNA Sequence Number=SeqID_114948
MEATLSMRRLIESNATTAAAASTTAEILGSTSGPHRGYNRNFYPYSLPSNFTPPTMHENVDHAVPVTFEGQLRQPIGGTHEEPRSKPKLTLTRGPPPAAEGKGKLDLIEERLRAVEGSRDYPFAYMTDLCLVSNVVIPPKFKLPDFDKHKGTTCPKKHLKTY

SEQ ID NO: 231727 - protein, 44 aa, Glycine max
  Coding DNA Sequence Number=SeqID_114949
MARRVAYFIPTIKSPCALKILLPAQMSMAVVAIRVDPMITFRRD

SEQ ID NO: 231728 - protein, 107 aa, Glycine max
  Coding DNA Sequence Number=SeqID_114950
  Gene Ontology: Mol. function=ubiquitin-protein ligase activity; Cellular component=ubiquitin ligase complex; Biological process =protein ubiquitination
  Homolog annotation: Hit_ID=Q9FJJ0; Match level="QueryCoverage=50%, HitCoverage=10%, E-value=8e-08, Identity=51%"; Hit description =Arabidopsis thaliana genomic DNA, chromosome 5, TAC clone:K19B1
MVLKGIVALVEDGRFDGVVQDYGGEVGLGAIVQLRGEVEVFAELNDEAFEALIRHVLGINIDPESLEIASDNADELELLGLALNLQDCYVGEFGKDVCESKASCFKW

SEQ ID NO: 231729 - protein, 818 aa, Glycine max
  Coding DNA Sequence Number=SeqID_114951
  Gene Ontology: Mol. function=DNA binding; Cellular component=beta -galactosidase complex; Biological process=DNA integration
  Homolog annotation: Hit_ID=Q1SS72; Match level="QueryCoverage=95%, HitCoverage=81%, E-value=3e-99, Identity=42%"; Hit description =Integrase, catalytic region
MMQFLRGLNDQYANVCSIILLMDLLPLIIKVFSYVVQQERQTLGSASVLGSLNLESRDYSQLMLNNKNNQICSAKMHSHCGRIGHTIDVCFRKHGYPPGYKFHNINSSVTGDMQVTAIDQQSQDTHAPSFTSQQYQALLALIQQPSHGASSSTPHVNQIGTFSPCLGISTSTNLGNLPHLFCNSVSNSTAPWILDSGATNQMSSSLANFSSYVSINPILFKLPIGQEVLATHSGVVKFSYSFLLTNVLYIPYFTFNLISISKLPSSLNCKLTFFSNKCFIQDAITKRMIGTVDVVTGLYMLNASPILHSVNNTLSMLRVFGCLCYTSTLTTHRKKLDPRAQPCVFLGFKPHTKGYLIYNLHSRSFEVSRNVTFYENFFPYFQPNNDFSHSSNTPFSNTFILSPLAYVDVPFPSHDTLSSSNIAPHNSASQPSSSQPLVPLRRSTRRTQQPAFLRHYHIAFTSTGIVPSPDVNNAFLHNTLDEEIYMQLPPGLKSAKAGQVCRLQCSLYSLKQASRQWYSRLSSFLLSHGYTLSYADHSLFLKRYSNFAFTALFVYVDDIVLSGNCIDEITSITAQLDATFRIKDFGDLRFFLALEVARSTKGINVCQHKYALDLLHDTGLLGAKPASTPSDYCTKLSQDSGDPLPDPSSNRHLIGRLIYLITTRPDIAFVVRHLSQFVNSPTTAHHQAIFRIIRYLKHAPGSGLFFPSTNHAQLLAFSNSDWARCADTRHFVTGFSVYLGSSLVSWRLKKQATVSHNSAEFEYRTLASITYEIQWLTYLLEDFKLVDIYTKALPPASFHTFLSKLGMSNIHSQLAGGS

SEQ ID NO: 231730 - protein, 56 aa, Glycine max
  Coding DNA Sequence Number=SeqID_114952
MILVSGIPQLCQWVCVSNLKNGPFSEQHHSPSSSSHKLHKKKRRSCLRELENTRGT

SEQ ID NO: 231731 - protein, 118 aa, Glycine max
  Coding DNA Sequence Number=SeqID_114953
  Subcellular localization annotation: CTP_CleavageSite=48; ConfidenceScore=5.26e-01
MATEHKNAITGPQIQRRRASPVCKILFPTIFKKVAFLNSSVKYFGVTKVMMASCGVQMRMLNWVLLIIAPRPQQRRMLVLAIKIDPMIMFRIFWIATMLFFSISFNKIHTSNLKNTEW

SEQ ID NO: 231732 - protein, 56 aa, Glycine max
  Coding DNA Sequence Number=SeqID_114954
MEWRTCYLDMTLIPLGLLINIGYHVWLCHKVRTQASLTIFGIDADGRCSWVPAMIK

SEQ ID NO: 231733 - protein, 56 aa, Glycine max
  Coding DNA Sequence Number=SeqID_114955
MACVVWHAKWIVDLPSMLGDMDDKLRFMRQKRNNGLQIEVYEAKEIEHGGTSEGAQ

SEQ ID NO: 231734 - protein, 160 aa, Glycine max
  Coding DNA Sequence Number=SeqID_114956
  Homolog annotation: Hit_ID=Q9LUH6; Match level="QueryCoverage=87%, HitCoverage=65%, E-value=4e-14, Identity=32%"; Hit description =Arabidopsis thaliana genomic DNA, chromosome 5, TAC clone:K24F5
  Pfam annotation: Domain name=DUF599; Domain location=1-155; Score =144.6; E_value=2.7e-40; Accession=PF04654.3; Description=Protein of unknown function, DUF599
MGSTLMATTAILLSAGLAAVISSTYSVKKPLDDAVYGAHSEFMVALKYVTLLTIFLFSFFCHSLSIRFLNQLAILICAPQDAMSLVTPEYLTEILEKGTFLNTVGNRIFYSALPLLLWIFGPVLVFLCSIAMLPVFYNLDFVCGRVKAKMVVINDKSDFA

SEQ ID NO: 231735 - protein, 47 aa, Glycine max
  Coding DNA Sequence Number=SeqID_114957
MPIPEYQITHNLQTHPLPPKEGGEEEVAEDVQCGGWIATGVELRRLW

SEQ ID NO: 231736 - protein, 523 aa, Glycine max
  Coding DNA Sequence Number=SeqID_114958
  Gene Ontology: Mol. function=drug transporter activity; Cellular component=integral to membrane; Biological process=response to antibiotic
  Homolog annotation: Hit_ID=Q7WTR3; Match level="QueryCoverage=80%, HitCoverage=93%, E-value=0.0, Identity=78%"; Hit description =Multidrug resistance protein mdtK
  Pfam annotation: Domain name=MatE; Domain location=114-274; Score =160.4; E_value=4.6e-45; Accession=PF01554.9; Description=MatE
  Pfam annotation: Domain name=MatE; Domain location=341-501; Score =101.3; E_value=2.8e-27; Accession=PF01554.9; Description=MatE
  Pfam annotation: Domain name=Polysacc_synt; Domain location=108-401; Score=-53.3; E_value=0.028; Accession=PF01943.8; Description =Polysaccharide biosynthesis protein
  Pfam module annotation: Pfam domain module=MatE::MatE::Polysacc_synt; Domain location=114-274::341-501::108-401
MAGHQRLFDEIEADAIAVNGGHRQAAPVVRYRGAQRQAGQQLSRQAHGVGAEQLFFFNGDNFCRALHNSACAARFNLPARKLYTNGAAKCDQCLAEVRATATLEARQLLALAIPVILAQVAQTAMGFVDTIMAGAVSATDMAAVAVGTSIWLPAILFGHGLLLALTPTVAQLNGSGRRERIAEQVRQGYWLAAGVALLIMVVLWNAGYLIHTMHDIDPQLAAKAEGYLHALLWGAPGYLFFQVARNQCEGLSKTKPAMLLGFLGLLTNIPLNYVFIYGHFGMPALGGVGCGVATASVYWVMYLVMRFWLKRMPAMRDIRMHSRWSPPSRAILTRLFTLGLPVALALFFEVTLFAVVALLVSPLGIVKVAGHQIALNFSSLMFVLPLSLGVATTIRVGYRLGQGSAEQARIAAWTGQGVGITMAAITALFTVTFRHDIAALYTANPEVITLAAQLMLLAAIYQFSDSIQVIGSGHALDLLYYPDRLLGAGAAGGLRAGADRLGGGTTGASRFLVRIYRRPDVGG

SEQ ID NO: 231737 - protein, 65 aa, Glycine max
  Coding DNA Sequence Number=SeqID_114959
  Subcellular localization annotation: CTP_CleavageSite=38; ConfidenceScore=5.35e-01
MNYQRLPPQRTPRNSPNTSNLTNSERASQNRQDRMPVRTHAKAPETKLRERAADQTFLRQLVPSP

SEQ ID NO: 231738 - protein, 53 aa, Glycine max
  Coding DNA Sequence Number=SeqID_114960
MASNSQQFKNISDILIRVLDAQAFIGSKGCKSDGLPLVIHYIQHAQLVAFLCK

SEQ ID NO: 231739 - protein, 85 aa, Glycine max
  Coding DNA Sequence Number=SeqID_114961
  Gene Ontology: Mol. function=protein serine/threonine kinase activity; Biological process=protein amino acid phosphorylation
  Homolog annotation: Hit_ID=Q53VE1; Match level="QueryCoverage=69%, HitCoverage=14%, E-value=3e-15, Identity=66%"; Hit description =Ser/Thr protein kinase
MQGAEEGRKGNLAMTVEVFEVAPEVAVVEFSKSAGDTLEYVRFCDEQVRPSLKDIVWSWQVWIEFVTVFDLRILVAKITPQIVEK

SEQ ID NO: 231740 - protein, 216 aa, Glycine max
  Coding DNA Sequence Number=SeqID_114962
  Gene Ontology: Mol. function=hydrolase activity; Cellular component =cytoplasm; Biological process=metabolic process
  Homolog annotation: Hit_ID=Q6D599; Match level="QueryCoverage=97%, HitCoverage=35%, E-value=4e-83, Identity=75%"; Hit description =Probable amidase
MAQEPVLFNSQFGTYTNFTNLADLSALALPGPLREDGLPAGITLIAPAWHDRALAAFGLRWQRQSALPLGATGRALPPQPAPAPSSGHVRLAVVGAHLSGMPLNVQLTQRDAVRVEQTVTAPCYRLYALADTEPPKPGLARVAQGAAIRLELWDIPLARFGEFVAEIPAPLGIGTLLLADGRRVKGFICEAWALEGATDITEFGGWRDYLAGVKGA

SEQ ID NO: 231741 - protein, 65 aa, Glycine max
  Coding DNA Sequence Number=SeqID_114963
MSVKNHVGRLGVHDKTNHTLASQVTLTRIDTCLKEYSNWVTPKAYTPKSPSRPLPPDLGPTHKIF

SEQ ID NO: 231742 - protein, 59 aa, Glycine max
  Coding DNA Sequence Number=SeqID_114964
VDPWVLVPITFRGLYILTIRGLHILDCRGLHALAFRGLRVLIFSVLHIHTLGEYKVLCP

SEQ ID NO: 231743 - protein, 147 aa, Glycine max
  Coding DNA Sequence Number=SeqID_114965
MKTCRCRSDENPEIGQIQAKGPSGEGRRPKWRRIKPPSETFGIFIKLGESFSPGSLLNQYQTYQGNPCGVYPDLSSFIGSGVYPDLSSFTGSGVYPDLSSFTGSGVYPDLSSFTGIGVIQTFVACIKRSAPTQFHITVELELRLSSN

SEQ ID NO: 231744 - protein, 86 aa, Glycine max
  Coding DNA Sequence Number=SeqID_114966
MSDSCVSHIETLEIEQRKLSRYSNGHNFSHGGPIQAHNTSRCSKWNNGSSQEIQMVETFHTNVRFRRIDVNLSRSRSFDTGYGGFG

SEQ ID NO: 231745 - protein, 63 aa, Glycine max
  Coding DNA Sequence Number=SeqID_114967
LLKLQTLDQTLVSREKHQLCKEMQRGRSKDQGIEVMESVGMLGTYLRKILLKNGIILFAWGQA

SEQ ID NO: 231746 - protein, 58 aa, Glycine max
  Coding DNA Sequence Number=SeqID_114968
MASIIVAILLFHGLHFGLHLLLHLLCFTHYFSSSTSSGKNAMSNANNEKHGCMRMKYS

SEQ ID NO: 231747 - protein, 66 aa, Glycine max
  Coding DNA Sequence Number=SeqID_114969
MVARFRGVTHDRARRLFTVPVSLIDQYIMVAQRDRKAVALWNEKLHTQISVDSTVMQQDAMPYILV

SEQ ID NO: 231748 - protein, 62 aa, Glycine max
  Coding DNA Sequence Number=SeqID_114970
  Gene Ontology: Mol. function=structural constituent of ribosome; Cellular component=ribonucleoprotein complex; Biological process =translation
  Homolog annotation: Hit_ID=Q09WX9; Match level="QueryCoverage=88%, HitCoverage=21%, E-value=9e-09, Identity=58%"; Hit description =Ribosomal protein S3
MKKAIELTEQAGTKGVQVQIAGRIDRKEIARMDQRSFLGPAVRLIRSAEIPILSLKKHFRSG

SEQ ID NO: 231749 - protein, 278 aa, Glycine max
  Coding DNA Sequence Number=SeqID_114971
  Gene Ontology: Mol. function=receptor activity; Biological process =protein amino acid phosphorylation
  Homolog annotation: Hit_ID=Q9ZU94; Match level="QueryCoverage=97%, HitCoverage=97%, E-value=1e-61, Identity=44%"; Hit description =Expressed protein
  Pfam annotation: Domain name=DUF26; Domain location=179-233; Score =55.3; E_value=2e-13; Accession=PF01657.8; Description=Domain of unknown function DUF26
  Pfam annotation: Domain name=DUF26; Domain location=78-132; Score =64.2; E_value=4.3e-16; Accession=PF01657.8; Description=Domain of unknown function DUF26
  Pfam module annotation: Pfam domain module=DUF26::DUF26; Domain location=179-233::78-132
  Subcellular localization annotation: CTP_CleavageSite=57; ConfidenceScore=5.13e-01
MAKRSMCVFLCVTLFMVGFSECSSTSTFLYSGCTQQRYTPNSPYEWNINSLLTSLVNSATYSAYNNFTVVGSTQQDAVYGLYQCRGDLAMPDCAACVARAVTRAGDICRGTCGGSVQLDGCFVKYDNATFLGAQDKAVVLKKCGPSVGYNPDAMGSRDAVLAGLAAAGGNFRVGGSGGVHGVAQCTGDLSYGECQDCVAEAISRLKSDCGTADYGDMFLGKCYARYSVGGAHDESKAHDKSSHGGVKIFSIVIGSLAGVAIIIIFLAFLSKICGRQGK

SEQ ID NO: 231750 - protein, 157 aa, Glycine max
  Coding DNA Sequence Number=SeqID_114972
MGKVCNLYIDRKRDKNGYRYGFARFVGIQNDLDFSRKLDAINAGSMKLHVNIPRFAIVGGLGAEKKEREYAEKEKGNKLRKKNLKEERWILGDHMQRSGYIIAWWGTLKDLTMFEKLKDARLSKEGGKIRLNYLGDNMLLIKGLKHEKAQQMIDTEE

SEQ ID NO: 231751 - protein, 94 aa, Glycine max
  Coding DNA Sequence Number=SeqID_114973
MGHEYLNVVSGKGAETQYNESDNKGGNVENVAREKYERNVTNGLIIKAQQMEESLRGQLKMGSIASSVNDQGASDGMTQLQQLTNSLETDVPME

SEQ ID NO: 231752 - protein, 71 aa, Glycine max
  Coding DNA Sequence Number=SeqID_114974
MVEGSLYSLWRARGSRWFDSMVRWKLGNGGRARFWLGEQKLAFMYPRLYMLTTQQREIIRDMGTWSGQIWN

SEQ ID NO: 231753 - protein, 224 aa, Glycine max
  Coding DNA Sequence Number=SeqID_114975
  Homolog annotation: Hit_ID=Q9FGI2; Match level="QueryCoverage=36%, HitCoverage=38%, E-value=1e-08, Identity=43%"; Hit description =Arabidopsis thaliana genomic DNA, chromosome 5, P1 clone:MPA22
MASKFSFLTLLMERRKPSKDNNNNNNDLAFVKAAAWAWYQHNSGSKGKTISEFDATITRRVPRPSRYKLEAMRIMAQEAPSEGSPTIRAKKLSLLDEYEVQSISRQLSGLVAEDSKSNNDNKHNKLFKGADNSTNRRTTKKKKVRKGFWLGHGAVCGREEDVVDPGALRVGRRLPAKPLWFRFRDPIIYCLTIFLRLEPKKKVYMLPVRIQIPSLNRNIVIEAN

SEQ ID NO: 231754 - protein, 473 aa, Glycine max
  Coding DNA Sequence Number=SeqID_114976
  Gene Ontology: Mol. function=nucleic acid binding
  Homolog annotation: Hit_ID=Q9LTS7; Match level="QueryCoverage=83%, HitCoverage=55%, E-value=8e-42, Identity=31%"; Hit description =Arabidopsis thaliana genomic DNA, chromosome 5, P1 clone:MHM17
  Pfam annotation: Domain name=zf-CCCH; Domain location=333-358; Score =20.5; E_value=0.0026; Accession=PF00642.15; Description=Zinc finger C-x8-C-x5-C-x3-H type (and similar)
  Pfam annotation: Domain name=zf-CCCH; Domain location=362-387; Score =18.5; E_value=0.0048; Accession=PF00642.15; Description=Zinc finger C-x8-C-x5-C-x3-H type (and similar)
  Pfam annotation: Domain name=zf-CCCH; Domain location=388-413; Score =10.3; E_value=0.057; Accession=PF00642.15; Description=Zinc finger C- x8-C-x5-C-x3-H type (and similar)
  Pfam module annotation: Pfam domain module=zf-CCCH::zf-CCCH::zf-CCCH; Domain location=333-358::362-387::388-413
MDFPPYCRSQLRSNTYRALVHLLSHISAYNASILEASTQPVNIPDNGSGRMDQENQEKEPKCSEVVDSDFLDPKDPICQKDIPEVQETIEGVEDKDMDFTSNKMVLDDIEHMMGIEDLSTLANGFDKEQKLMNEFEQVMKGTEDLICDSELIPLNLELDKTRSDGGEVELMDYQSEVEEGEISGDLGIDGNLFDVASADALILRQMEVDEVQKPENVTGNMIYPSKIENQEKEKGYDSKSSLVNAFQDYNNNGQVEPRTSGKKGIVCGVEVAISKETIECQKEDKTKLDNASKKNKRGGNKGKKKKADRKKRAEKNKQLGVKRLQLQHVQKPKVVSHCRHYLNGRCHEGDKCQFSHDVVPLTKSKPCTHFARHSCMKGDDCPFDHQLSKYPCTNFVSKGSCYRGDACLFSHQVSTKEDIPTASNMCRPELSPLLSGNANSSTPLNNNHGSTPVQQNHLTNSAGIHFCTSVEHK

SEQ ID NO: 231755 - protein, 332 aa, Glycine max
  Coding DNA Sequence Number=SeqID_114977
  Gene Ontology: Mol. function=glutamate-ammonia ligase activity; Cellular component=chloroplast; Biological process=nitrogen compound metabolic process
  Homolog annotation: Hit_ID=O82560; Match level="QueryCoverage=94%, HitCoverage=64%, E-value=9e-85, Identity=57%"; Hit description =Glutamine synthetase cytosolic isozyme 2
  Pfam annotation: Domain name=Gln-synt_C; Domain location=12-257; Score=-0.5; E_value=3.9e-11; Accession=PF00120.14; Description =Glutamine synthetase, catalytic domain
MSLLSDLININLSDTTKKVIVEYIWYGIEPEYTLLQKDVQWPLGWSIGGFPGPQGPYYCGIGANKAFGRDIVDSHFKACLYADINITGINAEVMPGQWEFRVGPSLASLRVTTCGLLATFWRLLAHDYSHHQILSFVNIAANISVCANISVCANISVVVLSFYPQPIKGDWNCASAHTNYSTKSMRNDGGYEVIRKATAKLEKRHKEHIAAYGEGNERRLTGQHETADINTFIRVSLSGGMPRGCTNVVDGARVLGLHAKRSVWFWGCISLWRCALVICLLSVHGGQIDVDEGVANRGASIRVGRDAEKAGKGYLRRIGGLRLTWTLMWLLP

SEQ ID NO: 231756 - protein, 223 aa, Glycine max
  Coding DNA Sequence Number=SeqID_114978
  Gene Ontology: Mol. function=catalytic activity; Cellular component =mitochondrial outer membrane; Biological process=electron transport
  Homolog annotation: Hit_ID=Q01G96; Match level="QueryCoverage=63%, HitCoverage=34%, E-value=1e-36, Identity=59%"; Hit description =Chromosome 01 contig 1, DNA sequence
  Pfam annotation: Domain name=ThiF; Domain location=93-223; Score =147.8; E_value=2.8e-41; Accession=PF00899.11; Description=ThiF family
  Subcellular localization annotation: CTP_CleavageSite=28; ConfidenceScore=5.01e-01
MERGKYLALVGGGALLGSVSTFFLLRLLQSQKRGVSQCSKNVTADFNGVEGCTIAGKKNDRVINEDLLKDEIVSEQLTRNVQFFGFESQQKVTASYVVVIGLGGVGSHAASMLLRSGIGKLLLVDFDQVSVSSLNRHAVATRADVGISKAQCLKEHFLSIFPECQIDAKVMLYDSSTEEEILSGHPDFVLDCIDNIDTKVALLAACVRRGFEGSICNRGWCQS

SEQ ID NO: 231757 - protein, 146 aa, Glycine max
  Coding DNA Sequence Number=SeqID_114979
SVCSFKSVNRENGIKLPQLFNFGLPEQEKSSLNKDDYNKASDTTKQNAPQTDIFLTEILGKNQSVAEEMKLKLPEKTSVDFFMRDHSHSKSVQEGKKSSDNSQSSKGQKALLSTLAFAAEHESSIKMKYPTGGLPMSSEDSERMFC

SEQ ID NO: 231758 - protein, 218 aa, Glycine max
  Coding DNA Sequence Number=SeqID_114980
  Homolog annotation: Hit_ID=Q8H6R5; Match level="QueryCoverage=54%, HitCoverage=35%, E-value=1e-12, Identity=36%"; Hit description=CTV.12
MDPPIKKKTLSRASLSPQRKDKCIVFPLVRYNEFREPVCQACNVVMLESIRAHLASPEHNEVMEKLKANAAGSTEDKNAKPVTGTNNSPKANPEQPQDTACQLPEFSQDVPRHESPSALPRDFCDDSGKIRTRSGIIFFSWNFHFFCNLNDREYPSVVFFCKTLFVTLVSKPWLKYKKFEKPFPKFLALPNTPFIKTGMSPDPPSGALGVYRNQRRIE

SEQ ID NO: 231759 - protein, 82 aa, Glycine max
  Coding DNA Sequence Number=SeqID_114981
VVRLSSTLKSYSEPHELIVIHVSSSIESRAPRIDCLALFAYPPPSKSCSETHELLPSAVHVSSTIKCGASEKEEGEMGVVID

SEQ ID NO: 231760 - protein, 159 aa, Glycine max
  Coding DNA Sequence Number=SeqID_114982
  Gene Ontology: Mol. function=nucleoside-triphosphatase activity; Cellular component=chloroplast
  Homolog annotation: Hit_ID=Q2PMM5; Match level="QueryCoverage=99%, HitCoverage=8%, E-value=8e-81, Identity=78%"; Hit description =Protein ycf2
MSHTNGFGSTTMGSNVRSVQDHGILFYQIGRAVSQNVLLSNCSIDPISIYMKKKSCDGGDSYLYKWYFELGTSMKKLTILLYLLSCSAGSVAQDLWSLPGPDEKNGITSYGLVENNSDLVHGLLEVEGALVGSSRTEKDCSQFDKDRVTLLLRSEPRIP

SEQ ID NO: 231761 - protein, 353 aa, Glycine max
  Coding DNA Sequence Number=SeqID_114983
  Gene Ontology: Mol. function=transferase activity, transferring hexosyl groups; Cellular component=Golgi stack; Biological process =metabolic process
  Homolog annotation: Hit_ID=Q1T4I9; Match level="QueryCoverage=93%, HitCoverage=76%, E-value=5e-54, Identity=32%"; Hit description =Pentatricopeptide repeat
  Pfam annotation: Domain name=PPR; Domain location=111-145; Score =34.5; E_value=3.8e-07; Accession=PF01535.11; Description=PPR repeat
  Pfam annotation: Domain name=PPR; Domain location=146-180; Score =53.7; E_value=6.1e-13; Accession=PF01535.11; Description=PPR repeat
  Pfam annotation: Domain name=PPR; Domain location=181-215; Score =47.3; E_value=5.1e-11; Accession=PF01535.11; Description=PPR repeat
  Pfam annotation: Domain name=PPR; Domain location=216-250; Score =46.6; E_value=8.3e-11; Accession=PF01535.11; Description=PPR repeat
  Pfam annotation: Domain name=PPR; Domain location=267-301; Score =45.2; E_value=2.3e-10; Accession=PF01535.11; Description=PPR repeat
  Pfam annotation: Domain name=PPR; Domain location=41-75; Score=41.3; E_value=3.3e-09; Accession=PF01535.11; Description=PPR repeat
  Pfam annotation: Domain name=PPR; Domain location=76-110; Score=46.9; E_value=7.1e-11; Accession=PF01535.11; Description=PPR repeat
  Pfam module annotation: Pfam domain module=PPR::PPR::PPR::PPR::PPR::PP R::PPR; Domain location=111-145::146-180::181-215::216-250::267 -301::41-75::76-110
MLHFLCLHRISSRSRFKVGGVGSARLVFDEIPKRGLRPTVVSFNTLISGCCKAGAVEEGFRLKGVMESERVCPDVFTFSALINGLCKEGRLDEGSLLFDEMCGKGLVPNGVTFTVLIDGQCKGGKVDLALKNFQMMLAQGVRPDLVTYNALINGLCKVGDLKEARRLVNEMSASGLRPDRITFTTLIDGCCKYGDMESALEIKRRMVEEGIELDDVAFTVLISGLCRDGRVHDAERMLRDMLSAGFKPDDPTYTMEMQSDGHVPGVVTYNALMNGLCKQGQVKNAKMLLDAMLNVGVAPNDITYNILLEGHSKHGSSVDVDIFNSEKGLVKDYASYTALVNESSKTSKDHLKR

SEQ ID NO: 231762 - protein, 441 aa, Glycine max
  Coding DNA Sequence Number=SeqID_114984
  Gene Ontology: Mol. function=pepsin A activity; Cellular component =endoplasmic reticulum; Biological process=proteolysis
  Homolog annotation: Hit_ID=Q9FGI3; Match level="QueryCoverage=80%, HitCoverage=82%, E-value=1e-159, Identity=74%"; Hit description =Similarity to nucleoid DNA-binding protein
  Pfam annotation: Domain name=Asp; Domain location=87-434; Score= -137.3; E_value=1.7e-05; Accession=PF00026.14; Description=Eukaryotic aspartyl protease
  Subcellular localization annotation: CTP_CleavageSite=100; ConfidenceScore=5.82e-01
MALSSPVSLFQLCMLLFSFFFFFSFSTSSSAKLNPTTDSLSLSFPLTSLPLSTAKPLNTNPKLRTLSSSSSYNIKSSFKYSMALVVTLPIGTPPQPQQMVLDTGSQLSWIQCHNKTPPTASFDPSLSSSFYVLPCTHPLCKPRVPDFTLPTTCDQNRLCHYSYFYADGTYAEGNLVREKLAFSPSQTTPPLILGCSSESRDARGILGMNLGRLSFPFQAKVTKFSYCVPTRQPANNNNFPTGSFYLGNNPNSARFRYVSMLTFPQSQRMPNLDPLAYTVPMQGIRIGGRKLNIPPSVFRPNAGGSGQTMVDSGSEFTFLVDVAYDRVREEIIRVLGPRVKKGYVYGGVADMCFDGNAMEIGRLLGDVAFEFEKGVEIVVPKERVLADVGGGVHCVGIGRSERLGAASNIIGNFHQQNLWVEFDLANRRIGFGVADCSRLSK

SEQ ID NO: 231763 - protein, 95 aa, Glycine max
  Coding DNA Sequence Number=SeqID_114985
MEYLNEDFMLYEEEDERVLSFGLVFRGFAVERGSEVRGKESESESVVGLSLAEEEVEKEKKKKNENRSMQMAIWGSESDDMGFIYIAKRPNNEMN

SEQ ID NO: 231764 - protein, 79 aa, Glycine max
  Coding DNA Sequence Number=SeqID_114986
MESVAKGRARSEVVEEGEERGRGEGERVEGDEVADVARLEVREDLFESRVLRVIVLLVLGIVDGFEDFAQKVVVFVGKV

SEQ ID NO: 231765 - protein, 50 aa, Glycine max
  Coding DNA Sequence Number=SeqID_114987
  Gene Ontology: Mol. function=acetyl-CoA carboxylase activity; Cellular component=acetyl-CoA carboxylase complex; Biological process=fatty acid biosynthetic process
  Homolog annotation: Hit_ID=P49158; Match level="QueryCoverage=98%, HitCoverage=15%, E-value=4e-18, Identity=91%"; Hit description =Acetyl-coenzyme A carboxylase carboxyl transferase subunit beta
MDEDMVSLDPIEFHSEEEPYKDRIDSYQRKTGLTEAVQTVYGGQYGIRSR

SEQ ID NO: 231766 - protein, 75 aa, Glycine max
  Coding DNA Sequence Number=SeqID_114988
MTKPMLDQFHPCIHNSIENIVDVKVNGMDGDSWSLVRNHLLKELEKWYDEYINLLGGIHRFEELKRSLLVDGLFM

SEQ ID NO: 231767 - protein, 77 aa, Glycine max
  Coding DNA Sequence Number=SeqID_114989
MDNPSLMFKNPYKSRDPRSLNQFHRMRRKKEEFSLEEKDITIEVHGETLNGFASVCPIVSFERAYGHEVLLESFMSF

SEQ ID NO: 231768 - protein, 133 aa, Glycine max
  Coding DNA Sequence Number=SeqID_114990
MVGKDLGSTNDPMMCKFKMSTPSRHMARLPTHEIPHHNLADFEPCLGYATGGQSVGGIPMPNTLEGPQFRPQPQPLHFAVGRAPPAMAEKGKLDHIEESLKDIEGGEDCAFANLEELFLVPEHGHSQVQGARL

SEQ ID NO: 231769 - protein, 123 aa, Glycine max
  Coding DNA Sequence Number=SeqID_114991
MGYAPSSFVDLVFVGERIETGLKRGKFDHPALMNEKTGANEKDEKEGETHAVTAIPIRPSFPPTQQCHYSANNNPSPYPPPNYPQRPSLNQPQNPHTTQPMLNTTFRTNQNTNQGRNFAAKSL

SEQ ID NO: 231770 - protein, 117 aa, Glycine max
  Coding DNA Sequence Number=SeqID_114992
VDVTYETWKQVPAAQKDLIWEDIQDEFDIPKASDADKDSVDDIVCEKYNISKEKWAQFCQTHRDPSWEDVRKKTQAIQKQNTTPHMLSRGGYEYLEQKLMAEKKKEKTGGSYSIWKH

SEQ ID NO: 231771 - protein, 83 aa, Glycine max
  Coding DNA Sequence Number=SeqID_114993
MFAILVTCWSWVRIRKQPLCICKGKAAYNIPPPYLRIAKSLWAMEYEISKQLLWPRKPWKDTAYMMEVRGIPYSIGIVIGTKN

SEQ ID NO: 231772 - protein, 524 aa, Glycine max
  Coding DNA Sequence Number=SeqID_114994
  Gene Ontology: Mol. function=nucleoside-triphosphatase activity; Cellular component=membrane; Biological process=protein catabolic process
  Homolog annotation: Hit_ID=Q6A167; Match level="QueryCoverage=77%, HitCoverage=50%, E-value=1e-175, Identity=77%"; Hit description=Ftsh- like protease
  Pfam annotation: Domain name=AAA; Domain location=382-522; Score =148.4; E_value=1.9e-41; Accession=PF00004.19; Description=ATPase family associated with various cellular activities (AAA)
  Pfam annotation: Domain name=AAA_2; Domain location=379-507; Score= -52.8; E_value=0.095; Accession=PF07724.4; Description=ATPase family associated with various
  Pfam annotation: Domain name=AAA_5; Domain location=382-512; Score =4.2; E_value=0.00085; Accession=PF07728.4; Description=ATPase family associated with various
  Pfam annotation: Domain name=FtsH_ext; Domain location=212-356; Score= -13.2; E_value=0.032; Accession=PF06480.5; Description=FtsH Extracellular
  Pfam module annotation: Pfam domain module=AAA::AAA_2::AAA_5::FtsH _ext; Domain location=382-522::379-507::382-512::212-356
  Subcellular localization annotation: CTP_CleavageSite=60; ConfidenceScore=5.77e-01
MATLQASLLSKPSLPFPFLSPNHSPFSLSFPPTRRVPSTLLCCTFRPEPNPSELEPEPGSANTEEEPGINSPEEEKEGAASVSDLGLEEEGAEALDSGADSEKIANGRRLSIVAFFVGLWVKARESLKRAFSELLDWWPFWRQEKRLERLVADADANPQDAAKQSALLVELNKQRWWILFVEFWFLSNSCISPESVIKWFEQRDRAVDSRGVAEYLRALVVTNAISEYLPDEDSGKASSLPTLLQELKQRALGNSDETFVSPGISDKQPLHVVMVDPKVSNKSRFAQELISTILITVAVGFMGAAALQKYIGSLGGIGPSGVGSSSSYAPKELNKEVMPEKNVKTFKDVKGCDDAKQELEEVVEYLKNPSKFTRLGGKLPKGILLTGAPGTGKTLLAKAIAGEAGVPFFYRAGSEFEEMFVGVGARRVRSLFQAAKKKAPCIIFIDEIDAVGSTRKQWEGHTKKTLHQLLVEMDGFEQNEGIILMAATNLPDILDPALTRPGRFDRHARKEEKREMSFPIIMFY

SEQ ID NO: 231773 - protein, 115 aa, Glycine max
  Coding DNA Sequence Number=SeqID_114995
  Gene Ontology: Mol. function=nucleoside-triphosphatase activity; Cellular component=membrane; Biological process=protein catabolic process
  Homolog annotation: Hit_ID=Q6A167; Match level="QueryCoverage=85%, HitCoverage=12%, E-value=5e-44, Identity=90%"; Hit description=Ftsh -like protease
  Pfam annotation: Domain name=Peptidase_M41; Domain location=15-114; Score=20.8; E_value=9.5e-12; Accession=PF01434.8; Description =Peptidase family M41
MNLMYAYICYSCFWKLQLTAYHESGHAIVALNTDGAYPIHKATIMPRGSALGMVTQLPSSDETSISKKQLLARLDVCMGGRVAEELIFGQDYVTTGASSDLHTATELAQYMSCIC

SEQ ID NO: 231774 - protein, 293 aa, Glycine max
  Coding DNA Sequence Number=SeqID_114996
  Gene Ontology: Mol. function=transporter activity; Cellular component= integral to membrane; Biological process=cell division
  Homolog annotation: Hit_ID=Q9HWH4; Match level="QueryCoverage=100%, HitCoverage=28%, E-value=1e-138, Identity=83%"; Hit description =Probable Resistance-Nodulation-Cell Division (RND) efflux transporter
MTFTDLFVRRPVLALVVSTLILLFGALALSKLPIRQYPLLENSTITISTEYPGASSELMQGFVTQPIAQAVSSVEGVDYLSSSSVQGRSVVTVRMALNRDSTQALTEVMAKVNQVRYKLPEQAYDPVIERSAGEATAVAYVGFSSKTLSTPALSEYLTRVVEPMFTTIDGVAKVEVFGGQKMAMRLWLDSDRLAGRGLTAADVADAVRRNNYQAAPGKVKGQYVVANVRVNTDLTSVEEFRNLVVRNDGNGLVRLKDVGTVELGAAATETSALMDGEPAVFLGVFPTPTGNPL

SEQ ID NO: 231775 - protein, 100 aa, Glycine max
  Coding DNA Sequence Number=SeqID_114997
AIQLDNKMSFDTLKQAIGSKISLPNGKVVKDAHFRLPVSFVGDFGHYKPCMLRNDEDEEDDDEEAELVPPITIIPPHMQNFEESNFQDSEYGHSLYREEV

SEQ ID NO: 231776 - protein, 60 aa, Glycine max
  Coding DNA Sequence Number=SeqID_114998
MNHTKRDLNPFSFNPNRTTGEGALESTKHTTIDNGECLSDYFEGSLEYQLKWVLGCFRHF

SEQ ID NO: 231777 - protein, 293 aa, Glycine max
  Coding DNA Sequence Number=SeqID_114999
  Gene Ontology: Mol. function=nucleic acid binding; Cellular component= intracellular; Biological process=transport
  Homolog annotation: Hit_ID=Q1S206; Match level="QueryCoverage=67%, HitCoverage=57%, E-value=1e-55, Identity=49%"; Hit description=RNA -binding region RNP-1 (RNA recognition motif); Nuclear transport factor 2
MSTLHSNIGEGFPTRGLPWSLLESCNEDLKTTVDGKTDQVGPQWIEVKWFGDGTPLDVETITTLHNKWTTYFVKVQNTKFRKDKSFLYKNAAHFAGFVKIKDVCGKPKFVQTFFLAPQEKGYFVMNDMFHFIDDGVTSPNLVPVASKTIDTQPHLSASLAEPPVSDYGLEEEARKYVNSVHIDDDPVDNYDIRVSKGLLVLSAAPKHAPHSFKSAPPPSELNHVAQPAVQQSSSASMYIPESGTEAAEGYRLEEDELTSVYFGNLPANATEAEIDQEFKNFGRIKPDGIFIRV

SEQ ID NO: 231778 - protein, 199 aa, Glycine max
  Coding DNA Sequence Number=SeqID_115000
MGKGWGPGAADVVYTDRSYHSTAPSPYGSLPAGQPNAACRAPFFACELRWTLEMVADVEVAVVRLRPAAADVLLNERPINGRLDELCGHNQYPIELAETCDQCWKSQCPIGLFWVQWVSRRCDTYKLVYGIRDKLCYMNIDLDQDSVDQLAFRRREIKIMVTKKDVAEEKHHPDLGQGGHASAHDLHPPSCHAPCKIMS

SEQ ID NO: 231779 - protein, 192 aa, Glycine max
  Coding DNA Sequence Number=SeqID_115001
MDSEAEALEHMKKRDRGHQSVSLENKTGDSTVVKMSEKNNNADADDCMILDDHEGEEHYCGKGTNARSVSFLPRSQEKIGDSAKVVIEQDMKGGEHKYGFNNNKREKPEKVRVVDDETGDKHELYEVLRMPSRTKNRCFKFFTEGRRGIINIIFYIYQTPNPMHVKYTQYFDYPSLLEYRLKANWETFKIQI

SEQ ID NO: 231780 - protein, 168 aa, Glycine max
  Coding DNA Sequence Number=SeqID_115002
MKRELKEAIKIDLSQMALQHSPPIEANIQLLVAHVSTKESYAETVVNPSQEEHVADVRPTMGLYVQHDHSTRLVALGKVYEWASTIHNVSYIDDVVKDSQICPKKQLEPIHRSKIIDGVDPLGDLIKNLYDLYENPLMLLWDGTKFGIPDVEASFFIAYSNFIEIISG

SEQ ID NO: 231781 - protein, 64 aa, Glycine max
  Coding DNA Sequence Number=SeqID_115003
MTSYGVVREDLNCLHLVVTDSITFFLALDATREDIGGGDSNSKFKPLSSFNVVILYLLVHGACV

SEQ ID NO: 231782 - protein, 100 aa, Glycine max
  Coding DNA Sequence Number=SeqID_115004
MEEGYVVSLSEVGQVHLRMRKMLLVESFASQVLQGKVAEEPQLFAVSGAVTVVVAAGLVEERMVGMIPPPGIVPVAGEHKLQAVQLLQIVAQKGKGPRGG

SEQ ID NO: 231783 - protein, 259 aa, Glycine max
  Coding DNA Sequence Number=SeqID_115005
  Gene Ontology: Cellular component=integral to membrane; Biological process=defense response to bacterium
  Homolog annotation: Hit_ID=Q5JJY5; Match level="QueryCoverage=68%, HitCoverage=77%, E-value=2e-25, Identity=38%"; Hit description =Putative MtN3
  Pfam annotation: Domain name=MtN3_slv; Domain location=136-222; Score= 107.6; E_value=3.7e-29; Accession=PF03083.6; Description=MtN3saliva family
  Subcellular localization annotation: CTP_CleavageSite=46; ConfidenceScore=5.12e-01
MAETLRMVVAVIGNVASVSLYAAPTYVNVTFHHSKIVFVSAFSTLNAKASSQENEETLAFKGYLQKVSNKWENFPLVTVNGVGILFELSYVLIYFWFSTPKGKVKVAMTAVPVLIVFCVIAVVSAFVFPDHRHRKLLVGSIGLGVSIAMYASPLVVMKKVIQTKSVEFMPLPLSFCSFLASVLWLTYGLLIRDIFVAGPSVIGTPLGILQLVLHCKYWKRRVTEEPTKVELQKGNNAEKLDLENGHGKECVTVPSNFNS

SEQ ID NO: 231784 - protein, 109 aa, Glycine max
  Coding DNA Sequence Number=SeqID_115006
GTKAGTGPPLEVDGIDKLDVVQAKVGGQTKFELAKTSFEVKRENEVGDSDIWHGLVHYKGVTVKSGGAYGSKVVGHNVTMGWLNGVVRWMEVVNLSSLLMPARRLGDVL

SEQ ID NO: 231785 - protein, 147 aa, Glycine max
  Coding DNA Sequence Number=SeqID_115007
  Gene Ontology: Mol. function=nucleic acid binding; Cellular component= nucleus; Biological process=mRNA processing
  Homolog annotation: Hit_ID=Q9FGL9; Match level="QueryCoverage=93%, HitCoverage=32%, E-value=2e-56, Identity=80%"; Hit description =Polypyrimidine tract-binding protein homolog 2
  Pfam annotation: Domain name=RRM_1; Domain location=20-91; Score =12.4; E_value=0.01; Accession=PF00076.12; Description=RNA recognition motif. (a.k.a. RRM, R
MASVSTQQQFRYTQPPSKVLHLRNLPWECTEDELIELGKLFGKVVNTKCNVGANRNQAFIEFADLNQAIAMISYYASSSEPAQVRGKTVYLQYSNRQEIVNNKTAADVAGNVLLVTIEGEDARLVSIDVLHLVSQCQGNICDGSLLA

SEQ ID NO: 231786 - protein, 88 aa, Glycine max
  Coding DNA Sequence Number=SeqID_115008
MVWLQQKWNQKRKRHHREGEEGLPRQCRQNPDEKKLQSTTNTTQEQEDNMGRAQQTGLKKKTGAQGLKKKKGLKKKNRLKKKRIRVTA

SEQ ID NO: 231787 - protein, 97 aa, Glycine max
  Coding DNA Sequence Number=SeqID_115009
  Gene Ontology: Mol. function=nucleic acid binding; Cellular component= nucleus; Biological process=mRNA processing
  Homolog annotation: Hit_ID=Q9FGL9; Match level="QueryCoverage=100%, HitCoverage=51%, E-value=4e-40, Identity=66%"; Hit description =Polypyrimidine tract-binding protein homolog 2
VFSAFGFVHKITTFEKTAGFQALVQFSDAETATSAKDALDGRSIPRYLLPEHIGPCGLKITYSGHSDLSVKFQSHRSRDYTNPYLPVAQSAMEGSGQ

SEQ ID NO: 231788 - protein, 105 aa, Glycine max
  Coding DNA Sequence Number=SeqID_115010
  Gene Ontology: Cellular component=chloroplast
MPLKDSTETKTGCQERRGGRMGSWSDLGFLIWDPGEEDQAGPCEQLDALSPFNPLSEMWQKEKESMDRPHRLHPVGTTRSPQGRLRHPGGRGPTIETLVQKSGTH

SEQ ID NO: 231789 - protein, 274 aa, Glycine max
  Coding DNA Sequence Number=SeqID_115011
  Gene Ontology: Mol. function=ribulose-phosphate 3-epimerase activity; Cellular component=chloroplast; Biological process=carbohydrate metabolic process
  Homolog annotation: Hit_ID=P32719; Match level="QueryCoverage=74%, HitCoverage=88%, E-value=4e-62, Identity=56%"; Hit description=D -allulose-6-phosphate 3-epimerase
  Pfam annotation: Domain name=Ribul_P_3_epim; Domain location=1-191; Score=184.5; E_value=2.5e-52; Accession=PF00834.9; Description =Ribulose-phosphate 3 epimerase family
MEIKHQLAVLDSRADFLHIDIMDGHYVKNITLSPFFIEQIRPHTQVAIDVHLMVEEPTDFIEAVANAGADYICPHAETINRDAFRVINLIRSYGKKVGVVLNPATPVSFIHHYIHLLDKITVMTVDPGYAGQPFIPEMVQKVQELKALKQAHGHRYLIEIDGSCNTRTYNTLVGAGAEVLIVGTSGLFNIHEDLATAWNMMRESIDEAQGLAQLGAAARCAGRTRAADCGNAGAAAGQRCNARPAGHSQPRSSAGDFTAVHSGARSSAGSGAAE

SEQ ID NO: 231790 - protein, 181 aa, Glycine max
  Coding DNA Sequence Number=SeqID_115012
  Gene Ontology: Mol. function=oxidoreductase activity; Cellular component=membrane; Biological process=electron transport
  Homolog annotation: Hit_ID=Q8U8J9; Match level="QueryCoverage=99%, HitCoverage=47%, E-value=3e-74, Identity=76%"; Hit description =Cytochrome d oxidase subunit II
MAGTENGWSGGGPRPQFRLRRRTCHHRSLRAWRRSSVAWYRWLSLHLGSRDRWTVQSLVKDGGDCNRGLVLQLCSASMDDAGAGPRPCFSARRIAVVDAAPGGDGAACQFARNLRHHLDGGAHDVSFHPSVFGRSEIEPDGMGCILQPYDAVHHAGRRPHLHPDHRRLYVMGLSRAVGQGG

SEQ ID NO: 231791 - protein, 71 aa, Glycine max
  Coding DNA Sequence Number=SeqID_115013
  Gene Ontology: Mol. function=oxidoreductase activity; Cellular component=membrane; Biological process=electron transport
  Homolog annotation: Hit_ID=Q8U8J9; Match level="QueryCoverage=99%, HitCoverage=18%, E-value=3e-34, Identity=91%"; Hit description =Cytochrome d oxidase subunit II
MHDQHGDGYKPAENGVGVQKFKQRRPVIENPEIVIEVEGNTLQYVADRHAEDKRRYEAADEERPVPAGAPC

SEQ ID NO: 231792 - protein, 86 aa, Glycine max
  Coding DNA Sequence Number=SeqID_115014
MKKRKTVWWTSVGFTRLDSQLDFMWGFMMRFARSWGSLDFAAMVAEEITFVGFYDEVAVEITVGFYYQYFYPMNKDKEISTLNIWN

SEQ ID NO: 231793 - protein, 87 aa, Glycine max
  Coding DNA Sequence Number=SeqID_115015
MEANAVAVADISAVAKVNPMPPSYLNQMNHPTSDMVGKDLGSTDGPMMCKFKMSMPFRHMACLPTIHHPIWRTLPMRMSITPASHTH

SEQ ID NO: 231794 - protein, 146 aa, Glycine max
  Coding DNA Sequence Number=SeqID_115016
RDSNISIRDLVSTEDDTAKKNVYSDNHSGISARQRDSNVSMTDLVSVKDDTEKKNVYTDNHSGISARQRDSNVSMTDLVSAEDDTAKKNVYTDNHSGISARQRDSNVNMTDLVSTDDDTAKKNVYTDNHSGISARQRDSNISIRDL

SEQ ID NO: 231795 - protein, 139 aa, Glycine max
  Coding DNA Sequence Number=SeqID_115017
MSGFTRNSPQISASPHQLDIAPYASEPYHAQWNALGLLRDKHTLRLSRILGEMEVDEPWLGLWLPLNYQADMGASGVRHWKCGRQTLWNGSHSMGFSLILTLFICPSFLSRPSRMIKFASFRTHIDPFIGEDQICKALR

SEQ ID NO: 231796 - protein, 62 aa, Glycine max
  Coding DNA Sequence Number=SeqID_115018
MEVAPIAKDVQHVDDATDEVHTQPEEVVVDDERFELKLSSHGRKVQKFGRPTIEIEGLIAAT

SEQ ID NO: 231797 - protein, 291 aa, Glycine max
  Coding DNA Sequence Number=SeqID_115019
  Gene Ontology: Mol. function=receptor activity; Cellular component =integral to membrane; Biological process=ER to Golgi vesicle -mediated transport
  Homolog annotation: Hit_ID=Q9LMP7; Match level="QueryCoverage=90%, HitCoverage=94%, E-value=4e-79, Identity=64%"; Hit description=Golgi SNARE 11 protein
  Pfam annotation: Domain name=V-SNARE; Domain location=88-255; Score =132.3; E_value=1.3e-36; Accession=PF05008.5; Description=Vesicle transport v-SNARE protein
MEVPSSWDALRKQVHRIGRLGMHPICLGIKVIIDGAEILFCAFTILEPNDARKLEAQLDEQMNSYRKLVSNNVSTKADAAESDLESWIERLLKQLQQVNTQMQAWVSSGGSEMVSHTLTRHQEILQDLTQVLYRKNPFTARRFDKLLEFYRLRSSLKAKQEHASLLEDFKEFDRTRLDLEQVDSEQHALLKERTSISRNTGHMDNVISQAQATLGALVFQRSTFGGINSKLGNVSSRLPTVNSILSAIKRKKSMDTIILSLVAAKKPCQYCRGRTIVVEFSPVIDSFEAMG

SEQ ID NO: 231798 - protein, 105 aa, Glycine max
  Coding DNA Sequence Number=SeqID_115020
MEVDAIQCSCAFHENHLVTFSIFLSEYLPKNFPGKASVFSLPTNPAKAPKSPIKIPSPPYLMSLSLFCFIIAADTFIVLLNTSTATDNPYSPPHHRPFIVNRKLP

SEQ ID NO: 231799 - protein, 265 aa, Glycine max
  Coding DNA Sequence Number=SeqID_115021
  Gene Ontology: Mol. function=nucleic acid binding; Cellular component= intracellular; Biological process=regulation of transcription
  Homolog annotation: Hit_ID=Q9LEU3; Match level="QueryCoverage=99%, HitCoverage=100%, E-value=2e-28, Identity=35%"; Hit description=Zinc finger-like protein
  Pfam annotation: Domain name=zf-C2H2; Domain location=105-127; Score =20.4; E_value=0.0063; Accession=PF00096.16; Description=Zinc finger, C2H2 type
MDLQRQEPCPSENLNIITFSDTVPCQNPSINTQTKTNQTQMEDQKHQHDSVPRVLLDLSLSSNKDSGDDNSKLKPELNLLNCFHTNFSENSSESSQGNELDPRVFSCNYCQRKFYSSQALGGHQNAHKRERTLARRGYKAGAADFGHTYSNIHFLPSHGLYNKALGIQVHSMINKPSYQTPFFGLCRSNNGWQRQPLDSQPAIGNFRVGAETESSSLADSVPKLGKFSTRLVAEGFGGYCFGSITTHLKSKQQEELQKLDLSLKL

SEQ ID NO: 231800 - protein, 60 aa, Glycine max
  Coding DNA Sequence Number=SeqID_115022
MKALIISQHLKLQCQDSDNGRGGYHEDHRIQDSLHILRITRAFEKRTPPKTIGIQICKGF

SEQ ID NO: 231801 - protein, 37 aa, Glycine max
  Coding DNA Sequence Number=SeqID_115023
MNCTPFTSLVRNINVGPTTSTLESGDNNVQRVHLKKW

SEQ ID NO: 231802 - protein, 239 aa, Glycine max
  Coding DNA Sequence Number=SeqID_115024
  Gene Ontology: Mol. function=zinc ion binding
  Homolog annotation: Hit_ID=Q1T1K4; Match level="QueryCoverage=74%, HitCoverage=48%, E-value=2e-72, Identity=67%"; Hit description=Zinc finger, DHHC-type
  Pfam annotation: Domain name=zf-DHHC; Domain location=164-217; Score =18.0; E_value=3.4e-06; Accession=PF01529.11; Description=DHHC zinc finger domain
MAVIACHFFFYTVLQFENFVASLVAHASHIQEQFVTEVTENYETTCWGCGLRVLLPSCASAFKCGWCGAITDQNKKKPNLKCIRWRVVRDRCFVSVVLVFMFFVIFGGVWAVYPVVFSVSILCGVFHSIITAILSVATISFFSFAAFRCAGTPPNILWGSYPTVGKSDLENYTYCHYCSKPKSPRAHHCRSCRKCVLDMDHHCPFSPVSRLSCSFFGGCLNCSLKVGDLVPHLVVIRPK

SEQ ID NO: 231803 - protein, 140 aa, Glycine max
  Coding DNA Sequence Number=SeqID_115025
  Gene Ontology: Mol. function=zinc ion binding; Cellular component =integral to membrane; Biological process=ubiquitin cycle
  Homolog annotation: Hit_ID=Q1SL99; Match level="QueryCoverage=61%, HitCoverage=70%, E-value=8e-21, Identity=47%"; Hit description=Zinc finger, RING-type; RINGv
  Pfam annotation: Domain name=zf-C3HC4; Domain location=50-91; Score =34.4; E_value=4e-07; Accession=PF00097.15; Description=Zinc finger, C3HC4 type (RING finger)
MGSRDKDGEESLGIGLQPRNSGFDPSIIASLPKLLYKQTDQFKQGEVVECSVCLGTIVEDAITRVLPNCKHIFHADCVDKWFNSNTTCPICRTVVDPNVQPEHGHVGATRVHNQVQPTAPPAEGGVELQDDSELERVGCS

SEQ ID NO: 231804 - protein, 63 aa, Glycine max
  Coding DNA Sequence Number=SeqID_115026
MAPVKLQNAVVGGEANIAKMDDRMRHAARTLVVGEVVITPEEVVDSVERDKNNEVVVVGEGDS

SEQ ID NO: 231805 - protein, 422 aa, Glycine max
  Coding DNA Sequence Number=SeqID_115027
  Gene Ontology: Mol. function=nucleotidyltransferase activity; Cellular component=integral to membrane; Biological process=aromatic amino acid family biosynthetic process
  Homolog annotation: Hit_ID=Q8H0H1; Match level="QueryCoverage=95%, HitCoverage=69%, E-value=1e-155, Identity=62%"; Hit description =Hypothetical protein A17
  Pfam annotation: Domain name=OPT; Domain location=1-393; Score=125.4; E_value=1.6e-34; Accession=PF03169.6; Description=OPT oligopeptide transporter protein
MICPYIINASLLLGAIFSWGILWPLIELKKGIWYSTDLPSGSLSGIQGYRVFTAIAMILGDGLYHCIIMLIRVAYSLITQYLKKRVSSAVDPEDVDQNSSEDFDSQRRTEYFLKDEIPSWVAIIGYSVLAVISIITVSLIFPQLKWYHVLITYLIAPILAFCNAYGCGLTDWSLAANYGKLAIIIFSSWVGLEHGGLIAGLASCGVMMSIVSTASDLMQDFKTGYLTLASPRSMFVSQVLGTATGCLVSPLMFWFFHKAYTLGDPQGSYPAPYGEVYRGMALLGAKGFSSLPKNCLELAIIFFLLAVFINIVRDLLERYETKYRLHRFVPNPMALAIPFYLGGYFAIDMCIGSLILFLWEKKNKQKAKDYGPALASGLICGDSLWSVPAAILSLAGANPPICMKFLSRAMNNKVDTFLSGGH

SEQ ID NO: 231806 - protein, 123 aa, Glycine max
  Coding DNA Sequence Number=SeqID_115028
MDFLGLRSEIEDEHSPSFLISPKRHFELGLTHSNLQIPQNPDLTFQPSRSHSFSTHNTILSPSNPRNLARLPIISPKTPYPRKSKEKEVHPNLKFRSPTRRDELHDSENALLSRFGAEMGTKG

SEQ ID NO: 231807 - protein, 88 aa, Glycine max
  Coding DNA Sequence Number=SeqID_115029
  Gene Ontology: Mol. function=metal ion binding; Cellular component =integral to membrane
  Homolog annotation: Hit_ID=Q9SFV0; Match level="QueryCoverage=87%, HitCoverage=43%, E-value=2e-19, Identity=56%"; Hit description =Putative RING zinc finger protein
  Pfam annotation: Domain name=DNA_ligase_ZBD; Domain location=32-56; Score=9.6; E_value=0.045; Accession=PF03119.7; Description=NAD -dependent DNA ligase C4 zinc finger domain
  Pfam annotation: Domain name=zf-C3HC4; Domain location=34-71; Score =33.5; E_value=7.2e-07; Accession=PF00097.15; Description=Zinc finger, C3HC4 type (RING finger)
  Pfam module annotation: Pfam domain module=DNA_ligase_ZBD::zf-C3HC4; Domain location=32-56::34-71
MAMLFTMPWDPKELDFSENNKTPEPPKEQPVFNCPICMSALEEETSTRCAHIFCKNCIRAALSAQAKCPTCRKVTRNSLIRVFLPATS

SEQ ID NO: 231808 - protein, 109 aa, Glycine max
  Coding DNA Sequence Number=SeqID_115030
  Gene Ontology: Mol. function=manganese ion binding; Cellular component=mitochondrion
  Homolog annotation: Hit_ID=Q8GYB1; Match level="QueryCoverage=90%, HitCoverage=36%, E-value=8e-18, Identity=49%"; Hit description=Nudix hydrolase 15, mitochondrial precursor
MDSSNSNGGSQRLLDLAQRLRLDKPPPFPEDILDQIMEEKGDKVVSEVSYTESATPIAQNTEKIRYKRAAVLICIFEGDAGDLRVILTKRSSKLSTYSGQSSFIHFLFA

SEQ ID NO: 231809 - protein, 78 aa, Glycine max
  Coding DNA Sequence Number=SeqID_115031
MGSVSCHVLFAEDCDYKFLHYKDHVLNDVMKGPQVIGPFLSEKGILGILKIVKHVGVRIVQSEKRIVIPRWNIVAERL

SEQ ID NO: 231810 - protein, 288 aa, Glycine max
  Coding DNA Sequence Number=SeqID_115032
  Homolog annotation: Hit_ID=Q0WNP8; Match level="QueryCoverage=94%, HitCoverage=98%, E-value=2e-63, Identity=51%"; Hit description =Putative SF16 protein
  Pfam annotation: Domain name=IQ; Domain location=54-74; Score=24.3; E_ value=0.00044; Accession=PF00612.17; Description=IQ calmodulin -binding motif
MFLSLSGHILQQGILTQEKLNASKSNNYPGKESSGLTNGIKSENLVSAGVSVETIAATRIQTAFRAYKARKALRRMKGFTKLKILTEGFSVKKQASTAVTYLHSWSKIQAEIRARRICMVTEDRIRRKKLESQLKLEAKLHDLEVEWCGGSETMEEILGRIHHREEAAVKRERAMAYAFSHQNQLLGNYELSKANWGWSWKECWIAARPWESRIPSLSVTPEKAQHKQPSPSKVQKDKNTSTPKTPVSFKPPSANAKGTPPSANAKGTSKARRLSYPTTEKTLVQRVQ

SEQ ID NO: 231811 - protein, 235 aa, Glycine max
  Coding DNA Sequence Number=SeqID_115033
  Gene Ontology: Mol. function=manganese ion binding; Cellular component=mitochondrion; Biological process=acetyl-CoA catabolic process
  Homolog annotation: Hit_ID=Q8GYB1; Match level="QueryCoverage=78%, HitCoverage=63%, E-value=5e-60, Identity=61%"; Hit description=Nudix hydrolase 15, mitochondrial precursor
  Pfam annotation: Domain name=NUDIX; Domain location=41-179; Score =43.8; E_value=6e-10; Accession=PF00293.18; Description=NUDIX domain
MGSNRAEVRGSQRLQALIHHLHSSIPSDSNEPNSKFTVWKKRAAVLICVFEGADGNLRVFLTQRASSLSTHSGGKREEGDADDVQTALREAKEEIGLDPSLVSVITLLPPFHTKKLDEVASEKVEYGVTIIPVVGVLFDKDAFSPVLNSAEVEAIFDVPLEMFLKNDNRRAEEREWMGEKHLVHYFDYEDGNKKYVIWAITAAILIRSATLLLQRPPAFLEQRPKIWGGMTENDI

SEQ ID NO: 231812 - protein, 198 aa, Glycine max
  Coding DNA Sequence Number=SeqID_115034
  Gene Ontology: Mol. function=molecular_function; Cellular component =nucleus; Biological process=biological_process
  Homolog annotation: Hit_ID=Q8C5X2; Match level="QueryCoverage=86%, HitCoverage=55%, E-value=7e-32, Identity=42%"; Hit description=Adult male testis cDNA, RIKEN full-length enriched library, clone:4930597G02 product:...
  Homolog annotation: Hit description=hypothetical protein, full insert sequence
  Pfam annotation: Domain name=DUF298; Domain location=76-194; Score =181.2; E_value=2.6e-51; Accession=PF03556.6; Description=Domain of unknown function (DUF298)
MFMSVCKSGSGLGRGRDLESCGDCPEGIETLCADMEVDHTDVRVLMLAWKMKAEEQGYFTLDEWRRGLKALRADTVSKLKKALPDLEKEVRRPSNFADFYSYAFQYCLTEEKQKSIDIESICELLTLVLGSTFPAQVNLFVEYLKTQNDYKVINMDQWMGFFRFCNEISFPTLNDYDSELAWPLILDNFVEWLREKQK

SEQ ID NO: 231813 - protein, 143 aa, Glycine max
  Coding DNA Sequence Number=SeqID_115035
MSLPRHGRSNQSTTIAWSFWLPLPHLHHKLVHATTVKGLEASRKKVKRINCWTGSEGVKLVITGAEEIGGDGGGIGLTRLFGCRRASHLQQEIQTLSDSEEEESKRAKFRKDKEKEKGVEVEGDDVDALKLWCGVVPYTVSFK

SEQ ID NO: 231814 - protein, 180 aa, Glycine max
  Coding DNA Sequence Number=SeqID_115036
  Gene Ontology: Mol. function=RNA-directed DNA polymerase activity; Biological process=RNA-dependent DNA replication
MVEREKFDHIEERLRVIEGGRNYAFADMEELCLVADVVIPPKFKVSDFVKYKGTTCPKNHLKIYYRKMGAYAKDEKLLMHFFQESLTGEAVTWYTNLEPSQYQYNSDMAPDRMQLQNMCKREHESFKEYAQRWRDLAAQVAPPMMEREMITMMVDSLPVFAGERIEVGLRKGKFDYGFDE

SEQ ID NO: 231815 - protein, 94 aa, Glycine max
  Coding DNA Sequence Number=SeqID_115037
MELHQDVASHKDGIEADANVDGQDDEAKEEDGGSNNDGSKEPLVQQVKLGPLRKTIGTYVEGAWWILNLVLEVFVVANAEWNDRIDAWVVESLE

SEQ ID NO: 231816 - protein, 91 aa, Glycine max
  Coding DNA Sequence Number=SeqID_115038
  Subcellular localization annotation: CTP_CleavageSite=51; ConfidenceScore=5.17e-01
METCRGSAFAVSSPSPFSATKKWNKKLGYGREGNGRVLLWVGKCGFNLLVSANGATRTYKGMSENGGRGEAVVAVYSGGIFIENREELRGV

SEQ ID NO: 231817 - protein, 124 aa, Glycine max
  Coding DNA Sequence Number=SeqID_115039
MVPPLAEFTLLVLLQNQRVTQELVEGICIEGDPVIPHPRAHGSNPLLSGPGIGIEFYDYLQGTHPPELDTPLPVERPSLDGLKVLLVLGTSEPVTIKLQGGTGVFSSGVLSRPLRGELLRSYLL

SEQ ID NO: 231818 - protein, 138 aa, Glycine max
  Coding DNA Sequence Number=SeqID_115040
MALGFEGYSYTTTLGRKRVVLLHNEASNLNYNTLVNPLKRRMSSEKFTFDSKRSRLEAFPVDVLCWGLLLLAEVARRMHFEYSTPKNITLAIPKSFDIEGATRLEEINTPKAPFRKPKLKPIGKNLASIPVALFASTN

SEQ ID NO: 231819 - protein, 872 aa, Glycine max
  Coding DNA Sequence Number=SeqID_115041
  Gene Ontology: Mol. function=nucleic acid binding; Cellular component= nucleus; Biological process=protein amino acid phosphorylation
  Homolog annotation: Hit_ID=Q6L4C3; Match level="QueryCoverage=32%, HitCoverage=99%, E-value=3e-82, Identity=60%"; Hit description=RIKEN cDNA 1500006O09, related
  Pfam annotation: Domain name=DUF783; Domain location=25-267; Score =255.8; E_value=9.2e-74; Accession=PF05615.3; Description=Protein of unknown function (DUF783)
  Pfam annotation: Domain name=PPR; Domain location=275-309; Score =27.4; E_value=5.1e-05; Accession=PF01535.11; Description=PPR repeat
  Pfam annotation: Domain name=PPR; Domain location=349-383; Score =33.1; E_value=9.5e-07; Accession=PF01535.11; Description=PPR repeat
  Pfam annotation: Domain name=PPR; Domain location=411-446; Score=2.0; E_value=4.3; Accession=PF01535.11; Description=PPR repeat
  Pfam annotation: Domain name=PPR; Domain location=481-515; Score =39.4; E_value=1.3e-08; Accession=PF01535.11; Description=PPR repeat
  Pfam annotation: Domain name=PPR; Domain location=517-551; Score =12.4; E_value=0.25; Accession=PF01535.11; Description=PPR repeat
  Pfam annotation: Domain name=PPR; Domain location=553-586; Score=4.1; E_value=2.4; Accession=PF01535.11; Description=PPR repeat
  Pfam annotation: Domain name=PPR; Domain location=620-654; Score =13.9; E_value=0.17; Accession=PF01535.11; Description=PPR repeat
  Pfam module annotation: Pfam domain module=DUF783::PPR::PPR::PPR::PPR: :PPR::PPR::PPR; Domain location=25-267::275-309::349-383::411 -446::481-515::517-551::553-586::620-654
MLGKTRKVSARGEAVAANYAFGPSEDDVIIKHRLLTRTTTTRGDPPLKKLQKKFTTFVSEVDKDEDINYNDCEKLARAFLQELTTFEIPLLKSKAIVEANVREKENFNELKEEMNRQILLAQSDIEDLKKQLEESKVERRHKEECEAIRKLIAMQPPRSETMKVISELEKEIAALDAENTAGSRLLELRKKQFALLLHVGGPGTNFGSVVTGLGMDGLGKTNELLVQMDSWQHGVDELQNTIEEEQKSLVEEMRMATEELKNGMVFDDLRDITLSAYNYMINGYHKQGQVEESLGLVHRLLVSGENPDGFTFSMILKASTSGCNAALLGDLGRMLHTQILKSDVERDEVLYTALIDSYVKNGRVVYARTVFDVMLEKNVVCSTSLISGYMNQGSFEDAECIFLKTLDKDVVAFNAMIEGYSKTSEYATRSLDLYIDMQRLNFWPNVSTQLVLVPCLQHLKLGNRVVDTRRVFDHMLVKNVFSWTSMIDGYGKNGFPDEALELFVKMQTEYGIVPNYVTLLSALSACAHAGLVDKGWEIIQSMENEYLVKPGMEHYACMVDLLGRAGMLNQAWEFIMRIPEKPISDVWAALLSSCRLHGNIELAKLAANELFKLNATGRPGAYVALSNTLVAAGKWESVTELREIMKERGISKDTGRSWVGADDGKQSTRIRSSSGSNGYFSEQRCEASHCGRAKTKGSKGTKGLSGVCRSLWISNSSFVGPIFNGYSSVGYSLLIKKEKAIKVQPNRATIGNGPSFGWVFMADFLTALAKKVKTNTATVENYRCIYVPPGIPLRREKDEPLRVNVIFKQVLFISSFKILDQEVLGRDSNWNSLPVASNRVEQELLSGDTAVIAETGDSWLNCQNLRLPENCG

SEQ ID NO: 231820 - protein, 191 aa, Glycine max
  Coding DNA Sequence Number=SeqID_115042
  Gene Ontology: Mol. function=hydrolase activity, acting on ester bonds; Biological process=lipid metabolic process
  Homolog annotation: Hit_ID=Q5VMA7; Match level="QueryCoverage=58%, HitCoverage=46%, E-value=9e-29, Identity=59%"; Hit description =Putative CPRD49
  Pfam annotation: Domain name=Lipase_GDSL; Domain location=6-178; Score=35.6; E_value=1.7e-07; Accession=PF00657.12; Description=GDSL -like LipaseAcylhydrolase
MTRAKFYLFGDSITEESFSVGGWGASLAHHFSRTADVVLRGYSGYNTRWALKVLERVFPGSHGVDGGTGTAPIALTVFFGANDACVPDRCSAFQHVPLHEYKQNLHSIVSFFKRALVAYIACHERVNYLSFGGVECYDDFLVKYGCGVSRIEWGELRIEISEVVSANTRAWPWAWEVWLLCLPLDHYDTLS

SEQ ID NO: 231821 - protein, 129 aa, Glycine max
  Coding DNA Sequence Number=SeqID_115043
  Homolog annotation: Hit_ID=Q53NL0; Match level="QueryCoverage=29%, HitCoverage=3%, E-value=1e-09, Identity=71%"; Hit description =Integrase core domain, putative
MVIAPLVVVRNNNEEEQHNNEPMIHNKPIVKEQQEDLLELPKGCKRVGCKWVFKTKHDSHGNLEHYKARLVARCHNLPSGGGTPRDSKVHLPFEENARSCHQCLFEGNIEKTKMERLRVYVFLKMRVRE

SEQ ID NO: 231822 - protein, 55 aa, Glycine max
  Coding DNA Sequence Number=SeqID_115044
MMRTAVLMKTQRRVLQRRCCGIFPSFQGINEALGLNLELGLGLNPALGLDLKRAN

SEQ ID NO: 231823 - protein, 102 aa, Glycine max
  Coding DNA Sequence Number=SeqID_115045
  Gene Ontology: Mol. function=transferase activity; Cellular component= cytosol; Biological process=glutamine metabolic process
  Homolog annotation: Hit_ID=Q1SPM3; Match level="QueryCoverage=66%, HitCoverage=27%, E-value=3e-19, Identity=72%"; Hit description=SNO glutamine amidotransferase; CobB/CobQ-like glutamine amidotransferase
MGIQIFEVELSVLELVSKEGGPETFCGFFIRAPTILEAWPEVQVLADYPVPSSRLLSFDSSIEDQMEVAVEVVQKLQPREASAVFIEVKSEKPFYRILFWIV

SEQ ID NO: 231824 - protein, 94 aa, Glycine max
  Coding DNA Sequence Number=SeqID_115046
MHFLIQTDARDIPVAPEKSVVAFKNENPTVSVLEKKEIYLLPIVRMSNLLHSQIDAILSETVVVGVGKSMKVVNINKDADQMPLQVEEEDLKWS

SEQ ID NO: 231825 - protein, 75 aa, Glycine max
  Coding DNA Sequence Number=SeqID_115047
MEVEMCTLEVTDNQRYWNVCAVHYNMGTASRVEGSKRTPYDTPAMRKLLLDDSQLQQRKRMAHKKQAIDRGRPKR

SEQ ID NO: 231826 - protein, 527 aa, Glycine max
  Coding DNA Sequence Number=SeqID_115048
  Gene Ontology: Mol. function=protein serine/threonine kinase activity; Cellular component=cell cortex; Biological process=protein amino acid phosphorylation
  Homolog annotation: Hit_ID=Q10EQ9; Match level="QueryCoverage=75%, HitCoverage=48%, E-value=1e-113, Identity=56%"; Hit description =Protein kinase domain containing protein, expressed
  Pfam annotation: Domain name=Pkinase; Domain location=188-457; Score =260.4; E_value=3.7e-75; Accession=PF00069.15; Description=Protein kinase domain
  Pfam annotation: Domain name=Pkinase_Tyr; Domain location=188-457; Score=122.0; E_value=1.6e-33; Accession=PF07714.7; Description =Protein tyrosine kinase
  Pfam module annotation: Pfam domain module=Pkinase::Pkinase_Tyr; Domain location=188-457::188-457
  Subcellular localization annotation: CTP_CleavageSite=83; ConfidenceScore=5.33e-01
MEQAETRSPRMVQQDASGCSESARDNSNNNLVNVPRRRSISGSSSASPSMSPQKTRNGDFVPYYYTYSKGNQFWSAPEMPSCEAGLLPPAFFDLSALSTEASLSPNSHQSLQMKSSQKHTRTFSGPPSPIHSMLPLEISTARHESNAPPVGVHPLPLPPGAALTSPPAAATFSHAVAKSESFPMKSQWKKGKLIGRGTFGSVYVATNRYALKQMLLLDRETGALCAMKEVELFPDDPKSAECIKQLEQEIKVLSNLKHSNIVQYYGSEIVEDRFYIYLEYVHPGSINKYVREHCGAITESVIRNFTRHILSGLAYLHSKKTIHRDIKGANLLVDSAGVVKLADFGMAKHLTGFEANLSLRGSPYWMAPEAVIQKDNSPDLAFAIDIWSLGCTIIEMFTGKPPWSEYEGAAALFKVMKETPPIPETLSSEGKDFLRCCFKRNPAERPTAAVLLEHRFLKNSQLLDVLSSTQLYNETSFMDKPHTPSRQSENSYDQLSTPCAKIAKGKAAERRGFLISSFDILPAYLDQ

SEQ ID NO: 231827 - protein, 132 aa, Glycine max
  Coding DNA Sequence Number=SeqID_115049
  Pfam annotation: Domain name=Self-incomp_S1; Domain location=29-131; Score=41.6; E_value=2.7e-09; Accession=PF05938.2; Description=Plant self-incompatibility protein S1
MSLFARSVSTLRVLILLLSTLNNTMAVKALIRVTNDLGVLDITVSCKVDDNHPHVLSPGTYYEWNFSPDNEFGTEPLFSNCSFQWERGHYHTFDLYVEVRDGDCSKCLWLIKPDSPCRYTGNSRFACYQWKT

SEQ ID NO: 231828 - protein, 115 aa, Glycine max
  Coding DNA Sequence Number=SeqID_115050
  Subcellular localization annotation: CTP_CleavageSite=53; ConfidenceScore=5.80e-01
MAVVAKAMRWLPTLSFSPSNSSSSSSSSSSASAASAVDHRRKAWLFGNSSKKRACHVGDHDEDALVSSPGTPQQLPLPELSAAAVLRQQDGECRLPSPKDAAPTTTGFRMRREAA

SEQ ID NO: 231829 - protein, 71 aa, Glycine max
  Coding DNA Sequence Number=SeqID_115051
  Gene Ontology: Mol. function=serine-type endopeptidase inhibitor activity; Cellular component=extracellular region
  Homolog annotation: Hit_ID=Q9AVS2; Match level="QueryCoverage=78%, HitCoverage=75%, E-value=7e-09, Identity=60%"; Hit description =Trypsin inhibitor precursor
MEFKVLVKVVLLLSLIGFTATTVDATLFDPSSFITRLLPNGEMLGQAATQLVELVAVYGATLPSVTALTIP

SEQ ID NO: 231830 - protein, 51 aa, Glycine max
  Coding DNA Sequence Number=SeqID_115052
MTCMIYINSKDIIVLSRMALCCGKMHDFKSPCGFEGVFVEEHLGDHEARTC

SEQ ID NO: 231831 - protein, 400 aa, Glycine max
  Coding DNA Sequence Number=SeqID_115053
  Gene Ontology: Mol. function=hydrolase activity, acting on ester bonds; Cellular component=cellular_component; Biological process =lipid metabolic process
  Homolog annotation: Hit_ID=Q9FJ45; Match level="QueryCoverage=97%, HitCoverage=99%, E-value=6e-97, Identity=50%"; Hit description=GDSL -motif lipase/hydrolase-like protein
  Pfam annotation: Domain name=Lipase_GDSL; Domain location=32-382; Score=191.5; E_value=2.1e-54; Accession=PF00657.12; Description=GDSL- like LipaseAcylhydrolase
MKIYILLVITSFTFGFLEKVVSNPSPRPYKAIFNLGDSLSDTGNFLASGAILFPVIGKPPYGQTFFKRATGRCSDGRLMIDFIAEAYELPYLPPYLALTKDKDIQRGVNFAVAGATALDAKFFIEAGLAKYLWTNNSLSIQLGWFKKLKPSLCTTKQDCDSYFKRSLFLVGEIGGNDYNYAAIAGNITQLQATVPPVVEAITAAINELIAEGARELLVPGNFPIGCSALYLTLFRSENKEDYDDSGCLKTFNGFAEYHNKELKLALETLRKKNPHARILYADYYGAAKRFFHAPGHHACKTVCGLTRHGCFWFNQSIKFKIAYGFTNGALRACCGGGGPYNFNISARCGHTGSKACADPSTYANWDGIHLTEAAYRYIAKGLIYGPFSYPPLKISPNKIA

SEQ ID NO: 231832 - protein, 336 aa, Glycine max
  Coding DNA Sequence Number=SeqID_115054
  Gene Ontology: Mol. function=protein binding
  Homolog annotation: Hit_ID=Q4FX63; Match level="QueryCoverage=95%, HitCoverage=86%, E-value=4e-12, Identity=25%"; Hit description =Proteophosphoglycan ppg4
  Subcellular localization annotation: CTP_CleavageSite=97; ConfidenceScore=5.62e-01
MASLASPKAHQTQGLSLVSLTAPKACQTQGPPLVSLAPLKARQIQGLPLVSLASSKARQTQGFSLVSLASLEACQIEGLSLVNLASPKACQTRGPTMASLASPKARQTQGLSLVSLTAPKACQTQGPPLVSLAPPTARQIQGPPLVSLASSKARLTQGLSMVRLAPPKARQTQGPSLMSLASSKAGQTQGPSWVNFASPKACQTQGSSLVCLFESRSSKGSSNPSLKGWSNPRSVLGEPRSSKGSSNPRSTLGESWISKGSSNSRFVLGESRFSKGSLNLRCILGESGFSKGSSNPRPIVGESHFAKGSSNPRSTLGTYSYKNLRHAFGKLTPLEL

SEQ ID NO: 231833 - protein, 425 aa, Glycine max
  Coding DNA Sequence Number=SeqID_115055
  Gene Ontology: Mol. function=triacylglycerol lipase activity; Biological process=lipid metabolic process
  Homolog annotation: Hit_ID=O49523; Match level="QueryCoverage=93%, HitCoverage=96%, E-value=1e-145, Identity=62%"; Hit description =Lipase-like protein
  Pfam annotation: Domain name=Lipase_3; Domain location=164-325; Score= 208.8; E_value=1.2e-59; Accession=PF01764.16; Description=Lipase (class 3)
MKMKLSLVPYIKHAVAALIKRWVGMEKKIMNSSIAKKWRQLSGQDHWKGLIDPLDIDLRRYIIHYGEMAQAAYDAFNTEKASKYAGSSRYAKKSFFSKVGLVNGNPFTYSVTKFLYATSEIDVPDAFIIKSFSREAWSRESNWIGYVAVATDEGKAALGRRDIVIAWRGTVQTLEWVNDLQFLLVPAPKVFGKNTDPKVHQGWYSIYTSEDPRSPFNKTSARTQVLSEVRRLVELYKNEEISITITGHSLGAAIATLNAVDIVTNGYNKPSDPSLKASPVTAIVFASPRVGDINFQKVFSGYKDLTTIRIRNELDIVPNYPLVGYSDVGEELKIDTRKSMYLKSPGNPSSWHNLEAYLHGVAGTQRSKGGFKLEVHRDIALVNKTLDALKDEFLVPVSWRTEKNKGMVQQNDGSWKLMDHEDDDF

SEQ ID NO: 231834 - protein, 299 aa, Glycine max
  Coding DNA Sequence Number=SeqID_115056
FKSFDEDLLTLLERVDRAILEQLSASLDAWAILSFPSAGDPLVALDEGSQPIVGIDPTNKVVEVSPNMLSSVLAKRKHDDGVGVYEGSCQVDAQFGLPLQFVGSPLALSAVQAIALIVAAHAPPPPATSTQEISASPATEVSALVASDDPVKAPSSTTATPLLSAGVATTSALAMPPPSSSAPPILPSVVLASVSPSTSSHPNSAKVFPQQSLVILEEIGQKHQEVLSKVASEAKVAKWRATARIVWRVEPPKVANAIIAFVKAVKLKHQLSSKVGSVLAKLLCTRLDGDKLFECYKGL

SEQ ID NO: 231835 - protein, 774 aa, Glycine max
  Coding DNA Sequence Number=SeqID_115057
  Gene Ontology: Mol. function=identical protein binding; Cellular component=cell wall; Biological process=negative regulation of enzyme activity
  Homolog annotation: Hit_ID=Q948Q4; Match level="QueryCoverage=95%, HitCoverage=90%, E-value=0.0, Identity=56%"; Hit description =Subtilisin-like serine protease
  Pfam annotation: Domain name=PA; Domain location=355-468; Score=27.0; E_value=6.9e-05; Accession=PF02225.12; Description=PA domain
  Pfam annotation: Domain name=Peptidase_S8; Domain location=106-622; Score=81.0; E_value=3.6e-21; Accession=PF00082.12; Description =Subtilase family
  Pfam annotation: Domain name=Subtilisin_N; Domain location=15-91; Score=47.5; E_value=4.6e-11; Accession=PF05922.7; Description =Subtilisin N-terminal Region
  Pfam module annotation: Pfam domain module=PA::Peptidase _S8::Subtilisin_N; Domain location=355-468::106-622::15-91
MMISFIWLVPSDVLDLVVSVMEASKAHTNHLLASHDLLLQSSLENGSYNKLHSYKHIINGFSVHTTPSQAARLRRSPGVKLVEKDRGAKMRTTYTPEFLSLRKGIWAQEGGERNAGEGVVIGFVDSGINALHPSFAYDPMHPFSSNLSRFEGACETGPLFPPSSCNGKIVAARFFSAGAEATVTLNASMDFLSPFDADGHGSHVASVAAGNAGVSVVVNGFFYGKASGMAPRARIAVYKAIFPSVGTLADVIAAIDQAVLDGVDILSLSVGPNEPPESTVTFLSMFDISLLFARKAGVFVVQAAGNKGPASSSVVSFSPWSVGVAACTTDRRYPASLLLGNGSVLNGAGLSGPTFGNGSVLHKLVLAKDAVKINGTTQEYIEECQHPEVLDPNIVLGSIIICTFSTGFNNGTSTLNAIIGTSKALGLEGFILVANPNYGDYIAEPIPFAVSGIMIPRVDDAKYYEEQIKRDRKGTATEFGAMAAVGEGRVASFTGRSPIVSRFSSRGPDIIDMHNNLADVLKPDILAPGHQIWAAWTPISALEPMLKGHDFALLSGTSMSTPHVAGIAALIKQYNPLWTPAMIASAISTTSSKYDNLGEHMMAEGFEASSLLPSTPFEYGAGFVSPNCAIDPGLVLSSEHQDFISFLCSLPNMDTDAIIAATGEQCNHPFAYPFSLNIPSVTISALRGSVSVWRTFMSVGNNTETYLASVQPPNGTKVYLYPTWFTISPQGTQDLEIQLSVIQPMSNFTFGEIVLTGNLNHIVRITLSVLAISV

SEQ ID NO: 231836 - protein, 70 aa, Glycine max
  Coding DNA Sequence Number=SeqID_115058
MPQAESYKDAGKLKKAGPNQFSEDFMLKDNDSEVVLVEGVVGDGEKNRGVLGLDGSEDEANYDICMGLLP

SEQ ID NO: 231837 - protein, 702 aa, Glycine max
  Coding DNA Sequence Number=SeqID_115059
  Homolog annotation: Hit_ID=Q84UR3; Match level="QueryCoverage=38%, HitCoverage=33%, E-value=5e-73, Identity=54%"; Hit description =Proline-rich protein family-like
  Subcellular localization annotation: CTP_CleavageSite=41; ConfidenceScore=5.76e-01
MVAGKVKLSMGFPKSLAPPTPPHSTPGNSSFTRSFGAYFSRSSAQVQPRPSDILDLLRLVEDLRDRESRLKTELLEHKLLKETVTIVPLLENQISASDAQLEINAKKMEQVEAENEKLRNELEELKLRMEEEKTENMRKTKALEDEIAELNKTASDPVCKALVNDEDSSLECKSFENDEHLQTPLEVPARPNFIKSLKKTALDHTSVNHKQLVVVVADFKPEVAESERPRRDSEELADSAESSLTRSRAPRVPKPPPRRSLSSSTLLSSKNGNFKMEQVISQPPRVAPPPPPPPPRAASKSAPPPPPPPLKGSRQVTAKVRKIPEVVEFYHSLMRRESQSRRESVSGDVEVPPTTANPRDMIGEIENRSSHLLAIKTDVETQGDFIRCLIKEVEGAAFTDIEDVVLFVKWLDDELSYLVDERAVLKHFDWPEQKADALREAAFGYCDLKKLESEASSFRDDPRQPCGPALKKMQVLFEKLEHGVFNISRMRESATNRYKVFHIPVHWMLDNGFVSQMKLASVKLAMKYMRRVSAELETGGGGGPEEEEIVVQGVRFAFRAHQFAGGFDVETMRAFQELRGKAMSCNLQCHSQQQKFFCSGELQTQFGKKNEFDMFDFFPKVYWNTFSNSVYKFKFDPNLSLQTKIQTCTRMTLILPGAIIIHPFIKLLMNDWERETRHALNQKHQLFPLVHVGVAIPPKPLP

SEQ ID NO: 231838 - protein, 82 aa, Glycine max
  Coding DNA Sequence Number=SeqID_115060
MEIRFEPNICHQIGNETRTTKATAKTCSLLRSEVALVGHGGEEEELGFEKEKGKLKVESSRGKDYFVQWSRKVSHCEGQFTC

SEQ ID NO: 231839 - protein, 593 aa, Glycine max
  Coding DNA Sequence Number=SeqID_115061
  Pfam annotation: Domain name=F-box; Domain location=20-67; Score =31.9; E_value=2.2e-06; Accession=PF00646.23; Description=F-box domain
  Pfam annotation: Domain name=F-box; Domain location=279-326; Score =32.6; E_value=1.4e-06; Accession=PF00646.23; Description=F-box domain
  Pfam module annotation: Pfam domain module=F-box::F-box; Domain location=20-67::279-326
MMISKVDSLRRKMRVEGVVVQWSDLPHDLLSRITNGLGPIDFLSFCGVCKDWRVASSKSSPQAPRINATPSTSQRPELDGATCLASYKGLTTEHVAALSSPPTSQDCIVAVLNRISDSELELFMLRRGENQWVQAKHSLLRIRFNTVRAALFHEGEELHFLDGDDNLVTFNASKTKQWEEFRLSYAKTIFNWRIIKKKLKVGLLEANVSISTCGTVIPHAGGELDMLIQSESIEPATHQSESRHHRKGVWIQPRYFYVPPGQKWVTSKVDSATYNKMTGEWSNLPHDLLSRISSGLGLIDFLSFRGVCKDWRVVSSKVSSEVKQSLGCDPWFLVYEEGEDSHSQCSLLSHQDQLYTINIPELDGATCLASYEGWLLLFRHGSLFFFSPFSRATIELPNCPFAEATDEHVAAFSSPPTSQNCIVAVVNRISDSELELFMLRRGESVWATRCCHGYKFKTMITGLFCEGKEFHFLDLKNGLAIFDSETKEWNKNNYRIRCQRSSRDISASSLRALRYVVRKNVFQDKSIRTVGLLLDDENVSISTCGTAIPHASVEFDQIVIKSESIEAAKQPESRHLKGVWIQPIYLCVPPGQT

SEQ ID NO: 231840 - protein, 286 aa, Glycine max
  Coding DNA Sequence Number=SeqID_115062
  Gene Ontology: Mol. function=binding; Cellular component=ubiquitin ligase complex; Biological process=protein ubiquitination
  Homolog annotation: Hit_ID=Q1SXA3; Match level="QueryCoverage=90%, HitCoverage=57%, E-value=8e-27, Identity=31%"; Hit description=IMP dehydrogenase/GMP reductase
  Pfam annotation: Domain name=Arm; Domain location=3-43; Score=8.7; E _value=1; Accession=PF00514.13; Description=Armadillobeta-catenin -like repeat
  Pfam annotation: Domain name=Arm; Domain location=46-85; Score=12.7; E_value=0.31; Accession=PF00514.13; Description=Armadillobeta -catenin-like repeat
  Pfam annotation: Domain name=Arm; Domain location=86-124; Score=2.9; E_value=5.3; Accession=PF00514.13; Description=Armadillobeta-catenin- like repeat
  Pfam module annotation: Pfam domain module=Arm::Arm::Arm; Domain location=3-43::46-85::86-124
MNSTRNKALIVEAGILSKLPKTIDLVDESTTSKLAEILLSLSSLANTQFPLASLDFIPLLRNILETGPSFDTKSSCLCALHNLSTVLENACPLVSSGVVPILLDVSSIKEISEKALATLGNLSVTLMGKKAIENNSMVPETFIEILSWEDKPKCQELSVYILMILAHQSSLQRKKMAQAGIVPVLLEVVLLGSPLAQKRAMKLLQWFKDERQTKVGPHSGPQTPRFAMGSPVNQREAKEGKRLMKSLVKQSLHRNMEIIAQRANAAGESSRLKSLIISTSSKSLPY

SEQ ID NO: 231841 - protein, 271 aa, Glycine max
  Coding DNA Sequence Number=SeqID_115063
  Homolog annotation: Hit_ID=Q1SYE0; Match level="QueryCoverage=79%, HitCoverage=19%, E-value=3e-89, Identity=75%"; Hit description=HASTY
MCRSWWARTSPRTESSTPLRRRSSKPKPQSRAWGQNKHDSEKKKKDVADDDIDDWELPHGIADTMGCLQREGRLLQGEHNLLGEAFLVMSSSAGIQQQQDVLRWLLEPLSVQWTQLEWQDKYLSGPHGLVQLCSDVPVMWSIFHTVTFFERALKRSGLKKANWNSENSSTPNSIPLNPMASRISWMVTPLLKLLRCIHSLWSPSVSQALPGEVRAAMVMGDVERFSLLGEGNSKLPKGVTDGSKIDMNKEGYTEPNESDIRNWFKGIRDSG

SEQ ID NO: 231842 - protein, 154 aa, Glycine max
  Coding DNA Sequence Number=SeqID_115064
  Gene Ontology: Mol. function=binding
  Subcellular localization annotation: CTP_CleavageSite=35; ConfidenceScore=5.62e-01
MSTPSSSSSSSSSIWVLSNIKLQFFARIRRFLQSKATRKRCDPSDRFDTAKSRVEHNNKVENLETVHVMEKHKEEEESVIMLQRTVKMLHFGSWEEKIVAAKEIEKLAKEDVKVSKLITELGVVPVLVSMVASPVASRRRVGLTALIHLADGTY

SEQ ID NO: 231843 - protein, 61 aa, Glycine max
  Coding DNA Sequence Number=SeqID_115065
  Homolog annotation: Hit_ID=Q9X9S9; Match level="QueryCoverage=46%, HitCoverage=13%, E-value=1e-09, Identity=96%"; Hit description =Cytochrome b6
MRRNIFTGYIIGNRLNFKTFFEPIIDFIEIGPYESTTKTSTSCDIHDDSKKPYMEVQKFPD

SEQ ID NO: 231844 - protein, 76 aa, Glycine max
  Coding DNA Sequence Number=SeqID_115066
MMAHQNPPYLAFCTPGQNETMNKIQGYQRETNENIHIFLNEHQGMKGMAFEKQHHIQHVQHLTNMQFTSSMAQNIS

SEQ ID NO: 231845 - protein, 144 aa, Glycine max
  Coding DNA Sequence Number=SeqID_115067
  Homolog annotation: Hit_ID=Q1T283; Match level="QueryCoverage=74%, HitCoverage=51%, E-value=2e-08, Identity=32%"; Hit description =Nucleic acid-binding, OB-fold
MTPFTCVCSKYNKEAVLRYRLEVMINQGNESTKFLLWDRECSELIGQSADAVSKLKIEDGDVDLNASPQALDKLLGHELAFKIKVQPKFRNSVVLKCSADSSFINVVMDTLADAETSSKMDIPVSDSNHSAQHESVSFDNCSHF

SEQ ID NO: 231846 - protein, 404 aa, Glycine max
  Coding DNA Sequence Number=SeqID_115068
  Gene Ontology: Mol. function=nucleotide binding
  Homolog annotation: Hit_ID=Q67XL6; Match level="QueryCoverage=85%, HitCoverage=56%, E-value=2e-98, Identity=53%"; Hit description=MRNA, complete cds, clone: RAFL25-35-C17
  Pfam annotation: Domain name=DUF246; Domain location=158-401; Score =201.8; E_value=1.6e-57; Accession=PF03138.5; Description=Plant protein family
  Subcellular localization annotation: CTP_CleavageSite=29; ConfidenceScore=5.65e-01
MVSASEPDRCSPTSRTPRRLSSSRRSQSQSSSSWYPRKRTKLLLALIAFLAFVFFLNWFMLLRLQHQHDAPDPIPKPTLRSSSVSLSLQGKWNKPANKKKSQKGNYARMLALAAHALAENKREPKDLWQEPFVPASSWRPCADQRNWEPNEGGNGYILVTANGGINQQRVAVCNAVVVARLLNSTLVIPKFMYSSVWRDVSQFSDIYQEEHFINYLTPDIRIVRQLPKELQSLDLEAIGSVVTDVDMEKEAKPSFYLKHILPIILKNQVVHFVGFGNRLAFDPIAFELQRFRCRCNFHALQFVPRIQETGALLLKRLREHSGLIGPLDRYLVGPFAESMKEKSESNAKKASKYLALHLRFEIDMVAHSLCEFGGGEEERKELEAYREIHFPALSLLKRTTKYAS

SEQ ID NO: 231847 - protein, 713 aa, Glycine max
  Coding DNA Sequence Number=SeqID_115069
  Gene Ontology: Mol. function=RNA-directed DNA polymerase activity; Cellular component=chromatin; Biological process=RNA-dependent DNA replication
  Pfam annotation: Domain name=RVP_2; Domain location=39-147; Score= -42.1; E_value=0.0019; Accession=PF08284.2; Description=Retroviral aspartyl protease
  Pfam module annotation: Pfam domain module=RVP_2::RVT_1; Domain location=39-147::270-501
MDPGPSRLPSPLPESVSVQISLHALSGHGALETLRLTGFICEHRVQILIDGGNTHNFLQQELVALLQLQPQETSTLRVTVGNGEELQCTQVCPNLAVKIQKHEFPVDLHVLPIRGADVVLGVQWLKALGPVLTDYTALTMKFIYNGQLIELVGDRDLSFQMISPSQLRRLVDTGNTSTFFHIKMEPSLETPMTITHPIPTVQKLFSKHAFLFQPLSTLPPSRATDHSITLLPNSAPVNVKPYRYPHFQKQEIETQVAAMLRQGHIQHSSSPFSSPVLLVKKRDGSWRFCVDYRALNAITVRDRFPIPTVDELLDELGGAVWFSKLDLMQGYHQILMRESDIGKTTFRTHHGHYEFRVMPFGLLQCSINVSSDDEQIVSAPLTKVLHYGQFTLKLTKCSFAQKKIEYLGHIVTGNGVQPVPEKEGHPISFFSKQFCPRLLQASTYVKELAAITAAVKKWRQYLLGRSFIILTDHKSLKELMNQAVQTPEQHKYLARLLGFDYVIQYRAGKRNIIADALSRSTPASLFIISVPHFVFLDELRRELQANPAFMELRRKVTTEPHAYPDHSLAQDLILYRGRIWLPQDCSFIKILLSEFHQSPSGGHMGFRKTLNHTLENFTWSTSTRDTRDFVSNCLDCQLVKYKTAKPRGLLCPLPVPSQPWDDLSMDFIVGLPAYRGSAPLNASLPSHITDGGSVIHGNGGEITWDASQYHLGS

SEQ ID NO: 231848 - protein, 81 aa, Glycine max
  Coding DNA Sequence Number=SeqID_115070
MDGKTCLLEGYRATFIPFLISERHTDTVDKAIYEFSGLNSFPDQCGFVSLVLSFLCCAYECGSKLVLALWIGLGIDVLYRL

SEQ ID NO: 231849 - protein, 367 aa, Glycine max
  Coding DNA Sequence Number=SeqID_115071
  Gene Ontology: Mol. function=metal ion binding; Cellular component =nucleus; Biological process=regulation of transcription, DNA -dependent
  Homolog annotation: Hit_ID=UPI000034F5B3; Match level="QueryCoverage =97%, HitCoverage=40%, E-value=1e-128, Identity=61%"; Hit description= transcription factor
KSSFEIEIPQSLCGDVERVYCDHCATSIIDFHRSCPYCSYELCLSCCQEIRDGSITPRAELKFPYVNRGYDYMHGGDPLPVPCDLETLEGHIEPSTVWNAKSDGSISCAPKELGGCGSAVLELRRILPDGWISDLEAKARNMLKIWEIEHTTLQQKEAVSSFTFLRKEAIREGINDNNIYYPESSNTQKEGLLLFQKHWANGEPIIVRDVLKQGTGLSWEPMVMWRALCENMVSEISSKMSEVKAIDCLANCEVEIDTHTFFKGYIEGRTYRDLWPEMLKLKDWPPSDKFEDLLPRHCDEFIRSLPFQEYSDPRAGILNLAVKLPAHVLKPDMGPKTYIAYGIKEELGRGDSVTKLHCDMSDAKMAP

SEQ ID NO: 231850 - protein, 212 aa, Glycine max
  Coding DNA Sequence Number=SeqID_115072
  Gene Ontology: Mol. function=metal ion binding; Cellular component =nuclear body; Biological process=regulation of transcription, DNA -dependent
  Homolog annotation: Hit_ID=Q6K7P0; Match level="QueryCoverage=64%, HitCoverage=13%, E-value=1e-54, Identity=70%"; Hit description =Putative DNA-binding protein PD3, chloroplast
  Pfam annotation: Domain name=JmjC; Domain location=66-177; Score =60.9; E_value=4e-15; Accession=PF02373.13; Description=JmjC domain
LKEAHKAQDEREQCAEERVADSLDDQPCKDNKEHIENKEVFEAKSMKKQPIEINENIFPNNVLEGFTSPAIENESMETGSALWDIFRREDSEKLETYLRKHSKEFRHTYCSPVEQVVHPIHDQCFYLTLEHKKKLKEEFGVEPWTFEQKLGEAVFIPAGCPHQVRNLKSCIKVAVDFVSPENIRECLRLTNEFRQLPKNHKAREDKLEVICF

SEQ ID NO: 231851 - protein, 188 aa, Glycine max
  Coding DNA Sequence Number=SeqID_115073
  Homolog annotation: Hit_ID=Q1T3M2; Match level="QueryCoverage=99%, HitCoverage=100%, E-value=2e-93, Identity=83%"; Hit description =Barwin-related endoglucanase
  Pfam annotation: Domain name=DPBB_1; Domain location=105-185; Score= -6.6; E_value=0.062; Accession=PF03330.8; Description=Rare lipoprotein A (RlpA)-like double
MKRFIPNASFILLATLILTSCFYSEAQKCRPSGRIRGKKAPPGQCNQENDSDCCKEGKMYTTYECSPPMSSNTKAYLTLNSFQKGGDGGGPSECDNQYHSDDTPVVALSTGWFNHKSRCLHNITISGNGRSVVAMVVDQCDSRKGCDAEHDYQPPCPNNIVDASKAVWKALGVPLNEWGGLDITWSDA

SEQ ID NO: 231852 - protein, 326 aa, Glycine max
  Coding DNA Sequence Number=SeqID_115074
  Gene Ontology: Mol. function=protein binding; Biological process =apoptosis
  Homolog annotation: Hit_ID=Q9FHI4; Match level="QueryCoverage=48%, HitCoverage=17%, E-value=5e-13, Identity=30%"; Hit description =Arabidopsis thaliana genomic DNA, chromosome 5, P1 clone:MFC19
MYIQTNSMKAVPLLLKHVRSIFLQRGRDELFDAKLEKLTLALNKIKDVFMGVRQNEDELLDVLVELDGHLRKLDKKKLDEEVDDICKRISDSALKLLPVENENKDEKSEKVPSDDDDPSSSQQHKKELEAQDLNLNLLWESYRKLGSKAKDCLLSLSVFPEDAVVKKRQAIYWWIGEGLVRETSQKTAEEEGEDVINQLLKFNVIVPHGNVLERRKIVLGDEDGLKPERLIHTVFNVGASYLDFRSDWSDKLENDLVVLQLGCWQDLPLHHIEVGSEEFLNELRNLMQLKYLGLRGISRISKLPPSIFSSYHSCKSDVQIFRRSNY

SEQ ID NO: 231853 - protein, 137 aa, Glycine max
  Coding DNA Sequence Number=SeqID_115075
  Gene Ontology: Mol. function=ATP binding; Biological process=apoptosis
  Homolog annotation: Hit_ID=Q8LJ95; Match level="QueryCoverage=71%, HitCoverage=15%, E-value=4e-09, Identity=36%"; Hit description=NBS -LRR resistance protein RGH1-like
MLDTLEEVDGHFRKLDKKRLDQEMDGICKRIGECAHKLLPMDDYDEEDHKSSEILHSSSTQHNNHLLLERYCMLRQQRSVCLLSLLVFPEHAIIKNLSTIYWWIGESYVENTEDKTAEEVGEDVIDELLKLNLIVPY

SEQ ID NO: 231854 - protein, 75 aa, Glycine max
  Coding DNA Sequence Number=SeqID_115076
MGSLKAWESCRHLNISKYHGECLKQGFPGQKVPEFLKPSKLPSGFKQLKIIGGKLQSMNDDDDVNKWGMEIVHLK

SEQ ID NO: 231855 - protein, 157 aa, Glycine max
  Coding DNA Sequence Number=SeqID_115077
  Gene Ontology: Mol. function=aminoacyl-tRNA ligase activity; Cellular component=mitochondrion; Biological process=embryonic development ending in seed dormancy
  Homolog annotation: Hit_ID=Q9XEA0; Match level="QueryCoverage=80%, HitCoverage=13%, E-value=2e-47, Identity=68%"; Hit description =Putative leucyl tRNA synthetase
MEGCYDLQMMGHSWIFSGDANSRATSVYWGWQWSRFHSYGRRIRNSAAKGGVSETEHNKQPVTRAYPFHEIELKWQRFWDHNRTFQTPDDDIDTSKPKYYVLDMFPYPSGAGLHVGHPLGYTATDILARYKRMQGYNVLHPMGWDAFGLPAEQYAIE

SEQ ID NO: 231856 - protein, 168 aa, Glycine max
  Coding DNA Sequence Number=SeqID_115078
  Gene Ontology: Mol. function=zinc ion binding; Cellular component =nucleus; Biological process=regulation of transcription
  Homolog annotation: Hit_ID=Q0GLE9; Match level="QueryCoverage=57%, HitCoverage=100%, E-value=5e-39, Identity=80%"; Hit description=Dof3
  Pfam annotation: Domain name=zf-Dof; Domain location=37-99; Score =128.7; E_value=1.6e-35; Accession=PF02701.6; Description=Dof domain, zinc finger
MGEESQGIKLFGALITLKGGEVKKGEKGSEYERVEKRAEKIIPCPRCKSMETKFCYFNNYNVNQPRHFCKSCQRYWTAGGALRNVAVGAGRRKAKSPCHGAGDFMDGRAYETSEDENRFFRPSARESPQELSIKVNEIMYENTTWNYYEQEIKDFSSEGPKRVLRIKM

SEQ ID NO: 231857 - protein, 369 aa, Glycine max
  Coding DNA Sequence Number=SeqID_115079
  Gene Ontology: Mol. function=cysteine-type endopeptidase activity; Cellular component=lysosome; Biological process=proteolysis
  Homolog annotation: Hit_ID=Q84Y03; Match level="QueryCoverage=90%, HitCoverage=87%, E-value=7e-80, Identity=48%"; Hit description =Cysteine protease
  Pfam annotation: Domain name=Inhibitor_I29; Domain location=56-115; Score=72.1; E_value=1.8e-18; Accession=PF08246.2; Description =Cathepsin propeptide inhibitor domain (
  Pfam annotation: Domain name=Peptidase_C1; Domain location=141-354; Score=280.7; E_value=2.9e-81; Accession=PF00112.13; Description =Papain family cysteine protease
  Pfam module annotation: Pfam domain module=Inhibitor_I29::Peptidase _C1; Domain location=56-115::141-354
MMIPHTSNLFLLFFFMTCTTLICLSSSSCGIPDQYNSILGPNLDKLPSQEEAMQLFQLWKKEHGRVYRDLEEMAKKFEIFVSNVKNIIESNAKRSSPSSYLLGLNQFADWSPYELQETYLHNIPMPENISAMDLNDSPCSAPPSVDWRPIAVTAVKNQKDCGSCWAFSATGAIEGASALATGKLISVSEQELLDCAYSFGCGGGWIDKALDWVIGNRGIASEIDYPYTARKGTCRASTIRNSVSIDGYCPIAQSDNAFMCATAKYPIGFYFNVVNDFFQYKSGIYDGPNCPVSSTFINHAMLIVGYGSIDGVGFWIVKNSWDTTWGMCGYALIKRDTSKPYGVCGIHAWPAYAATKCIGSVNPSIISSI

SEQ ID NO: 231858 - protein, 1017 aa, Glycine max
  Coding DNA Sequence Number=SeqID_115080
  Gene Ontology: Mol. function=transferase activity; Cellular component= integral to membrane; Biological process=response to oxidative stress
  Homolog annotation: Hit_ID=Q2HRE0; Match level="QueryCoverage=99%, HitCoverage=99%, E-value=0.0, Identity=68%"; Hit description=C2
  Pfam annotation: Domain name=C2; Domain location=276-356; Score=98.8; E_value=1.7e-26; Accession=PF00168.20; Description=C2 domain
  Pfam annotation: Domain name=C2; Domain location=441-521; Score=68.3; E_value=2.4e-17; Accession=PF00168.20; Description=C2 domain
  Pfam annotation: Domain name=C2; Domain location=6-91; Score=86.5; E _value=7.9e-23; Accession=PF00168.20; Description=C2 domain
  Pfam annotation: Domain name=C2; Domain location=609-699; Score=60.0; E_value=7.5e-15; Accession=PF00168.20; Description=C2 domain
  Pfam annotation: Domain name=PRT_C; Domain location=862-1017; Score =361.2; E_value=1.7e-105; Accession=PF08372.1; Description=Plant phosphoribosyltransferase C-terminal
  Pfam module annotation: Pfam domain module=C2::C2::C2::C2::PRT_C; Domain location=276-356::441-521::6-91::609-699::862-1017
MNNLKLGVEVASAHDLVPKDGQGSSSTYVELHFDGQRFRTTTKNKDLSPFWNESFYFTITDPSKLPSLTLEACIYHYNKDNGSNVLLGKVRLTGTSFVSYSDAVLLHYPLEKKNIFSRSKGEIGLKVFVTDDPSVRASNLLPAVESFFNTDQNENLTEYQSPPPVSFTNSIQNNMSRKKTEPRHTFHNIAKSSNEQKQQSKPAADAKPSVTFGIHEMKSSQAPPKVVQAFAGPQEFSVKETSPTLGGGKVVGGRVIRGSLPATSSSYDLVEPMQYIFVRVVKARDLPSMDMTGSLDPYVEVKVGNFKGITNHFEKNQNPEWNKVFAFAKDNQQSFILDVTVKDKDRISDDVVGTVRFYDLHDIPKRIPPDSPLAPQWYWIENKNGEKRGELMLAVWRGTQADEAFQDAWHSDAVVSPDGSTISNYAQIRSKVYMSPRLWYVRVKVLEAQDLVSSDKSKVPDVYVKVHIGNQITKTKPLRAMNPQWNHEALFVAAEPFEEPLVFTVEERVGGNKDETIGNVVIPLSRIEKRADDRPIRDNWYLLEKYMSSAMEEQAKKQEKEKEKDKFFSRIRVIAFLDGGYHVLDESTYYSSDLRPTSRQLWKKPIGVLELGILNADVLPVPTKNRDGRGTADTYCVAKYGHKWVRTRTIANNLNPMFHEQYTWEVYDIATVLTLGVFDNAQITNSSNGNKDSKIGKVRIRISTLEAGRVYTHSYPLLSVQNSGLKKNGDVHLAIRFSYTSMFDTMALYFKPHLPKMHYTKPLNIMDQERLRLQAVLIVASRLGRAEPPLRKEVVEYMSDSESHLWSMRRSKANFNRLKEVFSGLFAFGIWFGQIAKWKNTFVTVLLHILYLMFMCFPELILPTVFLYVFVIGMWKWRFRPRYPPHMDASLSCAHVTSPEDFDEEMDTFPTTKSMDIVRWRYDRLRSLAGKVQSVVGQIATQGERLHALINWRDPRATSIFMVFCLVTAIVLYVTPPKMLFILSGFYLMRHPKFRGKTPGAPVNFFRRLPSLTDSML

SEQ ID NO: 231859 - protein, 215 aa, Glycine max
  Coding DNA Sequence Number=SeqID_115081
  Homolog annotation: Hit_ID=Q2HRE8; Match level="QueryCoverage=97%, HitCoverage=54%, E-value=4e-84, Identity=66%"; Hit description =Lipopolysaccharide-modifying protein
  Pfam annotation: Domain name=DUF821; Domain location=21-215; Score =98.7; E_value=1.7e-26; Accession=PF05686.3; Description=Arabidopsis thaliana protein of unknown function (DUF821)
MTYTCPKDYYPTKLEQDQDSSTASTCPEYFKWIHEDLKPWKRTGITREMMERGRNVSYFRLVIKQGKAYAEMYADSYETRDVFTIWGILQLLRLYPGNVPDLELLFETGDKPVVGKEHFQGTPPPIFHYCGHKNAYDIVFPDWSFWGWAELAIKPWEALLQNIDEGNKKIKWKDRLPYAFWKGNTWVSHKRNDLTKCNASDQHDSYAQIHPLLNV

SEQ ID NO: 231860 - protein, 84 aa, Glycine max
  Coding DNA Sequence Number=SeqID_115082
MRYLAPSYDYIKKRAIASAGTYVTIFLGFHAETLKRVYVAILGVLAVVVVPLEIYRCKSQIMHHAVIIHRELWNRSRRKLMKLC

SEQ ID NO: 231861 - protein, 795 aa, Glycine max
  Coding DNA Sequence Number=SeqID_115083
  Gene Ontology: Mol. function=aminoacyl-tRNA ligase activity; Cellular component=mitochondrion; Biological process=embryonic development ending in seed dormancy
  Homolog annotation: Hit_ID=Q9XEA0; Match level="QueryCoverage=99%, HitCoverage=79%, E-value=0.0, Identity=76%"; Hit description =Putative leucyl tRNA synthetase
  Pfam annotation: Domain name=Anticodon_1; Domain location=619-766; Score=12.5; E_value=2.2e-06; Accession=PF08264.3; Description =Anticodon-binding domain
  Pfam annotation: Domain name=tRNA-synt_1; Domain location=2-575; Score=-311.1; E_value=2.5e-06; Accession=PF00133.12; Description =tRNA synthetases class I (I, L, M and V)
  Pfam module annotation: Pfam domain module=Anticodon_1::tRNA-synt_1; Domain location=619-766::2-575
LKSLGFSYDWDREVSTIEPDYYKWTQWIFLQLLKRGLAYQAEVPVNWCPALGTVLANEEVIDGVSERGGHPVIRKPMRQWMLKITAYADRLLEDLDDLDWPESVKEMQRNWIGRSEGAEMEFCILDSDGKERDITIIVYTTRPDTIFGATYLVVAPEHPLLSSLVSIAQSKHVEDYVDLASRKSDLERTELQKEKTGVFTGCYAKNPANGEAIPIWVADYVLGSYGTGAIMAVPAHDSRDYEFALKYDVPICWVVMPDDKSIESGKAFSGEGTIVNSSNTLVGLDINGLSSNEAALKVIEWAEKSGNGKRKVNYKLRDWLFARQRYWGEPIPVIFLDDSDETVPLCETELPLILPELDDFSPTGTGEPPLSKAVSWVKTTDSLSGRPATRETNTMPQWAGSCWYYLRFMDPHNSKELVDKTKERYWGPVDVYVGGAEHAVLHLLYARFWHKVLFDIGVVSTKEPFQCVINQGIILGEVQYMTCRDQVGNLISADSTDMLNEHKLEIIPAEKVMKSGDSFVLKEHPDIRLFARAHKMSKSRGNVVNPDDVVSEYGADSLRLYEMFMGPLRDSKTWSTSGIEGVHRFLGRTWRLIVGSPLSDGTFKDRTVSVDEEPTIEQLRCLHKCIAKVTEEIEGTRFNTGISAMMEFLNAAYKPCGSEPMVPGKARKIEMWDKHPRSVIEAFVLLLSPYAPHMAEELWSRLGHTKSLAYEPFPKANPAYLKDSTVVLPVQINGKTRGTIQVEETCTEEDAFVLASRDEKLSKYLDGQSVKKRIYVPGKILNVVLDRKNIKVGVQ

SEQ ID NO: 231862 - protein, 162 aa, Glycine max
  Coding DNA Sequence Number=SeqID_115084
  Gene Ontology: Mol. function=carboxypeptidase activity
  Homolog annotation: Hit_ID=Q8RUC0; Match level="QueryCoverage=78%, HitCoverage=35%, E-value=5e-21, Identity=45%"; Hit description=Leaf senescence protein-like
  Pfam annotation: Domain name=DUF231; Domain location=49-162; Score= -55.3; E_value=0.0042; Accession=PF03005.6; Description=Arabidopsis proteins of unknown function
MVSNQAKHTSTTHLSPTPRTYIYVDEADKAWASHIENFDYVIFSGGQWFFRPLTFYENGQVVGCQKCHNLMEDPQNLYGYRHAFRTAFRTVINLKGFKGMVFMVSHSPNHFENGEWNKGGGCNRTLVWRSFTRHKWRNSQLQRERFAFRVDQYNCRYAYEIS

SEQ ID NO: 231863 - protein, 83 aa, Glycine max
  Coding DNA Sequence Number=SeqID_115085
  Homolog annotation: Hit_ID=O65456; Match level="QueryCoverage=83%, HitCoverage=17%, E-value=1e-07, Identity=40%"; Hit description =Putative pectate lyase 16 precursor
MALVHDPNTKQVTKKEGKEKWKSWKWRSSKDLFLNGAHLVPSGFGTCAPNYSPTQSFTAAPAYMVPAMTLNAGPTICVVGRAC

SEQ ID NO: 231864 - protein, 114 aa, Glycine max
  Coding DNA Sequence Number=SeqID_115086
  Homolog annotation: Hit_ID=Q9SZ28; Match level="QueryCoverage=87%, HitCoverage=66%, E-value=5e-12, Identity=31%"; Hit description=STIG1 like protein
  Pfam annotation: Domain name=Stig1; Domain location=1-114; Score =84.7; E_value=2.9e-22; Accession=PF04885.4; Description=Stigma -specific protein, Stig1
MALAVFVSAISPGSEKPKGKINRFLSDRVVLTCEKYPEVCLIKGSAGSDCCKNKCVNLSTDVSNCGKCGKKCSYGKICCEGKCVNPRTNEKHCGKCDNKCNSESSCIYGMCSYA

SEQ ID NO: 231865 - protein, 291 aa, Glycine max
  Coding DNA Sequence Number=SeqID_115087
  Homolog annotation: Hit_ID=Q9FGR6; Match level="QueryCoverage=67%, HitCoverage=60%, E-value=2e-14, Identity=28%"; Hit description =Arabidopsis thaliana genomic DNA, chromosome 5, TAC clone:K6A12
MLLLILIHSLLLSLTTRAQSTPCRTSCGDIPIEYPFGIDDGCGSPYYRYILVCSDSGKLQVRTPSGRYHVHNVSYADPHILVTDPFMWNCDDGENYRPTRPFSLDTSTRFKLSPQNEYLFFNCSEDHVIVKPKPIFCERFPERCDSSCDSGSYLCRHMPGCSFAMTGSSCCSYSPRSIESLRLMLKYCTSYTSVYWRNVGAPQPHDQVPEYGIRIDFDIPVTTRCLQCQDPSKGDYDAARHNRKVHVIAGTVSGVSAAGAFGIGAGIWYLKKVRAKAPVTCGVQSNENRLF

SEQ ID NO: 231866 - protein, 693 aa, Glycine max
  Coding DNA Sequence Number=SeqID_115088
  Gene Ontology: Mol. function=carboxypeptidase activity
  Homolog annotation: Hit_ID=Q8RV74; Match level="QueryCoverage=75%, HitCoverage=85%, E-value=3e-78, Identity=37%"; Hit description=Leaf senescence protein-like
  Pfam annotation: Domain name=DUF231; Domain location=236-401; Score =123.9; E_value=4.5e-34; Accession=PF03005.6; Description=Arabidopsis proteins of unknown function
  Pfam annotation: Domain name=DUF231; Domain location=425-585; Score =50.3; E_value=6.2e-12; Accession=PF03005.6; Description=Arabidopsis proteins of unknown function
  Pfam module annotation: Pfam domain module=DUF231::DUF231; Domain location=236-401::425-585
GICPVLKFEATKMSGSIPKGAFLLPLTLFLIVLLLPLFRNFIQSSPKTYASNLETKETRRCNIFSGNWVPYPKEPYYNNETCPFILDQINCIKNGRPDRDFLKLRWKPHHCELPLFDATQFLELVRGKSMAFVGDSMGRNQLESLLCLINTVAHPEDITEKYTSNDNIFFRWWFVPDYNFTVTTMWSPFLVKFNDSDPTGRGFYSATKLYLEEADEAWRSKIKDFDFVVFSTGQWFFRPLTFYEKGQVVGCQKCENSTELNYYGYKKAFQTAFRTIRKLEGFKGLAFLVTHSPEHFENGAWNEGGTCNRTKPFEEKGVYENGDIVEALHQIQVEEFNAAREKGLRFGLIDITDAMGMRADAHPGRFRLGGNNNNNLNVNDCVHWCSPGAVDTWNEFLLYLMKLEAEIQHKHKVKSVDADPNASSFYRATKLYLDEADRAWAIVGCQRCEKNMTELNFYGYNRAFRTAFRTVIDFNGFKGLTFLVPHSPEHFENGLWNEGGMCNRTKPFTMEERGVYKNGDILETLHQIQTEEFEEAEKETRKKGLMGHPSRYGKVVDKNVTVSDCVHWCMPGPIDTWNEFLIYVMKLEGENDTMHHEAVKVLLFLLFHVTQVKDRVGCGSFTLEEGDGGCNDHGKMEGERGGDEKRGKPDECELPLFDAKQFLKVVRVKYMAFVGDSIGRNQMESLLCLLNSA

SEQ ID NO: 231867 - protein, 435 aa, Glycine max
  Coding DNA Sequence Number=SeqID_115089
  Gene Ontology: Mol. function=protein binding; Cellular component =integral to membrane; Biological process=xylan catabolic process
  Homolog annotation: Hit_ID=Q1S5Q1; Match level="QueryCoverage=94%, HitCoverage=91%, E-value=3e-83, Identity=30%"; Hit description =Leucine-rich repeat; Leucine-rich repeat, cysteine-containing type
  Pfam annotation: Domain name=LRR_1; Domain location=112-134; Score =7.8; E_value=10; Accession=PF00560.23; Description=Leucine Rich Repeat
  Pfam annotation: Domain name=LRR_1; Domain location=136-155; Score =4.9; E_value=35; Accession=PF00560.23; Description=Leucine Rich Repeat
  Pfam annotation: Domain name=LRR_1; Domain location=158-180; Score =16.0; E_value=0.14; Accession=PF00560.23; Description=Leucine Rich Repeat
  Pfam annotation: Domain name=LRR_1; Domain location=182-203; Score =10.7; E_value=2.8; Accession=PF00560.23; Description=Leucine Rich Repeat
  Pfam annotation: Domain name=LRR_1; Domain location=21-43; Score =13.2; E_value=0.96; Accession=PF00560.23; Description=Leucine Rich Repeat
  Pfam annotation: Domain name=LRR_1; Domain location=262-284; Score =13.9; E_value=0.6; Accession=PF00560.23; Description=Leucine Rich Repeat
  Pfam annotation: Domain name=LRR_1; Domain location=286-308; Score =16.5; E_value=0.095; Accession=PF00560.23; Description=Leucine Rich Repeat
  Pfam annotation: Domain name=LRR_1; Domain location=310-331; Score =9.3; E_value=5.2; Accession=PF00560.23; Description=Leucine Rich Repeat
  Pfam annotation: Domain name=LRR_1; Domain location=68-87; Score=1.0; E_value=1.8e+02; Accession=PF00560.23; Description=Leucine Rich Repeat
  Pfam annotation: Domain name=LRR_1; Domain location=88-110; Score =19.9; E_value=0.0093; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=112 -134::136-155::158-180::182-203::21-43::262-284::286-308::310-331::68- 87::88-110
LDLDNTNQGAKLPSWIYTQKSLEYLDISSSGITFVDEDRFKRLIAGNYFMLDMSNNSINEDISNVMLNSSFIKLRHNNFSGRLPQLSNVQYVDLSHNSFTGSIPPGWQNLNYLFYINLWSNKLFGEVPVELSNLTRLEVMNLGKNEFYGTIPINMPQNLQVVILRYNHFEGSIPPQLFNLSFLAHLDLAHNKLSGSIPQVTYNITQMVRSEFSHSFVDDDLINLFTKGQDYEYNLKWPRATVDLSANNLTGEIPLELFGLIQVQTLNLSYNHLIGTIPKTIGGMKNLESLDLSNNKLFGEIPQTMTTLSFLSYLNMSCNNFTGQIPIGTQLQSFDASSYIGNPELCGAPLPKCNTEDNNHGNATENTDGDSEKESLYLGMGVGFAVGFWGFCGSLLLLRKWRHKYYRFFDRLADQLYVTYMGKFNIFVNREAPVS

SEQ ID NO: 231868 - protein, 84 aa, Glycine max
  Coding DNA Sequence Number=SeqID_115090
MADSLPEKSVQDSKPTETVKGKDLDINGGTFATVDSASEWQKGGWNMEGGNSTNGQIKPQTATVSIQCNHLLVINAVKHFKLTL

SEQ ID NO: 231869 - protein, 106 aa, Glycine max
  Coding DNA Sequence Number=SeqID_115091
  Pfam annotation: Domain name=GRP; Domain location=20-99; Score=-28.4; E_value=0.062; Accession=PF07172.2; Description=Glycine rich protein family
MMMTVIVVVVVEVTIALMVTVVTMTITMMIMIMITVSDSSYDACDYNGDSGVMVVLTTIMLTSDNNDSGPRCYGGDGGGEYDGDGGGDNGGSGGNDGRGDDSGVVK

SEQ ID NO: 231870 - protein, 211 aa, Glycine max
  Coding DNA Sequence Number=SeqID_115092
  Gene Ontology: Mol. function=galacturonate binding; Cellular component=plasma membrane; Biological process=cell-cell signaling
  Homolog annotation: Hit_ID=P93788; Match level="QueryCoverage=86%, HitCoverage=78%, E-value=6e-28, Identity=41%"; Hit description =Remorin
  Pfam annotation: Domain name=Remorin_C; Domain location=69-208; Score= 151.8; E_value=1.8e-42; Accession=PF03763.4; Description=Remorin, C -terminal region
  Pfam annotation: Domain name=Remorin_N; Domain location=15-69; Score =32.6; E_value=1.3e-06; Accession=PF03766.4; Description=Remorin, N -terminal region
  Pfam module annotation: Pfam domain module=Remorin_C::Remorin_N; Domain location=69-208::15-69
MAELQSKSETAPAPAPVVAEVPSNDAVAKKASETGESKAIVSVSEKTPVPANKQSSRGSIDRDIALAEVEKEKKLSYVKAWEESEKAKAENRQDFMYFNSHDDDDMPFHRLFDPSCKFPIAQKHLSAIAAWENSKKAALEAELKKLEEQLEKKKAEYGEKMKNKVALVHKEAEEKRAMIEAKRGEEILQTEEMAAKYRATGTTPKKTIGCF

SEQ ID NO: 231871 - protein, 52 aa, Glycine max
  Coding DNA Sequence Number=SeqID_115093
MSRGDGVIEDNNSSIYSNSNEVANVGSGNGGLGVTVLSILSRDLGDFYSIDI

SEQ ID NO: 231872 - protein, 241 aa, Glycine max
  Coding DNA Sequence Number=SeqID_115094
  Gene Ontology: Mol. function=protein binding; Cellular component =integral to membrane; Biological process=defense response to fungus
  Homolog annotation: Hit_ID=Q1S5Q4; Match level="QueryCoverage=86%, HitCoverage=26%, E-value=5e-28, Identity=37%"; Hit description =Leucine-rich repeat
  Pfam annotation: Domain name=LRRNT_2; Domain location=35-75; Score =38.4; E_value=2.6e-08; Accession=PF08263.3; Description=Leucine rich repeat N-terminal domain
  Pfam annotation: Domain name=LRR_1; Domain location=104-131; Score =1.7; E_value=1.3e+02; Accession=PF00560.23; Description=Leucine Rich Repeat
  Pfam annotation: Domain name=LRR_1; Domain location=132-156; Score =0.4; E_value=2.4e+02; Accession=PF00560.23; Description=Leucine Rich Repeat
  Pfam annotation: Domain name=LRR_1; Domain location=158-179; Score =2.9; E_value=81; Accession=PF00560.23; Description=Leucine Rich Repeat
  Pfam annotation: Domain name=LRR_1; Domain location=182-202; Score =11.3; E_value=2.1; Accession=PF00560.23; Description=Leucine Rich Repeat
  Pfam annotation: Domain name=LRR_1; Domain location=204-226; Score =11.8; E_value=1.8; Accession=PF00560.23; Description=Leucine Rich Repeat
  Pfam annotation: Domain name=LRR_1; Domain location=80-102; Score =3.0; E_value=80; Accession=PF00560.23; Description=Leucine Rich Repeat
  Pfam module annotation: Pfam domain module=LRRNT_2::LRR_1::LRR_1::LRR_ 1::LRR_1::LRR_1::LRR_1; Domain location=35-75::104-131::132-156::158 -179::182-202::204-226::80-102
MVSSISQTSILLLLLFYASTFQKGMSNNLREVRCNEKDRQTLLIFKQGIVRDPYNKLVTWSSEKDCCAWKGVQCDNTTSRVTKLDLSTQSLEGEMNLALLELEFLNHLDLSMNNFNAISIPSIPNDVISDSNLQYLDLSLSGYNLSMDNLNWLSQLSSLKQLDLRGTDLHKETNWLLAMPPSLSNLYLRDCQLTSISPSANLTSLVTVDLSYNNFNSELPCWLFNLSNDISHLDLSWSSLH

SEQ ID NO: 231873 - protein, 98 aa, Glycine max
  Coding DNA Sequence Number=SeqID_115095
MIDDLLTHKLDLVHERGRDAKVKCKSHGFRVQRARMKDQGVMRECWVTDSGCDENGTALQCEAATRVSLCVVSLELWRKIQRKGSQEREVREWKRLRA

SEQ ID NO: 231874 - protein, 784 aa, Glycine max
  Coding DNA Sequence Number=SeqID_115096
  Gene Ontology: Mol. function=nucleic acid binding
  Homolog annotation: Hit_ID=Q8H4R8; Match level="QueryCoverage=93%, HitCoverage=96%, E-value=6e-73, Identity=27%"; Hit description =Pentatricopeptide repeat-containing protein-like protein
  Pfam annotation: Domain name=PPR; Domain location=249-283; Score =14.3; E_value=0.15; Accession=PF01535.11; Description=PPR repeat
  Pfam annotation: Domain name=PPR; Domain location=322-356; Score=8.1; E_value=0.83; Accession=PF01535.11; Description=PPR repeat
  Pfam annotation: Domain name=PPR; Domain location=489-523; Score =16.0; E_value=0.096; Accession=PF01535.11; Description=PPR repeat
  Pfam annotation: Domain name=PPR; Domain location=524-558; Score =22.8; E_value=0.0012; Accession=PF01535.11; Description=PPR repeat
  Pfam annotation: Domain name=PPR; Domain location=631-665; Score =29.7; E_value=9.9e-06; Accession=PF01535.11; Description=PPR repeat
  Pfam annotation: Domain name=PPR; Domain location=706-740; Score=0.2; E_value=7.1; Accession=PF01535.11; Description=PPR repeat
  Pfam module annotation: Pfam domain module=PPR::PPR::PPR::PPR::PPR::PP R; Domain location=249-283::322-356::489-523::524-558::631-665::706 -740
  Subcellular localization annotation: CTP_CleavageSite=81; ConfidenceScore=5.47e-01
MLAIRKLKTGPDIPFVLYVMVANCNYGTARVSSNKSVQSIVKSVGSYLANSSSQAFPLGSENKFTLQGLYFSSVAERILVQAQDPAKVSLEIQNAIDDNQLDYSWKLFEQHMHMEGFPRKFVISKLVTSYVDSLDVQYLEKAYELVERAIEEGKQDLLEKEVLIYLSFGLAKARLPVLSSTVLRKMIAMEHFPPVTAWSAVLAHMSQTAEGSYLAAELILEIGYLFQNNRVDPRKKSNAPLIAMKPNAAAFSIALAGCLLFETSRKAEELLDMMPRIGIKADANLLIIMARVYERNGRREELKKLQRHMEEAPNLNDLQFRQFYNCLLTCHLKFRDLDSASNMILEMLSKAKEARNSLAAAKFMTNAADIDRSHSPGLASVHSLNNSEDLDSLQNNRSITNAVLSYEEFSIDRNFLRLELESKAILGSLLAKLQMQVDLITTKHGILQPTETIYVKLVKAFLEAGKTKDLAVFLLKAEREDSPFSNDNSALVHVINACISLGWLDQAHDLLDEMRLAGVRTGSSVYSSLLKAYCRANRAADVTSLLRDAKIAGIQLDSSSYEAMIQSRVLQQDTQGALQLFKERKEARIPKVTQQNSGMMAKSGAETDEAGLVTKLLQEIKEGQSVDCGVHDWNNVIHFFCKKRLMQDAEKALKKMRSLGNSPNAQTFHSMVTGYAAVGGNYQEVTELWGEMKALASSISMKFDQELLDSVLYTFVRGGFFVRANEVVAMMEKGKMFVDKYKYRMLFLKYHKSLYKGKAPKFQTESQLNKREAALAFKRWIGLN

SEQ ID NO: 231875 - protein, 286 aa, Glycine max
  Coding DNA Sequence Number=SeqID_115097
  Gene Ontology: Mol. function=oxidoreductase activity; Cellular component=microsome; Biological process=metabolic process
  Homolog annotation: Hit_ID=Q2HVK6; Match level="QueryCoverage=97%, HitCoverage=97%, E-value=1e-124, Identity=78%"; Hit description =Short-chain dehydrogenase/reductase SDR
  Pfam annotation: Domain name=3Beta_HSD; Domain location=10-201; Score= -148.6; E_value=0.053; Accession=PF01073.9; Description=3-beta hydroxysteroid dehydrogenaseisomerase family
  Pfam annotation: Domain name=KR; Domain location=10-175; Score=-85.1; E_value=0.02; Accession=PF08659.1; Description=KR domain
  Pfam annotation: Domain name=adh_short; Domain location=7-187; Score =36.7; E_value=2.1e-08; Accession=PF00106.15; Description=short chain dehydrogenase
  Pfam module annotation: Pfam domain module=3Beta_HSD::KR::adh_short; Domain location=10-201::10-175::7-187
MTQAKLRYAVVTGANKGIGLETVNQLASNGVKVVLTARDEDRGHEAIERLKECGLSDFVIFHQLDVTDSASIVSLVEFVKTQFGRLDILVNNAGISGVNPYETEGSTINWKELAQTCEMAEKCLTTNYYGAKETTEAFLPLLQLSNSPRIVNVSSQAGLLKGIANELAKGVFDDAENLTEDRIDEVLKEFIKDFKEGSLKKKGWPTFLSAYMVSKAAMNSYTRILAKKHQNFCINCVCPGFVKTDINRNTGFLSVDQGAASVVRLALLPNASPSGLFYSRQELSNF

SEQ ID NO: 231876 - protein, 180 aa, Glycine max
  Coding DNA Sequence Number=SeqID_115098
  Gene Ontology: Mol. function=RNA-directed DNA polymerase activity; Biological process=RNA-dependent DNA replication
  Pfam annotation: Domain name=AT_hook; Domain location=66-78; Score =16.8; E_value=0.029; Accession=PF02178.9; Description=AT hook motif
MRMLRWMCGKTRQDKIRNEAIRERVGVAPIVEKMVENRLRWFGHVERRPVDSVVRRVDQMERRQTIRGRGRPKKTIKEVIKKDLKINGLDRSSLLQFSSPVAMQTSTPELLDRLPTSGEQFPLPNHIMGTIKMKIQWDKTSISPHDSQNLRCIYCCWYAPSSARHQKKHVSQRYLSYTLM

SEQ ID NO: 231877 - protein, 518 aa, Glycine max
  Coding DNA Sequence Number=SeqID_115099
  Gene Ontology: Mol. function=protein serine/threonine kinase activity; Cellular component=chromosome, telomeric region; Biological process=protein amino acid phosphorylation
  Homolog annotation: Hit_ID=Q2HRF6; Match level="QueryCoverage=73%, HitCoverage=79%, E-value=1e-165, Identity=67%"; Hit description =Tyrosine protein kinase, active site
  Pfam annotation: Domain name=RIO1; Domain location=163-323; Score =274.4; E_value=2.3e-79; Accession=PF01163.12; Description=RIO1 family
MAAPGTEEAVSCVSNSTHTAMENDDEHKLHNHREQVQEQEQENEEEEQEDEVWSSSDSEIGEALDWLDSREEDEGSSFSLTSWRPNAHGGHHHHSSTLQPLANRNQKFSHHIRASPLEEWEGRMNVGMSNSVTTAIRSSVRDLAIGKTKTTEKADRATVEQANVYHATKSDGQELAIKVYKTSVLVFKDRDRYVQGDFRFRNGYCKHNPRKMVKTWAEKEMRNLMRLKAAGIRCPTPYLLRLHVLVMEFIGKSGWAAPRLKDAALSLDKLREGYVEGHLYIIDVSQAVDPEHPHALDFLREDCVHVSDFFKKHGVAVMTIRELFEFIVDASITDDAVDSYLEEMQQKILTRGDISAEDEIADSVFVQSYIPKTLEDVKNAEEDVQRITSGKDTKDLYYQTITGLKHALSLTQPSQQKTQQKSSPTKDSPAVSDDKSKLLEDDAEGQSDEDEDDESNSEEDSPSESEVDDPADKKAARKEARKENKKKVKEEKREARKTKVPKAVKKRKKKLAKAKKTR

SEQ ID NO: 231878 - protein, 146 aa, Glycine max
  Coding DNA Sequence Number=SeqID_115100
NNKGDSNGVSNSGENTNSDYDDNDDRSDWWWLVGMPMVFVIILVVVMTLMVINNGGNDKGGIGDNGGGSSSSNVSGIGDNDNDSGSNDNIGGDYDNNVGDRGDDDSGGDNGGGGIGGDDDSNIGDNECADSDNSSGSDNKRCHDQI

SEQ ID NO: 231879 - protein, 97 aa, Glycine max
  Coding DNA Sequence Number=SeqID_115101
PEFVVEVEVLAGWNERRGGGKLREVVIEVHGAVAFEDSGEFAERGFGVRVSRFLPLSLGNGKSFTLTFVRYLLRVLSDLVSEHCVRGESRHGLVDTG

SEQ ID NO: 231880 - protein, 70 aa, Glycine max
  Coding DNA Sequence Number=SeqID_115102
MCNAFIGCHFSKEFRFSAVVQHRQQHQHEIENANSHQAFGKKQSGIEKGQGRTFGIRVLYTGANSISKPN

SEQ ID NO: 231881 - protein, 180 aa, Glycine max
  Coding DNA Sequence Number=SeqID_115103
  Gene Ontology: Mol. function=3'-5' exonuclease activity; Cellular component=intracellular; Biological process=RNA processing
  Homolog annotation: Hit_ID=Q8GWN3; Match level="QueryCoverage=61%, HitCoverage=24%, E-value=7e-33, Identity=51%"; Hit description =Putative nucleolar protein
MESSNVKQGENTRLANAKMQEKIKRGNVLDVTRKFSQDHICKIKQLRVMEKLSVLDFVDKENLENLVPVEPPSIECTPFKLVEDVKGLKEVAAMLSSVNEFAVRNHVGPYLREVFKDPTKKKVMHGADRDIVWLQRDFGIYVCNMFDTGQSNKVDCFATALKKIAGNKCCNEICASFAFV

SEQ ID NO: 231882 - protein, 213 aa, Glycine max
  Coding DNA Sequence Number=SeqID_115104
MVGHASKNRIYAFGSEINQNENQNTSFAQGSMICRPANPPNALQVRPPDGDTSSSSVSLRRNFLGEYFSQVALIRDEQVGDRNGVVIVDVSVVAVVFLPFLLPRGGGPLEVVVLFRRRRGERHEEVNLAALELCVGRDDDDLGNDAVLGGGGGRLLEDVLGVCLHDVAGLDGAADFLDAAVGVHYADYVQGPAWENAGDATPDAVSHAFSQFS

SEQ ID NO: 231883 - protein, 186 aa, Glycine max
  Coding DNA Sequence Number=SeqID_115105
MATPTSEKTREWLCESEAWVAETQLDTIDPRRAPPPTAKEPMVMARLYPGTDETHDPAGKGDFPRLQQESQKGAAVESKGGNVAERAVGILKGEDDLVPYEVAVGCRGGHGRTRSRVSNEGFTHNQDLNGFSGNSKHQDAGEKTCSGENSKARSINHLGISKPVGGNRCGRPGEDGGQIYGNGGER

SEQ ID NO: 231884 - protein, 154 aa, Glycine max
  Coding DNA Sequence Number=SeqID_115106
  Gene Ontology: Mol. function=RNA-directed DNA polymerase activity; Cellular component=exocyst; Biological process=RNA-dependent DNA replication
  Homolog annotation: Hit_ID=Q1SLB1; Match level="QueryCoverage=96%, HitCoverage=24%, E-value=2e-37, Identity=48%"; Hit description=RNA -directed DNA polymerase
MDRKLQFKTLAASDFHLSGIPMVPKQLFAKLILRLDTSSKDLKIALMALTFSIDASPKNIVSSAYCRMLISTLFAPTEKPRNKFLLTASLTRPFNASATILKRKGANGSPCLRPLCGENSTEGLPLTRTEIDADFRHPTIHWIHLAQKSNLLSI

SEQ ID NO: 231885 - protein, 40 aa, Glycine max
  Coding DNA Sequence Number=SeqID_115107
MGCGNWEMCIRKCLKLGLLGCQVGYFLVPESEGSDNPLLE

SEQ ID NO: 231886 - protein, 711 aa, Glycine max
  Coding DNA Sequence Number=SeqID_115108
  Gene Ontology: Mol. function=RNA-directed DNA polymerase activity; Cellular component=extracellular region; Biological process=RNA -dependent DNA replication
MEAEEAPWLGRKFTWFRPNGIAKSKLDRFLVSPDRLTKWPGSTQQPLDRNFSYHCPVLLRSKFVDRGPKPFRILDCWLSDKSFNSIVQECWTTHQLRDLWATAQYHESLLRHKARARWVKEGDSNSRYFHLLVNASRKGNSLHGVRIDGEWTEEPARVKEAARLFFLHRFKEEDHNRPLLDGIHFQTIGHQHNDMLTGRFMKEEIKDAVWGCGSEKSPDPDGINFKFIKRFWHIVKPDVLQFLDEFYVNGIFPRGCNASFIVLIPKVPNLQTLDEYRPVSLIGCMYKIVAKLLANRLKKIMPLIIDERQSTFIESRHLLQSALIANEVVENAKRSQKSCLVFKVDYEKAYDLVSWNFLVYMLRRLDFCAKWIQWIVGCLKSASISVLVNGSPSVEFSPQRGLRQGDPLAPFLFNIVAEALNGLVREAVKRNLFRGFSVGANSVDISILQYADDTIFFGEASMENVRAIKAILRSFELVSSLKINFAKSCFGTIGMPERWKSEAASVLNCSFLSIPFVYLGIPIGANPRRGQMWDPIIKKCERALSKWKQRHLSFEGRVTLIQIPKKVANKLLSLQRRFQWGGGPNKNKIMWNLFQQEGQLWARVFQTSQQGEELKKGIQWRVGSGDRIKFWEDEWIDGEVSLVTKYPRLTLFDNEIPMATNFLTDMERKTIQRNRRDEWVGKADPSGQYTAKTAYNLMRGAEIEGIQDRAF

SEQ ID NO: 231887 - protein, 387 aa, Glycine max
  Coding DNA Sequence Number=SeqID_115109
  Gene Ontology: Mol. function=RNA-directed DNA polymerase activity; Biological process=RNA-dependent DNA replication
  Homolog annotation: Hit_ID=Q1T5K4; Match level="QueryCoverage=56%, HitCoverage=25%, E-value=4e-31, Identity=30%"; Hit description=RNA -directed DNA polymerase
  Pfam annotation: Domain name=Chromo; Domain location=277-331; Score =15.1; E_value=0.016; Accession=PF00385.14; Description='chromo' (CHRromatin Organisation MOdifier
MAQVGNVLNDIIVPGRESVPQKEGDDGLGDISIKEFNDWIDDLEAVEVPWLERKFTWFRPNGAFRSNLDKFLVSPEWLGKWPGSTQLTLERNFSDHCPILLRSKFVDWDPKPFRILYCWLLDNSFKATVHQCWISNQQSRWGGYLLKEKMKRLKERLKIWNKEQFGDTFKKEALWVAAQAHESLLRQKARSRWIKEGDCNSLYFHLLMNANRGNNSLKGVMIDGTWTDEPHRVKEEVRSFFSQRFQEPDYHRPRLAVGEHQIEEELPKELQAEEQGIQPEQVLVTRMFGSAGAKIPQVFIKWKGQHAEGATLQDRSNMMQQFPAFNLEDKVLAGKRALPCVKRERTINNSESFISACTVLCWFLCASVLPLVAVSKVEKIPNGRLMH

SEQ ID NO: 231888 - protein, 255 aa, Glycine max
  Coding DNA Sequence Number=SeqID_115110
  Gene Ontology: Mol. function=3'-5' exonuclease activity; Cellular component=intracellular
  Homolog annotation: Hit_ID=Q2HVC7; Match level="QueryCoverage=33%, HitCoverage=31%, E-value=1e-26, Identity=68%"; Hit description =Ribonuclease D
  Pfam annotation: Domain name=HRDC; Domain location=1-71; Score=25.1; E_value=9.5e-05; Accession=PF00570.13; Description=HRDC domain
GIWEWRDGLARADDEGPGYVLPNRIILEIANQMPVIISNLRRIVGRTKHPYVERSLDVIVNIVRHSMQNAAAFEEAALRLKEEHAASLSNVIPVKDGTEVPHTLQKDGCAARGSMGIENGSCVDITQNCMLSYDQEEKSFQHQVEDGLSDCLNSDLLRVSPTIPYKNRDNANVIVLSTAKVKKEIKPEQSRSSLNIPSPLLLGNNEKSRLVAETPSVTYETSYSREKLVSGSPSTSNPIGMVMVDSAKEKKMNDE

SEQ ID NO: 231889 - protein, 171 aa, Glycine max
  Coding DNA Sequence Number=SeqID_115111
  Gene Ontology: Biological process=response to biotic stimulus
  Homolog annotation: Hit_ID=Q9FJ49; Match level="QueryCoverage=86%, HitCoverage=92%, E-value=8e-46, Identity=61%"; Hit description =Arabidopsis thaliana genomic DNA, chromosome 5, TAC clone:K15I22
  Pfam annotation: Domain name=Bet_v_I; Domain location=18-166; Score= -43.0; E_value=0.011; Accession=PF00407.9; Description=Pathogenesis -related protein Bet v I family
  Pfam annotation: Domain name=Polyketide_cyc; Domain location=23-156; Score=9.6; E_value=0.044; Accession=PF03364.10; Description =Streptomyces cyclasedehydrase
  Pfam module annotation: Pfam domain module=Bet_v_I::Polyketide_cyc; Domain location=18-166::23-156
MLNTYHASKLPSNQCGSSLVQTIDAPLPLVWSLIRRFEYPQGYKLFVKKCTLLDGNGGIGSVREVMVTSGLPAGVSVERLDKLDDDKHVFKFSIIGGDHRLVNYSSTITLHQEEEEYGGKTVAIESYAVDVPAGSTVDDTCSFANTIIACNLRSLAKITEEMVCKANQIKV

SEQ ID NO: 231890 - protein, 75 aa, Glycine max
  Coding DNA Sequence Number=SeqID_115112
MPTLSTQKLNSGERMLINVLVNIRHNTECTLDRHFKFELHKKMKHRLQSLEGISIVSMPLSCSCCPEGNNCLEGL

SEQ ID NO: 231891 - protein, 270 aa, Glycine max
  Coding DNA Sequence Number=SeqID_115113
  Homolog annotation: Hit_ID=Q4JBB0; Match level="QueryCoverage=29%, HitCoverage=16%, E-value=2e-10, Identity=45%"; Hit description =Conserved conjugative plasmid membrane protein
MTMRKFNYNEIVILNPLQTRYQMMSSRVFISLHAAANDGIYRMNRRKFVTKYGPKTIGIYMLGAFGALILLIGIGMAAYPFTQTTGMTSADGLIAIVIGGLMLYFAIKNAKKTVQKINEEKGIEGELVVPWNQVKTITVMNVRQENVANRPSLVLNTIAPTYKEIGGGSEDVDPPLLFSTTTVFPDPPPFFFLNAPIICSPGLSPKTKKARVNKNSPSIAIGSIANINAPNGSVANIANVTAAISPATISPINKSMTTIAIFLVHSNIHR

SEQ ID NO: 231892 - protein, 259 aa, Glycine max
  Coding DNA Sequence Number=SeqID_115114
  Gene Ontology: Mol. function=siderophore-iron transporter activity; Cellular component=membrane; Biological process=siderophore transport
  Homolog annotation: Hit_ID=Q0K283; Match level="QueryCoverage=99%, HitCoverage=35%, E-value=9e-93, Identity=64%"; Hit description=Outer membrane receptor, TonB dependent precursor
  Pfam annotation: Domain name=TonB_dep_Rec; Domain location=27-259; Score=64.8; E_value=2.9e-16; Accession=PF00593.14; Description=TonB dependent receptor
MLGLRHDHSRTSVDNDPKGGADDSALTRRFGLMYRSVAGLNPYISYAESFEGQTGLNKANEPFKPLRGKQWEAGAKYQPAGRNLTLTAAIFAMIENNRKVPGVVNGRADTVQVGQARTRGLELEALASQGNLDLVASYTYLDARVARGKPAEEGRQLSGIARHMASFWANYRFRAFGVSGLVAGAGARYNGTHDDGTGHNGMAAVTLYDAVLAYDAGPMRMALNVTNLFDKRYVDVCLARGDCFFGTRRSVVGSVTYRF

SEQ ID NO: 231893 - protein, 608 aa, Glycine max
  Coding DNA Sequence Number=SeqID_115115
  Gene Ontology: Mol. function=siderophore-iron transporter activity; Cellular component=membrane; Biological process=siderophore transport
  Homolog annotation: Hit_ID=Q0K283; Match level="QueryCoverage=97%, HitCoverage=81%, E-value=0.0, Identity=63%"; Hit description=Outer membrane receptor, TonB dependent precursor
EGVGGHQIDIAQRRQGFQFGALGAGLAHLHGVGNAVDHAGDLAVFLGHVEHAGGDRQVLARRLVLQARLPLLAAQRLERLVGTVEAGQALERFRVAQIGIEARLGAVHQAKALAHFAVIARPGRRIVHRRARAIVAQPQHQQPTLPFELVLHVEAQLVAARGRRADRRGGRREVAVHGVVHVDGRDRAAHPLARIQHGTLVVDAGQQGVADRAGLELELALGVDHELLEGRLVLVDHAAQQRVAARHPSMPGAVEAGGVDAAIVDLAVRVAQVLPHRDVVVEGVLELVAHRALPGGVLVEVGFADEEVLRDAAGRRAGERAAPREETDHRPAIVFLEIGQQRQRGRGAGPPGQRRRDEIAVVVDVFDRTVAIAPQRDHAIQPLAVFVDRAGEVGLDLLAVVVAVADADLAHRLGLRPLADLVDDAADGALPVQHAGRPAQDLDALQRVGVGPGVVVGPHGVEQAVQVLGGIGAADLDGVAAIVRPERAGRDASGIARRLLHRLGALQRHAILGDDADRLRRFHHRGVGLGGGGGTLGDKALHGADRGLFDVAARDGDGGQVDLGRGGLRQGGARQAQAEYDQRQLPGPEMHRAPAGRKAYSHGNSARM

SEQ ID NO: 231894 - protein, 339 aa, Glycine max
  Coding DNA Sequence Number=SeqID_115116
  Gene Ontology: Mol. function=DNA binding
RQLSKAQALALIEKAVEEKTKILKKNQNSENNPKETKVERVPVQLSESQNKKIQSLTDLRNAVKEELKKYNVKVDDRALDYYIRIKENAPWLTDYILKGKLGIYPAYSIYTKLQEMGLLEAVAKLPPYERNTLLTDGRKIILDERKDLLEEIVNHRMAVSQAINKLKTEEKLQRSKKKSKVKEEKEDEGEEVETDEGEEAESDEYSFVEEWAQKEEEAKQQLTPQFNTEVHSPAEEITRINHEKWLQTVAKLKEEMLSNCPEIKQLYEEKKLDEEAILTMVEVWRNFQIAFKNLSINWHNVAEPLLSSHLNRQQLEELFYKFVKGNMRLYPKEEFGVVK

SEQ ID NO: 231895 - protein, 38 aa, Glycine max
  Coding DNA Sequence Number=SeqID_115117
VHWHLTVVYGSPSRARMDSLWDDLFSLYEDIEGPWALT

SEQ ID NO: 231896 - protein, 288 aa, Glycine max
  Coding DNA Sequence Number=SeqID_115118
  Gene Ontology: Mol. function=nucleoside-triphosphatase activity; Cellular component=membrane; Biological process=polyamine transport
  Homolog annotation: Hit_ID=Q1XR27; Match level="QueryCoverage=97%, HitCoverage=96%, E-value=8e-59, Identity=39%"; Hit description=ABC transporter related
  Pfam annotation: Domain name=ABC_tran; Domain location=29-189; Score =159.0; E_value=1.3e-44; Accession=PF00005.17; Description=ABC transporter
MLLEINNLYFSHRKDQPLFQNLNIRFEEGKIIALAGESGCGKSTLLNLIYGLLDWEGGEIIFDGTPLMGPKGNLVPGEPQMKFVAQNFDLMPYSTVADNVGLQEYADVFPKNLSGGQQQRVAIARALSILPKLLILDEPFSNIDFPRKIELRERLFRYVKQHNISLIISTHELQDIIPWVDQIVVLQSGRLIQNTHPEETYKEPYNPYVAKLFGEVNIFTDHEMKNFGISKFSYYPHEIKVSENGMDAEVLESRFAGNHYWNKVRAKEKDLVLYTNSKIEGPVKIVFA

SEQ ID NO: 231897 - protein, 66 aa, Glycine max
  Coding DNA Sequence Number=SeqID_115119
MLHGEMIVVIFNSKVKHNCPSSPNLFCRELFRNNAMVAAQHRYTQSLAKQGLIRLQFFKLHYLELI

SEQ ID NO: 231898 - protein, 41 aa, Glycine max
  Coding DNA Sequence Number=SeqID_115120
MAASNVDASTSAMRAVPIRTEDVAVRNSPSEFLRTALIPYR

SEQ ID NO: 231899 - protein, 144 aa, Glycine max
  Coding DNA Sequence Number=SeqID_115121
  Pfam annotation: Domain name=zf-CCHC; Domain location=123-140; Score =16.8; E_value=0.0016; Accession=PF00098.13; Description=Zinc knuckle
  Pfam annotation: Domain name=zf-CCHC; Domain location=90-107; Score =10.2; E_value=0.02; Accession=PF00098.13; Description=Zinc knuckle
  Pfam module annotation: Pfam domain module=zf-CCHC::zf-CCHC; Domain location=123-140::90-107
MDVDDKLSSKKPHGLADEATAATETVSEKEERPLRLYFGNGPRIHKQLCIKYGVVDKRCEKCGKVGQLTCFSPAFRKWALGRVTEEELNQTCKICNERGHIYLDCDLPNELAEVPPPKQKRTVRCGLCGEAGHNKRTCPKARHN

SEQ ID NO: 231900 - protein, 1016 aa, Glycine max
  Coding DNA Sequence Number=SeqID_115122
  Gene Ontology: Mol. function=RNA-directed DNA polymerase activity; Cellular component=chromatin; Biological process=chromatin assembly or disassembly
  Pfam annotation: Domain name=Chromo; Domain location=966-1016; Score =28.4; E_value=2.6e-05; Accession=PF00385.14; Description='chromo' (CHRromatin Organisation MOdifier
  Pfam annotation: Domain name=RVP_2; Domain location=225-335; Score= -58.0; E_value=0.033; Accession=PF08284.2; Description=Retroviral aspartyl protease
  Pfam module annotation: Pfam domain module=Chromo::RVP_2::RVT_1; Domain location=966-1016::225-335::452-622
MALDERLVAKDKEDVSSSQKNRAIQGRHDGNGASGDRFTHYAGYTRLSRIEFPRFNGDNVKEWLYQCETYFLMDETPPEVKTNWEEYVQILTERFGDACDDPMAELMNLRQKGANDGSYVSTQPMMKAYNLAKLYESAALQGTAATLPSKNKPAVPIKSLLEPKPPTITEPKSMKTKPRFTKNLTPAFMSERRAKGLYYFYDEPFSMEHSLTHKKLQIHLMEVDDIEEDTVEIENHIGGLQHRRYNKKPLHILIDSGSTHYFLDVHVVARIGCKIEDLKPLVVTVADGKKVLISSVGQNFTWVIQHTTFTSDVMLIPLGCCDIVLGIEWLITLGDITWNFTKLSMEFMVQDRRHVLRGSNPSSCKSVKSPTLDKIVNNSVHLSMIQVGMEDVFVTPTQLPLSRGEHDHRIPLLQSAEPINKRSYRYAKQQKDIIDKIIHEMLDSIIIQISNSPYASPVVLVGKKDGTGRLCVDYRDLNKNIIKDRFPIPLVEDLMDELHGFTIFYKIDLRAGYHQVKMHIADIYKTTFRTHNGHFEYLVMPFGLTNAPATFQNLMNTVFQEFMRKFLLVEYLGHVISIEGVSTDPAKIVAVQNWPMSATLKQLIGFLGLAVNASGQGIGVVLMQQHHPIAFKWQHYLLSRPFVIRTDHKILKCMLEHILTTAFQQKWFVKLMEFEFSIEYKQGKENIAVDSLSRLKDIECKALRVQTIQTDVLDKIQSTWTSDASLATIIATLKENSSSHKHYTWLNDQLRRKGKLVGLTSDVKQFVQQCVSKIMLLIQGSCNNCLCRIIKVAHYIPLSHPYTANTVAQAFMDHVFKLHGFPSSITSDRDSIFLSKFWQELMAFQGVCVLILLNNDLSGYLWQSGGTIGGSKFGKKKGDVEDLVYVKLHACRQVSIVARANEKLAPKYFGSYPVISRIGVVAYELKLPYHAKIHNVFHVSQLKKHISQFIHSPTLPDFIPEAVGPKEPAAILDRMTFKRRGQAVTKVLVQWKHQLKEDATWEFYYDLKRRFPQFDS

SEQ ID NO: 231901 - protein, 80 aa, Glycine max
  Coding DNA Sequence Number=SeqID_115123
MTDWGFSGGVDAIRKELMCVMTMVSRIHAFKKWSTTAILARSNVKVSCLATTTIAAASSTFACNIRNVKDHNKTATAAVI

SEQ ID NO: 231902 - protein, 34 aa, Glycine max
  Coding DNA Sequence Number=SeqID_115124
VYLSNLPNNWYQSQWFKLVTGSDEYASTAGDQNG

SEQ ID NO: 231903 - protein, 70 aa, Glycine max
  Coding DNA Sequence Number=SeqID_115125
MRRVKVRRDIHGCNIFLCVLVSSAATTIYINNSETQVPMTKTSQENVVKCTRKGARDNSRIDVNHPDEQE

SEQ ID NO: 231904 - protein, 156 aa, Glycine max
  Coding DNA Sequence Number=SeqID_115126
  Gene Ontology: Mol. function=oxidoreductase activity; Cellular component=endoplasmic reticulum; Biological process=electron transport
  Homolog annotation: Hit_ID=Q9C7S7; Match level="QueryCoverage=53%, HitCoverage=23%, E-value=3e-29, Identity=57%"; Hit description =Endoplasmic oxidoreductin-1 precursor
  Pfam annotation: Domain name=ERO1; Domain location=1-154; Score= -180.7; E_value=0.001; Accession=PF04137.6; Description=Endoplasmic Reticulum Oxidoreductin 1 (ERO1)
MVRDPLDLRRYAKTEDGDDLTQALVEEIIEKCLGFEVEQRSLVLIFKPPAFFFGILAHPCYSNTFHYELEKNWGQNLTLMYDRVLRYPDHVRNLYFTFLFVLRAVTKLLYNPKLQAACPIPFDEANLWKGQSGPELKQKIQQQFRNIRALLWLSLL

SEQ ID NO: 231905 - protein, 94 aa, Glycine max
  Coding DNA Sequence Number=SeqID_115127
  Homolog annotation: Hit_ID=Q9FIS3; Match level="QueryCoverage=35%, HitCoverage=33%, E-value=1e-12, Identity=91%"; Hit description =Arabidopsis thaliana genomic DNA, chromosome 5, P1 clone:MTG10
CNLDNKAREDIIRVMDVRVLFHNKGVTALVTDCVKAELSLNMHSNRRDTRRHAQHHEAASARAFELDIGALLELKAITLREYVWERKIWIWSEG

SEQ ID NO: 231906 - protein, 113 aa, Glycine max
  Coding DNA Sequence Number=SeqID_115128
MTLLLRKKKTSSVESRERHFPRDSTEEVFFRSCNVNCERQLLPWNLSENVFRETPWMKVSSAVDITTVEEYFFRECSRMMSSARLHGRRFLPLLTLQLRNTASSVESCGRHFP

SEQ ID NO: 231907 - protein, 105 aa, Glycine max
  Coding DNA Sequence Number=SeqID_115129
MEHAVEGGNGVVEGGGFGEGFARGVRVEAGEEEEKKKGGEKGGGIQHHGGEGDTRLMEMGVCVVRKSPKQNKTEQSRVCIISVRVYKLLVKDLPDKWDSYEFFIL

SEQ ID NO: 231908 - protein, 400 aa, Glycine max
  Coding DNA Sequence Number=SeqID_115130
  Gene Ontology: Mol. function=receptor activity; Cellular component =integral to membrane; Biological process=signal transduction
  Homolog annotation: Hit_ID=Q2HVJ5; Match level="QueryCoverage=91%, HitCoverage=89%, E-value=0.0, Identity=86%"; Hit description=EXS, C -terminal
  Pfam annotation: Domain name=EXS; Domain location=170-342; Score =162.3; E_value=1.2e-45; Accession=PF03124.5; Description=EXS family
MDANLRDLFLYEVFLYYNPLLLVTMMVWLWGANLWVFLQSTVSYAKVFDLDQNHLSHKETWKCSTWMTIIVPTSMTAYLYLYSHGEVLLYILVAVILIFPFDIFYLSSRYFFLRTLFRIAFPFQPITFPDFFLADILTSMAKVFSDLERSVCRMVNRQVATIAWLEADSVCGSHSVAIPIALVLPYVWRLFQCLRQYRDTKEKNCLFNALKYSTAVPVIFLSALKYHVLHEKWTTLYRPLWLLSSVINSLYSFYWDITRDWDLSGFSRIFKFNKPNLISNLLYGRQWVYFWVIGSNFVLRCSWTYKLSAHLRHNYLTVFTITLLEMFRRFQWVFFRVENEWNKITRSGVQLTEIPREEEKLLGSNIHDERFCQSQQFNENEEASLQLHANVHLYMKSCKK

SEQ ID NO: 231909 - protein, 306 aa, Glycine max
  Coding DNA Sequence Number=SeqID_115131
  Homolog annotation: Hit_ID=Q1SGC9; Match level="QueryCoverage=99%, HitCoverage=99%, E-value=3e-13, Identity=25%"; Hit description=HPr serine phosphorylation site
MKASLKFREEHKKPLFRAKVPLSILGKPFQSGIVAGESKELTLNLCTFFESGPSLKVASMLMSCEFSVPGRTGSPLFMLHFKPRFGDFTFKKTQSSIFDGKGFGSLNTQNDAVELENGTVETPLMESAKVSILGDGASGAVAGMFSGVEVAARTTLPVRGRAAVKFRWGVRVPSEFKGNNAFQKIPFLVMDKIGVEHMMECGVSKEKVSAGEKSRVPASADVAEACFAVKRQMEVLQAENGLLRNAVEDLRREIVGVRTSSSVMGKSPNLRKNEKKTTSDYGNFPGKSTEAEASEKLKKALMGAAA

SEQ ID NO: 231910 - protein, 98 aa, Glycine max
  Coding DNA Sequence Number=SeqID_115132
AHGFDVEHSNFNFGSLMGYEHWVLVPHCLFSVGKGMLLMLAVLDFLSATSISSNRRGTLFAANVGDSCVVLGKKVGNTRGIAAIHLFAEHNANFEAVR

SEQ ID NO: 231911 - protein, 34 aa, Glycine max
  Coding DNA Sequence Number=SeqID_115133
MEVTNARWNEHSFLYKGKCAILFYIMMSTLPLME

SEQ ID NO: 231912 - protein, 491 aa, Glycine max
  Coding DNA Sequence Number=SeqID_115134
  Gene Ontology: Mol. function=small conjugating protein ligase activity; Biological process=protein modification process
  Homolog annotation: Hit_ID=Q1RVR2; Match level="QueryCoverage=61%, HitCoverage=43%, E-value=3e-76, Identity=46%"; Hit description =Ubiquitin-conjugating enzyme, E2
  Pfam annotation: Domain name=UQ_con; Domain location=359-465; Score =1.7; E_value=2.5e-05; Accession=PF00179.16; Description=Ubiquitin -conjugating enzyme
MGIFTCGWNTILGTATCRCCKRTPLETPQWGLSPAGGGTPKWRLSHVGGTPHWGLQPAGSRAPKWGLSHIGGTSHWGLPPAGGIGGTPLETPQWGLPPVGGGTSEWGLSHVGGTPHWGLQPVRSGAPEWGLPHIGGTSHWGLPPAGGGTQKWELSHVGGTQHWGLLHASGVGGTPPAGGAPEWGLSHISGTPHWGLSPTSGVGGTPLAGGAPNWGQAGVSMMTVYNPYHSNFVGPSYHHPGSESINQMWSTNAYNLQAFPNYNYYYPYDYNYTAPFAHHFHVPPGPLIHNSWVYNSVGDGNNEATANNTVATISDEARGEILRKFQSFKQFDVIEDVSDHHFVHANSSMEQHSKHWAKRIQGEWKSLEKDLPDSIFVRVYESRIDLLRAVIIGAKGTPYHDGLFFFDVFFSSGYPHVPPVLVSIQGLILVAKPFFNEPEYAHLSNSQYGEISSLKYNEDTFILSLRTMIYIMRRPPKNFKDFVAGNLQPSS

SEQ ID NO: 231913 - protein, 358 aa, Glycine max
  Coding DNA Sequence Number=SeqID_115135
  Homolog annotation: Hit_ID=UPI00005F8A28; Match level="QueryCoverage =78%, HitCoverage=66%, E-value=9e-61, Identity=45%"; Hit description =COG3550: Uncharacterized protein related to capsule biosynthesis enzymes
  Pfam annotation: Domain name=HipA_C; Domain location=201-280; Score =33.9; E_value=1.4e-07; Accession=PF07804.3; Description=HipA-like C -terminal domain
  Pfam annotation: Domain name=HipA_N; Domain location=126-195; Score =48.6; E_value=2.2e-11; Accession=PF07805.3; Description=HipA-like N -terminal domain
  Pfam module annotation: Pfam domain module=HipA_C::HipA_N; Domain location=201-280::126-195
ANQTSRRADPVRPEGFVMVQADHKSFHSDGLPWWLFDMRPQGYLGRAYASTYASGLGLPTNPEQWADADVVRALLAQGHDAIGNLLIGEQARSRFLEMPEPTPMECATAYPRLARAAGAGEVPGSSAGGEQPKFCTYTERGHVLVKFTAADDNPVSEHWRDLLMAEHLALKVLGVKTDVFDIAGQRFLEIPRFDRVGKMGRIGVFSLRALDAEFVGNASASWPVLVNQLVAEKCVHSEAANSTARLWAFGMLIGNTDMHAGNLSFISRHGRPYHLAPAYDILPMGFAPRAGGAIVNTLRPASLPEVVTSDIWREALALAEEFLSLTNSCDGFSDRFAPCLAALQHHLDEARARIARLG

SEQ ID NO: 231914 - protein, 96 aa, Glycine max
  Coding DNA Sequence Number=SeqID_115136
  Subcellular localization annotation: CTP_CleavageSite=74; ConfidenceScore=5.36e-01
GAQDVDQGDSSSSVQFRTSLAAFVNMLVNEFTQVGAKDCDKVFPLTAVGNSSSEMLTTVGNPSGVKLTAVGNMSGEMVAAVGNASGEMLVAAASIP

SEQ ID NO: 231915 - protein, 47 aa, Glycine max
  Coding DNA Sequence Number=SeqID_115137
MKEKPRGLARKRTAERDLQTKNLQLSLSQALASLAKMMHLKYKGACA

SEQ ID NO: 231916 - protein, 83 aa, Glycine max
  Coding DNA Sequence Number=SeqID_115138
MRLINGTEQSLSKENDSIKKSLMGFANPVLFLSLRQRVVHDAEALIGASSKEHALAVEEADLLDGGHATLLPAKLAKISNHIL

SEQ ID NO: 231917 - protein, 150 aa, Glycine max
  Coding DNA Sequence Number=SeqID_115139
  Homolog annotation: Hit_ID=Q8LKR2; Match level="QueryCoverage=36%, HitCoverage=12%, E-value=8e-15, Identity=67%"; Hit description=Actin- related protein 4
KVLVQAVESLDLVDLPQSMVSESVSTFVVVALEDVVADLGELSWQECCMTSIEKISFFDGQSMFLAACSDQSLCVVNHSLSECLLIDPKEHPMLLAEPSSNSQQQRERTVELMFEKYKAPALFLVKNVVSPSLTYTFKNNLCHGVRMKNY

SEQ ID NO: 231918 - protein, 360 aa, Glycine max
  Coding DNA Sequence Number=SeqID_115140
  Gene Ontology: Cellular component=nucleus
  Homolog annotation: Hit_ID=Q2HVJ8; Match level="QueryCoverage=98%, HitCoverage=64%, E-value=1e-126, Identity=68%"; Hit description =Nuclear protein SET
MPHSYVFPEMQDAQDICDPEADEKRKFIAGSQIEQSDNLTKEGTCNPMTGDTVWVEGLVPGIDFCNHVIRVSYIVIYNLKPIATWEVDGTGLASGVPFSMYLISAAQSPLQIDQEIYISYGNKGNEHQSFKLQAERPARGRFFMWPTLELLYLYGFVIDDNTDDYLMVHYPAEAINTISFSESKNQLLEVQKAELRCLLPKTSLDNGFFPLNTQNGEENNKSKADQVCNYSWSGQRKMPSYVNKLVFPEKFMTTLRTIAMQEDELFKVSSMLEEVHQKFRILKLAGPERERQLSDTDVQSAVWEVCGDSGALQLLVDLLRVKMMDLEESSGTEENDLDLLKKALIIDSHEDSKQCLSNLR

SEQ ID NO: 231919 - protein, 73 aa, Glycine max
  Coding DNA Sequence Number=SeqID_115141
  Subcellular localization annotation: CTP_CleavageSite=36; ConfidenceScore=5.49e-01
MSIQSSSNSYLVSHTSSTHSKAAYESISMQNPKRVSSRTAQGKNSKTEDTIIGASKRRWIRYMCKHSPFDILI

SEQ ID NO: 231920 - protein, 34 aa, Glycine max
  Coding DNA Sequence Number=SeqID_115142
MFSASSFHMKNWSYTTRPIIMHLAYARTAQNEDE

SEQ ID NO: 231921 - protein, 266 aa, Glycine max
  Coding DNA Sequence Number=SeqID_115143
  Gene Ontology: Cellular component=integral to membrane
  Homolog annotation: Hit_ID=Q015U6; Match level="QueryCoverage=85%, HitCoverage=86%, E-value=4e-32, Identity=34%"; Hit description=[S] KOG4473 Uncharacterized membrane protein
  Pfam annotation: Domain name=DUF125; Domain location=39-257; Score =94.4; E_value=3.5e-25; Accession=PF01988.9; Description=Integral membrane protein DUF125
MGERGGSSGGTTTRLLQTAAEDGGERKSERPKEPWKGEYVKSMVFAGLDAIITCFSLISSISASTSSSVHVLVLGVSNLVADAISMGFGDFVSASSEQDVIIEERRVTEWDVINQRDKEQTELVKHYQNLGMDYNDATMVVNIFTKYNDILVDQRMVADKGMLPADQEVKPWRNGLVTFASFMLFGSTPLLSFIILIPFTDNDSVKFLSACIVSALALALLGVAKARIAGQNIMLSAAVTLLCGAIAAASAYLVGWLLKLMAGLES

SEQ ID NO: 231922 - protein, 147 aa, Glycine max
  Coding DNA Sequence Number=SeqID_115144
MVADKGMLPADQEQTFESFMFFGSTTLLSFIIFIPFTDNDSVKFLSACLLSAPYLALLGLPKARIDGQSIIFSVASTTGKKVVALLLSYVIFTKLTEVAEQHVISGALLIAIGNTLKMLLDNIFTSTKTKRVLASSTTRGNGAKSTV

SEQ ID NO: 231923 - protein, 606 aa, Glycine max
  Coding DNA Sequence Number=SeqID_115145
  Gene Ontology: Mol. function=single-stranded DNA binding; Cellular component=nucleus; Biological process=pollen development
  Homolog annotation: Hit_ID=Q64MA3; Match level="QueryCoverage=99%, HitCoverage=100%, E-value=1e-173, Identity=49%"; Hit description =Putative single-strand DNA endonuclease-1
  Pfam annotation: Domain name=XPG_I; Domain location=129-219; Score =63.1; E_value=9.3e-16; Accession=PF00867.9; Description=XPG I-region
  Pfam annotation: Domain name=XPG_N; Domain location=1-97; Score=34.1; E_value=4.9e-07; Accession=PF00752.8; Description=XPG N-terminal domain
  Pfam module annotation: Pfam domain module=XPG_I::XPG_N; Domain location=129-219::1-97
MGVGGNFWDLLKPYARKEGFDFLRNKRVAVDLSFWIVQHENAIKATHVRNPHLRLTFFRTINLFSKFGALPVFIVDGTPSPLKSRARIVRYFRSSGIELASLPVPEEGVSAERNHMFSSHVQKCVELVELLGMPVLKAKGEAESLCAQLNSEGHVDACITADSDAFLFGANCIIKCFCPNFKEPFECYNMSDIEAGLGLKRKHLIAISLLVGNDHDIKGVRGIGLDTALRFVKAFSEEDILNRLHEIGKGNTSQIPIFIKFEDDMDMDGNSLNRKQSHCSLCGHPGSKKDHMKFPCEFCVTKADEGCQRKPEDFKCDCFSCDMNRKHKEKKRLKNWHTKICHKIAEEPNFPKNEIIDMYLCNDNASDGPHIVWGKPNIEMLIDFLNFHQHWEPAYVRRMMFPMMSTIFLRDMTTTTEETMLFGQYQFDSIERVKMRYGYQFFVVKWKHAGVNISCKVPLKESSVQQDAIIELDETVDLLDDCDVPEIHEDSGCRFLLTDENMDLVGAAFPAEVKRFWQDQELKRRKNSTSRSQENEKSPSPNSRSIQLNITEFYPSTKVKHRQSKQGGGESSKIADSQGNEGSKMKRKMSSPDKIPKSVRRRLLFD

SEQ ID NO: 231924 - protein, 137 aa, Glycine max
  Coding DNA Sequence Number=SeqID_115146
  Homolog annotation: Hit_ID=Q9FGQ9; Match level="QueryCoverage=43%, HitCoverage=35%, E-value=2e-09, Identity=47%"; Hit description =Arabidopsis thaliana genomic DNA, chromosome 5, TAC clone:K14A3
  Pfam annotation: Domain name=DUF581; Domain location=49-107; Score =105.1; E_value=2.1e-28; Accession=PF04570.5; Description=Protein of unknown function (DUF581)
MLLGKRPRPPIMKRTTSMSEITFDLNTTLDDDPNNPVKGPGGNQNRVWAMVSPRNHSEDTTPDFLRVCFLCKRRLVPARDIFMYKGDSAFCSSECREQLMKQDERKDKYRVGSKKQVAEKPNSGSQVNKAKPWLPCN

SEQ ID NO: 231925 - protein, 115 aa, Glycine max
  Coding DNA Sequence Number=SeqID_115147
MEEAPPSIQDLIFSLQQATFMAKQLLPSSTNNPTHLHQIHSSLHHAHRHLSVFLAALPSPPPAAESSATDAEPMQVEDGGDGDDEETTSKCIIDKVEEKMRHCFIKNKRPKRPLS

SEQ ID NO: 231926 - protein, 114 aa, Glycine max
  Coding DNA Sequence Number=SeqID_115148
  Gene Ontology: Mol. function=chitin binding; Cellular component =extracellular region; Biological process=chitin metabolic process
  Homolog annotation: Hit_ID=UPI00006A17C9; Match level="QueryCoverage =72%, HitCoverage=100%, E-value=7e-11, Identity=37%"; Hit description= UPI00006A17C9 related cluster
MTKSNRTHTLREFSERFAKDRISTLTSRGLHVLAIRGLHVLTFVGLHALTFRGLHVLANRGLHARTLRGLHVLAKVGLHALTFRGLHVLANRGLHALTFKGLHVLGSEGYTPSP

SEQ ID NO: 231927 - protein, 40 aa, Glycine max
  Coding DNA Sequence Number=SeqID_115149
MSSMRLSTMFEGVSFRDVRGQKVEPQDQEEDFVTISETWQ

SEQ ID NO: 231928 - protein, 98 aa, Glycine max
  Coding DNA Sequence Number=SeqID_115150
MEQGENWACSGSRRRKTMVKMENVARGRQTSEPCFERSHPEKHGDFMEAVEAKSSSGYGKPSWVFRGRQVAWYQLHLVKAEKARAYIPEEFKLVEAFG

SEQ ID NO: 231929 - protein, 95 aa, Glycine max
  Coding DNA Sequence Number=SeqID_115151
MKGQQILETACLAMATDPSLAERALEVSFVVLLLFKAIQVVIYKLHGEREYSRESLENGNTFQQVIKDHDNGEKFMENVQQNQASIDGEGEGHHK

SEQ ID NO: 231930 - protein, 1227 aa, Glycine max
  Coding DNA Sequence Number=SeqID_115152
  Gene Ontology: Mol. function=RNA-directed DNA polymerase activity; Cellular component=chromatin; Biological process=chromatin assembly or disassembly
  Pfam annotation: Domain name=Chromo; Domain location=1140-1188; Score= 22.5; E_value=0.0015; Accession=PF00385.14; Description='chromo' (CHRromatin Organisation MOdifier
  Pfam annotation: Domain name=RVP_2; Domain location=238-369; Score= -41.1; E_value=0.0016; Accession=PF08284.2; Description=Retroviral aspartyl protease
  Pfam annotation: Domain name=rve; Domain location=866-1022; Score =83.8; E_value=5.1e-22; Accession=PF00665.16; Description=Integrase core domain
  Pfam module annotation: Pfam domain module=Chromo::RVP_2::RVT_1::rve; Domain location=1140-1188::238-369::462-634::866-1022
  Subcellular localization annotation: CTP_CleavageSite=34; ConfidenceScore=5.57e-01
MAQKFDALLLRFPSSPLSSSSANPSTPNFPPVPASQHKMKLNIPKFDGTDLFGGWLTMGSSRRGPPSSKPFKPAFLPRTTTIPRAPFSNYNRPAPWFRLSPNVRREVQALQPLTLVQAAGLARLQEEKLLNTRPSLRNCAPSVVPIPSRPAPSPALLPLPVPHSPPPRLPPTLKRLSPKEISSRQERGLCFNCDEKYHRGHRCASRVFFLVAEEDEAVDPHIEGIDPSPDSPDIHDPGPTQISFNSLASQLAPKTLRLIGTVAGTTVVILVDGGSTHNFIQESLVTQLGLQTQQKTPLRVMIGNGQHLACNRLCPNLSLTMQQFHCVVDLYVLPIAGANIVLGVQWMKMLGPVLTDYNTMSMKFFLEGQLIELQGDQESTLTMLTPHQFRRLSHNSDTSSFYHIAVLAEVPIPDSNSPLHPSIQTLVDHFVVLFQPPTSLSPERITDDHIHLIPQAAPVNVRPYRYPHFQKHEIELQDSSWHFCMDYQALNAMNVRDRFPIPTIDELMGELGKACWFSKLDLLQGYHQIRMHSSDIAKTAFRTHHGHYEFKVMPFGLCNAPSSFQATMNMIFRPFLRRFLIVFFNDILIYSATIEEHVAHVEQAFQVLLDNHFVLKLSKCSFAQQQVEYLGHMVSKKGVEPVAAKVEAVRQWPVPHSIKAFQSFFGLTGFYRRFIKGYASIAAPLVAATTVDPFQWTAVAQLAFDHLKQALSEAPILALPDFQLPFTVETDASGVGMGAILSQQGHPIAYFSKPFPPKLQRSSTYVLELFVMTAAVKKWRQYLLSNCFIILTDHHSLKELLTQVIQALEQNMYLARLMGPHLVTTTIALDHDSSSRVPCHSDSCVDCQYAKYKTKRVAGLLCPLPVPHRPWEDLSLNFIMGLPSFQGNTVILIVVDHFLKGIHLAMLPASHTAHAVACLFMNIVEKIHGLPRSMVSDRDPLFISRFWQELFHLSGTQLRLSSVYHPQSDGQTKVLNRVIEQYLRSFVHRRPGSWGKLLLWVEWSHNTARNATTGSTPYEITFGRKPFNFPEYLTGTSKVDVVDEMLTNQEETFLLIRKKLLKAQELMKKYADRKRREVVYQLGEWVVDRVGPVAYRLKLPEGANIHPVFHCSLLKPFKGSPEMTNSVPLLDQVVHNQPLIAPLAILDYRQASAGEDSHWEVLVQWSGLPPEETSWERWTQLCKEYHLEDKVHLHGLWNDRQAGVQQAIGKEPSKHTNSKDHLKGCCL

SEQ ID NO: 231931 - protein, 122 aa, Glycine max
  Coding DNA Sequence Number=SeqID_115153
  Homolog annotation: Hit_ID=Q10RZ3; Match level="QueryCoverage=23%, HitCoverage=17%, E-value=3e-07, Identity=79%"; Hit description=60S ribosomal protein L21, putative, expressed
MVELVWHSLVDDIVNLDGDIIAGVVGSEVCGGGGRRGGGGRGGRRWCRHQSRGGQGGRGGTMGGNALGFAGKKKTYSFLNLPLPLPTLLTKASRCHLHTCPYHLRASLLDYHMMINPHNITS

SEQ ID NO: 231932 - protein, 132 aa, Glycine max
  Coding DNA Sequence Number=SeqID_115154
MEAMKEKMATMMEAMKEKMTTMMEAMMSMKKIMEANAVTIAATSIVAKVNPMPPSGLNQMNHPTLDMVGKDLGSRDDPHDVQNQNKHAFPPYGLPPNYTPSNVAYTPNEDVNNSTPIPIESQQPQTDHAHVS

SEQ ID NO: 231933 - protein, 180 aa, Glycine max
  Coding DNA Sequence Number=SeqID_115155
  Gene Ontology: Mol. function=metal ion binding
MLGSGTNLVTTVIGFGMSATFIVFVCTRIICGRLRGGVESRMMYEIESRIDMEQPEHHVNDPESDPVLLDAIRTLKFNQEAFSSLEHTQLSFSLSIVELMIYKQHFDRYITEVASTVCRLPLKNSSETKHVRPVTFTMSQSLDESHTSDRNDDIERYVEPTPTAASNSLQPTSGEQEARQ

SEQ ID NO: 231934 - protein, 37 aa, Glycine max
  Coding DNA Sequence Number=SeqID_115156
MAHLSSTRKVVFIHKQDKTLQGTSSSFEDIFGITNCK

SEQ ID NO: 231935 - protein, 141 aa, Glycine max
  Coding DNA Sequence Number=SeqID_115157
  Homolog annotation: Hit_ID=Q67XL6; Match level="QueryCoverage=92%, HitCoverage=40%, E-value=1e-17, Identity=57%"; Hit description=MRNA, complete cds, clone: RAFL25-35-C17
  Pfam annotation: Domain name=DUF246; Domain location=3-141; Score= -175.9; E_value=0.00021; Accession=PF03138.5; Description=Plant protein family
MYLIVGMLFQVTDVDMEKETKPSFYLKHILPIILKNQVIHFVGFGNRLAFDPIAFELQNTSSLCFVGPLDPYLVGPFAKSMKGVCSRLVALTNLYPKLVSKENLLSSAELQSFANYSSQLAALDFIGCTASDAFAMTDSRS

SEQ ID NO: 231936 - protein, 335 aa, Glycine max
  Coding DNA Sequence Number=SeqID_115158
  Gene Ontology: Mol. function=transferase activity, transferring nitrogenous groups; Cellular component=mitochondrion; Biological process=biosynthetic process
  Homolog annotation: Hit_ID=Q01CL8; Match level="QueryCoverage=74%, HitCoverage=52%, E-value=1e-105, Identity=72%"; Hit description=[E] KOG0258 Alanine aminotransferase
MRRRHPPPMWRHPPVMTRGWSETPTRPVHPRGSHDERDGDDSVDDDASRRASTTAGERRENEEARRDAGETVRLDASNSMTTPLNGDTINGAVVATEYAVRGPIVIQAQQLERALEEGADLPFEKVVYCNIGNPHQLGQRPVTYYRQVLAAIECEGVDGALPADVVARANEYKSSIKGGTGAYSESKGVQVLRQRVAAGITKRDGHAANPDDIYLTDGASAGCHYLMNILIRGSEDAVMCPIPQYPLYSAALTLYGGTLVPYYLDEDRSWSMDVEHVKKQLNEARANGKNVRAIVVINPGNPTGNLLSDENLLDIAKFCADEKLLLISDEVYQEN

SEQ ID NO: 231937 - protein, 105 aa, Glycine max
  Coding DNA Sequence Number=SeqID_115159
MSWVSAQIITLRLGKVMAATLSTIPVRVSLFREYQGKGKRHKGGNTRLQLFFLVFVVTFAYYTIPGVMTVEAQKAYKCGVDCTMTMHYTNYQRQDIDVEEQTLKT

SEQ ID NO: 231938 - protein, 161 aa, Glycine max
  Coding DNA Sequence Number=SeqID_115160
  Homolog annotation: Hit_ID=Q5JK75; Match level="QueryCoverage=93%, HitCoverage=17%, E-value=6e-23, Identity=37%"; Hit description =Putative 200 kDa antigen p200
MAGGCWLQQKLSHATDQNRKELEEKFNNVEKDAEETIQSARREAEEYSFDLTKHKTAFIDLVSNQRQLEAEVGRVVKQLQPTRQHLASVDEKKEELDLMARKLALEIKKFHKDFEHKNKILSPMLSKCKLDTADNQMLLKEVKLSNNRRKQAEQETQRWFN

SEQ ID NO: 231939 - protein, 72 aa, Glycine max
  Coding DNA Sequence Number=SeqID_115161
MNDVVRVLEFFLQLQDSVVSGVVAESGGNNYEDILDILSMTSDGDRSFVGKESDKLVPVELVFSEINDPKGR

SEQ ID NO: 231940 - protein, 129 aa, Glycine max
  Coding DNA Sequence Number=SeqID_115162
MSYVLRRLSPPPSGSRAPFERRLRVVGAPENVNVVVPAVDDLRRGGVCPPFGSHLARAVGVVVRAAETMLRGRVLFVDEDKARVAVLLGVLLAVTRTLGLAETLFVGVSGVRPSFDFVSRVSRVVRLAR

SEQ ID NO: 231941 - protein, 155 aa, Glycine max
  Coding DNA Sequence Number=SeqID_115163
  Homolog annotation: Hit_ID=Q014B4; Match level="QueryCoverage=39%, HitCoverage=18%, E-value=4e-10, Identity=51%"; Hit description=[U] KOG2667 COPII vesicle protein
  Subcellular localization annotation: CTP_CleavageSite=70; ConfidenceScore=5.59e-01
MARPPPRLDLVVVARRLVAATVRAPNARVAHARMPISRVGFSASRARRTMDARVAVSETSRSSSSSSSASASSASASDAMPTMGGREGRVEGDASIDAWIRRVHERGAASDEKDAHGRVHLHRRRRLGAEPGMRRVGGFSHADAHEDDGGGRCAR

SEQ ID NO: 231942 - protein, 440 aa, Glycine max
  Coding DNA Sequence Number=SeqID_115164
  Gene Ontology: Mol. function=catalytic activity; Biological process =metabolic process
  Homolog annotation: Hit_ID=Q00RT6; Match level="QueryCoverage=89%, HitCoverage=53%, E-value=1e-40, Identity=32%"; Hit description=[I] KOG0873 C-4 sterol methyl oxidase
MDERASLLAREERVLRMVDVADGTYRAEKRAFETQTRELREELASVRATLVREREARASGESGSRERESADARAIGALRRRGEELEREVETLTTKNRELHKEALLAKANGNKVDWLEGEATQTRERLEASEATMKRLKADLEFEKSSVTKYESKAIALEKEKSGLEKALAARDGKIERLEDQLQAKEEKLATMASELRASGALAPREAALAKSEASVEAREARARARETEIKEALAKLKSRESACDAREKGLGKREAALDAREVALTKREAASTVRAGRSARAPTPSSGKELAVAPTPKRLASRFPDIVRRYVFTPGLAPRRADDSPTPASPPAPASTPVSERSKHLFAAVVEKAQSAAKASASKLEASASKASASASAAKTAAGVGMFNALQSVVGYKESPRAAIASAEKSPKTPKSSKGKEKVEKKVAEKAEEKCGIL

SEQ ID NO: 231943 - protein, 471 aa, Glycine max
  Coding DNA Sequence Number=SeqID_115165
  Homolog annotation: Hit_ID=Q017W9; Match level="QueryCoverage=58%, HitCoverage=86%, E-value=1e-96, Identity=63%"; Hit description =Chromosome 06 contig 1, DNA sequence
ALRANFDKYANQLCDTIYRDNGPTIELTKAERKLAKLTKDPESAFYALEQKPLEDFSSASFEELCVEFDYSMKRTVFDIPAYVWMRDMELMDLKQEAIDECEKKRETALRRIIDIAQTTKDSFEKCQKKTQEMYEKIHNLIGRLAGATGARRKMQGSRIETARMAAEVVMLRHDLRKLALNDGSLKIPEHEVGVTASYDGAILLGNYRGDFAGIVASRLPEDENDVATSFGQVDLPIFECALGLGGFDEEFEKQARKCGILFGLLDIDASLNEVSKNVGPSLLRRPPRAPFDKNKDVNEYDMEAYARMPADSSFVNIAETSFDQVEYLDTDYLHEGLSLAGKDDDENSGPGKVKMYFSVMRVARAYIKLLNANGKRKRSSAVARYMSAAPAPEVLLMHVPDSCGVDNTDSRGMSVELAVASVKALQTIVNEWNEMRTLFKSAAQSEGGFVIDINRSIGDMAAEDFEKCGIL

SEQ ID NO: 231944 - protein, 82 aa, Glycine max
  Coding DNA Sequence Number=SeqID_115166
MRSLDSQGNPKAHFPNSLVNKVPALDSREGQTNHELVEEDQKVQMGPRMCKSFPKLKTDTSHATFVSQARHIKEVSHISVNL

SEQ ID NO: 231945 - protein, 162 aa, Glycine max
  Coding DNA Sequence Number=SeqID_115167
  Gene Ontology: Mol. function=RNA-directed DNA polymerase activity; Biological process=RNA-dependent DNA replication
MTKARQKGVWKENRGGACHPARPGKLGCFLPKQPPFGGTSWKAQVGLNFTDCVTMLPFDFWHVSKLHELPNDGCQLIMFPSGLKIRPPKLMNSKFVVDFVRSNIFCRFGVPRSIISDQGRHFYNRSLASLLQKYGVVHRVAIAYHPQSSGQVKVFNRKIKQV

SEQ ID NO: 231946 - protein, 463 aa, Glycine max
  Coding DNA Sequence Number=SeqID_115168
  Gene Ontology: Mol. function=acyl-CoA thioesterase activity; Biological process=acyl-CoA metabolic process
  Homolog annotation: Hit_ID=Q56XD4; Match level="QueryCoverage=50%, HitCoverage=67%, E-value=1e-79, Identity=63%"; Hit description=Acyl CoA thioesterase
  Pfam annotation: Domain name=Acyl_CoA_thio; Domain location=148-237; Score=50.1; E_value=7.3e-12; Accession=PF02551.5; Description=Acyl -CoA thioesterase
  Pfam annotation: Domain name=Acyl_CoA_thio; Domain location=239-363; Score=77.4; E_value=4.6e-20; Accession=PF02551.5; Description=Acyl -CoA thioesterase
  Pfam annotation: Domain name=cNMP_binding; Domain location=33-126; Score=32.7; E_value=1.3e-06; Accession=PF00027.19; Description =Cyclic nucleotide-binding domain
  Pfam module annotation: Pfam domain module=Acyl_CoA_thio::Acyl_CoA _thio::cNMP_binding; Domain location=148-237::239-363::33-126
MAKEDVFEFLGNVPLLQRLPGSSVRKISELVILKHYEPGEYVVREGERGDGLYFIWEGEFSDLQAEVVGSVNADDDNHPEFQLKRYDYFGFGLSNEVHHADVIALTKLSCLVLPHEHSALLQPKSIWSAEKSHDTCSLVEHILHLEPIEVDIFRGITPTNAPTFGKVFGGQIVGQALAAASKSVDCLKVVHSLHVYFLLVGDFNIPIIYQVKRLRDGKSFATRKVDAIQKGNVIFTLLASFHLLSLEELREQRLTDPRLPSLRYWFRARGKLSDDEALHRCVVAYTSDLIFLQVSLNPNRRKGRKARAVSLDHSMWFHRPLRADDWILFVIFSPTANNARGYVTGQMFNQKGELLVSVVQEGVMREVISANFKICKIGPFVVCILPIPYQDSHLSDSSITPSFVPPIPTKIHASIDSSITMKNHSFTSSITIHPKLQNSNIHTKRALTCNANTNIPTVMEILY

SEQ ID NO: 231947 - protein, 1287 aa, Glycine max
  Coding DNA Sequence Number=SeqID_115169
  Gene Ontology: Mol. function=beta-amylase activity; Biological process=polysaccharide catabolic process
  Homolog annotation: Hit_ID=Q0WU61; Match level="QueryCoverage=50%, HitCoverage=83%, E-value=1e-143, Identity=63%"; Hit description =Putative beta-amylase
  Pfam annotation: Domain name=Acyl_CoA_thio; Domain location=1012 -1111; Score=65.6; E_value=1.6e-16; Accession=PF02551.5; Description =Acyl-CoA thioesterase
  Pfam annotation: Domain name=Acyl_CoA_thio; Domain location=1143 -1272; Score=29.1; E_value=3.5e-06; Accession=PF02551.5; Description =Acyl-CoA thioesterase
  Pfam annotation: Domain name=DUF822; Domain location=185-348; Score =192.2; E_value=1.2e-54; Accession=PF05687.4; Description=Plant protein of unknown function (DUF822)
  Pfam annotation: Domain name=Glyco_hydro_14; Domain location=375-871; Score=282.2; E_value=1e-81; Accession=PF01373.8; Description=Glycosyl hydrolase family 14
  Pfam annotation: Domain name=cNMP_binding; Domain location=902-990; Score=19.3; E_value=0.0048; Accession=PF00027.19; Description=Cyclic nucleotide-binding domain
  Pfam module annotation: Pfam domain module=Acyl_CoA_thio::Acyl_CoA _thio::DUF822::Glyco_hydro_14::cNMP_binding; Domain location=1012 -1111::1143-1272::185-348::375-871::902-990
LNLVRRISHASLARTLARRTLSGAAVPFPDLDLAGFLPIAADLAGPPRRSPVIAVPDGALKIPVRRRRICRRIRHLQRHFDLDACGVPEDMVFLVRDGGWFRLGIMATDMQRLVGTSEDDEEMGMDVKDEDDDDDDYEENGGEQGNASVSGMVEIDGGNGIGTATDDNRFQQHQQFQEQVGTPGGGTRRSRPLEEKERTKLRERRRRAITARILAGLRRHGNYNLRVRADINDVIAALAREAGWVVLPDGTTFPSRSQVQKPAGGNSTIVTSSSSHAASQQTPSASLRGVASGYRSPLEYNACQTKSVFMPTPSPYGLSSSSRSQTSMVGDGEAQRDNRPLIGGSMDNADDKQIADLPPRLPERDLAGTPYVPVYVMLPLGVINIKCELVDPDGLLKQLKVLKSVHVDGVMVDCWWGIVEAHAPQEYNWNGYKRLFQMVRELKLKLQVVMSFHECGGNFGDDVCIPLPHWVAEIGRSNPDIFFTDREGRHNPECLSWGIDKERVLRGRTALEVYFDFMRSFRVEFDEYFEDGLISMIEVGLGPCGELRYPSCPVKHGWRYPGIGEFQDKGLHLTSIDIKLKLRTPLPRGSSLCEGMGEGCCTQPYPCICKEAVSGFEPMTNKSPRHNFTAAPGLALLTSIDICCYDQYMLKSLRKAAEVRGHAIWARGPDNAGTYNSQPHETGFFCDGGDYDGFYGRFFLSWYSQVLIDHGNRVLSLAKLAFEGSCIAAKLSGIYWWYKTASHAAELTAGYYNPCNRDGYAAIMTMLKTNGINLNIPCVDLHTLNQHEGFPETFADPEGLVWQVLNAGWEVDLPVTSQNGFPCLNRVGYNKVLDNAKPMNDPDGRHFSSFTYLRLSSLLMERQNFIEFERFVKRMHVFEFLGNVPLLQRLPGSSVQKISELVILKHYGEYVVREGERGDGLYFIWGGEAEVVGSVSADEDNHPEFHLKRYDYFGFGLPNDVHHADVVALTKLSCMVLPHEHSTLLQPKSIWSAEISPDTCSPVEHILHLEPIEVDIFRGITPPDAPKFGKVFGGQIVGQALAAASKSVDCLKVVHSLHAYFLLVGDFNIPIIYQVYRLRDGKSFATRKVDAIQKGHIIFTLLASFQEEVGFHHQAVSIPLVPAPDEATFIAGRTTGATSNGPSSSKIDVGKKASSEVLDQVLGVFDRNDTGSFDLSVIVALIPFAYASDLIFLQVSLNPNRKKGMKARGVSLDHSMWFHRHLRADDWVLFVIFSPTSSNARGYVTGQMLNQKGEVFPFDNLQLLVSVVQEGLMREVISANSAIKSNL

SEQ ID NO: 231948 - protein, 239 aa, Glycine max
  Coding DNA Sequence Number=SeqID_115170
  Gene Ontology: Mol. function=structural constituent of ribosome; Cellular component=large ribosomal subunit; Biological process =translation
  Homolog annotation: Hit_ID=Q56W16; Match level="QueryCoverage=90%, HitCoverage=78%, E-value=3e-54, Identity=51%"; Hit description =Chloroplast 50S ribosomal protein L22
  Pfam annotation: Domain name=Ribosomal_L22; Domain location=80-184; Score=102.0; E_value=1.7e-27; Accession=PF00237.9; Description =Ribosomal protein L22pL17e
  Subcellular localization annotation: CTP_CleavageSite=59; ConfidenceScore=5.13e-01
MEARNHMSSGQVTSPVLVYSSSQLMEGIANVGISSSAQLLANSSEETPVLSPLAPVSLLSSSKGEDQKQKVVTKPEKVQAILKAIKQSPKKVNLVAALVRGMLVKDALMQLELTIKRAAKTVYQVIHSARANASHNHGLDPERLIVAEAFVGKGFYKKRLWPHAKGKSSLRVRPECRLTVVVREITAEEEAEIARLRVHNFKRLTKRQKRLVPHQLIESNPIWGRKNKSSGQNLSATPA

SEQ ID NO: 231949 - protein, 36 aa, Glycine max
  Coding DNA Sequence Number=SeqID_115171
MWFEDLGNVNLKHELRWGAATLLDIPGAGKRVVKEF

SEQ ID NO: 231950 - protein, 424 aa, Glycine max
  Coding DNA Sequence Number=SeqID_115172
  Gene Ontology: Mol. function=DNA binding; Biological process =regulation of transcription
  Homolog annotation: Hit_ID=Q10LZ1; Match level="QueryCoverage=31%, HitCoverage=30%, E-value=3e-41, Identity=61%"; Hit description=Myb -like DNA-binding domain, SHAQKYF class family protein, expressed
  Pfam annotation: Domain name=Myb_DNA-binding; Domain location=259 -310; Score=42.3; E_value=1.7e-09; Accession=PF00249.21; Description =Myb-like DNA-binding domain
MNENRIDSCVGRIQQSYGLNGDWNSEFGNCSSQYFDMRQASNMGTSNQPLAMASGGGVEQEPNIGQTKSSSSIISRFESPASAFYATEMCMGGFPQYDSQIGNNLSLMSQSSKFSNMEFPLYQSPRQSLFMASLANQPPPNFDLSNPLQEILKSHLNSDQCVRSPEDSNKIPYGDFPGSNFLPIEQHKFFIDDAISTGISPSIPSKGNQDQSVSCGPFNLPSAQLSFSSQQEMLSPTGSMSTTSGNSNSNGPVVSSKTRIRWTQELHEKFVECVNRLGGAEKATPKAILRLMDSDGLTIFHVKSHLQKYRIAKFMPQPTQGKSDKRTNVENVHLDVKTGLQIKEALQLQLDVQRRLHEQLEIQRKLQLRIEEQGKQLKMMFDQQQKTSNGHLITENNDRPISSKDVLVSTSDGSENSLFSTNIS

SEQ ID NO: 231951 - protein, 260 aa, Glycine max
  Coding DNA Sequence Number=SeqID_115173
  Gene Ontology: Mol. function=protein serine/threonine kinase activity; Cellular component=cytoplasm; Biological process=protein amino acid phosphorylation
  Homolog annotation: Hit_ID=Q8W1D5; Match level="QueryCoverage=73%, HitCoverage=41%, E-value=5e-39, Identity=47%"; Hit description=CBL -interacting protein kinase CIPK25
  Pfam annotation: Domain name=NAF; Domain location=145-204; Score =63.1; E_value=8.9e-16; Accession=PF03822.5; Description=NAF domain
MATGLRGCSYEARSPATTVLVMAAEEVPVVKGALPFGVSFRPIVFIAKVTSGATLNTSGQHENLMTMYNKVLRVEFEFPPWFLPESKKLISKIVVADPAKRTTISAITRMPWFWKGFSSFFAPNLCQLEKQEALTITEEENNFKMPKFFNAFEFISSMSSRFNLSRMFESKRKTTTMFTLKCSTAVIVAKIAVATWWLRFRVAKVKDFKIRLKGVAKGRKKRQAVTVEVFEVAPEVTFATKTMEGEGSYYNRYPKQISII

SEQ ID NO: 231952 - protein, 221 aa, Glycine max
  Coding DNA Sequence Number=SeqID_115174
MEEAKPAMGPPPPPAPPTTKKRPLEDSNAHSNYFKIRAVIRDLRPHFLENGSFPLEILFEVPDHCCLILKVLRTPDYKNCKASHEIQEHGCVNDWHISRTLVPDDATVSMISELKIVVKLYENMKADAASLAKSKNVQDGQMKAGQNMDQKTLKEQQPQHGKQSQVEKSFARPSEIKLTPPAPGFQKQLVEETQTQGTYVVGGSAFGWNFITFSGKEPVYY

SEQ ID NO: 231953 - protein, 170 aa, Glycine max
  Coding DNA Sequence Number=SeqID_115175
  Gene Ontology: Mol. function=serine-type endopeptidase inhibitor activity; Cellular component=extracellular region
  Homolog annotation: Hit_ID=Q40330; Match level="QueryCoverage=53%, HitCoverage=81%, E-value=1e-18, Identity=52%"; Hit description =Serine proteinase inhibitor
  Pfam annotation: Domain name=Bowman-Birk_leg; Domain location=110 -135; Score=37.7; E_value=3.9e-08; Accession=PF00228.10; Description =Bowman-Birk serine protease inhibitor family
  Pfam annotation: Domain name=Bowman-Birk_leg; Domain location=137 -161; Score=25.5; E_value=0.00019; Accession=PF00228.10; Description =Bowman-Birk serine protease inhibitor family
  Pfam module annotation: Pfam domain module=Bowman-Birk_leg::Bowman -Birk_leg; Domain location=110-135::137-161
MVKAATNSRQLQLEPQLAYLNNKKNTWNVLLQIELLSAWFFTLLTERESEREREMMELKKVALVKVALLLFLLGFSATTADATRFDPRSFITQVLPNNYYVKIKSTATACCDLCLCTKSYPPQCNCVDESETGCHSCCKNCICNKKFPRTCYCSDITNFCYDKCNSTEAN

SEQ ID NO: 231954 - protein, 76 aa, Glycine max
  Coding DNA Sequence Number=SeqID_115176
  Gene Ontology: Mol. function=serine-type endopeptidase inhibitor activity; Cellular component=extracellular region
  Homolog annotation: Hit_ID=Q1SVI6; Match level="QueryCoverage=99%, HitCoverage=89%, E-value=7e-09, Identity=46%"; Hit description =Proteinase inhibitor I12, Bowman-Birk; Growth factor, cystine knot
MELSMKVLVKVASLLFLLGFTATVVDARFDPSSFITQFLPNAEANNYYILEKHVTLHAKVVFVIFPRFLDCVNALT

SEQ ID NO: 231955 - protein, 411 aa, Glycine max
  Coding DNA Sequence Number=SeqID_115177
MASMKCKSIGARPTAQYDIRQFHSLDALNRYTDNVLGRSILLERKVEIYHTEFDDFKTELERHNLHKHLTNLADGTIDVALVKEFYANLYSSEDPLPKQARARGHLVACRLPIDHREIEAALCRPWRGFILNAEGHPGRILRKDLTTLAQVWSVLSYSNLAPTSHTSDLTVDRANLTLANLGSPTLITALCRARGIVSDNLTFERLSSAINLAYIKKNCWNTNDPTIAFRGARRARARPADIPSTSAALAPTPTSTSAAPSIPAHVDSQRFEAMLQSIHQGSILSVEQFLEMVAWPGAQPSLDREGEGPTAWVPQHVRDASSKTTIPEPFTLHPEAGEEQVRPETAVTPERSLEGTSEPRTPVADLSSPQPIADPSTHLLDIPEDQTTPVLALNTSPPATPVLHLIDEEDA

SEQ ID NO: 231956 - protein, 140 aa, Glycine max
  Coding DNA Sequence Number=SeqID_115178
MFDLILARVSNSLTPPRVATMNAYDSIERGVVDEGERRRPRTFTLTQLLVACVAVSCCTLAATTVVNTHRGLANFGDPGTEAIKQQYEDVMKKQAEAVKAAASRYEAMIKQAEHIDAMETQAEAIREAKEAEAMEKQLRP

SEQ ID NO: 231957 - protein, 558 aa, Glycine max
  Coding DNA Sequence Number=SeqID_115179
  Gene Ontology: Mol. function=ATP-dependent helicase activity
  Homolog annotation: Hit_ID=Q010R7; Match level="QueryCoverage=99%, HitCoverage=51%, E-value=0.0, Identity=63%"; Hit description=[R] KOG0950 DNA polymerase theta/eta
  Pfam annotation: Domain name=DSHCT; Domain location=378-555; Score =61.7; E_value=2.4e-15; Accession=PF08148.2; Description=DSHCT (NUC185) domain
MVLNLLQGRSLEQVKGIVERSFGNYLGGKARSVRERELQRANDQIKTLTAQIEETNSNEEAGEWRRFVKLDERLKEEKRLLKILVRQAAESQADEIRETLRCELETRPGPVLVAIDIGDNAVRRRKERKSATIALFEDDSMRVEGEDFAGEWRLQDIGNDASVDFDRLTSDFDDGSSEDDFLQSFDENVGLPRGVIAAAVVEAVPAAKIAPTASAVGKPYPMGEFTALGSDGYWYLFYSDRVKYICDDALHLADFELVGSPPASSSLRWIRASGGGVWKADTSKKTKPVAERIPTDPNNFTMLDQAVESAEFIDAQKLQIQQTREEISQLSHIAELRKTAKQQKKRETKLKKLKERRDNIEQRIKEYSAAGWDEFLRVVDILVECGALERESLDLLEFGEVCANLRGENELWLGMTMSSEALADLDAPTLAGFAGALCMDNRPATCFYGASQELVQVLEDLEPTMGDLLYLQSSSRIDMPVSLSYEIAALAESWASGTSWDQIRRDTTLDEGDIARLFRRTAELLAQIPRIPHLPESLKVTAKKANDVVNRPPISDLS

SEQ ID NO: 231958 - protein, 97 aa, Glycine max
  Coding DNA Sequence Number=SeqID_115180
MKGCHFDEHDQQCFSAVGQEECDHADQPEEPEKPEEPEEPEPEEPEPEEPEEPEPEGPEPEEPEEPEEPEPEGPEPEEPEEPEPEEPEPEEPEEPEP

SEQ ID NO: 231959 - protein, 42 aa, Glycine max
  Coding DNA Sequence Number=SeqID_115181
MGEDIVKRMEGDGVRGAKALRPTFTVPSNDFSVGNEESIRLT

SEQ ID NO: 231960 - protein, 129 aa, Glycine max
  Coding DNA Sequence Number=SeqID_115182
  Homolog annotation: Hit_ID=Q014E0; Match level="QueryCoverage=99%, HitCoverage=20%, E-value=7e-09, Identity=32%"; Hit description=[L] KOG2326 DNA-binding subunit of a DNA-dependent protein kinase
MPWETLNPTLAHHRDVFEARALGTRPPEPKEIRLARTRGETSARAFAERFQLDVDEASTDRRVRARLDAGDAGVDERAAPSPVASPEEGTNDRLATVDVWRDVKEEPPTDDAENTARSPANLELFDDME

SEQ ID NO: 231961 - protein, 81 aa, Glycine max
  Coding DNA Sequence Number=SeqID_115183
MRPWWWLRCNRCHRCVREYTSRPIAPGSLLKAATCLCRITVAVNNRIGCYTKKTDDRSRLNSHATLSSVVRCRGHRCLSCY

SEQ ID NO: 231962 - protein, 68 aa, Glycine max
  Coding DNA Sequence Number=SeqID_115184
MSLRSVSSDISKSCTLPSRRRRVVTLYHIDGEENEAGITETTQIQCVSDGPRAASATSAGHHGLEPLE

SEQ ID NO: 231963 - protein, 123 aa, Glycine max
  Coding DNA Sequence Number=SeqID_115185
  Homolog annotation: Hit_ID=Q01A17; Match level="QueryCoverage=99%, HitCoverage=27%, E-value=2e-44, Identity=69%"; Hit description =Chromosome 05 contig 1, DNA sequence
MLYGAKGEEINAMLEEYTKTFIVEEAARRGLSTADLDCEVIGEIAKRVVDELPEHVHVLHEYTDATLGLQELMRERMKMMTPQEFERVLHPIFEQDELTLIISGAVLGAIAGYLQQIGTVKKT

SEQ ID NO: 231964 - protein, 176 aa, Glycine max
  Coding DNA Sequence Number=SeqID_115186
  Gene Ontology: Mol. function=protein kinase activity; Biological process=protein amino acid phosphorylation
  Homolog annotation: Hit_ID=Q2QZ78; Match level="QueryCoverage=99%, HitCoverage=31%, E-value=9e-48, Identity=51%"; Hit description=AT hook motif-containing protein, putative
MNTDEQKTIYNRIIQAVNNNEGGMFFLYGFGGTRKTFIWRTLASSLRADNQIVIIVASSGIASLLLPGGKTAHSRFKIPVSIFEDSTCNIHQGTQLAELLNQTSLIIWDEAPMAHKFCFEALDQSLRDIITNKSNSNQIFGGKAIVFDGDFRQILPVIPRGSRSDIINATINSTYL

SEQ ID NO: 231965 - protein, 322 aa, Glycine max
  Coding DNA Sequence Number=SeqID_115187
  Gene Ontology: Mol. function=transporter activity; Cellular component= outer membrane; Biological process=transport
  Homolog annotation: Hit_ID=Q8A0A7; Match level="QueryCoverage=90%, HitCoverage=28%, E-value=6e-69, Identity=43%"; Hit description =Putative outer membrane protein, probably involved in nutrient binding
  Pfam annotation: Domain name=Plug; Domain location=13-120; Score =83.4; E_value=7e-22; Accession=PF07715.5; Description=TonB-dependent Receptor Plug Domain
MDEVVAIGYGTTKRKDLTGSVASINAEQLKDLPTVSVLQAISGRLPGVNVTITEGSPDAQIKVRVRGGSSITQDNSPLYIVDGFRVANINDIPMADIENIDVLKDAASTAIYGSEGANGVILITTKSGKGGSPKITFNSYLAASNVYNLTEVLSPYEYVYWQRELDPSVAANNSFNSMYGLWEDVDIYKSKGGLNWQDKLYGNTGLQQNYSLGMTGGDKDGSLTYNLNYTRDDEDYIMLNSAYQRDYVSAKLNKKISPKLSFEFNSRMSNTKITGPSISDGRKLREAVKYAPVRSLASLTEGALGGAEDITSAEALSSLNDP

SEQ ID NO: 231966 - protein, 217 aa, Glycine max
  Coding DNA Sequence Number=SeqID_115188
  Pfam annotation: Domain name=Transposase_23; Domain location=129-203; Score=-17.7; E_value=0.099; Accession=PF03017.5; Description =TNP1ENSPM transposase
MTSEAPKEITEKIDLLEEQASQRSFVSYGRQDVLIVAIGRPEHPGRVRAVRAGVTIKQYFESNPQTSHTSSSMAPEELEQLTQQIRDQLEESIKEKGLALPLEPKVGPSTAHVSIKESCVNPSGNDPDTSDSDKCGLYIEENIPHLVALGRVYEGSITIHNIPLLHDQVKVSVEEVKDADAPVPVPTDEGVVGPAKPIDRLHHEVDDPLYLMTLIIP

SEQ ID NO: 231967 - protein, 681 aa, Glycine max
  Coding DNA Sequence Number=SeqID_115189
  Gene Ontology: Mol. function=transporter activity; Cellular component= membrane; Biological process=oligopeptide transport
  Homolog annotation: Hit_ID=Q9FRU2; Match level="QueryCoverage=94%, HitCoverage=99%, E-value=0.0, Identity=66%"; Hit description=Nitrate transporter NRT1-5
  Pfam annotation: Domain name=MFS_1; Domain location=40-604; Score= -34.7; E_value=0.012; Accession=PF07690.6; Description=Major Facilitator Superfamily
  Pfam annotation: Domain name=PTR2; Domain location=202-588; Score =215.9; E_value=9.4e-62; Accession=PF00854.12; Description=POT family
  Pfam module annotation: Pfam domain module=MFS_1::PTR2; Domain location=40-604::202-588
MTKRETSENDEEESLLKNENSGTDNESKINYRGWKVMPFIIGNEIFEKLGAIGTLSNLLVYLTTVFNLENITATNIINIFNGSTNFATLLGAFLSDAFFGRYKILAFCTVASFVNRTIPQSLNELKREQNRNRSGLGRVSADSGELRVHASCCLQLLNRVSSSSRRIRCQSATVKSDGEGILRETTTVKFECHCAVCASSRLAAIEKLHPPHCEESAICQGPTEGQMTFLKTGLGLLMVGAAGIRPCNLAFGADQFNPNTDSGKKGITSFFNWYFFTFTVAQMISLTIIVYIQSNVSWAVGLGIPSALMFVSSIIFFMGSKLYVKVKPSGSPITSIVQVIVVATKKRRLKLPEYQYPSLFNYVAPNVHQMVYLNRFLDKAAIVTPQDQINPNGSVTDPWNLCSMQQVEEVKCLLRVLPIWVSGILYFVVIVQQHTILVFQALLSDRRIGQSEFLIPGASYYVFLMISVAIWLPMYDRKVMPLLQRLTGKEGGITLLQRMGIGIFFSILSMLVSAKVEKHRRTLALINPLGVETRKGAISSMSGLWLIPQLSLAGLAEAFMSVAQVEFYYKQFPENMRSIAGSLYYCGHAGSSYLSSVLISVIHQITAKSETGNWLPEDLNKGRLDNFYSLIAALEIINLGYFVLCARWFRYKGTGSSSIELEKATKQSERSATNCVNDSNL

SEQ ID NO: 231968 - protein, 64 aa, Glycine max
  Coding DNA Sequence Number=SeqID_115190
MGRKQRSNLFVDELRGRLALWSLGRMLLNSNVIHVRMVMLVPRSALVFLQRHGGNLAPVCIVDA

SEQ ID NO: 231969 - protein, 209 aa, Glycine max
  Coding DNA Sequence Number=SeqID_115191
MKCGKSVFMKFLLANLFHLHVYSIMLSSQDQDKCKLRKLKEEDFKCFGGKLMQKLEEKTLKKNRKNWKARLARKRPMKKPKGALSAKARSKPEVNPRLNPYCWVRGGQSACDVILCLLCGSNVFQDYFDDAKESRVKQVPKNQASRIKSQRIKIQEQLSFTIQDSRTIKIKIQDSRFKIQEKLISRFKRRNREATVKTSQGKYFSKIQT

SEQ ID NO: 231970 - protein, 182 aa, Glycine max
  Coding DNA Sequence Number=SeqID_115192
  Gene Ontology: Mol. function=hydrolase activity, acting on acid anhydrides, catalyzing transmembrane movement of substances; Cellular component=integral to membrane; Biological process =metabolic process
  Homolog annotation: Hit_ID=Q9SU58; Match level="QueryCoverage=98%, HitCoverage=18%, E-value=2e-51, Identity=57%"; Hit description =ATPase 4, plasma membrane-type
  Pfam annotation: Domain name=Cation_ATPase_N; Domain location=10-90; Score=108.8; E_value=1.6e-29; Accession=PF00690.16; Description =Cation transporterATPase, N-terminus
  Pfam annotation: Domain name=E1-E2_ATPase; Domain location=102-182; Score=-98.2; E_value=0.00082; Accession=PF00122.10; Description=E1 -E2 ATPase
  Pfam module annotation: Pfam domain module=Cation_ATPase_N::E1-E2 _ATPase; Domain location=10-90::102-182
MGDKSQVLEAVLKETVDLENIPIEEVLENLRCGREGLSSEAAEERLTIFGHNKLEEKKESKFLKFLGFMWNPLSWVMEAAAIMAIALANGGGKAPDWQDFVGIITLLLINSTISFIEENNAGNAAAALMARLAPKAKVLRDGRWNEQDAAVLVPGDIISIKLGDIIPADARLLEGDPLKIDQ

SEQ ID NO: 231971 - protein, 51 aa, Glycine max
  Coding DNA Sequence Number=SeqID_115193
TLLDIPGGRNIVVKEYLWKGDDLESLIIHGQCIDGAHVSYVVCCVRTWAVQ

SEQ ID NO: 231972 - protein, 79 aa, Glycine max
  Coding DNA Sequence Number=SeqID_115194
MSGYGDANFECNQRYLEAKWKIGNINMVHGNLVRVPVVTYPSAGGRREAHGCIFQGRKTCRVTTNVYLRKTLEKPNAGL

SEQ ID NO: 231973 - protein, 146 aa, Glycine max
  Coding DNA Sequence Number=SeqID_115195
  Gene Ontology: Mol. function=transporter activity; Cellular component= integral to membrane; Biological process=transport
  Homolog annotation: Hit_ID=Q9LHQ6; Match level="QueryCoverage=93%, HitCoverage=25%, E-value=4e-44, Identity=61%"; Hit description =Organic anion transporter-like protein
MPTTSSSESKDRNADPSRSPLISAAEKPTGESSKSEKLCIDEMLQRYCGEFGRWQLKHFILTSLAWALEAFHTMVIIFADREPEWRCLDGPAGLRCDPAAKSVCRLEPGSWKWVGDSTVAEWDLFCGDKFKVGLVQAVFFGGCMIG

SEQ ID NO: 231974 - protein, 128 aa, Glycine max
  Coding DNA Sequence Number=SeqID_115196
MFHLAMKFLSDEIQVITSKGDHKKACRCYKESLKQNNLDKSNKMDYEPRTKTQSEVMLIELDCREDIKKGVWEPRLELEASCQDLHIESMKEQVTSIGADLGEGTREILSSFMEANKHARYSPKLFLS

SEQ ID NO: 231975 - protein, 90 aa, Glycine max
  Coding DNA Sequence Number=SeqID_115197
  Gene Ontology: Mol. function=transporter activity; Cellular component= integral to membrane; Biological process=transport
  Homolog annotation: Hit_ID=Q9LHQ6; Match level="QueryCoverage=98%, HitCoverage=17%, E-value=2e-26, Identity=64%"; Hit description =Organic anion transporter-like protein
KGEDEDEEEEGGDGGGNVEIAPCGEDVGKDGEEGDAGGEEVEGGHANCTPHFGAHRLGGEDEGAEADATGAAAGEEAEEDVEGVVGGEGC

SEQ ID NO: 231976 - protein, 118 aa, Glycine max
  Coding DNA Sequence Number=SeqID_115198
MAKYDPEIVMEFYANAWPTEEGVRDKRSWASAESLTRVGVKPRAMMRRPSASCYAFRGRISPGAWRGDGPPPTEVSAGLHHPDSWITPPRHPVDLEKSNRALGFPALITGLCQFYGVT

SEQ ID NO: 231977 - protein, 44 aa, Glycine max
  Coding DNA Sequence Number=SeqID_115199
MALKKLLAKSSKKDAAREGSRVRNTSDDLRPLKVGRSSWRGESS

SEQ ID NO: 231978 - protein, 137 aa, Glycine max
  Coding DNA Sequence Number=SeqID_115200
  Homolog annotation: Hit_ID=Q1RUG8; Match level="QueryCoverage=45%, HitCoverage=56%, E-value=4e-07, Identity=39%"; Hit description=Zinc finger, GRF-type
  Pfam annotation: Domain name=zf-GRF; Domain location=15-60; Score =60.7; E_value=4.7e-15; Accession=PF06839.3; Description=GRF zinc finger
  Subcellular localization annotation: CTP_CleavageSite=29; ConfidenceScore=5.13e-01
MSANSSTRGNATSNRLCYCRRRATIQTARTARNKGRLFYACPLPQQDTDRCNFFLWVDEDIDVGATEIGRIESIPDFGLRLRPEILQREVRSPIALLSSPAHSGLQLLLNFFPYLIWIAASGTMVHFLQLTSIYGHS

SEQ ID NO: 231979 - protein, 69 aa, Glycine max
  Coding DNA Sequence Number=SeqID_115201
  Gene Ontology: Mol. function=protein kinase activity; Biological process=protein amino acid phosphorylation
  Homolog annotation: Hit_ID=Q9LTU4; Match level="QueryCoverage=100%, HitCoverage=4%, E-value=1e-18, Identity=63%"; Hit description =Helicase-like protein
MAHKFCFEALDQSLRDIIKGKSSSNKIFGGKVMVFGGDFRQILPVIPRGNRSDIVNATINSSYLWDYCQ

SEQ ID NO: 231980 - protein, 132 aa, Glycine max
  Coding DNA Sequence Number=SeqID_115202
MYFFQRLRQRAFQKLTTFRRYRLEVMVNHKDKSTKFLLWDHECTELIGQSTDEVNRLKIAQSLSVTVDHDPLLGLCRNVPFCGRAKARLTGALSKGGKMRGVATNVYLWKMSEKPKETGQNENSKFGSCIYA

SEQ ID NO: 231981 - protein, 56 aa, Glycine max
  Coding DNA Sequence Number=SeqID_115203
MVHLVIHLAYEAKVTGPIHYRRMYPIERLHAYNNKIVLKLQMIKWLARGLLETVRR

SEQ ID NO: 231982 - protein, 104 aa, Glycine max
  Coding DNA Sequence Number=SeqID_115204
MGSEIYPEVHENLGAFFSSSSPILLESSIQYPWGVGLVGGTMPSFAAIPLTGERGQPAIQVGPIIVVAEVSLDVCSSLLANRKRDNGIGVLGRKKSSAPLAFVH

SEQ ID NO: 231983 - protein, 149 aa, Glycine max
  Coding DNA Sequence Number=SeqID_115205
MFSFISDSAIGMGGNDSRGLIQQPLVDQEVISISDYSLEETHHATSNLLPWKGRGKPIPVTIILPPSISGGARRSGGGDVRASPRVRGDVLKYRSSITSAVSVAALPRQVKLVSLDDFPFLRAVLGNLPFFSCIGALRDLASSSPLDYI

SEQ ID NO: 231984 - protein, 239 aa, Glycine max
  Coding DNA Sequence Number=SeqID_115206
  Gene Ontology: Mol. function=RNA-directed DNA polymerase activity; Biological process=RNA-dependent DNA replication
MVALFHNMMHKEIEFYVDDMIAKSKTEEEHLVNLRKLFKRLRKYRLRLNPAKCTFEVKYGKLLSFIMSQKRIEVHPDKVKAILEMPEPHTKKQVRGFLGRLNYITRFISQLTATWKKKTNTQEFYTGSAITHAYIQSPSDLRSLRFLFNLVNSFTSKDPQGMYPPLFSLNNLVDVPSTRTDSQEMYPLLFSVTTTQVDVPSTCTTKDIPSNVLRQSSQAVSPSKLCEGGNKRILRRLVF

SEQ ID NO: 231985 - protein, 834 aa, Glycine max
  Coding DNA Sequence Number=SeqID_115207
MSQGDAYKRKMQNSVYSFREQGTVGNKKVKLDDIDASYVHEKKLGLKTLSEENKEEVKNWDSVGKQQKAASPIRGILKNHKHISESTSSGSNIQDGNEESHCDVQVLLSDNHVRFSAEDSVLGPEKRNSFDETGFSLSSDSLASSFGEKQFTGNEEGTVNLEENRNDNTAINTDKTKEVCPMVENKQFSNTLGHVAVQKLLKPCSSEEKSKHLEEKSESLSNVTICDNNLDRFDRGNTTTVLVSPYGDFSRSLSEFQGGQTSGINTQACESEAFSCTGKFIDHLGGPTFQSTNANTRTYLEPSPSYSASCNEVNERPEFPLHTYKNNDNNGQALGGRSLSGTFSADRIGNSFLLPGWGKGSIRNNCMGLNFYGLPLNSHGELINFSSSGKVEMNKIETSCTLRGSLTDLAVNNVFHQNSQEYLSIGKRHVVQKTFQDRVNLFPHYSGSLGVRELHGRERADIYQHNSGWCSNHHVEPFDSELNLMRNPFIEQNQLEKMPNHKEYGMVSPRGSSGLLSPSSSQPTMRLMGKDVPIGRSSKEKQKIVGGVPWAEEKSRRHYSVDSARDNSLLGRCYMPDSASGSQSQRQTENVFQSVKIQSNQALQSTLLMKGPNSEFLNLRSNHHISQNGSLGFSRNASTNLHTISQAPTSCAIYNRPHEDLPEQFISGAKPQGFCFHSQVPSSPCNFNLSTLSSGELNDRKRHHCVTNSSFGFPFLHPIVEEQAKSSWSKSSYRSLPPWSLGSTHERPLGSSSSTSFPHNTWRNDSTIPFVNHSADVLYPPNSVTSHFPRKTILCPTSIARPHSPHASVPPIIEPPSAIDSGCRNIFKVTDSEI

SEQ ID NO: 231986 - protein, 115 aa, Glycine max
  Coding DNA Sequence Number=SeqID_115208
  Gene Ontology: Mol. function=nucleic acid binding; Biological process= DNA integration
  Homolog annotation: Hit_ID=Q1SCY9; Match level="QueryCoverage=91%, HitCoverage=15%, E-value=5e-23, Identity=76%"; Hit description =Integrase, catalytic region; Zinc finger, CCHC-type
MEGCHPVDTPLDKGSYQRLVGRLMYLNHTRPDLTNALSAVSYNKPEDPKIRLYCDNKAACDIAYNSIQHDHTKHIEEDRFFIKEKLDRKIVELPKIRPEDQQADILTKAVSKAVF

SEQ ID NO: 231987 - protein, 480 aa, Glycine max
  Coding DNA Sequence Number=SeqID_115209
MNLIGDYTSKMRSVDVFKCWPFAASGLSRDEAESWLPPMSIPESRQWSDNLAGQRSNLACAGRGGERLNQPNGMISYESESEKEDKLVSGGCAKDKLVTGGCAKDLVLEEEEKVELVCPVCRDFKAATLTTVNAHIDDCLSRTVREERRWMRQSKPKAPKRRSISEIFEMKEDVEKEKPPEIESVLKRFVADEVSITVTKFRWLSERLAALRSNGISFDFVGGNSNSTDEEKESEMLCPVCRVFNTATVTTANAHIDDCLSMAMKKNELWLEPSLNNPKLKVSKKRSLAEILTVTPQINAVGDRKLTAEAGKEDENEENGEEFANFKRSTNNNVTKKKKLKKVITRKKNKVERRGFVILNDESKKINKRRKKLNKEFTAKKRVPCDNRFATLRVAFTAYKIDAEKRGGLRDSVTFVIRGTELDTQLTAGYMMKFRFVHGICVRQLGSEFEGSLIIGSIIYRDVLLSHKIYTGLVIAMTRE

SEQ ID NO: 231988 - protein, 84 aa, Glycine max
  Coding DNA Sequence Number=SeqID_115210
MASIKIAFAVVFLALIACNGHGFKNIRRMKALGENHETDECWKTGCYHKGKPQCNVNRDCWFACTDYFDIAYCDMSTRKCVCPC

SEQ ID NO: 231989 - protein, 93 aa, Glycine max
  Coding DNA Sequence Number=SeqID_115211
  Gene Ontology: Mol. function=transferase activity
  Homolog annotation: Hit_ID=Q2HSF9; Match level="QueryCoverage=99%, HitCoverage=32%, E-value=3e-11, Identity=63%"; Hit description =Polynucleotidyl transferase, Ribonuclease H fold
MAVLAFSNANAFRSVWWTDIVRYAIRVECERGHNWPTFEQELLMKDDQSENAKERRKCMWLTRQWEMVGRLDDKCRDHHYLDCASMSPPLLGP

SEQ ID NO: 231990 - protein, 103 aa, Glycine max
  Coding DNA Sequence Number=SeqID_115212
  Gene Ontology: Mol. function=transferase activity
  Homolog annotation: Hit_ID=Q2HSF9; Match level="QueryCoverage=98%, HitCoverage=15%, E-value=8e-39, Identity=79%"; Hit description =Polynucleotidyl transferase, Ribonuclease H fold
  Subcellular localization annotation: CTP_CleavageSite=87; ConfidenceScore=5.28e-01
MATTNPTSSKSSLLLNVSITFKLSRANYRAWKRQVTALLSGIQVMGHIDGTISSQSPTIVQDGSSTPNPQYTNWFTIDQLIINLLLSAMTEANSLSFASYDTA

SEQ ID NO: 231991 - protein, 119 aa, Glycine max
  Coding DNA Sequence Number=SeqID_115213
MAAKFGCYVHIDEVFQQTYTRKDIGEFVNERTKRTEFQRIYSQARFEATSFVSELETSPLEPSLEKSIRPRCWAEVVGGKTKGRLYGVGDLTHDYEGGDCSLTQKRKAPNISSNSEEII

SEQ ID NO: 231992 - protein, 915 aa, Glycine max
  Coding DNA Sequence Number=SeqID_115214
  Gene Ontology: Mol. function=protein binding; Cellular component =membrane; Biological process=defense response
  Homolog annotation: Hit_ID=Q1SW19; Match level="QueryCoverage=98%, HitCoverage=96%, E-value=0.0, Identity=44%"; Hit description=Disease resistance protein
  Pfam annotation: Domain name=Arch_ATPase; Domain location=165-356; Score=-98.9; E_value=0.096; Accession=PF01637.9; Description =Archaeal ATPase
  Pfam annotation: Domain name=LRR_1; Domain location=574-595; Score =3.6; E_value=59; Accession=PF00560.23; Description=Leucine Rich Repeat
  Pfam annotation: Domain name=LRR_1; Domain location=621-642; Score =10.1; E_value=3.7; Accession=PF00560.23; Description=Leucine Rich Repeat
  Pfam annotation: Domain name=LRR_1; Domain location=644-665; Score =1.6; E_value=1.5e+02; Accession=PF00560.23; Description=Leucine Rich Repeat
  Pfam annotation: Domain name=LRR_1; Domain location=771-793; Score =4.9; E_value=34; Accession=PF00560.23; Description=Leucine Rich Repeat
  Pfam annotation: Domain name=LRR_1; Domain location=844-865; Score =8.7; E_value=6.6; Accession=PF00560.23; Description=Leucine Rich Repeat
  Pfam annotation: Domain name=NB-ARC; Domain location=147-460; Score =337.0; E_value=3.2e-98; Accession=PF00931.13; Description=NB-ARC domain
  Pfam module annotation: Pfam domain module=Arch_ATPase::LRR_1::LRR _1::LRR_1::LRR_1::LRR_1::NB-ARC; Domain location=165-356::574 -595::621-642::644-665::771-793::844-865::147-460
MAEMAVSFARDKLLSLLSNEANLLSGIPKEFADIRKDADSRAANEGDNTNEGIRTLVKELREASFRIEDVIDEYLIYVEQQPDALGCAALLCQIIHFIETLMPRHRIASEIQQIKTVVDGIMQRVQNYNSLNQLFSKQGQSSHGGVQRHQPRSNPRFLEDAEVVGFEDTKDELIGWLVEGPAERIVISVVGMGGLGKTTLVGRVFNNQKVTAHFDSHAWITVSQSYTLEKLMRDLLKNLCKEEKKEPPRDVSEMDQDSFIDEVRNHLQQKRYIVIFDDVWSVELWGQIKNAMLDNNNGSRIVITTRSMDVVNSCMNSPSDKVHELKPLTFEKSMDLFCKKAFQRHNNGGCPEDLEDISSDFVEKCKGLPLAIVAIGSLLKDKEKTPFEWEKVRLSLSSEMKKNPHLIGIQKILGFSYDDLPYYLKSCLLYFGIYPEDYRVKSKRLTRQWIAEGFVKVEEGKTVEDVAQQYLTELIGRSLVQVSSFTIDGKAKSCHVHDLLRDMILRKCKDLSFCQHISKEDESMSNGMIRRLSVATYSKDLRRTTESSHIRSLLVFTGKVTYKYVERIPIKYRLLKILDFEDCPMDFVPKTWGNLAHLKYLSLRRCIGAEVLVKFISKLQNLETLDIRNAKLGEMSKEICKLTKLRHLLVKNVKLFELKNGLGGMTSLQTLCQLSVGYNEDDDVVELLKELGKLKQLRSLGLIDLKEGLGTALCSTINELPNLEKLHIQSDWDFDFNVIDLPLISSLAMLRKLKLSGRLNKFPEWVPQLQNLVKLSLLRSRLTDDPLKSLQNMPHLLFLYFGYCAYEGGSLYFQNGGFQQLKELYLYELRYLGSIIIDKGALCSLETLELYRIHLETVPHGIQHLEKLQVLNAYVLPDKFMECVAPDGGPEHPSIQHVPLVRITSYGKTTRIIHH

SEQ ID NO: 231993 - protein, 62 aa, Glycine max
  Coding DNA Sequence Number=SeqID_115215
MIDYKDQRVNSKKRYNTIVEAQHGESNFESTGRSPIPMPIQGAMLVENITLARLLIVQNICY

SEQ ID NO: 231994 - protein, 350 aa, Glycine max
  Coding DNA Sequence Number=SeqID_115216
  Gene Ontology: Mol. function=ATP binding; Cellular component =membrane; Biological process=defense response
  Homolog annotation: Hit_ID=Q0PDU6; Match level="QueryCoverage=59%, HitCoverage=78%, E-value=6e-42, Identity=41%"; Hit description=NBS -containing resistance-like protein
  Pfam annotation: Domain name=NB-ARC; Domain location=101-350; Score =72.2; E_value=1.6e-18; Accession=PF00931.13; Description=NB-ARC domain
MWVSLARDKLLSLLSNKAKLLWNIPKKFVDIKTELDFIQAFLKDADSRVVDEGDNTNEGIRILVKEFREASFRIEDVIDEYLIYVEQQPDALGCATLFFEYDIAHFNEYLKHRHQIASEIQQIKDQQGALSFVVGIGGLGKTTLVGRVFNNEMVMAHFDSHAWITVSQSYTVGKLMRDLLKKLCKEEKKEPPRDVFEMDQDSLIEEMRNYLQQKRYIIVFDDVWSIELWGQIEISMLENNNGCRILITTRSMDVVKSCKNSSFNKMHELKPLTFEKSMELFNRKATPMSQINERCPEDLVNTSSGFVKKCKGLPLAIVAIGSLLDDKEKTPFEWKKISQSLSSKMEKIPI

SEQ ID NO: 231995 - protein, 97 aa, Glycine max
  Coding DNA Sequence Number=SeqID_115217
MDNYLKNWSWVWDEDILTTLRDIGAGWIIYLCGSFITQSSDKILISKEYFFTSRVKIKRKTWFQIGEKEERARESRNGALRLFLTVTGARTLCSSDS

SEQ ID NO: 231996 - protein, 444 aa, Glycine max
  Coding DNA Sequence Number=SeqID_115218
  Gene Ontology: Mol. function=RNA-directed DNA polymerase activity; Cellular component=chromatin; Biological process=chromatin assembly or disassembly
  Pfam annotation: Domain name=Chromo; Domain location=348-402; Score =36.5; E_value=9.1e-08; Accession=PF00385.14; Description='chromo' (CHRromatin Organisation MOdifier
  Pfam annotation: Domain name=rve; Domain location=64-201; Score=49.8; E_value=9.2e-12; Accession=PF00665.16; Description=Integrase core domain
  Pfam annotation: Domain name=zf-H2C2; Domain location=5-46; Score =8.9; E_value=0.024; Accession=PF09337.1; Description=His(2)-Cys(2) zinc finger
  Pfam module annotation: Pfam domain module=Chromo::rve::zf-H2C2; Domain location=348-402::64-201::5-46
MEEFHATPQGGHSGFYRTYRRLASNLFWKGMKGDIMRFVQDCDVCQRQKYLTTAPGGLLQPLPIPDQVWEDISLDFITGLPRSKGFEAILVVVDRLSKYSHFIPLRHPYTARAIAEIFVKEVIRLHGVPNSVVSDRDPLFMSLFWKEFFKLQVTNRCLETYLRCFITDQPKGWVIWLPWAEYWFNTTYQDSIGTTPFEVVYGRKPPMIVKSIQGEVKVEVVQRELQDRDEALRQLKNHLARAQERMKKQADKHRKERNFEIGDLVFLKLKQHRQHSVAARISPKLSARYYGPFEVIERIGEVAYRLKLPISSKIHLVFHVSSLKKAHGDYKVESTLPSGLEDDREGEIELELVLATRSIMKRGERVNQWLVQWKGKSVDEATWEDKLTLKSQFPELSLEDKTLLQGEGVDRNQICNGPLVHEMQKGQREWLVYSRRKKRGVEEE

SEQ ID NO: 231997 - protein, 151 aa, Glycine max
  Coding DNA Sequence Number=SeqID_115219
  Homolog annotation: Hit_ID=Q5MJW2; Match level="QueryCoverage=46%, HitCoverage=25%, E-value=1e-08, Identity=42%"; Hit description =Avr9/Cf-9 rapidly elicited protein 102
  Subcellular localization annotation: CTP_CleavageSite=21; ConfidenceScore=5.60e-01
MPRPPSNPAPPPPSNPHAKWMCMSTQPNHNRFGFMHFLLFIVNTITFSSLQHTLKILSMKLWILDVVITFAIPNSSSTNQSRSSTRITDVVVFVNKNFKSKGEEGEGEAKVEVSIEGRVNDTVGSGDTGLDEDGGVRLCSVGEGEEEGLNF

SEQ ID NO: 231998 - protein, 87 aa, Glycine max
  Coding DNA Sequence Number=SeqID_115220
MTLERQTTHLIKNGPNQMVHRNINEPKRSKVRHSLRNNTNRDATHFGQRAPKRNVSKHVQKPNGSTKKQRRPIQKQIVTSSQEEWKG

SEQ ID NO: 231999 - protein, 348 aa, Glycine max
  Coding DNA Sequence Number=SeqID_115221
MKVFENHCCYKGDRISDEEDACSQDSEMGMRLGSSGSEFSFDTWHATEHDVVQRQDSTEDNLETNKSVDLDQGKGVIGPLAHCAASISQPLGFELKKITIGPSDSKPTKALLTSNKFFDPPKSHASSNYKGEAENMLDQGVNIGFLDYGSQKVFIDNLTLLVERDESKVKTARGLIRKYDTQFVTLQETKKDFIDLEFYKRLWGDYVVSWEAIFENNTSGGNWRDNNEVITLVNVYSPWDLEALDVPMIDCKFTWYQIRELKAKLIDSFALGGGQRDMPKLSSGGTKCICLEGNLKITKQALKRWNLEEFGNLKKKKKDAQLEMNSLDLSEEERSLGEEEKTRKIHIQ

SEQ ID NO: 232000 - protein, 170 aa, Glycine max
  Coding DNA Sequence Number=SeqID_115222
MYIADDVNRVKIEDGDVYLNASPQALDRLLGHVLAFKVRIQSKFKNAVVVRYSNELDLINAALEMLADSEACSKIDPSNVDCNNATHAECQSLSVTTDHDPVAGFPLTPKKRMPSDELDDELGSSQISPAQLSSNKLTRHSDKNNYVVFVIGTSDNSPGVSFYHADALAI

SEQ ID NO: 232001 - protein, 120 aa, Glycine max
  Coding DNA Sequence Number=SeqID_115223
MRRSLHGDLRSLPQAPSCLYSRPTMIASAFHLLLPAASVVQNPFFKYILGCLNGPEGLLHFYIKELKSSKPICDTIWSQQMHTTRQPVWSPPAGRASVAELATPAPATNLGCAFVASCYS

SEQ ID NO: 232002 - protein, 406 aa, Glycine max
  Coding DNA Sequence Number=SeqID_115224
  Gene Ontology: Mol. function=transferase activity; Cellular component= nucleus; Biological process=flavonoid biosynthetic process
  Homolog annotation: Hit_ID=O64470; Match level="QueryCoverage=90%, HitCoverage=76%, E-value=6e-56, Identity=36%"; Hit description =Putative anthranilate N-hydroxycinnamoyl/benzoyltransferase
  Pfam annotation: Domain name=Transferase; Domain location=1-404; Score=146.5; E_value=7.2e-41; Accession=PF02458.6; Description =Transferase family
MKTIVASYNITPNQPTPKDPLWLSDSDQIGVLGHVSILYIYRSAKEHNNNTVERMKNSLSKLLSYYYPVAGRLRLSKSGRMELDCNAKGVTLLEAETTNTFVDYGDDFSPSEFTDELIPKLDDTQQPIEEIPLLLVQLTRFHSGGDCEGLAIGVLLSHPLTDATGIIDFMNRWAKLSRGEELDPNEIPFLDRTLLKFPDILLEKPREVNTREISKLDTSTLQHIPTSKLLDQWKKPVVPQTPEDDGIDKPKKRSGAMLKLTSSQVERLKNKAMANNHQSSKQGSRPNYSRFEVVAAHIWRCASKALGDDLTQVRFSVNFRNRMNPPLPHNYFGNAVANVATPEGDIISNPLGFAAHKIREASHAVTDEFVKSQLNVSRLGQVQLDNIRAFFMRQGHRVNIPYALII

SEQ ID NO: 232003 - protein, 93 aa, Glycine max
  Coding DNA Sequence Number=SeqID_115225
MYQKAFDRLEMEDKKKYLQLYQGVEEGSQINQKVVKLDEEDDDDIHDCEPFIKSINFDILNWWKDFKELEKFEQDMVSPHEGASSTVVINLDD

SEQ ID NO: 232004 - protein, 118 aa, Glycine max
  Coding DNA Sequence Number=SeqID_115226
MDEEYNANGMEMIRVEAEMHNYSDETKRVVVRLTSLAALIGLQLLLSGICRAWQIKLSESVSLSLIDIKAHIEKVGAISESVSLSPISLNAQPEKVLGLEDGLTQRGTLCHWMRDWCA

SEQ ID NO: 232005 - protein, 427 aa, Glycine max
  Coding DNA Sequence Number=SeqID_115227
  Gene Ontology: Mol. function=RNA-directed DNA polymerase activity; Cellular component=chromatin; Biological process=chromatin assembly or disassembly
  Pfam annotation: Domain name=RVP_2; Domain location=259-392; Score= -51.4; E_value=0.01; Accession=PF08284.2; Description=Retroviral aspartyl protease
  Pfam module annotation: Pfam domain module=RVP_2::Retrotrans_gag; Domain location=259-392::53-143
MPKGRDSRNSTPVPFIFIANPSTIPSSVTSHRLKLEITQFFEYHETPEPDRLTIASFYMEGLTLAFFQWMSRNGQLSSWPSFLRALEARFAPSQYDDPTGALFKLNQHRSVNTYLSEFESLANKIVGLPTPFLLSCLILGLTPEIHPEVQEKLADSCLFFQRRSVASTLSVPPPSQPLPPVPTSALLPTPQPSPSIPFKKLSPEELALHREKGLCFNCDEKFSRGHCCSSKMFLSITDEDGNPALIPPDELGDTGEQVGPLSGQISLHTIASHIAPKTLCLVGWLAGHMVWILIDGGSTHNFIQKRLITNLGLTTQATQPLWVMVGSGHELECHLRCPDTLLRIQGHDFRVQFHVLPLCRADLVLVVEWLKSLGPVLTNYSELTMKFTHDGRIVELKGDHNNGVGSISVHQLRCLVQTNKVSEFFHL

SEQ ID NO: 232006 - protein, 847 aa, Glycine max
  Coding DNA Sequence Number=SeqID_115228
  Gene Ontology: Mol. function=RNA-directed DNA polymerase activity; Cellular component=chromatin; Biological process=chromatin assembly or disassembly
  Pfam annotation: Domain name=rve; Domain location=523-679; Score =81.8; E_value=2.2e-21; Accession=PF00665.16; Description=Integrase core domain
  Pfam module annotation: Pfam domain module=RVT_1::rve; Domain location=104-382::523-679
MASCRHGPVSCVSLKLALLHPSTTTQPELYLNSINIGLTPEIHREVQVAQPLMLVQATTLARLHEEKLANSYLFFQCHSVTSALSVPPPSLLLPPIPTSALLPTPQPSPSIPFKKLSPEELALRREKDDNPTYELIPPDELGDTGEPVGPLSGQISLHTIAGHIAPETLRLVGWLAGHRVWILIDGVATSWSATCGDLTLFFGFKGMIFGFNSMFFTYAKQIWSWGDRNSGAGSISVHQLHCLVQTNTDEDVSKTMFCTHHDHYEFRVMPFGLCNAPLSFQATINETFRPYLCKFIIVFFDDILVYSKTFQDHLVNLVKTFRALETGQFFLKKSKRYASIANPLTQPHLVWSSVAQTFFQQLKDAISSAPSEHPIGFFNKQFCLKLRHASTYVRELATLTTTPEQQFYHSRLMGYNFRIKYRTEQLKTDLTTHPDFVALRPLNTDLTTHPEFVALRQEILANPTKRPEYTIANDLILLNNRIWLPKGIAFIQTLLQEFHTCLDCQATKYEAKKPAGLLYSLPAPSRPSKDLSMDFIVGLPLYHDNTTILVVVDRFSKGIHLGMLVTNYTASSVALLFMEIMGKNHGMPKSIVSDRDPLFVSRFWQELFRLSETKLRMSSSYHPQMDGQTEVLNRVMEQYLRAFMHNKPKSWGKLLLWATWCYNTSIHSATGVSPFEETFGRKPPSIPQYLTSDSQVIAVDNILNEREVVFTTLSKKLSKAQQRMKLTVDVHRWDVMFEPGEWVMLQLPEESRIHPVFHCSNLKLFQNSTTATPLALPSQDIDNNPVIIPLAILGTHWDLVLKKAHHLKDKVLPNGVENDKPKIGNAKITQGKPKRRIIVPNHLKDYA

SEQ ID NO: 232007 - protein, 66 aa, Glycine max
  Coding DNA Sequence Number=SeqID_115229
LQTKFREDPTVNEGWAAFLPRQLHTKFREDPTVNEGWTAFLPRQLHVAFSRSFIKRLPLEASSWLL

SEQ ID NO: 232008 - protein, 217 aa, Glycine max
  Coding DNA Sequence Number=SeqID_115230
DVVGGGDRGGISGGGDGGDKCGINGSNVNGGCGNDGDDKCGIVSSGDDTMTVVVTLMVVRVVVMLVVMVMLVAMIVAVIVVLVGVPSGDDDDGCDNNGGDSDTNDDGGHGDDDDGGIGGDGGGDDNKKCHCQMASLGAAVKLCLGDLLVMGSNSETAKECVHDTCAECAFTVESSGRALSAGCGLARDSCLPMWLLALSDLLGLNGFDLLSEKVVLH

SEQ ID NO: 232009 - protein, 98 aa, Glycine max
  Coding DNA Sequence Number=SeqID_115231
  Gene Ontology: Mol. function=sequence-specific DNA binding; Cellular component=nucleus; Biological process=regulation of transcription, DNA-dependent
  Homolog annotation: Hit_ID=Q56NI2; Match level="QueryCoverage=75%, HitCoverage=31%, E-value=5e-33, Identity=93%"; Hit description=MADS box protein M8
  Pfam annotation: Domain name=SRF-TF; Domain location=24-74; Score =117.7; E_value=3.4e-32; Accession=PF00319.9; Description=SRF-type transcription factor (DNA-binding and dimerisation domain)
MEDPNQAQEGSSQKKMGRGKIEIKRIENTTNRQVTFCKRRNGLLKKAYELSVLCDAEVALVVFSTRGRLYEYANNRFYQHTNPSLNFSNPQILKVLDK

SEQ ID NO: 232010 - protein, 106 aa, Glycine max
  Coding DNA Sequence Number=SeqID_115232
  Gene Ontology: Mol. function=sequence-specific DNA binding; Cellular component=nucleus; Biological process=regulation of transcription, DNA-dependent
  Homolog annotation: Hit_ID=Q56NI2; Match level="QueryCoverage=71%, HitCoverage=31%, E-value=4e-25, Identity=80%"; Hit description=MADS box protein M8
  Pfam annotation: Domain name=K-box; Domain location=33-105; Score =40.0; E_value=8e-09; Accession=PF01486.8; Description=K-box region
MDPTNPTLAFKQFPELFVLCSVRATIERYKKANAAASNAESVSEANTQFYQQESSKLRRQIRDIQNLNRHILGEALGSLSLKELKNLEGRLEKGLSRASINWYLTG

SEQ ID NO: 232011 - protein, 66 aa, Glycine max
  Coding DNA Sequence Number=SeqID_115233
  Gene Ontology: Mol. function=sequence-specific DNA binding; Cellular component=nucleus; Biological process=regulation of transcription, DNA-dependent
  Homolog annotation: Hit_ID=Q56NI2; Match level="QueryCoverage=86%, HitCoverage=23%, E-value=5e-12, Identity=63%"; Hit description=MADS box protein M8
MVQIAEHERAQQQQSNMMSGTLCESLPSQSYDRNFFPVNLIASDDQQQYSSQDHTALQLVQKQEAQ

SEQ ID NO: 232012 - protein, 193 aa, Glycine max
  Coding DNA Sequence Number=SeqID_115234
  Subcellular localization annotation: CTP_CleavageSite=25; ConfidenceScore=5.61e-01
MASSSNSVLFQSSHSKSSQNSLESYSSTKNGSLALGIPCIKSLPGGESRQRVPQEKATMWKRLTHEGGDCWSTSVSVVSSSLIWWLMVQRCKSPRHLPPSNVPNITDINHPVLGYKCECGVKFPYVVARSPPLESMWTLMAILVEDFLSWGRLPCGRDSHLRERLLGYKCEVKFHIGKFGVKFPYVVARGPPV

SEQ ID NO: 232013 - protein, 178 aa, Glycine max
  Coding DNA Sequence Number=SeqID_115235
MHNHHEKGRASDLESVLADFKTYQASSKDYQWESEWQPCYQNEAEGLSNLDDLLMQFKGIVDSMQQAFKRAETQIGKLVDDMTKVVVRRKEEYAEIETHQESILQVNTIHHQLINNEEKDEVSIIPEYSCMVTTGYDVGKDKGRLELSVEDHNISFDLFKGMKHPDMSDACFEEEEVE

SEQ ID NO: 232014 - protein, 352 aa, Glycine max
  Coding DNA Sequence Number=SeqID_115236
  Gene Ontology: Mol. function=protein transporter activity; Cellular component=nuclear pore; Biological process=protein import into nucleus, docking
  Homolog annotation: Hit_ID=Q84NP8; Match level="QueryCoverage=99%, HitCoverage=35%, E-value=1e-108, Identity=55%"; Hit description =Putative Ran binding protein 11-like
MKILVAFQGRHPYSFGDKFVLSSVLDFCLNRITDPDPYLLSFEQFLIQCMVMIKNILECKEYKPSLTGRVMDENGVTLELMKKNISSAVGGVLTSLLPTERIVHLCNVLISRYFVLTASDLEEWYRNPESFHHEQDMVQWTEKLRPCAEALYIVLFETNSQLLGPVVVFLLQESMNNCPTSVAEITPALLLKDAAYGATAYKLIKQIRTPKSHSQQKFNGALSLELSNEHPNLRIIHRKVAIILGQWVSEIKDDTKRPVYCALIRLLQDKDLSVRLAACRSLCLHIEDANFSEREYVDLLPICWDSCFKLFEDVREFDSKVQILNLISILIGHVSEVIPFANKLVQFFQKVQ

SEQ ID NO: 232015 - protein, 149 aa, Glycine max
  Coding DNA Sequence Number=SeqID_115237
  Gene Ontology: Mol. function=binding; Cellular component=nuclear pore; Biological process=protein import into nucleus, docking
  Homolog annotation: Hit_ID=Q84NP8; Match level="QueryCoverage=94%, HitCoverage=14%, E-value=5e-26, Identity=45%"; Hit description =Putative Ran binding protein 11-like
MNTNSLAQLASDPSTSQLLQTASIPVQENILLCLVDIWVDKVDNVSSIQKKTIGLALSIILTSRLPQVLDKLDQILSVCTSVILGRNDDLTEEESSGDMSSSTSPDEGTIPSKEFRKRQIKFSDRINQLSLEDSVRKSTKMCFYSWRII

SEQ ID NO: 232016 - protein, 126 aa, Glycine max
  Coding DNA Sequence Number=SeqID_115238
  Gene Ontology: Mol. function=protein transporter activity; Cellular component=nuclear pore; Biological process=protein import into nucleus, docking
  Homolog annotation: Hit_ID=Q84NP8; Match level="QueryCoverage=99%, HitCoverage=12%, E-value=7e-44, Identity=69%"; Hit description =Putative Ran binding protein 11-like
  Pfam annotation: Domain name=IBN_N; Domain location=29-104; Score =69.2; E_value=1.3e-17; Accession=PF03810.9; Description=Importin -beta N-terminal domain
MALSASDVAAMYSLLSNSMSTDHRLRGPAEDALAQSESRPGFCSCLLEVITAKDLGSQTDVRMMATVYFKNSVNRYWRHRRNSSGISNEEKMHLRQKLLMYLREENDQIALMLAVLISRIARSDYP

SEQ ID NO: 232017 - protein, 108 aa, Glycine max
  Coding DNA Sequence Number=SeqID_115239
  Homolog annotation: Hit_ID=Q66NX3; Match level="QueryCoverage=51%, HitCoverage=9%, E-value=3e-07, Identity=47%"; Hit description =Polyphenol oxidase
MSTTNSITDFIHSKPSHQQVSYNLAFMYTCDNLSEPDQTEFVGTFVNLFHGQGHNIKVTSFKVGISKVLDCLEAEEDDVVLVTLVPKVGKGDVIIGGIKVEFIPKYKD

SEQ ID NO: 232018 - protein, 96 aa, Glycine max
  Coding DNA Sequence Number=SeqID_115240
MWFPGSFPFTSYPKFVNINPCTLRVRLIASEPNLRSCLMDEGLTEDKSCHSNSMKKVPNAFVIHGVSGRGMFRTESKMEVGEVIVVPGSSGDLVEV

SEQ ID NO: 232019 - protein, 54 aa, Glycine max
  Coding DNA Sequence Number=SeqID_115241
  Homolog annotation: Hit_ID=Q10MW6; Match level="QueryCoverage=65%, HitCoverage=5%, E-value=5e-10, Identity=83%"; Hit description=DnaJ domain containing protein, expressed
  Pfam annotation: Domain name=DnaJ; Domain location=17-53; Score=12.6; E_value=0.00026; Accession=PF00226.21; Description=DnaJ domain
MCCVLELKVIHLRVFVCTWSVLGVDKNASQREIQKAFNKLSLQYHPDKNKSKGA

SEQ ID NO: 232020 - protein, 88 aa, Glycine max
  Coding DNA Sequence Number=SeqID_115242
MVLACNNSKLARKQSEATKMTRVEGKRVFILGSECVAGRNLKSEIGTESRCFQVKDVALWCVTTHVGQSDFRISDLGIAIDTAYVGGF

SEQ ID NO: 232021 - protein, 459 aa, Glycine max
  Coding DNA Sequence Number=SeqID_115243
  Gene Ontology: Mol. function=protein serine/threonine kinase activity; Cellular component=membrane; Biological process=protein amino acid phosphorylation
  Homolog annotation: Hit_ID=Q9C660; Match level="QueryCoverage=78%, HitCoverage=46%, E-value=1e-107, Identity=57%"; Hit description=Pto kinase interactor, putative
  Pfam annotation: Domain name=Pkinase; Domain location=213-456; Score =88.0; E_value=2.9e-23; Accession=PF00069.15; Description=Protein kinase domain
  Pfam annotation: Domain name=Pkinase_Tyr; Domain location=213-448; Score=81.7; E_value=2.3e-21; Accession=PF07714.7; Description =Protein tyrosine kinase
  Pfam module annotation: Pfam domain module=Pkinase::Pkinase_Tyr; Domain location=213-456::213-448
  Subcellular localization annotation: CTP_CleavageSite=17; ConfidenceScore=5.78e-01
MSAPSPSSSPAPPPELSSSAPPSSTSPLPLPSPSPSLSPANPLPAPPPQSPASISSPPATLPPPHSSSPSPPSTTTISSSAPPPPPTTRKNPFDSHHSTPSHTSGLAPPPPSAQNSGPGSSSGTSAVAIVGVLTGVLLLGFIGIAIWCLRRQKERVSKSGAYDLPPESDMPLHKIRSSAPLIERASGGNTPPGLGNSRTLFAYEELLKATNDFSTKNLLGEGGFGCVYKGSLPDGREVAVKQLKIEGSKGEREFKAEVEIISRIHHRHLVSLVGYCISDNRRLLVYDYVPNDTLYFHLHGEGRPVLDWTKRVKIAAGAARGIAYLHEDCNPRIIHRDIKSANILLHYNFEARISDFGLAKLAVDANTHVTTRVVGTFGLRIHDSFLNNAQTVKMIRFFPLKRYVAPEYVSSGKFTEKSDVYSFGVMLLELITGRKPVDISQPVGEESLVEWEGAGVSNC

SEQ ID NO: 232022 - protein, 66 aa, Glycine max
  Coding DNA Sequence Number=SeqID_115244
MRTLSPMKDKVRTLSPMKDFASYEGENFKSSNGEDFEPSKGKDFESSKARTLSPLPMKARTLSPLR

SEQ ID NO: 232023 - protein, 198 aa, Glycine max
  Coding DNA Sequence Number=SeqID_115245
MACGDKSWSSATFLSSRDNQVRWHAETNMVIYPLLSKTQCLLIETIKVSPPSSRDNQTIMVIRFRCFQDYFSLLYRPETIDSDGIRRPYVLIYILKMTMSSVIACLQKATMSSSTFRRRQCLPKATKPSFTFRRRECLHQSLHAFKRWQCPHLHFEDDNVFGHCMPSKGHHVFIYISKMAMSSVIACLQKATMTSSTF

SEQ ID NO: 232024 - protein, 174 aa, Glycine max
  Coding DNA Sequence Number=SeqID_115246
MSSTAIVLPEQSLAAEKAGLAVNKKGLTLKELLQQTSHHNPKVHRDALIGIKDLFTRYPAEQKLQKYAAVEKLRERIGDDDKVVRKSLYDLFKVVILPCCKESSLVHTGSPELEESLKVLSAKAQNAQEWWGRRNLWLKVMESCSHQINLTPAKKCNIFILLPKPLIHPNVEPF

SEQ ID NO: 232025 - protein, 472 aa, Glycine max
  Coding DNA Sequence Number=SeqID_115247
  Gene Ontology: Mol. function=hydrolase activity; Cellular component =intracellular; Biological process=metabolic process
  Homolog annotation: Hit_ID=Q6Z2M7; Match level="QueryCoverage=94%, HitCoverage=96%, E-value=7e-94, Identity=43%"; Hit description =Pentatricopeptide (PPR) repeat-containing protein-like
  Pfam annotation: Domain name=PPR; Domain location=175-209; Score =14.2; E_value=0.15; Accession=PF01535.11; Description=PPR repeat
  Pfam annotation: Domain name=PPR; Domain location=286-320; Score =44.5; E_value=3.5e-10; Accession=PF01535.11; Description=PPR repeat
  Pfam annotation: Domain name=PPR; Domain location=321-354; Score=6.3; E_value=1.3; Accession=PF01535.11; Description=PPR repeat
  Pfam annotation: Domain name=PPR; Domain location=357-390; Score =13.6; E_value=0.18; Accession=PF01535.11; Description=PPR repeat
  Pfam annotation: Domain name=PPR; Domain location=427-461; Score=1.5; E_value=5; Accession=PF01535.11; Description=PPR repeat
  Pfam annotation: Domain name=PPR; Domain location=74-108; Score=12.9; E_value=0.22; Accession=PF01535.11; Description=PPR repeat
  Pfam module annotation: Pfam domain module=PPR::PPR::PPR::PPR::PPR::PP R; Domain location=175-209::286-320::321-354::357-390::427-461::74-108
MSKSNVFEFLHQSRGSGNVSAIKKLHAQLLRTGMLFLSHNLHTQLIATYAACLPNNNLQSLNNFFKCMNSTNPLHFNAIISDFCRKGLPFLALASFSFVHANGVPLDTYALCSTLTASSKVKDLNLGKQIHAHVAKSGWSSSVFVGSALIDFYSKLSNVKDAAHMFDEIPEKNTVCANALLSGYAEAGLWVQELQLVRKMPVLKLKHDHFTLSAALRACTGLSAVEMGRQVHGYLLRTTPDIESDVFLQSALVEMYGKCGLVKKAWQVFKLVGMEIRKEVRSRDVVLWTSMLGVYGRNGHYKEVIDLYDEMLVEGIRPDGIAFLTVISTCGHTGQVHAGVKYFESMANDFKLDPGPEHYSCLVDLLCRAGELQRAWELLNETLYKGMGNCSVSMWGALLSACVDRGDLDLGKLAAQRALELDPQNVGICIMLSNLYARFGMWEEIGHLRVLIKARGLKKDVGCSWVQVGSGD

SEQ ID NO: 232026 - protein, 83 aa, Glycine max
  Coding DNA Sequence Number=SeqID_115248
KINNNVYAIRVVLEVPCQAKKNVDVGDQYSKVNRDGVVGDEALEDKNREDYEVHTLTFVEDNVGQQVYHTKQGTKRSVDVDNM

SEQ ID NO: 232027 - protein, 88 aa, Glycine max
  Coding DNA Sequence Number=SeqID_115249
MYLDIVSTTLLYDGNLIGYRSTFPPKTIWLSAVQHMQNTLSASKIWRSASKIWRSLIREDALNTSQALSARLSSYLLSVTIALRAKIV

SEQ ID NO: 232028 - protein, 61 aa, Glycine max
  Coding DNA Sequence Number=SeqID_115250
MKISVSVGQYLLPGAKTCIKIYCPSLPEQIEVKMKKGIWQQTNSNPRFKVSISQLAFPESS

SEQ ID NO: 232029 - protein, 67 aa, Glycine max
  Coding DNA Sequence Number=SeqID_115251
MKHYMPLSSSCTSMLAIVESDAEMYNLKSFPFIGDIELVDWQSVFHQFSIESGHSFIFPCEAVLELM

SEQ ID NO: 232030 - protein, 78 aa, Glycine max
  Coding DNA Sequence Number=SeqID_115252
  Gene Ontology: Mol. function=catalytic activity; Biological process =auxin mediated signaling pathway
  Homolog annotation: Hit_ID=Q1S379; Match level="QueryCoverage=94%, HitCoverage=79%, E-value=9e-23, Identity=69%"; Hit description=Auxin responsive SAUR protein
  Pfam annotation: Domain name=Auxin_inducible; Domain location=1-76; Score=108.3; E_value=2.3e-29; Accession=PF02519.5; Description=Auxin responsive protein
LRGLQRRVDVPKGSVAVYVGESQKKRFVVPISYLNQPSFLELLSQAEQEFGFDHPMGGLTLPYTEEVFLDVTSRLHRR

SEQ ID NO: 232031 - protein, 102 aa, Glycine max
  Coding DNA Sequence Number=SeqID_115253
MENLRWSKRINHRMGFTMPLREKLLQPLKSKKWLLWPSKLKKWLLRPLKLKKRLLRPSKLKMMDTNGIEEEKEMMDTNAIKEEKKMMDIDAIRVKEKSKDVS

SEQ ID NO: 232032 - protein, 153 aa, Glycine max
  Coding DNA Sequence Number=SeqID_115254
MDLTLDHFLNLEIEQHPPTAKEQLTLKVPVDISVLILVVETNESIVDQTIVKNLSMMDAENLHRETDPLNVDPFAFIDVWSSDSVPSKASESSYNRSFTYFDEAVAKFQRLAFDQPFEDSLSNLDYKSQLQKSINEVFKFNDLVVNEIPKVFP

SEQ ID NO: 232033 - protein, 263 aa, Glycine max
  Coding DNA Sequence Number=SeqID_115255
  Homolog annotation: Hit_ID=Q9SD55; Match level="QueryCoverage=34%, HitCoverage=43%, E-value=2e-26, Identity=59%"; Hit description=Zinc -finger-like protein
  Pfam annotation: Domain name=PHD; Domain location=153-197; Score=7.9; E_value=0.0093; Accession=PF00628.19; Description=PHD-finger
  Pfam annotation: Domain name=zf-C3HC4; Domain location=154-194; Score= 34.5; E_value=3.7e-07; Accession=PF00097.15; Description=Zinc finger, C3HC4 type (RING finger)
  Pfam module annotation: Pfam domain module=PHD::zf-C3HC4; Domain location=153-197::154-194
MEREEGKQPPQKTPLHNQHEQANSDNNFVQENNLQEQSGTFTTFASFESETEGESSFDDNDYDADFFLSQEFESELQFLESEGSNDNGDDYDNEDDEDMEEDEIDVDELTYEELIELGDFIGQEKRGLSAHEICSCLHSHTFHSAENKSGIDRCVICQVEYEEGESLVAIQCEHPYHTDCISKWLQIKKVCPICNIEISAPKMKFDVPSKMLVAREGVKVRRFLHKTAEINAKKGYSKNEKLRVSKFNPVDVDYGNESVCTRK

SEQ ID NO: 232034 - protein, 77 aa, Glycine max
  Coding DNA Sequence Number=SeqID_115256
MAASSQYNTSADQVASMSTEGSIPLPTPTVSTTTTNKGIELILILRHEEECKKVLTVLNWIMKPLVVGSPLMRMNIL

SEQ ID NO: 232035 - protein, 67 aa, Glycine max
  Coding DNA Sequence Number=SeqID_115257
MGDQEEIQEHMKVDMSALKEKMASMMDVMLGMRQLMKNNVATAAAVSSAAEADPTLLATPHHPLPNV

SEQ ID NO: 232036 - protein, 268 aa, Glycine max
  Coding DNA Sequence Number=SeqID_115258
  Homolog annotation: Hit_ID=Q2R3D4; Match level="QueryCoverage=70%, HitCoverage=71%, E-value=1e-81, Identity=77%"; Hit description =Expressed protein
MVVTRALLPPPPHPHPLCSLPIPTKTRAFAFHQVDPFLGFKLERQHKRKSKKHVAHVSLHDDPLVSYTIQQNPYHLVLLAESAGYSLASYYTSLGLFVISVPGLWSLIKRSVKSKIVQKTFIGEGEKKAPNQAAGEILSFFTRNNFTVTDRGETITFEGMMVPSRGQAALLTFCTCISLASVALVLTITFPDVGNNWFWITISSPLAGLYYWTRASRKEQIKVKMIVGNDGNLSEIIVQGDDQQVEQMRKELKLSEKGMVYVKGVFER

SEQ ID NO: 232037 - protein, 116 aa, Glycine max
  Coding DNA Sequence Number=SeqID_115259
  Homolog annotation: Hit_ID=Q2R3D4; Match level="QueryCoverage=87%, HitCoverage=38%, E-value=3e-37, Identity=73%"; Hit description =Expressed protein
MVPRGQAALLTFCTCISLASVALVLTITFPDVGNYWFWITISSSLAALYYWTRASRKEQIKVKMIVGNDGNLSEIIVQGDDQQVEQMRKELKLSEKGMVYVKASLKDDLLAIFFRR

SEQ ID NO: 232038 - protein, 166 aa, Glycine max
  Coding DNA Sequence Number=SeqID_115260
  Subcellular localization annotation: CTP_CleavageSite=37; ConfidenceScore=5.69e-01
MPHQFFTLIEPPNKTPTSKPFSSLQAKTWTSSESICVFSSKQSGFSWRRFWGRWTFQVLNLMWLIWYSRNQWVFQNKVIPLWQVFQRAAIPHIEPEKKRNRGTGLGVVYHDSEGMFLACAVVLITYCYDLKIAEAMTFKWSMETVSHLSFSRVKYEIDSLERKFLD

SEQ ID NO: 232039 - protein, 432 aa, Glycine max
  Coding DNA Sequence Number=SeqID_115261
  Gene Ontology: Mol. function=GPI anchor binding; Cellular component =membrane; Biological process=root hair cell differentiation
  Homolog annotation: Hit_ID=Q69F98; Match level="QueryCoverage=89%, HitCoverage=89%, E-value=1e-100, Identity=45%"; Hit description =Phytochelatin synthetase-like protein
  Pfam annotation: Domain name=Phytochel_synth; Domain location=47-210; Score=156.0; E_value=1e-43; Accession=PF04833.5; Description =Phytochelatin synthetase-like conserv
MTGQENMKGPFTKSGALASFDCYDPLDPNGNISVTFDIFQRTPDNGYLARVTLQNYYQYRHVDKPGWKLGWTWANNEVIWSMSGAIATDRGNCSSYSGSQMPHSCKKDPTIVDLSLDASQNRSEHCCRGGLLSPWSIDPFYAFSSFELEVRNVGDNPLGQAPINLTLMAPGPGYTCSPLLDTDLSVSSDFGGLRQVPVLRTWKSTCAYSSFLANTIPVCCVSLSSFYNPAITSCRNCSCGCREADKSTATCIRSSSLSRSNEDNTIDEMIECTDHMCPVRVHWHFKNNYMNQWRVKLTISNYNYNRNYSNWNVLVQHPGFTQKARTYSFNSTKLPTLGLQDYYNNELVHSDKDGVGLVTTEILLDKDPNSFTVSNGWAFPRRIYFNGENCEMPLPDTFPMLPNGGSILRATYCGFSLLYILLFLALLLILWF

SEQ ID NO: 232040 - protein, 343 aa, Glycine max
  Coding DNA Sequence Number=SeqID_115262
  Homolog annotation: Hit_ID=Q9FFY0; Match level="QueryCoverage=99%, HitCoverage=33%, E-value=1e-79, Identity=45%"; Hit description =Arabidopsis thaliana genomic DNA, chromosome 5, P1 clone:MAC12
MAADQRRKRVNGANIAGYGSREQHRIKRKNLGLVQNDLNMRPHISVEWDGNHKKVVAKWEQIGISWRQMKPFINLVSNDHKILADVFAVPQEIFELDNLSEVLSYEVWKTHLSENERNLLMNFLPSGFESHQVVEELLGGINFNFGNPFSKWGASLCLGSLHPDMIVDQEQHLKTERREYYSHIHNYHNDMIGFLSKLKKSWQSCKDPEKEIVQKIWRTKHVEKRMLSKVIESRGYDHNGNVTGTSESCSWDAEEKACSSDNQISSLRKDDKLQRRVLEKCIVKGKSRNLMDSLDNMPNVGEKPKTGDKLPKHSIHSSDSDKYMSCIKISKQQHELVKNMKQA

SEQ ID NO: 232041 - protein, 546 aa, Glycine max
  Coding DNA Sequence Number=SeqID_115263
  Homolog annotation: Hit_ID=Q9FFY0; Match level="QueryCoverage=99%, HitCoverage=55%, E-value=7e-33, Identity=25%"; Hit description =Arabidopsis thaliana genomic DNA, chromosome 5, P1 clone:MAC12
MKDKSNPFMEEEDGVDTGSELKDQDGVNSGSELQDHDEVNSGSELQDQDEDNLGSGDKLKDKNEDNMSSECEPQEQNEDNVTSGSELQDQGEDNVNSGDELQDQVNDGGLNDQSDLKEDEDSFSRSPENQSQHNSYVSGDDEFNRMSVDSERNILLSKSNNTSSISGDHEFNRMNVDSEKNLLLSKSNNTSLNKDEYSRNMNTRDVSIDEEAPFTSSGDVWQGVEMPHSYYDSAVTHEYAASGLSLANPQVSQEQPTRMIDLEADLRREETGKELLSRQLDNGTFSSYQSQDRSVLLESLFKGEGLLPYHHDQKVAELDFQTSNNVMMGGGQFSSHLKEPLQTSLTLDQGRRRATEVYMPENMSENIYSDGGRYLIPRQDPLTAVNMTDWAANNARIAGPSQSHLNTGDFIDHHWFPADHQVRGGGWNGSDGGGLSSQSLGTGASADQSLFSILSECDQLHSGSPYDSVRNTNQFLAPRTYGLADAGTPRVNTVAPPASHPLDYFTRREAPSGLVPDDTVWMSLPPHQNSSLHDQIRKPYLRSWNR

SEQ ID NO: 232042 - protein, 191 aa, Glycine max
  Coding DNA Sequence Number=SeqID_115264
  Subcellular localization annotation: CTP_CleavageSite=40; ConfidenceScore=5.65e-01
MTLSQLLDNFLHKAHFAATSSCLNAASSFFSKAQTDTAPAAAARAATAYTVTTTVAATTAITTAERDMVEPRTTRRERQSHDSNFAMRRSSCVLTLEGLEQVTEKVWSRGWGFRVWKKSRRGAWRSSARRRQWWKWRQRLEAVSVWSKKVEMRRMRRVGIGVRVRARASWTRSRVGLRWWSWASMLERMSV

SEQ ID NO: 232043 - protein, 166 aa, Glycine max
  Coding DNA Sequence Number=SeqID_115265
  Gene Ontology: Mol. function=methylthioadenosine nucleosidase activity; Biological process=nucleoside metabolic process
  Homolog annotation: Hit_ID=Q8W162; Match level="QueryCoverage=98%, HitCoverage=66%, E-value=6e-42, Identity=52%"; Hit description =Methylthioadenosine/S-adenosyl homocysteine nucleosidase
PGPFPPGVDSIGTIPSALATYAAVLALQPYLIINAGTAGGFKIFDLYGIGLRKVFETPNLVKELNLKEFIVFVQNLNVKQYLCIFLVAKLSTGGSLDMTEQDESSIIANDATVIDMEGAAIAYVADILKVPAIFIKAVNSIVDGDKAIVEEFLQNLEALTAVLDLN

SEQ ID NO: 232044 - protein, 451 aa, Glycine max
  Coding DNA Sequence Number=SeqID_115266
  Gene Ontology: Mol. function=calcium ion binding; Cellular component =mitochondrial inner membrane; Biological process=transport
  Homolog annotation: Hit_ID=Q69X19; Match level="QueryCoverage=95%, HitCoverage=75%, E-value=1e-143, Identity=61%"; Hit description =Putative small calcium-binding mitochondrial carrier 2
  Pfam annotation: Domain name=Mito_carr; Domain location=245-332; Score=101.9; E_value=1.9e-27; Accession=PF00153.17; Description =Mitochondrial carrier protein
  Pfam annotation: Domain name=Mito_carr; Domain location=341-432; Score=106.8; E_value=6.5e-29; Accession=PF00153.17; Description =Mitochondrial carrier protein
  Pfam annotation: Domain name=efhand; Domain location=103-131; Score =25.1; E_value=0.00025; Accession=PF00036.22; Description=EF hand
  Pfam annotation: Domain name=efhand; Domain location=181-209; Score =22.5; E_value=0.0015; Accession=PF00036.22; Description=EF hand
  Pfam annotation: Domain name=efhand; Domain location=33-61; Score =4.7; E_value=4.5; Accession=PF00036.22; Description=EF hand
  Pfam annotation: Domain name=efhand; Domain location=72-100; Score =27.8; E_value=3.9e-05; Accession=PF00036.22; Description=EF hand
  Pfam module annotation: Pfam domain module=Mito_carr::Mito _carr::efhand::efhand::efhand::efhand; Domain location=245-332::341 -432::103-131::181-209::33-61::72-100
MGSNRRKSEDHPATTLDHALLASGESAEERETRIRALFAFFDAENCGFLDCSAIESGLSALRMPSDSECCNYAQDLFGACDANKDGRVDYEEFKRYMDDKELELYRIFQAIDVEHSGCISPEELSHALVRAVIGRPKIQLEGMLEISHCLVMVNCYSTLNRCPALQIPRPIILGIQIDDEELARFVERVDKDHNGVITFGEWRDFLLLYPHEATIENIYHYLERVCLIDIGEQTVIPAGISKHIHASSYLIAGGVAGAASRTTTAPLDRLKVVLQVQTTRAHVMPAIKDIWKEGGCLGFFRGNGLNVLKVAPESAIRFYTYEMLKAFIGNAKGEGAKADVGTMGRLLAGGMAGAVAQTAIYPLDLVKTRIQTYACEGGRLPSLGTLSKDIWVKEGPRAFYKGLIPSILGIVPYAGIDLAAYETLKDMSKKYILLDEGNGLICLSCSVPDVL

SEQ ID NO: 232045 - protein, 144 aa, Glycine max
  Coding DNA Sequence Number=SeqID_115267
MHWCDAKKPHPNDKKTWKLQSKASGETWLFTSELSNQTQDTNHINSPPVNEYKRKSIYRSIREITALDFIWVGEMHGSIIGVQGTMAQGLRTNAWIFHNSCINESANARGEAVCVLGALPLPRSLTRCARSFGCGERYQLTQRR

SEQ ID NO: 232046 - protein, 273 aa, Glycine max
  Coding DNA Sequence Number=SeqID_115268
  Homolog annotation: Hit_ID=Q9FM77; Match level="QueryCoverage=78%, HitCoverage=66%, E-value=3e-60, Identity=55%"; Hit description =Arabidopsis thaliana genomic DNA, chromosome 5, P1 clone:MDF20
  Subcellular localization annotation: CTP_CleavageSite=80; ConfidenceScore=5.61e-01
MAGIAILLDLWRKNQNLSSGLHSSHAFQSSSAFCSASAATAAAASLAAGTGFASRALFGAFALTSLRSFLMFYLPLLEPRVEMEDDENFQEEDQEHHVDLVVPFKKSVKQIMRETTVVTTRRILERIVVHYVSQRMAWKLLKDIPRSATRKAGRSMPTLVYVYCVSRTTFRGHMLGVAASWLVQVGIDLYRFFSSTFQGQYEDNDVDQTNQVGVLGQKVVIATVRCTSSLIFASIGAGIGATFIRRPWLGQWVGCAIGDLGGPIIVAFCADRF

SEQ ID NO: 232047 - protein, 273 aa, Glycine max
  Coding DNA Sequence Number=SeqID_115269
  Gene Ontology: Mol. function=catalytic activity; Biological process =nucleoside metabolic process
  Homolog annotation: Hit_ID=Q9M4H0; Match level="QueryCoverage=94%, HitCoverage=89%, E-value=8e-93, Identity=67%"; Hit description =Putative ripening-related protein
  Pfam annotation: Domain name=PNP_UDP_1; Domain location=26-270; Score= 0.3; E_value=4.3e-09; Accession=PF01048.10; Description=Phosphorylase family
MAALGDQSEEQAMAAQPKPQNRPISNIVIVVAMQTEALPIVNRFQLTEDPDTPFPQGVPWVRYQGTYKDLNISLIWPGKDPTLGVDSVGTISSALVTYAAIQALQPDLIINAGTAGGFKVGTVFPQAIQLELLLFYFPPLAKGASIGDVFIVSDCAFHDRRIPIPVFDLYGVGLRKAFVAPNLVKELNLKVGKLSTGDSLDMTQQDESSIIANDATVKDMEGAAIAYVSDLLKVPAIFVKAVTDIIDGDKPTAEEFLQNLAAVTTALDLAVEQ

SEQ ID NO: 232048 - protein, 69 aa, Glycine max
  Coding DNA Sequence Number=SeqID_115270
  Gene Ontology: Mol. function=transporter activity; Cellular component= mitochondrial inner membrane; Biological process=transport
  Homolog annotation: Hit_ID=Q1SMQ9; Match level="QueryCoverage=90%, HitCoverage=14%, E-value=1e-17, Identity=67%"; Hit description =Calcium-binding EF-hand; Adenine nucleotide translocator 1
  Pfam annotation: Domain name=Mito_carr; Domain location=5-68; Score =34.1; E_value=4.8e-07; Accession=PF00153.17; Description =Mitochondrial carrier protein
KLESDMVVDFRMQAQRAYMGMADVFRITFKHEGFRGFYKGLFPNLLKVVPSASITYLVYENMKKGLDLD

SEQ ID NO: 232049 - protein, 600 aa, Glycine max
  Coding DNA Sequence Number=SeqID_115271
  Gene Ontology: Mol. function=hydrolase activity, acting on glycosyl bonds; Cellular component=membrane; Biological process=metabolic process
  Homolog annotation: Hit_ID=Q9SW48; Match level="QueryCoverage=99%, HitCoverage=99%, E-value=0.0, Identity=74%"; Hit description =Invertase-like protein
  Pfam annotation: Domain name=GDE_C; Domain location=180-566; Score= -229.1; E_value=0.015; Accession=PF06202.4; Description=Amylo-alpha-1, 6-glucosidase
  Pfam annotation: Domain name=Invertase_neut; Domain location=97-593; Score=1058.7; E_value=0; Accession=PF04853.3; Description=Plant neutral invertase
  Pfam module annotation: Pfam domain module=GDE_C::Invertase_neut; Domain location=180-566::97-593
MSSFPIDRSHNGSLKCLEALSSVSEKEEFDFSKALDRPRALNIERQRSFDERSMNELSLGFSPRQLATKVDSSSRLGDLLDHVHSPRPKSDINTPGSVTLDPHPLTSEAWEELRRSLVYFRGQPVGTIAALDNSDEKLNYDQWGEELAQFHHNTWILVTLLDHVNYYGSTLMVFIRDFVPSALAFLMHGETDIVKNFLLKTLRLQSWEKKIDRFQLAEGVMPASFKVFHDPVRNHETLIADFGESAIGRVAPVDSGFWWIILLRAYTKATGDSSLAERPECQKGMRLILSLCLSEGFDTFPTLLCADGCCMIDRRMGVYGYPIEIQALFFMALRCALQLLKQDMEGKEFVERIVKRLHALSYHMRSYFWLDLKQLNDVYRFKTEEYSHTAVNKFNVIPDSLPDWIFDFMPHHGGYFVGNVSPARMDFRWFCLGNCIAILSCMATPEQSIAIMDLIESRWEELIGEMPVKVCYPAIENHEWRLVTGCDPKNTRWSYHNGGSWPVLLWLLAAASIKTGRPQIARRALNIAESKLLKDNWPEYYDGTTGRYVGKQARKFQTWSIAGYLSARMMLDDPSHLGLVALEEDKHLKPLLKRSISWTL

SEQ ID NO: 232050 - protein, 88 aa, Glycine max
  Coding DNA Sequence Number=SeqID_115272
  Gene Ontology: Mol. function=manganese ion binding; Cellular component=mitochondrion
  Homolog annotation: Hit_ID=Q52K88; Match level="QueryCoverage=75%, HitCoverage=33%, E-value=3e-17, Identity=66%"; Hit description=Nudix hydrolase 13, mitochondrial precursor
MNHILVTLDEYSDRAHNSSIWKCIPYRWKKGKADQMGDTEEIIEVLMISSPKRDDLLFPKGGWEDDETVTEAACREALEEAGVKGIIR

SEQ ID NO: 232051 - protein, 116 aa, Glycine max
  Coding DNA Sequence Number=SeqID_115273
  Gene Ontology: Mol. function=structural constituent of ribosome; Cellular component=ribonucleoprotein complex; Biological process =translation
  Homolog annotation: Hit_ID=Q9M2F1; Match level="QueryCoverage=73%, HitCoverage=100%, E-value=2e-35, Identity=80%"; Hit description=40S ribosomal protein S27-2
  Pfam annotation: Domain name=Ribosomal_S27e; Domain location=60-114; Score=114.8; E_value=2.4e-31; Accession=PF01667.7; Description =Ribosomal protein S27
MVAFISLSLSLSLSLSLSLSLSLNSRIRSEIVLQNDIDLLNPPAELEKRKHKLKRLVQSPNSFFMDVKCQGCFNITTVFSHSQTVVVCGNCQTVLCQPTGGRARLTEGCSFRKKGD

SEQ ID NO: 232052 - protein, 118 aa, Glycine max
  Coding DNA Sequence Number=SeqID_115274
MHENEWHGACLLFAPIWEPIGHYLGVSNNYSPTIHNSHGCFLEFNKSTPKVHHSTIPKIGLTHKEKSPAESPTVATCPSRATEGEAHGCASQRRKDARSRHQRLFVENVGKTEGNRSK

SEQ ID NO: 232053 - protein, 46 aa, Glycine max
  Coding DNA Sequence Number=SeqID_115275
MVPFRVNIKLIVALGMRKPCDGKWALAREEKEEQEKKGKQHGFFMT

SEQ ID NO: 232054 - protein, 118 aa, Glycine max
  Coding DNA Sequence Number=SeqID_115276
MEAGKVIRFVLCERGENGAVLPQEKGKWSCRMETGWEHGQCFCTSGPFAHHIRHCHWLVVLLPLQRLQGSAPYHSLQLSAIPLLVARLLHLLHLFIFYYLKAQLSRIQTMTLTATGVA

SEQ ID NO: 232055 - protein, 190 aa, Glycine max
  Coding DNA Sequence Number=SeqID_115277
  Gene Ontology: Mol. function=transferase activity; Cellular component= membrane; Biological process=protein metabolic process
  Homolog annotation: Hit_ID=Q9FNI7; Match level="QueryCoverage=73%, HitCoverage=26%, E-value=5e-63, Identity=74%"; Hit description =Glucosyltransferase-like protein
  Pfam annotation: Domain name=Glycos_transf_2; Domain location=16-187; Score=19.9; E_value=2.8e-05; Accession=PF00535.16; Description =Glycosyl transferase
MKDDVELGNSSYPMVLVQVPMYNEREVYQLSIGAACGLSWPSDRIIIQVLDDSTNPTIKELVQMECSRWASKGVNIKYEVRDNRDGYKAGALKEGMKRSYVKQCDYVAIFDADFQPEPDFLWRTVPFLVNNPELGLVQARWKFGLRWVPLCVEMALNIGHVYKPLPCSPRPSVVFVFLLCLFGFSCLQSS

SEQ ID NO: 232056 - protein, 634 aa, Glycine max
  Coding DNA Sequence Number=SeqID_115278
  Gene Ontology: Mol. function=binding
  Homolog annotation: Hit_ID=Q9FKW5; Match level="QueryCoverage=99%, HitCoverage=99%, E-value=0.0, Identity=65%"; Hit description =Arabidopsis thaliana genomic DNA, chromosome 5, TAC clone:K2A18
  Pfam annotation: Domain name=Arm; Domain location=178-218; Score =30.9; E_value=4.5e-06; Accession=PF00514.13; Description =Armadillobeta-catenin-like repeat
  Pfam annotation: Domain name=Arm; Domain location=219-259; Score =34.1; E_value=4.7e-07; Accession=PF00514.13; Description =Armadillobeta-catenin-like repeat
  Pfam annotation: Domain name=Arm; Domain location=462-497; Score=4.8; E_value=3; Accession=PF00514.13; Description=Armadillobeta-catenin -like repeat
  Pfam annotation: Domain name=Arm; Domain location=540-580; Score =21.5; E_value=0.0031; Accession=PF00514.13; Description =Armadillobeta-catenin-like repeat
  Pfam module annotation: Pfam domain module=Arm::Arm::Arm::Arm; Domain location=178-218::219-259::462-497::540-580
MSSIVKEILASPIQMADQVSKLAEEAQNFRQECLELKSKSEKLAGLLRQAARNSNDLYERPTRRIIDDTEQVLDKALALVTKCRANSLIKKLFTIIPATAFRKTSMQLENSVGDVQWLLRVSASADERDDEYLGLPPIAANEPILCLIWEQVAILLSGASLDERSDAAASLVSLARDNDRYGKLIIEEGGVPPLLKLLKEGRMDGQENAARAIGLLGKDPESVEHIVNSGVCSVFAKVLKEGHMKVQTVVAWAISELAANHPKCQDHFSQNNAIRLLVSHLAFETIQEHSKYAIANKHKSIHSVLMASNTTSAQEEDDDKQVSHPMSGQSSTLMHNVVSNTMAIKSAMEEDDKANTKKQQQQQSGNGSHLAIAGKSIKGREYEDAGTKAQMKAMAARALWQLSRGNLTVCRSITESRALLCFAVLLEKGPDDVQSYSAMALMEITAVSEQHSELRRSAFKPTSPAAKAVVEQLLKVIEKEQAELLIACVRSVGNLARTFRATETRLIGPLVRLLDEREAQVSMEAAIALNKFACTDNYLHENHCNAIIEAGGAKHLIQLVYFGEQMVQISSVTLLCYIALHVPKSETLAQEEVLIVLEWCTKQPHLIDQPSIQPLLPEAKSRLELYQSRGRGFR

SEQ ID NO: 232057 - protein, 45 aa, Glycine max
  Coding DNA Sequence Number=SeqID_115279
LPLEGEATMWNRLTLEGEICWVRSVRSLYVVAPDPQVYPSNLPNN

SEQ ID NO: 232058 - protein, 334 aa, Glycine max
  Coding DNA Sequence Number=SeqID_115280
  Gene Ontology: Mol. function=protein binding; Cellular component =integral to membrane
  Homolog annotation: Hit_ID=Q5Z9P4; Match level="QueryCoverage=98%, HitCoverage=98%, E-value=1e-115, Identity=59%"; Hit description =Permease-like
  Pfam annotation: Domain name=DUF6; Domain location=18-123; Score=9.8; E_value=0.018; Accession=PF00892.11; Description=Integral membrane protein DUF6
  Pfam annotation: Domain name=DUF803; Domain location=5-301; Score =638.3; E_value=6.5e-189; Accession=PF05653.4; Description=Protein of unknown function (DUF803)
  Pfam annotation: Domain name=DUF914; Domain location=1-292; Score= -218.1; E_value=0.1; Accession=PF06027.3; Description=Eukaryotic protein of unknown function (DUF914)
  Pfam module annotation: Pfam domain module=DUF6::DUF803::DUF914; Domain location=18-123::5-301::1-292
MGIAENSKGLVLAVASGVFIGASFVLKKKGLKQAATHGTRAGVGGYSYLLQPLWWAGMLTMLIGEVANFVAYIYAPALLVTPLGALSIIVSAVLAHFLLKEKLQKMGILGCVFCIVGSVLIVIHAPQEHALNSVQEIWDLATQPLFLVYVAAAVSVVLALILHFEPRYGQTNMLVYLGICSLIGSLLVMSTKAIGIAIKLTLEGTSQLTYPQTWFFLTVTVICIITQLNYLNKALDTFNTAIVSPVYYVMFTTLTIIASVIMFKDWSEQSAGSIASEICGFVIVLSGTILLHATREQEQSNKQGSLTWYIGEDLVKRIEDGHLNLLHGSDYVEK

SEQ ID NO: 232059 - protein, 136 aa, Glycine max
  Coding DNA Sequence Number=SeqID_115281
MATFHLPANNKPNASSSDLYFSHHLGSDDISSVYLAKLNDDSLSVMFATKVADATMCKHHTPNDEDYLECSSVRDFITKPKLVFFLMSTMAVKVKLRLERSVFVFCDSIVTVSISDGTKIGGDLGEDRVGVRADNR

SEQ ID NO: 232060 - protein, 457 aa, Glycine max
  Coding DNA Sequence Number=SeqID_115282
  Gene Ontology: Mol. function=amino acid transporter activity; Cellular component=integral to membrane; Biological process=auxin mediated signaling pathway
  Homolog annotation: Hit_ID=Q8L883; Match level="QueryCoverage=99%, HitCoverage=99%, E-value=0.0, Identity=79%"; Hit description=Auxin transporter-like protein 5
  Pfam annotation: Domain name=Aa_trans; Domain location=37-412; Score =251.0; E_value=2.5e-72; Accession=PF01490.8; Description =Transmembrane amino acid transporter protein
MASEKEVETVIVGNYEEMESEGKPRDAKSRLLSFLWHGGSVYDAWFSCASNQVAQVLLTLPYSFSQLGMLSGTLFQLFYGLLGGWTAYLISTLYVEYRTRKEREKFNFRNHVIQVLDGLLGKHWRNVGLAFNCTFLLFGSVIQLIACASNIYYINDNLDKRTWTYIFGACCATTVFIPSFHNYRIWSFLGLLMTTYTAWYLTVASLLHGQVEGVKHSGPTKLVLYFTGATNILYTFGGHAVTVEIMHAMWKPQKFKAIYLLATLYVMTLTLPSAAAVYWAFGDMLLNHSNAFSLLPRSPFRDMAVILMLIHQKAIGIHECRSLCKRALARLPVVIPIWFLAIVFPFFGPINSTVGSLLVSFTVYIIPALAHMFTFKSPAARRNAVEQPPRSVGRWVGAYTMNVFVVVWVLVVGFGFGGWASMVNFIHQIDTFGFFTKCYQCPTPTSINSTAPSPRAH

SEQ ID NO: 232061 - protein, 640 aa, Glycine max
  Coding DNA Sequence Number=SeqID_115283
  Gene Ontology: Mol. function=zinc ion binding
  Homolog annotation: Hit_ID=Q8LA17; Match level="QueryCoverage=71%, HitCoverage=91%, E-value=6e-22, Identity=24%"; Hit description=PhD -finger protein, putative
  Pfam annotation: Domain name=PHD; Domain location=395-442; Score =27.7; E_value=4e-05; Accession=PF00628.19; Description=PHD-finger
MDRDDDPSALAWLWVIEALLTSKEITTPTLQGFIDAAPVGHHRFSKNTKELVALRCLEKLSTLVVDPEASSNLDSRFGFNVLGSCQDVLKEILGKIPLSNLKVAGAELLKWDICPFIKHKRAVTFKCHLEQLRESIFKNTHPDTDYLKETTRLFPQNSSRVCSKRSRVCSADETDLPSKRSWACSADETDHARNGYGVEISGDIVSQGEKINLETKKQAEQNLSLKCNEEDRLLICDANVVQPVVPEYVMTTTIIPHHTSVAEPCNNTSMDETDNTAHHAIPTNDANAENNQHIINFHQPKQTEPDITSLNLSQKPVASDKTVFDMVNGCRAELSSDSDGYHNGKNDLEAKKHEFLCSPCTVDQDFSAMTESIEQNLRTVDQVFSSMTESIEQNLCMKCHEGGQLLACKTTTCPLMVHKNCLGASAQLDAKGNFFCPFCAYSHAISEYLESKENASLARKELAIFISKGKLIQAAEFVHEFHRQEHCFSRKNSKCEHIHVKNNEDDQLAGCEDNREDHVGEHANEANDLQFERSKQQAEVLREEEIGKMPTVGRVEESEVPTDHVDGHVGDKFASEKTNIAPESNAEEVPQEMTKQHNIDGTIEPVCAQDTGKEKISEDESEKHSNPLYSLRFRKHETQW

SEQ ID NO: 232062 - protein, 90 aa, Glycine max
  Coding DNA Sequence Number=SeqID_115284
MEDQHSLDNSKGMGHLIPMVELAKKENFRSPQPSKAETAVRCLQMDWTCLQQFYSSRLNCIVIVVCFGSGGTLSSAQINELALGGVGDDE

SEQ ID NO: 232063 - protein, 534 aa, Glycine max
  Coding DNA Sequence Number=SeqID_115285
  Gene Ontology: Mol. function=hydrolase activity, hydrolyzing O -glycosyl compounds; Cellular component=membrane; Biological process =carbohydrate metabolic process
  Homolog annotation: Hit_ID=Q10P81; Match level="QueryCoverage=98%, HitCoverage=93%, E-value=0.0, Identity=57%"; Hit description =Glycosyl hydrolase family 10 protein, expressed
  Pfam annotation: Domain name=Glyco_hydro_10; Domain location=183-477; Score=154.1; E_value=3.7e-43; Accession=PF00331.11; Description =Glycosyl hydrolase family 10
MTDGPLYDSTAYAECKEKPEEPLYGGGLFNTRRGVEGTIDSSISNVANNSYVPSLVLYNLTQGTIYSFSAWVRVKGSSSAMVRTTLETEKETHDCIGTVSAKHECWSFLKGGFVLNWSSNLSMIFFQNADGKDINIDVASPSLQPFTKQQWRINQQYKINTQRKRAVTIHVSDSNGRRFQGASICIEQISKDFPFGSAIAKTILGNLPYQNWFVKRFNAAVFENELKWYATEPDEGKVNYTISDQMLQFVRTNNIIARGHNIFWENPKYTPPWVLNLTGTKLQSAVNSRIHSLMSQYKDEFIHWDVSNEMLHFNFYEERLGPDATLHFFETAHESDPLATLFMNDFNVVETCSDVKSTVDAYISRVRELQRNGIFMDGIGLEGHFTIPNPPLIRAILDKLATLGLPIWLTEVDISKTLDRDAQANYLEEVLREGFSHPSVNGIMLWTAFHPNGCYQMCLTDNNFKNLPAGDVVDKLVEEWQISRVEGVTDVHGSYSFYGFLGEYRISVKYGNKTTKSTFSLSRGDETRHFTITI

SEQ ID NO: 232064 - protein, 105 aa, Glycine max
  Coding DNA Sequence Number=SeqID_115286
MREKEADEVEPKGYLLPSLLGVERVPGDKSQPMPMTSSLTGLTPLDTPPFSIPSSKNGVEALEGFEIAEQNEGEIFHFFFSYQLCLAKLNSGIGRFKRPLALAWK

SEQ ID NO: 232065 - protein, 214 aa, Glycine max
  Coding DNA Sequence Number=SeqID_115287
  Gene Ontology: Cellular component=cellulose and pectin-containing cell wall
  Homolog annotation: Hit_ID=Q67W03; Match level="QueryCoverage=87%, HitCoverage=62%, E-value=8e-30, Identity=41%"; Hit description =Putative phi-1
  Pfam annotation: Domain name=Phi_1; Domain location=1-214; Score =102.6; E_value=1.2e-27; Accession=PF04674.3; Description=Phosphate -induced protein 1 conserved region
MKTPEPDAANQPNYGAAAGNNNIPVKVINQVFDPNYSYGKVLIKDFIKPLLPKATGGNPNTLAIVIASKGVTVQDMCAGSCAQHGLIENQVYVAVGDPEEECPECAWPFLATKGKTGATMKPPNGNVGADVMVKLLAGGLAGAVTNPFWDGFYANAHGDHVLEATSKCPDIFATTKLPVDPRNGGAFNAVGDKGTKFLLPAIWNPKTSSCWTPL

SEQ ID NO: 232066 - protein, 80 aa, Glycine max
  Coding DNA Sequence Number=SeqID_115288
  Subcellular localization annotation: CTP_CleavageSite=75; ConfidenceScore=5.02e-01
MANFTKNFVPHCPEALRYAKKTQFANVSLPSIISQSHQKACKRSSPFPKVAKQFATKKGVDYNAKAGNNTICSIKAQAIS

SEQ ID NO: 232067 - protein, 157 aa, Glycine max
  Coding DNA Sequence Number=SeqID_115289
MTNVVARKEEERAEIEMHQESILQVTSIHHQLTNEEEKHEFSSTLEYPCLATIGYVGGKDKGRLELSVEDKKISFDLFEAMKHLDIGDAYFEEEEVEQEIALSASTMVLQSPLEREPSYGIDCLVCDEELDDPKDNCVDHVVFEELEKMRPTEKPKA

SEQ ID NO: 232068 - protein, 109 aa, Glycine max
  Coding DNA Sequence Number=SeqID_115290
  Gene Ontology: Mol. function=DNA binding; Biological process=DNA integration
  Homolog annotation: Hit_ID=Q1SIT1; Match level="QueryCoverage=74%, HitCoverage=28%, E-value=1e-14, Identity=47%"; Hit description =Integrase, catalytic region
MDQAGEERKLQLSELDEIRLEAYENAKFYKEKTKKFHDSMIVKKDFMVGQKVLLYIFKLGLMSVEIKSNSTNKSFKVNGPRLKSFLPNPSLGNVVGEETSLLPPTLPFP

SEQ ID NO: 232069 - protein, 558 aa, Glycine max
  Coding DNA Sequence Number=SeqID_115291
  Gene Ontology: Mol. function=identical protein binding; Cellular component=cytoplasm; Biological process=negative regulation of enzyme activity
  Homolog annotation: Hit_ID=O49607; Match level="QueryCoverage=93%, HitCoverage=68%, E-value=0.0, Identity=68%"; Hit description =Subtilisin proteinase-like
  Pfam annotation: Domain name=PA; Domain location=374-472; Score =111.0; E_value=3.4e-30; Accession=PF02225.12; Description=PA domain
  Pfam annotation: Domain name=Peptidase_S8; Domain location=118-551; Score=-41.1; E_value=0.00014; Accession=PF00082.12; Description =Subtilase family
  Pfam annotation: Domain name=Subtilisin_N; Domain location=42-115; Score=65.6; E_value=1.6e-16; Accession=PF05922.7; Description =Subtilisin N-terminal Region
  Pfam module annotation: Pfam domain module=PA::Peptidase _S8::Subtilisin_N; Domain location=374-472::118-551::42-115
MANIMRNADPPALLSCNLLLLFFIILFSFLPQTIALQYQVSKTFIFRIDSESKPSVFPTHYHWYTSEFADPTRILHLYDTVFHGFSAVLTHQQVASLGQHPSVLAVFEDRRRHLHTTRSPQFVGLRNQRGLWSETDYGSDVIIGVFDTGIWPERRSFSDSNLGPIPKRWKGVCESGVRFSPSNCNRKLIGARFFSKGHEASGTSFNDTVEFRSPRDADGHGTHTASTAAGRYVFEASMAGYAFGVAKGVAPKARLAMYKLCWKNSGCFDSDILAAFDAAVADGVDVISMSIGGGDGISSPYYLDPIAIGSYGAVSRGVFVSSSGGNDGPSGMSVTNLAPWLTTVGAGTIDRDFPAEVILGNGRRLSGVSLYSGEPLKGKMYPLIYPGKSGVLTDSLCMENSLDPELVKGKIVVCDRGSSARVAKGLVVKKAGGVGMILANGISNGEGLVGDAHLLPACALGANFGDEIKEYINFSANPTATIDFKGTVVGIRPAPVVASFSARGPNGLSLEILKPDLTAPGVNILAAWTGGVGPSGLDSDTRRTEFNILSGTSMACPH

SEQ ID NO: 232070 - protein, 196 aa, Glycine max
  Coding DNA Sequence Number=SeqID_115292
  Gene Ontology: Mol. function=identical protein binding; Cellular component=cytoplasm; Biological process=negative regulation of enzyme activity
  Homolog annotation: Hit_ID=O49607; Match level="QueryCoverage=99%, HitCoverage=25%, E-value=1e-56, Identity=57%"; Hit description =Subtilisin proteinase-like
MMTTATVFDNTNALMIDQATGNASTPYDFGAGHLNLALAMDPGLVYNITPHDYVTFLCAIGYGPRLIQVITGSPPNCPRRRPLPENLNYPSFVAVLPVSSSLLSKTFFRTVTNVGPPSAVYRVRVETQAEGVAVTVRPSQLVFSEAVKKRSFVVTVTADGRNLELGQAGAVFGSLSWTDGKHVVRSPMVVTQAQPL

SEQ ID NO: 232071 - protein, 393 aa, Glycine max
  Coding DNA Sequence Number=SeqID_115293
  Homolog annotation: Hit_ID=Q651E9; Match level="QueryCoverage=95%, HitCoverage=92%, E-value=9e-76, Identity=41%"; Hit description =Minichromosome maintenance protein 10 isoform 1-like
  Pfam annotation: Domain name=zf-primase; Domain location=210-240; Score=8.8; E_value=0.0036; Accession=PF09329.1; Description=Primase zinc finger
MTSHEEDLDLLLSLDERVAETPPSSPTISDDDDDELELPNQRERDKPDMSVFKSALQDCLPYDPPKPTNKPVINVDSHLEKFSGLRIRNQLLTPAELKEHFSDIRFVRLSVIKNSLVGDTVSGSWATVGVLTEKGTQKTSSTGKSYCIWKIGCLDETTVSLFLFGDAYQMNMQEQAGTVFALFNSTVRKDNAGNGFSLSIYSTRQIMKMGTSVDYGVCKGKRTDGMACTLKASEKYSSMRTELKGGNLRTAFRPMGYLKSEGIYLVDPLADKTNLKKSQPVKLLSVDGIRKALSNAGKVTTASHSQGIRFLSEVAAKSDPKMKNKGSKFPNVQNKWTEKRKSSFPNVGSSPVIGNRQSGEKRIKPDGQVLADKTLKRIEKMIEIDLVSSDEDF

SEQ ID NO: 232072 - protein, 1860 aa, Glycine max
  Coding DNA Sequence Number=SeqID_115294
  Gene Ontology: Mol. function=ubiquitin-protein ligase activity; Cellular component=intracellular; Biological process=protein modification process
  Homolog annotation: Hit_ID=Q1T683; Match level="QueryCoverage=95%, HitCoverage=95%, E-value=0.0, Identity=72%"; Hit description=HECT
  Pfam annotation: Domain name=Arm; Domain location=266-306; Score =12.1; E_value=0.38; Accession=PF00514.13; Description=Armadillobeta -catenin-like repeat
  Pfam annotation: Domain name=Arm; Domain location=309-347; Score =21.1; E_value=0.0039; Accession=PF00514.13; Description =Armadillobeta-catenin-like repeat
  Pfam annotation: Domain name=HEAT; Domain location=314-349; Score =17.1; E_value=0.063; Accession=PF02985.12; Description=HEAT repeat
  Pfam annotation: Domain name=HECT; Domain location=1489-1848; Score =306.2; E_value=6e-89; Accession=PF00632.15; Description=HECT-domain (ubiquitin-transferase)
  Pfam module annotation: Pfam domain module=Arm::Arm::HEAT::HECT; Domain location=266-306::309-347::314-349::1489-1848
  Subcellular localization annotation: CTP_CleavageSite=45; ConfidenceScore=5.96e-01
METRSRKRAEASSAAPSSSSTTPSRSAKRSRLSSSSSSILPVNTRSRSARNNNNNNNSGSISFMDPTNESSGSRRDRRGKNFDRENSDKGKEKEQDVRIRDAERERERALALNMESEDVGDDDDNDSDGGVGILHQNLTSASSALQGLLRKLGAGLDDLLPATAMGGSASSPHQSGRLKKILSGLRADGEEGRQVEALTQLCDMLSIGTEDPSAHFRALTHLCDVLPSSCAAVVHYGAVSIFCARLLTIEYMDLAEQSLQALKKISQEHPTACLRAGALMAVLSYLDFFSTGVQRVALSTAANMCKKLPPDAADFVMEAVPLLTNLLQYHDSKVLEHASVCLTRIAEAFASSPDKLDELCNHGLVTQAASLISTSSSGGGQASLSTPTYTGLIRLLSTCASGSPLGAKTLLLLGTSGILKDILSGSGVSSNTSVSPALSRPADQIFEIVNLANELLPPLPQGTISLPVSSNLFVKGSVVKKSSSGNSGIQEDTNGNVHEILAREKLLNDQPELLQQFGMDLLPVLMQIYGASVNGPVRHKCLSVIGKLMYFSTAEMIQSLLSVTNISSFLAGVLAWKDPHVLVPALQISEILMEKLPGTFSKMFVREGVVHAVDQLILAGNSTNISTQTSSAEKDNDSVSGTSSRSRRYRLRSGNSNPDANPSDDLKSPVPVNVGLPPSSVETPTTNSSIRASVSSVARAFKDKYFPSDPGSVEVGVSDDLLHLKNLCTKLITGVDDQRSKAKGKVKASGFGLDDNSSNTEEYLIGVISDMLKELGKGDSVSTFEFIGSGVVEALLNYFSCGYFSKDRISETNLPKLRQQALSRFKSFVAVALPLSIDNGAVAPMTVLVQKLQNALASLERFPVMLSNSSRSSSGSARLSSGLSALSQPIKLRLCRAQGEKSLRDYSSNVVLIDPLASLAAIEEFLWARVQRGESGQKSTVGTENSESGTTPAGAGVSSPSSYTPSTAHRHSTRTRSSVNIGDTPRKETSQDKGTSSSKSKGKAVLKPAQEEAQGPQTRNTVRRRAALDKVAQMKPANGDSTSEDEELDISPVEIAEALVIEDDDISDDEDEDHEDVLRDDSLPVCLPDKVHDVKLGDSAEESTVAPATSDSQTNAASGSSSKAGTARGSDSADFRSGFSSSSRGAMSFAAAAMAGLGYANSRGFRGGRDRHGCLLFGSSNDPPKLIFTTGGKQLNRNLSIYQAIQRQLVLDEDDDERFAGSDYVSGDGSSLWGDIYTITYQRAENQPDKASTGGSSSNTSKSAKSGSALNSSSEAKLHQTSVLDSILQGELPCDLEKSNPTYNILALLRVLEGFNQLAPRLRVLMVSDSFAKGKILDLDELCVTTGARVLLEEFVSGKLTPKLARQIQDALALCSGNLPLWCYQLTKACPFLFPFETRRQYFYSTAFGLSRALYRLQQQQGADGHGSTTEREVRVGRLQRQKVRVSRNRVLDSAAKVMEMYSSQKAVLEVEYFGEVGTGLGPTLEFYTILSHDLQKVGLQMWRSYSSDKHQMEIDGDEKKKKSEGSGPNLAGDGELVQAPLGLFPRPWPTNSDASESSQFSKVIEYFRLLGRVMAKALQDGRLLDLPLSVAFYKLVLCQDLDLHDILFIDAELGKTLQEFNALVCRKHYIESIGGSYTDTIVNLYFHGAPIEDLCLDFTLPGYPEYTLKPGDEIVDINNLEEYISLVIDATVKTGIMRQIEAFRAGFNQVFDISSLQIFTPQELDNLLCGRRELWEAETLADHIKFDHGYNAKSPAIVNLLEIMGEFTPEQQRAFCQFVTGAPRLPPGGLAVLNPKLTIVRKLSSTAVNNSSNGNGPSESADDDLPSVMTCANYLKLPPYSTKKGKWCNENGLQITVAS

SEQ ID NO: 232073 - protein, 135 aa, Glycine max
  Coding DNA Sequence Number=SeqID_115295
  Gene Ontology: Mol. function=zinc ion binding; Cellular component =intracellular
  Homolog annotation: Hit_ID=Q0VJB4; Match level="QueryCoverage=98%, HitCoverage=55%, E-value=2e-33, Identity=56%"; Hit description =Putative zinc-binding protein
  Pfam annotation: Domain name=PLATZ; Domain location=1-63; Score=84.6; E_value=3.2e-22; Accession=PF04640.4; Description=PLATZ transcription factor
RVSEIQKVLDISGVQTYVINSARVLFLNVRPQPKSGKGVAHICEICGRSLLDPFRFCSLGCKLEGIRKNGDASFALDGRNEELTMDTSRGSVSSRQQEEELREGSTQDMYPATPSPSASNSRRRKGIPHRAPFGS

SEQ ID NO: 232074 - protein, 359 aa, Glycine max
  Coding DNA Sequence Number=SeqID_115296
  Gene Ontology: Mol. function=protein binding; Cellular component =nucleus; Biological process=translation
  Homolog annotation: Hit_ID=Q9ZT87; Match level="QueryCoverage=98%, HitCoverage=99%, E-value=6e-68, Identity=40%"; Hit description =Pelota (PEL1) (Putative pelota (PEL1) protein)
  Pfam annotation: Domain name=eRF1_1; Domain location=1-131; Score =117.9; E_value=2.8e-32; Accession=PF03463.6; Description=eRF1 domain 1
  Pfam annotation: Domain name=eRF1_2; Domain location=140-252; Score= -10.1; E_value=0.0074; Accession=PF03464.5; Description=eRF1 domain 2
  Pfam annotation: Domain name=eRF1_3; Domain location=249-351; Score =94.9; E_value=2.5e-25; Accession=PF03465.5; Description=eRF1 domain 3
  Pfam module annotation: Pfam domain module=eRF1_1::eRF1_2::eRF1_3; Domain location=1-131::140-252::249-351
MKLLEKDFAVNQTGTAKLVAEEPDDVWLLYNLILPGDIVSTDTTRKVHLDSSAKKNTASRVKLTLDIKVTCRDFHKDSSTLRLHGRNLQPNQHVAAGSFHTLTLEPHKPFHLRKKLWQNDAVETLNESTENSNPNTNSPDLAVVLFHPHHAEIHLIAQGVATRCTKIEPSSNSRNSVYFRQVFAAFVKRVDFKVVKRVVITSEEFRRFVMSEARKSRMRSIEENQSRIMVVAGGDSLEKVMGDRAVMELVKDKKVAAFRELWEMVCDDSDRACYGPAEVERAREMRAIETLLITDDLYRNEDVETRKKYASLVKSVKEGGGKALVYSSMHVSAPQLAQLTGVAAILRFPLPELEDVNGC

SEQ ID NO: 232075 - protein, 288 aa, Glycine max
  Coding DNA Sequence Number=SeqID_115297
  Homolog annotation: Hit_ID=Q5YJL6; Match level="QueryCoverage=54%, HitCoverage=93%, E-value=5e-42, Identity=56%"; Hit description =Autophagy protein AGP6
  Pfam annotation: Domain name=Mod_r; Domain location=103-242; Score =144.5; E_value=2.9e-40; Accession=PF07200.3; Description=Modifier of rudimentary (Mod(r)) prote
MDEIEGSERGKTTTVGCNLEMLFGAYATLELESSLRLYVATIQLSKQQSQDGSSQSQSWYPPSVVSSPTSSRPVTPTASSSSLSQRPSSHVPPSEAAAVIAVLKDKSVDELRKLLSDKDAYQQFLHSLDQLKDELCKENLQLAEENLQKEPRIMELRNQCRIIRTTELAAAKEKLNELEKQKEDMLKLNSAASLLQRIQESVNKTDEESENLHHNLLDREIDLGAFLQKYKKLRTTYHRKTLVHLAAKTSTPEIVHCGDIVEWFHATWNECAVAYEIIIADIGFTVVL

SEQ ID NO: 232076 - protein, 68 aa, Glycine max
  Coding DNA Sequence Number=SeqID_115298
  Gene Ontology: Mol. function=zinc ion binding; Cellular component =intracellular
  Homolog annotation: Hit_ID=Q5QLZ0; Match level="QueryCoverage=82%, HitCoverage=24%, E-value=3e-13, Identity=55%"; Hit description=Zinc -binding protein-like
MGFKLQEDTAVLVPPWLEQLLHTPFFNVCRIHAEAARSECNMFCLHCNGEAFCFYCSSSRHKDHQVIQ

SEQ ID NO: 232077 - protein, 386 aa, Glycine max
  Coding DNA Sequence Number=SeqID_115299
  Gene Ontology: Mol. function=pepsin A activity; Cellular component =cellulose and pectin-containing cell wall; Biological process =proteolysis
  Homolog annotation: Hit_ID=Q9FFC3; Match level="QueryCoverage=92%, HitCoverage=57%, E-value=1e-94, Identity=49%"; Hit description =Protease-like protein
  Pfam annotation: Domain name=Asp; Domain location=84-386; Score= -164.0; E_value=0.00064; Accession=PF00026.14; Description=Eukaryotic aspartyl protease
MRGGVSLLLALASVAAAATVSCGGLAGTFLPLERAIPLNQQVELEALRARDRARHGRILQGVVGGVVDFSVQGTSDPYFVGYGLYFTKVKLGSPAKEFYVQIDTGSDILWINCITCSNCPHSSGLGIELDFFDTAGSSTAALVSCGDPICSYAVQTATSECSSQANQCSYTFQYGDGSGTTGYYVSDTMYFDTVLLGQSVVANSSSTIIFGCSTYQSGDLTKTDKAVDGIFGFGPGALSVISQLSSRGVTPKVFSHCLKGGENGGGVLVLGEILEPSIVYSPLVPSQVMTSISLHLAKYVDFGRILVIKAMALEGTVTCHILGKWHESTRKWPHYNLNLQSIAVNGQLLPIDSNVFATTNNQGTIVDSGTTLAYLVQEAYNPFVKA

SEQ ID NO: 232078 - protein, 991 aa, Glycine max
  Coding DNA Sequence Number=SeqID_115300
  Gene Ontology: Mol. function=ubiquitin-protein ligase activity; Cellular component=intracellular; Biological process=protein modification process
  Homolog annotation: Hit_ID=Q9AUK0; Match level="QueryCoverage=77%, HitCoverage=98%, E-value=1e-132, Identity=55%"; Hit description =Putative ubiquitin protein ligase
  Pfam annotation: Domain name=HECT; Domain location=639-991; Score =307.5; E_value=2.4e-89; Accession=PF00632.15; Description=HECT -domain (ubiquitin-transferase)
MEALQGHKDDFPAASAGVGDSGESLCWCDDSKLDFKQFVETISVLYHPYLNSASEGPQQENRFYEAVLYNPTGKPEIFWAQDITIVTSLAMRVLVMLTDLKGWKGITDDNHLDADLAVKDLIQFLGEKVLMEMLEFVKSEILVSFKAIPPVGWALTNSICLATGNENESFNQGLEYALYVRVVITLAEALLACLDNIGWVKKKKKALQIDVESSTQPVDTVRHEGEATDESIIMSYMDQFRPVCQQWHLKNLLASIDRDANNKAATVISNDLACLGKLELCDVALFYSNLLRIFSVLSPIRGPLSVLNMLAFTPGFLVRLWGVLEDSFFSEDKNNSDNHTSESSKHKAFEKMQKHVSKDGANKWVNVLHKFTGRSQAATDCIDSIGSHSEPSRVNDDSSDVWDTEPMRHGPQGVPKDMFAMLHLFCATYSHLLLVLDDIEFYEKQSSKEELRQCSIPWFIMACPIHPFCPPALWLSPARKSRPPIAVAARTHEVLATNLRSDDSSASLSVGSVVTIVPHVFPFEERASPGAAVKLCLGDLLVVGSNPETASLHMQGVEMFREFIKMDKASRKMAGEISEPGSRAIEIVIRRGHIVEDGFRQLNSLGSRLKSSIHVSFVSECGLLEAGLDYGGLSKEFLTDISKAAFSPEYGLFSQNSTSDRLLIPTASARYLENGLQMIEFLGRVVGKALYEGILLDYSFSHVFVQKLLGRYSFLDELSTLDPELYRNLMYVKGRGLDFGFLHWRALRLGVSFPSAFYSFYRPKPWAFPCGPSRAKPDLRAERDLALSLASPVERELRAEPDLCTERNYDGDVKELSLDFTVTEESLGKRYVVELKSGGKDISVTNENKMQYIHAMADYKLNQQILPFSNAFYRGLTDLISPAWLKLFNASEFNQVIKGFEPKERCMLLKFVTSCSRAPLLGFKYLQPPFTIHKVACDVPLWATIGGQDVDRLPSASTCYNTLKLPTYKRPGTLRAKLLYAISSNAGFELS

SEQ ID NO: 232079 - protein, 256 aa, Glycine max
  Coding DNA Sequence Number=SeqID_115301
  Homolog annotation: Hit_ID=Q9ZTY1; Match level="QueryCoverage=99%, HitCoverage=100%, E-value=1e-55, Identity=46%"; Hit description=35 kDa seed maturation protein
  Pfam annotation: Domain name=LEA_4; Domain location=133-172; Score =27.3; E_value=5.3e-05; Accession=PF02987.7; Description=Late embryogenesis abundant protein
MASRRQFKEERAEAAAKLAAKDIGDINRANERDEGYDLRNEANFKQARAEAAAKLAAKDLEDANRLRDSTLINTTCHDHDENKPSLIGSMLRAAKEAVVGKPHHDEVDNSSGFYEKAKETKVDAAGSKMGEYADYATQKARETKQKAKEAKDYAADKAKDAKDTTVQTAAKRAIGFFSGGNKDQTKEEEETSRRMQEVRVQDKEYGTGRGGEKLVIKMEESRPGAVADALKAANKAMDGVMEEEGVLHVERRREKI

SEQ ID NO: 232080 - protein, 279 aa, Glycine max
  Coding DNA Sequence Number=SeqID_115302
  Gene Ontology: Mol. function=transferase activity; Cellular component= nucleus; Biological process=regulation of transcription
  Homolog annotation: Hit_ID=Q9FFN1; Match level="QueryCoverage=77%, HitCoverage=62%, E-value=1e-60, Identity=43%"; Hit description =Selenium-binding protein-like
  Pfam annotation: Domain name=PPR; Domain location=123-157; Score =41.0; E_value=4.2e-09; Accession=PF01535.11; Description=PPR repeat
  Subcellular localization annotation: CTP_CleavageSite=29; ConfidenceScore=5.23e-01
MAGSGGGGLHCKSFLKSSLSPPYSKPPPSLSLRHGTLHATLLKRDQDTHLSTYLKLNLFPHALGLCGTLGHLDMGKQIHCHVVKRGLGCNLEVGNAVVSMYFKCGSVDDAMKVFNDMPCTDIVTWNTLISGNLMHRQGDRALEIWVEMLQEGMKPNQVTFVLIISAYRKTNLNLVDDCRSLFNSMRTVYQIEPTSKHYASFISVLGYWGLLQEALETINNMPFQPSALVWRALLDGCRLHKNALIGKWAAQNILTLEPKDPSTFILVSNLYSASGMGPL

SEQ ID NO: 232081 - protein, 274 aa, Glycine max
  Coding DNA Sequence Number=SeqID_115303
  Gene Ontology: Mol. function=nucleic acid binding
  Homolog annotation: Hit_ID=Q10N87; Match level="QueryCoverage=99%, HitCoverage=40%, E-value=7e-25, Identity=30%"; Hit description =Polyadenylate binding protein, types 1, 2, 3, 4 family protein, expressed
  Pfam annotation: Domain name=PABP; Domain location=183-249; Score =91.7; E_value=2.2e-24; Accession=PF00658.8; Description=Poly -adenylate binding protein, unique domain
MYHGKPLYVALAQRKEDRKAQLQLQYAQQLARLSGPSTAIIPSGYPPYYYAASGVISHVPPRAGLMYQHLALRPGWGANGFAPPARSFQQSPVPAVSNNTRQHRQNRGKLNGNSIAQGNTHSGTYLPQAQQISQPVISSRDSSTQQRTGQARYIPSGRQRDVEKGSGSSSVGSNSGRGGSQGSEMLHSLLAGAAPEQQKEILGEHLYMLPTLAAKITGMLLEMDNGELLLLLESPESLSAKVEEAVQVLKNSKTKVSGQDVLHSNFLSAEVAVN

SEQ ID NO: 232082 - protein, 633 aa, Glycine max
  Coding DNA Sequence Number=SeqID_115304
  Gene Ontology: Mol. function=protein serine/threonine kinase activity; Cellular component=integral to membrane; Biological process=protein amino acid phosphorylation
  Homolog annotation: Hit_ID=Q9LZM4; Match level="QueryCoverage=94%, HitCoverage=92%, E-value=1e-153, Identity=47%"; Hit description =Putative wall-associated receptor kinase-like 20 precursor
  Pfam annotation: Domain name=APH; Domain location=338-537; Score= -13.2; E_value=0.05; Accession=PF01636.13; Description=Phosphotransfer ase enzyme family
  Pfam annotation: Domain name=Pkinase; Domain location=346-623; Score =157.2; E_value=4.3e-44; Accession=PF00069.15; Description=Protein kinase domain
  Pfam annotation: Domain name=Pkinase_Tyr; Domain location=346-623; Score=121.1; E_value=3.1e-33; Accession=PF07714.7; Description =Protein tyrosine kinase
  Pfam module annotation: Pfam domain module=APH::Pkinase::Pkinase_Tyr; Domain location=338-537::346-623::346-623
MIAESNMRPNFHFCYAFLLILVLGHHTSSQKTCTNCGSMQVPYPLSTDSTCGDPHYKLRCDPHSQRLFFDTLNGSSYLVLRIMSSNQRMVVEPSPWLPGSCVTQDMPRSNGIWLNQSLPFNITSSNTVFLFNCSPRLLVSPLNCTSSSICHRYLENSGHVDTKRALECANDLHPCCTFLAGGIPSAYRIRLHDSGCKAFRSIIHLNQDKPPNQWEEGLEIQWAPPPEPVCKTQRDCSEDSKCSPTSRNGLFRCLCNGGHIWNPFEATCVRYERKSKWKTSLVVSIGVVVTFFSLAVVLTIITKSCKLSTYKENQAKEREDKLKSSAVEKPCRMFQLKEVKRATNGFSHERFLGSGGFGEVFKGELQDGTLVAVKKARVGNLKSTQQVLNEVAILSQVNHKNLVRLLGCCVESELPLMIYEYISNGTLYDHLHGRYCSNFLDWKTRLKVAFQTAEALAYLHSAAHTPIYHRDIKSTNILLDDEFNAKVSDFGLSRLASPGLSHVSTCAQGTLGYLDPEYYRNYQLTDKSDVYSYGVVLLELLTSQKAIDFNRDQDDVNLAIHVNQHASNGTIMEVVDQRLLISVETLLGDKMFTSIKLFLELALECLREKKGERPNMRDIVQRLLCIIRIVEQE

SEQ ID NO: 232083 - protein, 72 aa, Glycine max
  Coding DNA Sequence Number=SeqID_115305
  Gene Ontology: Mol. function=DNA binding
  Homolog annotation: Hit_ID=Q70I27; Match level="QueryCoverage=73%, HitCoverage=10%, E-value=1e-18, Identity=85%"; Hit description=SAR DNA-binding protein-like protein
MAIDLFSQMGMRGAKFDSKIDCIYNNAVMELMSGVRNQLTELIFGLAIQDMAPMSWGLSHSLSRYKLKLSAE

SEQ ID NO: 232084 - protein, 214 aa, Glycine max
  Coding DNA Sequence Number=SeqID_115306
  Gene Ontology: Mol. function=sequence-specific DNA binding; Cellular component=nucleus; Biological process=regulation of transcription, DNA-dependent
  Homolog annotation: Hit_ID=Q1S8N0; Match level="QueryCoverage=99%, HitCoverage=98%, E-value=1e-47, Identity=48%"; Hit description =Leucine zipper, homeobox-associated; Homeodomain-related
  Pfam annotation: Domain name=HALZ; Domain location=112-156; Score =32.3; E_value=1.7e-06; Accession=PF02183.8; Description=Homeobox associated leucine zipper
  Pfam annotation: Domain name=Homeobox; Domain location=57-111; Score =74.1; E_value=4.5e-19; Accession=PF00046.19; Description=Homeobox domain
  Pfam module annotation: Pfam domain module=HALZ::Homeobox; Domain location=112-156::57-111
MDWHHGTKPFVPRPETLSFFYNYDNNNSYPGVEVKQAALMETGERSVPAMDRGNKEKKKRLTNNQIELLERSFQEEIKLDPERKMKLSRELGLQPRQIAVWFQNRRTRWKAKQLEHLYDMLKHQYDVVSNEKQKLQEEVIKLKAMLSKQQGYWTQKFGGYTEISGEETVESTSEGLRGKSNIEHVADQGYCSFAVEDYNTTVSLPHCHWPVVPY

SEQ ID NO: 232085 - protein, 566 aa, Glycine max
  Coding DNA Sequence Number=SeqID_115307
  Gene Ontology: Cellular component=integral to membrane
  Homolog annotation: Hit_ID=Q75GI8; Match level="QueryCoverage=60%, HitCoverage=82%, E-value=6e-96, Identity=50%"; Hit description =Expressed protein
  Pfam annotation: Domain name=AmoA; Domain location=107-449; Score= -148.6; E_value=0.075; Accession=PF05145.3; Description=Putative ammonia monooxygenase
  Pfam annotation: Domain name=DUF81; Domain location=61-389; Score =4.9; E_value=7.7e-06; Accession=PF01925.9; Description=Domain of unknown function DUF81
  Pfam annotation: Domain name=Ribosomal_L24e; Domain location=405-475; Score=173.9; E_value=3.9e-49; Accession=PF01246.10; Description =Ribosomal protein L24e
  Pfam module annotation: Pfam domain module=AmoA::DUF81::Ribosomal _L24e; Domain location=107-449::61-389::405-475
MSTKGFIIYLLSSFSVALLSALLLPRTSNYKHYSSISPPSHDYGFGNDKLWPELKVGWRVALATVIGFLGSAFGTVGGVGGGGIFVPMLTLIVGFDTKSAAALSKCMIMGASTASVWYNLRVPHPTKEVPIIDYDLALLFQPMLMLGITVGVVLSVVFPYWLITVLIIILFIGSSSRSFFKGTQMWREETLLKAVLIDTEYEQLFPKEEKSSMNDVKICSVWYWVLFCLQFPIALLVFGYEAVKLYKGHKERVSTGNPESICEASIEWTVLHILFCALCGILGGTVGGLLGSGGGFILGPLLIEIGVIPQVASATATFVMMFSSSLSVVEFYLLKRFPIPYALYLTAVSVLAGFWGQYFVRKLMVILKRASIIVFILSGVIFASALTMGKGLHRAATPPAAAMVLKTELCRFSGAKIYPGKGIRFVRGDSQVFLFANSKCKRYFHNRLKPSKLTWTAMYRKQHKKDIAQEAVRKRRRAAKKPYSRSIVGATLEVIQKKRAEKPEVRDAAREAALREIKERIKKTKDEKKAKKAEVASKSQKAGGKGNVSKGAMPKGPKLGGGGGKR

SEQ ID NO: 232086 - protein, 97 aa, Glycine max
  Coding DNA Sequence Number=SeqID_115308
MVLSLHNTLEDMKERALYRVTKEDAESCCDENMRNRAMEEGTGENRLCGGGGAGGVEEVEQIRKRTMDCKCYTSVRVKLVSLFCKFALFVVCLKSLA

SEQ ID NO: 232087 - protein, 93 aa, Glycine max
  Coding DNA Sequence Number=SeqID_115309
MGRARSHIKKLRTYLGIVAHDKVDVTYENWKQVPANQKDLIWEDIQLNLISLKWALSADKESVDDTVCEKYDISKEKWTQFCQTRRHMAETSM

SEQ ID NO: 232088 - protein, 66 aa, Glycine max
  Coding DNA Sequence Number=SeqID_115310
MQNSKRDVYLGAYLNGIITYIGLHCRAHWQMVIILPKENVVICALKGLDDTPQSKSKTGARWIFVE

SEQ ID NO: 232089 - protein, 114 aa, Glycine max
  Coding DNA Sequence Number=SeqID_115311
  Gene Ontology: Mol. function=chitin binding; Cellular component =extracellular region; Biological process=chitin metabolic process
  Homolog annotation: Hit_ID=UPI00006A17C9; Match level="QueryCoverage =80%, HitCoverage=100%, E-value=8e-10, Identity=32%"; Hit description= UPI00006A17C9 related cluster
MIDPLDESISCILIRVDPWVHALTFRGLHALTFRGLHALAFRGLHVLTFRGLHTLTFRGLHALAFGGLHTLAFRGLHVLTFRELHALTFRGLHVLAFRGLRIITFRGLHVASLN

SEQ ID NO: 232090 - protein, 185 aa, Glycine max
  Coding DNA Sequence Number=SeqID_115312
  Subcellular localization annotation: CTP_CleavageSite=44; ConfidenceScore=5.03e-01
GVFGDGGGSPQSTLSVFENSGKGSSPNDAVPPHVNSSSTWDLLRAAAGEVERICDESCNRYGQNFLTPSSIDASVQQPNAVNCANGVGLGFYPQQKQHQQQPSLCHQQLQIAQFEMMKKQQQHRQMVPPNRGINNNNNNNNNNVVTVGNVVNGLGLSGSAWVPPPGSRMRAVFLAGKIEKSTGTG

SEQ ID NO: 232091 - protein, 86 aa, Glycine max
  Coding DNA Sequence Number=SeqID_115313
  Pfam annotation: Domain name=G-patch; Domain location=1-42; Score =7.0; E_value=0.026; Accession=PF01585.13; Description=G-patch domain
MVTRVMLRNGFEPRMGLGKDGLRNADMVDIKGNPYKYGLGYEPGMPGRRNVPSRLRVDRENPHYKVLNGQFTTLFGVISFLPLIIL

SEQ ID NO: 232092 - protein, 180 aa, Glycine max
  Coding DNA Sequence Number=SeqID_115314
  Homolog annotation: Hit_ID=Q47522; Match level="QueryCoverage=23%, HitCoverage=53%, E-value=3e-19, Identity=100%"; Hit description=LacZ protein
DLPSQVLQWLLFLSAVPPVQLLTGWCVTAKAPPDISAGKCSGRVPFAIQAAQLLGRAIGAGLFAITPAGERGMCCKAIKLGNARVFPEFDETAASAFNPGQDYPQGLPGLSQICGNTRPKYRAPIRWVRLPPPGRPGALIKLIDTVDLEGGPAECILAYYVGTDEGVSEVLHVAGEKRLH

SEQ ID NO: 232093 - protein, 74 aa, Glycine max
  Coding DNA Sequence Number=SeqID_115315
PFTGFLVESGWAANPSVDCEAQNAIPKSKHTSFVQDQNQRHHHHFDGEVVMHACFGFVWEILVAMVVPVVVQWQ

SEQ ID NO: 232094 - protein, 227 aa, Glycine max
  Coding DNA Sequence Number=SeqID_115316
  Gene Ontology: Mol. function=oxidoreductase activity; Cellular component=membrane; Biological process=metabolic process
  Homolog annotation: Hit_ID=Q76KV8; Match level="QueryCoverage=83%, HitCoverage=73%, E-value=2e-57, Identity=65%"; Hit description=Short- chain alcohol dehydrogenase A
  Pfam annotation: Domain name=KR; Domain location=19-167; Score=-81.3; E_value=0.012; Accession=PF08659.1; Description=KR domain
  Pfam annotation: Domain name=adh_short; Domain location=18-159; Score= -0.3; E_value=5.8e-06; Accession=PF00106.15; Description=short chain dehydrogenase
  Pfam module annotation: Pfam domain module=KR::adh_short; Domain location=19-167::18-159
MAECTSTPTNSSLRLTAKVAIVTGGASGIGEATARVFAEQGARMVVIADIQDDLVNRVAASIGTHRCTYVHCDVADEEQVKYLVQTTVNAYGQIDIMFRNAGIASPSKQTVSELDMSQQLFAVNMHTWNSGVRETRSACDIGGAREGKHYLHGERARGVGVDAFGERAACGTRDKSELRLAQWVGNAVDLSGSHAQRRGRHRVVVSDDSAFITGFDLIVDGGFKYGQ

SEQ ID NO: 232095 - protein, 132 aa, Glycine max
  Coding DNA Sequence Number=SeqID_115317
MVTTKCWNARKRRHKKDDVLMNLPANGVNTMERRRGKEARGGEQTRRQTDKKMRKNAREKKYDLCPQMVVDGIPSVSHVKLGKVHGHLPRMRNCKEKIDGPNPSVDMIATLSYVVPNTLARSKTFTCIPYCK

SEQ ID NO: 232096 - protein, 418 aa, Glycine max
  Coding DNA Sequence Number=SeqID_115318
  Gene Ontology: Mol. function=protein transporter activity; Cellular component=nuclear pore; Biological process=protein import into nucleus, docking
  Homolog annotation: Hit_ID=Q9LHS4; Match level="QueryCoverage=93%, HitCoverage=42%, E-value=1e-153, Identity=61%"; Hit description=RAN binding protein 16-like
  Pfam annotation: Domain name=IBN_N; Domain location=25-89; Score =28.0; E_value=3.3e-05; Accession=PF03810.9; Description=Importin -beta N-terminal domain
MELAQLEALCERLYNSQDSVERAHAENTLKCFSMNTEYISQCQYILDHALTPYALMLASSSLLKQVTEHSLAMKLRLDIWTYLINYLATRGPELQPFVAASLIQLLCRVTKFGWFDDDRFRDLVKESMNFLSQATPGHYAIGLKILSQLISEMNQANAGMPATNHRRVACSFRDQYLFQIFQISLTSLGQLKNDGKMVVNQLQELALALSLKCLSFDFVGTSVDESSDEFGTVQIPSPWKPVLEDSSTLQIFFDYYAITKPPLSKELSELVNVEGYSDWIRLVAEFTLKSLQSWQWASNSVYYLLGLWSRLVSSVPYLKGDAPSLLDEFVPKITESFITSRFNSVQAGLPDDLSENPLDNAELLQDQLDCFPYLCRFQPDATMKMPLVNTLKQRFWASNYQEPKIFSLPEQVDLPMKK

SEQ ID NO: 232097 - protein, 114 aa, Glycine max
  Coding DNA Sequence Number=SeqID_115319
MICNLMLMVCNNDLPPLRIILSCIGGKCRVQWLRSENVARVDNNCNRQFSFKICYISVDTEREIYRREWSATVVVLEGWGPSFISCSGDSFNSPVITVAESREGSRTVFKEYEA

SEQ ID NO: 232098 - protein, 287 aa, Glycine max
  Coding DNA Sequence Number=SeqID_115320
  Gene Ontology: Mol. function=protein serine/threonine kinase activity; Cellular component=ubiquitin ligase complex; Biological process=protein amino acid phosphorylation
  Homolog annotation: Hit_ID=Q336U1; Match level="QueryCoverage=49%, HitCoverage=32%, E-value=2e-11, Identity=27%"; Hit description=U-box domain containing protein, expressed
  Pfam annotation: Domain name=Usp; Domain location=80-225; Score=12.8; E_value=0.052; Accession=PF00582.16; Description=Universal stress protein family
MMSVETGHDCLHYDSDEETSSCSCGFIGFRRNQVFDCSTNEINNEDSEELFEINLKEQLDTISEEDCESSVFSFDFHNDKDVVHVAVDHVGESSMEALLWTLNHAVTPSTTVYLVHVFPEIRLVPSPFGKFPRSHVNPEYVNFHLTQQKSKTKELLQKFIDLCLDSKVKVEIMLIEGDNIAKAITDHVRVHSIRKLVIGITKSNLSKSVSRRRNAIANKVLKNVPEICDIKIICDGKEVIDQMIGCNSSCSSDSRSSRVSQEENESCGFVPLMRFVPNPIWLFRPRF

SEQ ID NO: 232099 - protein, 148 aa, Glycine max
  Coding DNA Sequence Number=SeqID_115321
  Gene Ontology: Mol. function=protein serine/threonine kinase activity; Cellular component=cytoplasm; Biological process=protein amino acid phosphorylation
  Homolog annotation: Hit_ID=Q9FG74; Match level="QueryCoverage=59%, HitCoverage=19%, E-value=5e-33, Identity=73%"; Hit description =Serine/threonine-specific protein kinase ATPK64
VGQPLRFPEAPVVSFAARDLIRGLLVKEPQHRLAYKRGATEIKQHPFFEGVNWALIRCATPPEIPKAVEFEKIPSPASSSGGEKAVNHMSIANQKGLRLVEKFVSSPLGKVPPRDECNIGGKLPDGGLINSRQLLECTLSPELGQILK

SEQ ID NO: 232100 - protein, 337 aa, Glycine max
  Coding DNA Sequence Number=SeqID_115322
  Gene Ontology: Mol. function=protein serine/threonine kinase activity; Cellular component=cytoplasm; Biological process=protein amino acid phosphorylation
  Homolog annotation: Hit_ID=Q39183; Match level="QueryCoverage=86%, HitCoverage=47%, E-value=7e-84, Identity=59%"; Hit description =Serine/threonine protein kinase (AT5g47750/MCA23_7) (Protein kinase (EC 2.7.1.37) 5)
  Pfam annotation: Domain name=Pkinase; Domain location=212-337; Score=- 114.9; E_value=0.1; Accession=PF00069.15; Description=Protein kinase domain
  Pfam annotation: Domain name=Pkinase_Tyr; Domain location=212-335; Score=-174.5; E_value=0.092; Accession=PF07714.7; Description =Protein tyrosine kinase
  Pfam module annotation: Pfam domain module=Pkinase::Pkinase_Tyr; Domain location=212-337::212-335
MDSKTSSRALPKHHQKTAGIQTLEAKDTGSSLQKGEKTELAAPVDLSMYAANASKQNTGETAEIKKLGGLTLKGSADSMSIKSGSGASSSVLDKVVHAANENIGSQESSIDLDKKTSEDGSVKNSSVSAKVSDGASSLAKTSGSAKISNRADFVESGKSSICRGSTSSDVSDESTCSSFSSSINKPHKANDLRWEAIQAVRSRDGVLGLGHFRLLKRLGCGDIGSVYLSELSGTKCYFAMKVMDKGSLASRKKLLRAQTEREILQSLDHPFLPTLYTHFETEKFSCLVMEFCPGGDLHTLRQKQPGKHFPEQAVKLLNPCMRIKKNDDYTYVKNIKF

SEQ ID NO: 232101 - protein, 71 aa, Glycine max
  Coding DNA Sequence Number=SeqID_115323
MSQTCQQKLEIFGEIKKGIGVVAENYQKQRFKVESEADPKEERETQMEKELNLKGYGENPGWEGKNWKRGK

SEQ ID NO: 232102 - protein, 115 aa, Glycine max
  Coding DNA Sequence Number=SeqID_115324
  Homolog annotation: Hit_ID=Q9FIK4; Match level="QueryCoverage=26%, HitCoverage=9%, E-value=2e-07, Identity=77%"; Hit description=4 -nitrophenylphosphatase-like protein
  Subcellular localization annotation: CTP_CleavageSite=15; ConfidenceScore=5.07e-01
MVAAICGSTQKEPVVAGKPSTFMMEFLLKKFFSAYNLLSLADSISSFSVLLAVWLFSVVKLWLIHSQSKFLEKFTSTAWFEGRGKSMMLFTFLLMEFGSPECQMTTIGNIMHNLR

SEQ ID NO: 232103 - protein, 100 aa, Glycine max
  Coding DNA Sequence Number=SeqID_115325
MSNCITVGGNEKASWIFTILNTGHVTPNYVAVKDQDHEVGSRFGLQDPYQDSGTQSNNEQGVTLHSYHIQQSSSASGLLFYLHRPAINECFSEDTSVTIL

SEQ ID NO: 232104 - protein, 95 aa, Glycine max
  Coding DNA Sequence Number=SeqID_115326
MKDAALKKPMNQQEAFQSYLLGWCKPTGGHHAQRSQTSNHQSVYLQMKSISMNFGSIMERDEKRFVYRIRCSSDENNEAEGIEEGIGVSYVSEYR

SEQ ID NO: 232105 - protein, 194 aa, Glycine max
  Coding DNA Sequence Number=SeqID_115327
  Homolog annotation: Hit_ID=Q8L8H3; Match level="QueryCoverage=58%, HitCoverage=71%, E-value=2e-24, Identity=55%"; Hit description=Iron -stress related protein
MNPKLCLFGPTIGSFLLIKLKDQAGRPRHALIDYGKRKGKEDVLSLSLNWHWNSTLLFLCRRTSSFRKMLENLQAPPSTTESAPVVKRYAPPNQRNRSANRRKSSDRLDRTNSVGNDLEKNQVASSRSVHIPDHEDAGSSNLLNENHYSRFIALEGCSCSAAAQLLNDRKFLGYMDHDGFIELVGGMGMPKANF

SEQ ID NO: 232106 - protein, 337 aa, Glycine max
  Coding DNA Sequence Number=SeqID_115328
  Gene Ontology: Mol. function=nucleic acid binding; Cellular component= cytosol; Biological process=regulation of mRNA stability
  Homolog annotation: Hit_ID=Q93YF1; Match level="QueryCoverage=84%, HitCoverage=71%, E-value=1e-128, Identity=56%"; Hit description =Nucleic acid binding protein
  Pfam annotation: Domain name=MPPN; Domain location=183-269; Score= -11.9; E_value=0.0021; Accession=PF05172.3; Description=MPPN (rrm -like) domain
  Pfam annotation: Domain name=RRM_1; Domain location=194-259; Score =87.8; E_value=3.3e-23; Accession=PF00076.12; Description=RNA recognition motif. (a.k.a. RRM, R
  Pfam annotation: Domain name=RRM_1; Domain location=5-67; Score=7.7; E_value=0.028; Accession=PF00076.12; Description=RNA recognition motif. (a.k.a. RRM, R
  Pfam annotation: Domain name=RRM_1; Domain location=89-161; Score =70.1; E_value=7e-18; Accession=PF00076.12; Description=RNA recognition motif. (a.k.a. RRM, R
  Pfam module annotation: Pfam domain module=MPPN::RRM_1::RRM_1::RRM_1; Domain location=183-269::194-259::5-67::89-161
MLPVLLISNLLSDCCIILQISSIKVIRNKQTGLSEGYGFVEFYSHATAEKVLQNYAGILMPNAEQPFRLNWATFSTGDKGSDNVPDLSIFVGDLAADVTDSLLHETFASVYPSVKAAKVVFDANTGRSKGYGFVRFGDDNERTQAMTQMNGVYCSSRPMRIGAATPRKSSGHQQGGLSNGTANQSEADSTNTTIFVGGLDPNVSDEDLRQPFSQYGEIVSVKIPVGKGCGFVQFANRNNAEEALQKLNGTTIGKQTVRLSWGRNPANKQFRMDFGSPWTGAYYGAPMYDGYGYALPPRHDPSIYAAAYGAYPLYGGHQQQTRIPPNCGVEMNFDSLR

SEQ ID NO: 232107 - protein, 324 aa, Glycine max
  Coding DNA Sequence Number=SeqID_115329
  Gene Ontology: Mol. function=serine carboxypeptidase activity; Cellular component=cellulose and pectin-containing cell wall; Biological process=proteolysis
  Homolog annotation: Hit_ID=Q6W6R6; Match level="QueryCoverage=97%, HitCoverage=70%, E-value=1e-119, Identity=60%"; Hit description =Putative serine carboxypeptidase
  Pfam annotation: Domain name=Peptidase_S10; Domain location=1-316; Score=373.7; E_value=3e-109; Accession=PF00450.12; Description =Serine carboxypeptidase
MQELGPFRVNSDGRTLYTNQYAWNNVANVIFLESPAGVGFSYSNTSSDYTKTGDKSTAMDSYTFLLNWLERFPQYKTRDLFITGESYAGHYVPQLADTILTYNKLTNHTVINLKGIAVGNGWIDDNMCGKGMYEYFWTHALNSDETHEGIQRHCDFENGNLTSECSKYQIRGDIEIGTIDIYGIYAPPCDSAATKAGASPATNSDSNYDPCSDDYTNSYLNLAEVQEALHAKASVWYPCSGDTDGRVPITSSRYSINSMKLPVETTWRPWYSSNEVGGYLVGYKGLTLITVRGAGHMVPSYQPQRALTMISFFLRGELPPEFTS

SEQ ID NO: 232108 - protein, 297 aa, Glycine max
  Coding DNA Sequence Number=SeqID_115330
  Gene Ontology: Mol. function=zinc ion binding
  Homolog annotation: Hit_ID=Q5UBY2; Match level="QueryCoverage=44%, HitCoverage=26%, E-value=9e-16, Identity=29%"; Hit description=FAR1 -related 1 protein
WLKAMSNLPPKVIITDQEQFLKEAVMGMFPDKHEQFDKRWWKLINRFELKDDEWVQSLFEDRKKWVPTYTRDISLAGLSTTIRPRKKSINTVNANNSARSTLESNKLVLNGFDVEEKNDGCYRAKPTKKRKSFNKRECSDPERIKIKMLDDFQKREQRNTRAHNFDNCYISQQDIQTVACNISVPNLDSRASTLDVYYGAQHNAQLNSVSVMHDGYYSSQPAITGLGQLHSVPSSGSHHEMQHSMQGPLQGQLTFRTPTVQGFFDLQDSLEAMEQPIRVSQFHGITSKQLDVDRSLS

SEQ ID NO: 232109 - protein, 172 aa, Glycine max
  Coding DNA Sequence Number=SeqID_115331
MDKEECKEVSVSSMRLAKKESHFAIKTKIKETSPLRQPPHLLLCKMIFVSTVTPLGLKVILQVKELLDEGLVRKSLNPCVLLVPKIGIINMKIQKKVSKEGAHSIKNPGKEPKVSRTSRKGLFYCLPLIIFWPRRRAPLRCIDLGLSLDMSESHKILNRLPFKLLLYPYFSI

SEQ ID NO: 232110 - protein, 210 aa, Glycine max
  Coding DNA Sequence Number=SeqID_115332
  Homolog annotation: Hit_ID=Q6AST9; Match level="QueryCoverage=86%, HitCoverage=86%, E-value=2e-35, Identity=43%"; Hit description =Expressed protein
MGPRELTGSVDLLNHFKLLPHFEFFCKRPLPVSISDAHYLYNVVGDIEIRKGDGMQLDQLIQDTSLSSGSNYRIQPLDLNILKEAFQLKETVPIDLPAAEKGILTVAGKSKGESKDEEKKHKKHKDRDKDKDKEHKKHKHRQKDRSKDKEKEKKKDKNRHRDSSADPSKKHNEKKRKHDGDDDLNVVHKHKKSKHKSSKIDELGAIKVAS

SEQ ID NO: 232111 - protein, 149 aa, Glycine max
  Coding DNA Sequence Number=SeqID_115333
  Gene Ontology: Mol. function=kinase activity
  Homolog annotation: Hit_ID=Q84YQ2; Match level="QueryCoverage=74%, HitCoverage=25%, E-value=7e-33, Identity=62%"; Hit description =Putative Serine/threonine-protein kinase
MENIPESSSRGTKRRRDEDSDAGNTSSLEDDLTFTDTLVALRIMRAQFPHVHKSSVEPFILKSQLYSIVKDRTQVDRELESLRRDKVLRVFKLNTGQDDHAIMFLDDYLNQLCNLEVTRSNPENGLLACEGKTVYIYPPKIPLGGSLVH

SEQ ID NO: 232112 - protein, 559 aa, Glycine max
  Coding DNA Sequence Number=SeqID_115334
  Gene Ontology: Mol. function=zinc ion binding
  Homolog annotation: Hit_ID=UPI00004BCC4B; Match level="QueryCoverage =16%, HitCoverage=5%, E-value=1e-09, Identity=33%"; Hit description =CTD-binding SR-like protein rA9
  Pfam annotation: Domain name=PHD; Domain location=385-433; Score =59.8; E_value=9e-15; Accession=PF00628.19; Description=PHD-finger
  Pfam annotation: Domain name=zf-C3HC4; Domain location=386-430; Score= 1.9; E_value=0.1; Accession=PF00097.15; Description=Zinc finger, C3HC4 type (RING finger)
  Pfam module annotation: Pfam domain module=PHD::zf-C3HC4; Domain location=385-433::386-430
TTRENCGSSRSENFKMDVWPDKKGGLDTKKVNGSINEEIQWLWKRIKERRRRKLEEVLMRNFMENDFSENLVRSETGGWSPKCLGAYQLVSKLVANVWERATYKGAELGYYGVPKSLIGQYGMINGIFKCMVIMLIQTSVLSSVEAGLCYVSDDGKDVLCDRMPSGETWQVCLKCNKYPLDWCRKAEPVEEDRRNADDPYRSSCVVSFGQPSTASIMTENTTPNMVYRRKKLRKDSNFNLGPTNVQASANIPSVISSAAHLSSAEDQPTGFQVKHAIEIVKDPTMPSVLFDGVTKDSTHKNLGINSVNDSCSSSKPNMETEMDETGECSSSSIIVMDCTREEVTEKDFCMNILRSHGLLKENSPVDNVTSGEDAVTTSNNCCSRSCKICGDLDNSLNMLLCDHCEDAYHLSCYNPRLKKLPIDEWFCHSCLIKRQKILKETVIRSPSIHNELGKCRTAPVKAELNPILLMLRDTKPYTTGVRVGKGFQAEVLDWSGPIKSRIKGFNHLEHFQLLDKGVQQHEFGQEDAFIDLGSICCNEANGLGQRPSIQDKEEWMLGS

SEQ ID NO: 232113 - protein, 130 aa, Glycine max
  Coding DNA Sequence Number=SeqID_115335
  Gene Ontology: Mol. function=isoleucine-tRNA ligase activity; Biological process=tRNA aminoacylation for protein translation
  Homolog annotation: Hit_ID=Q9SV89; Match level="QueryCoverage=71%, HitCoverage=7%, E-value=1e-23, Identity=61%"; Hit description =Isoleucine-tRNA ligase-like protein
MSYSTSCKTPLSNFEAAANKVKVSDPEAFIKLHSASFVAWMTIPLTLPSNLALCVNANFTYVKVPNKYSGKVYIVAESLLSAIHNPRSNPKKLLLTVQKTFLEIQMQRSREPQVKKWKMGWILSKCWRKS

SEQ ID NO: 232114 - protein, 69 aa, Glycine max
  Coding DNA Sequence Number=SeqID_115336
MWTRDTVAPYLSAATTTTPYPTRWGRLHGSTSAIMFYQQWNENIAHLCIRSGAGSKARKGDIKEIYSDE

SEQ ID NO: 232115 - protein, 275 aa, Glycine max
  Coding DNA Sequence Number=SeqID_115337
  Homolog annotation: Hit_ID=Q5XM23; Match level="QueryCoverage=50%, HitCoverage=83%, E-value=3e-13, Identity=42%"; Hit description =Resistance-like protein HAAS-1
  Pfam annotation: Domain name=DUF1014; Domain location=31-258; Score =378.1; E_value=1.4e-110; Accession=PF06244.2; Description=Protein of unknown function (DUF1014)
MDDGGTGRPCRHSVKFERDPKKKKKKKKKKMPKKMGVNTKAEAARARKSAADTERKEKESREKEDQYWREAEGSKSRAAKKKEEEAEKRAEAAARKAEARRLAEQEEKELEKSMKKVDKKATRVSIPVPKVTEVELRRRREEEQAEAERKAEEAKKQQSRTAAEEEYERMVLISNTNRDDSIIEARTLDDAIAQMTVVDNLPPDRHPERRLKASFKAFEEAELPKLKEEKPGLTHTQYKDMIWKLWKKSPDNPLNQVGHTLSLSLFAYKKMTFLS

SEQ ID NO: 232116 - protein, 344 aa, Glycine max
  Coding DNA Sequence Number=SeqID_115338
  Gene Ontology: Mol. function=aminoacyl-tRNA ligase activity; Cellular component=membrane fraction; Biological process=alanyl-tRNA aminoacylation
  Homolog annotation: Hit_ID=Q9FFC7; Match level="QueryCoverage=82%, HitCoverage=29%, E-value=1e-129, Identity=77%"; Hit description =Alanyl-tRNA synthetase
  Pfam annotation: Domain name=tRNA-synt_2c; Domain location=67-342; Score=170.1; E_value=5.6e-48; Accession=PF01411.9; Description=tRNA synthetases class II (A)
  Subcellular localization annotation: CTP_CleavageSite=43; ConfidenceScore=5.38e-01
MEGLALAVPVAQSQLLPFPTAYRFVSLKRHRGRGFRFRTWLCSQAQGVPLPEQVTVPDTENSVTGDSIRQRFLNFYASRGHKVLPSASLVPDDPTVLLTIAGMLQFKPIFLGKVPRQVPCAATAQRCIRTNDIHNVGLTARHQTFFEMLGNFSFGHYFKKQAILWAWELSTAEFGLPPDRLWISVYEDDDEAFQLWSDEVGVPVERIKRLGEEDNFWTSGVTGPCGPCSEIYYDFHPERGYVDADLNDDTRFIEFYNLVFMQYNKKDDSSLEPLKQKNIDTGLGLERMARILQKVPNNYETDLIFPIIEKASKLANVSYGIADDQTKRNLKVNMTIFIQAAVQS

SEQ ID NO: 232117 - protein, 81 aa, Glycine max
  Coding DNA Sequence Number=SeqID_115339
  Homolog annotation: Hit_ID=Q1SI74; Match level="QueryCoverage=41%, HitCoverage=15%, E-value=6e-13, Identity=94%"; Hit description =Ribulose bisphosphate carboxylase, large chain
DVCTAAPGEGERGSVILEILAKGVPVTALLVLVAAAGGGGSRRGIGASNQAVAGGVHGGCCGGGDGSCSRVPKTMRGESEG

SEQ ID NO: 232118 - protein, 89 aa, Glycine max
  Coding DNA Sequence Number=SeqID_115340
MGVEPSYQGVHMINTGTPINMRYSWGMPNWRPQNIGMYSFQPFNGFSGHNSITSQSRNQIKQGRNLDNETVNNDLKQYLNILKTTNGSQ

SEQ ID NO: 232119 - protein, 261 aa, Glycine max
  Coding DNA Sequence Number=SeqID_115341
  Gene Ontology: Mol. function=aminoacyl-tRNA ligase activity; Cellular component=membrane fraction; Biological process=alanyl-tRNA aminoacylation
  Homolog annotation: Hit_ID=Q9FFC7; Match level="QueryCoverage=88%, HitCoverage=24%, E-value=8e-65, Identity=55%"; Hit description =Alanyl-tRNA synthetase
  Pfam annotation: Domain name=tRNA-synt_2c; Domain location=1-226; Score=-265.0; E_value=4.1e-08; Accession=PF01411.9; Description=tRNA synthetases class II (A)
MNKASRIFEELKREELRFVQTLERGEKLLEEKLSDALSSAERNGTVPCLAGEDVFLLYDTYGYPMEITKEVAEERGVSIDMDGFDIEMEKQRRQSQAAHNTVKLDIENGENIAENVPDTEFIGYDNLHCKAMIESLMVNGNPAPQVSEGSNVEVLLNKTPFYAESGGQIGDHGYLYISKGENQPKAVVEILDVQKSFGNIFVHKGTVQKGVVEVGKEVEAAVDVKLRQRAKMNPYIIIVMYISRFQTYKLFKIIIGIVGAL

SEQ ID NO: 232120 - protein, 87 aa, Glycine max
  Coding DNA Sequence Number=SeqID_115342
MACGDEVGGGCRACGPGVVESCSGVTIARKEEVKGTMVDATTVLVGEVVAHPDLAISGSEEGTMICDFQILSLLPLRLQMFCSRWLS

SEQ ID NO: 232121 - protein, 306 aa, Glycine max
  Coding DNA Sequence Number=SeqID_115343
  Gene Ontology: Mol. function=aminoacyl-tRNA ligase activity; Cellular component=membrane fraction; Biological process=alanyl-tRNA aminoacylation
  Homolog annotation: Hit_ID=Q9FFC7; Match level="QueryCoverage=99%, HitCoverage=31%, E-value=1e-116, Identity=72%"; Hit description =Alanyl-tRNA synthetase
  Pfam annotation: Domain name=DHHA1; Domain location=222-295; Score =70.6; E_value=5e-18; Accession=PF02272.9; Description=DHHA1 domain
  Pfam annotation: Domain name=tRNA_SAD; Domain location=73-116; Score =82.6; E_value=1.2e-21; Accession=PF07973.4; Description=Threonyl and Alanyl tRNA synthetase s
  Pfam module annotation: Pfam domain module=DHHA1::tRNA_SAD; Domain location=222-295::73-116
ETSQAGSLVAFDRLRFDFNFHRPLRDSELAEIEVLINGWIEDATQLQTKVMPLVEAKSAGAIAMFGEKYGEEVRVVEVPGVSMELCGGTHVSNTSEIRGFKIISEQGIASGIRRIEAVAGEAFIEYINARDFYLKQLCSTLKVKPEEVTTRIENLLEELRAVRNENSAVHAKAAIYKASVIASKAMLVGNSKQYRVLVECFDDADAESLKSAAEYLLETLTDPAAVVLGSCPGEGKVSLVAAFTPGVVDQGIQAGKFIGQIAKLCGGGGGGRPNFAQAGGRKPENLASALDKARSELIATLCEKGN

SEQ ID NO: 232122 - protein, 61 aa, Glycine max
  Coding DNA Sequence Number=SeqID_115344
MGRVNLELNVRMVVLEVEKWEILRVRKAKFRVSGNWSLKKAWSEQMRKMSDKCERKEPFLK

SEQ ID NO: 232123 - protein, 83 aa, Glycine max
  Coding DNA Sequence Number=SeqID_115345
MGRRQRTNFFVDELRGFGGGNGASVARCQPSPGYCGVLPYACLGAQYFLMKARPVIRVGNPKTLLDFFGSTGCLTGAIPANNR

SEQ ID NO: 232124 - protein, 107 aa, Glycine max
  Coding DNA Sequence Number=SeqID_115346
MESNDSGDLLLHPRMTELPSRSSTSPSNSSSPVREEITSAKDEKSSTQKTITGRIAQIFSKSSDMSSTASRRSIDLDQSEISKVEVSEMKAEDQSSNETFEEAMRKL

SEQ ID NO: 232125 - protein, 194 aa, Glycine max
  Coding DNA Sequence Number=SeqID_115347
  Gene Ontology: Biological process=pollen maturation
  Homolog annotation: Hit_ID=Q5Z6I4; Match level="QueryCoverage=98%, HitCoverage=19%, E-value=2e-58, Identity=52%"; Hit description =Putative Osnop
MALWKVRSLSPEQKVEFVEEQSDSKSLISDESGSFLGLDDASYLMEIFSGGELDRRVMEKLGYLNYSYTPWVSENLDISERAVYYKFEKRISSYKGEVTSTQQRSPLPDGKGWLVEELMNLHGVPLGDYFNIHLRYQIEDLPPKAKGCRVQVLFGMEWLKSSKNQKRLTKNILENLLERFKVTFSLAEKELLPN

SEQ ID NO: 232126 - protein, 744 aa, Glycine max
  Coding DNA Sequence Number=SeqID_115348
  Homolog annotation: Hit_ID=Q1RVN3; Match level="QueryCoverage=48%, HitCoverage=55%, E-value=4e-14, Identity=24%"; Hit description =Nucleotide-binding, alpha-beta plait
  Pfam annotation: Domain name=RRM_1; Domain location=96-166; Score =16.7; E_value=0.0041; Accession=PF00076.12; Description=RNA recognition motif. (a.k.a. RRM, R
IEDIQVIPPTFSSMGSPIIVITLRKGRGVDARHGAKTQDEQGRLSEWTTVVRGRGKQREGERPRVDPKTNYDNNKLGQFQRYHHHNWRDKDDITTFYFTRFHEHITEEDLWAQFKKWGDVRDIFIHKHRNKGGRRYGFVRFKGVLDKYRLEKQLDNIILEGLKMYVNVPKYGRGKARVKECTSKLGILKEGHSREVEAGRHRAVQHRNPQKSYAKVVSTIQTDDGKMKHPKLPQLRYVESHSSVHLQLAVGEKKWFTDAWVGRLKKLQALERIEDDIPWELGVNVVLKYLGDDMVLLLGLADNKAEHIIAEETQHGTSPFHSLERWNPTMRLGHRLVWAQCWDIPIEAWDLGNIRKIAAAIGELVKVDDDVKEMRRMDRARILIRTPNDGRHNFSGRRPSYSSEELDSDGIDGESIISPYSPRYEIRRQPNNPHDDPKAVVDSGGGPRIGTGIPIGRATDPPEANHSDDPGGNPLNVAHVQSISCRGRKASSDGDTVPVATDKPRSPLPKGPTTIENTVDINQGSWVILPNLGNGSRISSERVMEQEDKGKGSETTINNGEINVGEAQKRKQQGEIESLTETVVHPEATIREIAVEDVQFQMRVDHTVVHPEATIREIAVEDVQFQMRVDHVTPSGPSHSQLPPPIETLGPPQHFQSSPSYQVKDHELLTPPIGIQDLQNVEDGPNNGGCKQQMTQKDLTNGKATKSIFLGINPHTESIGTATSKRSKEANSQIPVKSIGADEG

SEQ ID NO: 232127 - protein, 70 aa, Glycine max
  Coding DNA Sequence Number=SeqID_115349
  Subcellular localization annotation: CTP_CleavageSite=40; ConfidenceScore=5.19e-01
MRVLFEPCQSSLSLIFSFFPLRSFYCPASVRLSLWVKRVLAMEKGGKGASLFSKGGREDDPLPIQDRESL

SEQ ID NO: 232128 - protein, 91 aa, Glycine max
  Coding DNA Sequence Number=SeqID_115350
MELGEGDGMRWKVKGEEKRGYGDRKRTEYIQKCHPRQNQRAIRLVYMVELLYLQQIERGKYIRANSSEDKCLGKSGDMKKEDTSVGGIILF

SEQ ID NO: 232129 - protein, 65 aa, Glycine max
  Coding DNA Sequence Number=SeqID_115351
MKYTGELEKIVRKAALIIAVSWLLLVAFIVVSANADNTKIHPPSSKNMVLLVHMEVNDQMWESLL

SEQ ID NO: 232130 - protein, 139 aa, Glycine max
  Coding DNA Sequence Number=SeqID_115352
  Subcellular localization annotation: CTP_CleavageSite=52; ConfidenceScore=5.61e-01
LGSQKGKDDSATKSAKKRMVQFSSDGPSFESGVSSSSLPSQKSGGKDPLTRDCNMPKAVRSIQICILLDAFLSILNFSLISPLAKCGLTDSEICVIGNVCPETIDEVFALLPSLKDKRNIDRQVLKDSLSQLAKFRQSM

SEQ ID NO: 232131 - protein, 149 aa, Glycine max
  Coding DNA Sequence Number=SeqID_115353
  Gene Ontology: Mol. function=phenylalanine-tRNA ligase activity; Biological process=phenylalanyl-tRNA aminoacylation
  Homolog annotation: Hit_ID=Q2L3C2; Match level="QueryCoverage=69%, HitCoverage=53%, E-value=1e-23, Identity=59%"; Hit description=Kh1 protein
MGTRDVDDDDDQDSKLEDKESAKAEKWKKHYSSKHRILLVGEGDFSFSLCLARAFGSGHNLVATSLDSYDNIGKKYSNVLSNAMELQERGCLVFHGVDAKEMSQHFFSRLRGLIALSTTSLMLALYTQRIVSARKERAGFATSCAILRG

SEQ ID NO: 232132 - protein, 39 aa, Glycine max
  Coding DNA Sequence Number=SeqID_115354
  Gene Ontology: Mol. function=hydrolase activity, acting on glycosyl bonds; Cellular component=vacuole; Biological process=polysaccharide catabolic process
  Homolog annotation: Hit_ID=P06215; Match level="QueryCoverage=94%, HitCoverage=11%, E-value=5e-09, Identity=71%"; Hit description =Endochitinase precursor
VIAVFEHLVEAAPGDDAAQITSCRTTTSTLAPLAAIFLL

SEQ ID NO: 232133 - protein, 370 aa, Glycine max
  Coding DNA Sequence Number=SeqID_115355
  Gene Ontology: Mol. function=catalytic activity; Cellular component =cytoplasm; Biological process=folic acid and derivative biosynthetic process
  Homolog annotation: Hit_ID=Q6K2P4; Match level="QueryCoverage=92%, HitCoverage=83%, E-value=1e-108, Identity=56%"; Hit description =Methylenetetrahydrofolate dehydrogenase-like
  Pfam annotation: Domain name=THF_DHG_CYH; Domain location=65-198; Score=170.4; E_value=4.6e-48; Accession=PF00763.13; Description =Tetrahydrofolate dehydrogenasecyclohydrolase, catalytic domain
  Pfam annotation: Domain name=THF_DHG_CYH_C; Domain location=201-367; Score=310.2; E_value=3.7e-90; Accession=PF02882.9; Description =Tetrahydrofolate dehydrogenasecyclohydrolase, NAD(P)-binding domain
  Pfam module annotation: Pfam domain module=THF_DHG_CYH::THF_DHG_CYH _C; Domain location=65-198::201-367
MRGCATDGVVAWHRTLRKAFHSFCSPTSCIFGPNLPDVWVPREHTPPHTLFPESLQWANNGHNALILEGKPIAKQIKLEVADEIRRMKSGIGKFPRLAVVLVGDRRDSHTFIHIKLKACDQVGIETVTSQLPENCDESELLDVVSGFNEDPDVHGILVQLPLPQVDVDTNALVILTYLMQHLDEEKIINVVSPEKDVDGFHPLNIGNLAIRGRKPFFVPCAPKGCIELLLRHGVEIKGKRAVIIGRSKIVGLPTSLLLQRHHATVSVLHAYTKNPEHITSEADIVVVDVGVPNIVRGNWLKKGAVVIDMGTNQVKDPSGHGFCVSGDVCFEEAVKVASAITPVPGGVGPVTISMLLSNTLDSAKRAFGMV

SEQ ID NO: 232134 - protein, 119 aa, Glycine max
  Coding DNA Sequence Number=SeqID_115356
  Homolog annotation: Hit_ID=Q6Z3F9; Match level="QueryCoverage=48%, HitCoverage=15%, E-value=7e-22, Identity=87%"; Hit description =Putative NADPH-dependent reductase
MKNQDEPTTEGESEENNGGVKRKNNTATNFKRKKTPGTFRELKKIIGCTNNNVGVPSITLLVLTSDTVFSVPMAETYSLLGVDSKDIVTLEKYLQDYFTNILKKLKDLKAQSKQTDIIF

SEQ ID NO: 232135 - protein, 344 aa, Glycine max
  Coding DNA Sequence Number=SeqID_115357
  Gene Ontology: Mol. function=kinase activity; Cellular component =integral to membrane
  Homolog annotation: Hit_ID=Q5Z7P9; Match level="QueryCoverage=80%, HitCoverage=51%, E-value=1e-102, Identity=67%"; Hit description=MAP kinase activating protein-like
  Pfam annotation: Domain name=DUF300; Domain location=16-340; Score =401.1; E_value=1.6e-117; Accession=PF03619.7; Description=Domain of unknown function
MNYRSNILIQLFSSPPAWATLIAAAFLLLTLALSMYLLFEHLSAYKNPEEQKFLIGVILMVPCYSFESVSSCSTLHSYDIISILTHFPLSPNPNQFVSLVNPSISVDCEILRDCYESFAMYCFGRYLVACLGGDERTVQFMERQSRLSVKTPLLQHSSSSDKATVNHPFPLNYFLKPWKLGRAFYQVIKFGIVQYMLTKAFTAILAVILEAFGVYCEGEFKVGCGYPYMAVVLNFSQSWALYCLVQFYTVTKDELAHIKPLAKFLTFKSIVFLTWWQGVAIALLSTFGLFKSPIAQGLQFKSSVQDFIICIELTVVRKHFLLTLTMTDSVLGPPWSRMPGEHDL

SEQ ID NO: 232136 - protein, 414 aa, Glycine max
  Coding DNA Sequence Number=SeqID_115358
  Gene Ontology: Mol. function=protein binding; Cellular component =nucleus; Biological process=regulation of progression through cell cycle
  Homolog annotation: Hit_ID=P46277; Match level="QueryCoverage=72%, HitCoverage=70%, E-value=1e-105, Identity=62%"; Hit description =G2/mitotic-specific cyclin-1
  Pfam annotation: Domain name=Cyclin_C; Domain location=291-412; Score= 169.3; E_value=1e-47; Accession=PF02984.9; Description=Cyclin, C -terminal domain
  Pfam annotation: Domain name=Cyclin_N; Domain location=163-289; Score= 232.9; E_value=7.2e-67; Accession=PF00134.13; Description=Cyclin, N -terminal domain
  Pfam module annotation: Pfam domain module=Cyclin_C::Cyclin_N; Domain location=291-412::163-289
MEGSKENCVPRIPLIPSSNLQGLISPFIEEGPRMKPLLHHRLPLGNISQNVNMPHSQVNKLDLSRKCTAHTIQHHFPQETKKQNLLAPNPSCKLDCDIVDIDDDDGDGSDDAVPVFVKHTEAMLDEIDKIEEVEMEDVEEEPVLDIDACDRKDPLAVVEYIDDIYSFYKDIENSSCVSPNYMTSQLDINERMRAILIDWLIEVHYKFELLEETLFLTVNLIDRFLERQAVIRNKLQLVGVTAMLIACKYEEVTVPTVEDFILITDKAYTRNEVLDMEKLMMNILQFKLSMPTPYMFMRRFLKAAHSDKKLELLSFFLVELCLVECKMLKFSPSLLAAAAIYTAQCSLYQFKQWTKTTEWYTDYSEEKLLECSRLMVTFHQKAGSGKLTGVYRKYNTWKYGCAAKIEPALFLLDN

SEQ ID NO: 232137 - protein, 441 aa, Glycine max
  Coding DNA Sequence Number=SeqID_115359
  Homolog annotation: Hit_ID=Q9M670; Match level="QueryCoverage=69%, HitCoverage=78%, E-value=3e-09, Identity=23%"; Hit description=Small heat shock-like protein
  Pfam annotation: Domain name=HSP20; Domain location=15-111; Score= -17.6; E_value=0.025; Accession=PF00011.11; Description=Hsp20alpha crystallin family
MATTQSYEDLEAKYETEETSESVILVVHMPDGFAREHIGAKIEYDFGRVRVHGERSLGNNRRARFNALYQVPEYCDINKIKGKFDGKTVIITIPTIPGKVPKKETQPTEQEPPKEPSQEAESNPEEEKEGTPPSDDNQESKEETGHVTSTSNPPNASQEESMDQKGQEGIPQKATLNKVESEKHVGQEASSTSTPPKDTQESKAQKGQEGIPTQVAHEASLTSTPPQDTQESMPQKGQEGIPSKDTITKVDSKSQVGHEGSTSTPSQDPQESIPQKGQEAIPPNATPTTNAKLQGEEKFEGEIDENVEKQKVLGKEETKDHSEKPLESGKPPKKAVVDDSPKKEGKEESKGLAAFEGEKGREINGKIGNDVVGRKSDKKAKPDSTTRATIKEVVASASQAMTSLAKKFNEEDKQRIAYMGTAVLVVALGVYATYKLRSRVP

SEQ ID NO: 232138 - protein, 200 aa, Glycine max
  Coding DNA Sequence Number=SeqID_115360
  Pfam annotation: Domain name=efhand; Domain location=6-34; Score=5.7; E_value=3.4; Accession=PF00036.22; Description=EF hand
  Pfam annotation: Domain name=efhand; Domain location=68-96; Score =25.4; E_value=0.00021; Accession=PF00036.22; Description=EF hand
  Pfam module annotation: Pfam domain module=efhand::efhand; Domain location=6-34::68-96
MENRVILQEWFDRVDSEKSGSITAVQLKVRWVVWFELLVVIICGDLIVYSYSYQTALAVGNLEFPLSVVQQMIRMYDFDRNGTMSFQEFVALNNFLLKVQHAFSDLERGRGFLVPDDVFEVLCWYIGGCSPLTLVPLQDLFFPFPGYENITDESCHDPLLDHDQLIDYNFLSLVNLRVPHSQSQLKDRPKGVIKNQQSFP

SEQ ID NO: 232139 - protein, 48 aa, Glycine max
  Coding DNA Sequence Number=SeqID_115361
MEKKREGLRDGGFGKNWFHAGFSCFLLCLRGTYLIHLIQLNKAELLSI

SEQ ID NO: 232140 - protein, 144 aa, Glycine max
  Coding DNA Sequence Number=SeqID_115362
  Gene Ontology: Mol. function=ATP binding; Cellular component=signal recognition particle, endoplasmic reticulum targeting; Biological process=defense response
  Homolog annotation: Hit_ID=Q2L361; Match level="QueryCoverage=75%, HitCoverage=11%, E-value=1e-15, Identity=40%"; Hit description =Putative CC-NBS-LRR resistance protein
MPSYLKHCFAYSSLFPTDFGFAGAQISSLWAGLGLLRSPVGSRQVEHIAAQYIDELHSRSFLEDFEDFGHIYYFKLHDLVHDLALYVAKEDLLVVNLRTCNIPEQARHLSVVENDSLNHALFPRSRSVRTILSCLEFKSLPQTF

SEQ ID NO: 232141 - protein, 372 aa, Glycine max
  Coding DNA Sequence Number=SeqID_115363
  Gene Ontology: Mol. function=protein binding; Cellular component =membrane; Biological process=defense response
  Homolog annotation: Hit_ID=Q2QR00; Match level="QueryCoverage=82%, HitCoverage=42%, E-value=1e-23, Identity=27%"; Hit description=NB -ARC domain containing protein, expressed
  Pfam annotation: Domain name=LRR_1; Domain location=246-267; Score =8.0; E_value=9.1; Accession=PF00560.23; Description=Leucine Rich Repeat
  Pfam annotation: Domain name=LRR_1; Domain location=292-321; Score =1.6; E_value=1.4e+02; Accession=PF00560.23; Description=Leucine Rich Repeat
  Pfam annotation: Domain name=LRR_1; Domain location=323-345; Score =2.4; E_value=1e+02; Accession=PF00560.23; Description=Leucine Rich Repeat
  Pfam annotation: Domain name=LRR_1; Domain location=347-369; Score =4.6; E_value=40; Accession=PF00560.23; Description=Leucine Rich Repeat
  Pfam module annotation: Pfam domain module=LRR_1::LRR_1::LRR_1::LRR _1; Domain location=246-267::292-321::323-345::347-369
MWVCISDYFDKRQIIIKIISSALASAPTSALANQENVNSLDIKQLQIYLRHKLSGQKYLLEMDAIWNDDSAKWIELKDLIKVGGMGSKILLSYDQMPSYLKHYFAYSSLFPKDFGFAGAQISSLWAGLGLLRSPVGSRQVEHIAAQYIDELHTRSFLEDFEDFGHIYYFKLHDLALYVAKEDLLVVNLRTCNIPEQARHLSVVENDSLNHALFPRSRSVRTILFPIDGMGVGSEALLDAWITRYIYLRLLELGYVQLETLPKGLGMLISHQHLHLTTKQSILSEEDFASLSNVHTLTFEYCDNLKHCPRQQTLPQWILGAADTLQTLLIINSHSLKMVPEWLTTMTHLKMLHIVNCSLLLCLPSDMHHLIAL

SEQ ID NO: 232142 - protein, 677 aa, Glycine max
  Coding DNA Sequence Number=SeqID_115364
  Gene Ontology: Mol. function=sugar binding; Cellular component =histone methyltransferase complex; Biological process=histone H3-K4 methylation
  Homolog annotation: Hit_ID=Q9LJC6; Match level="QueryCoverage=74%, HitCoverage=91%, E-value=0.0, Identity=66%"; Hit description =Retinoblastoma-binding protein-like
  Pfam annotation: Domain name=Prefoldin_2; Domain location=14-119; Score=109.3; E_value=1.1e-29; Accession=PF01920.10; Description =Prefoldin subunit
  Pfam annotation: Domain name=WD40; Domain location=150-187; Score =28.1; E_value=3.1e-05; Accession=PF00400.22; Description=WD domain, G-beta repeat
  Pfam annotation: Domain name=WD40; Domain location=194-231; Score =22.2; E_value=0.0019; Accession=PF00400.22; Description=WD domain, G- beta repeat
  Pfam annotation: Domain name=WD40; Domain location=343-380; Score =15.1; E_value=0.25; Accession=PF00400.22; Description=WD domain, G -beta repeat
  Pfam annotation: Domain name=WD40; Domain location=462-500; Score =22.9; E_value=0.0012; Accession=PF00400.22; Description=WD domain, G- beta repeat
  Pfam module annotation: Pfam domain module=Prefoldin_2::WD40::WD40::WD 40::WD40; Domain location=14-119::150-187::194-231::343-380::462-500
MAKAEGGKEPINEQAVANMYAAMRSELNQIYSKITELEMEVSEHTLVTNAIQPLDQSRRCYRMIGGVLVERTIKEVLPAVQRNKEGLEEVVARLNEALEKKKKEISEFEAKYKIRIRKADAEVKDESGRKEGSAQGVLVGPADPLQGDFPEVIEEYLEHGCMKCIAFNRRGTLLAAGCNDGSCVIWDFETRGIAKILRDDECSSPITSICWSKYGHRILVSAADKSLLLWDVMSGKKITRIVLQQTPLQARLHPGSSTPSLCLACPLSCAPMIVDLNTGDTTLLKVSVSETCNGPTPPSRNKCSDGITSFTPTAACFNKYGTLVYVGNSKGEILVIDYKNGDVRAVVPISGGSVVKNIVFSRNGQYLLTNSNDRIIRIYENLLPLKDEVRALDDLSGSHNDLNNIENLKAVGSKCLTLFREFQDSITKVHWKAPCFSGDGEWVVGGSASKGEHKIYIWDRAGHLVKILEGPKEALIDLAWHPVHPIVVSVSLNGLVYIWAKDYTENWSAFAPDFKELEENEEYVEREDEFDLIPETEKVKGPDVDEDEEVDIVTVEKDATFSDSDMSQEELCYLPSTPSHDVPEQQEKCVESSSKLLDSNNTGSPLSEEAGPNGHMMNHASSPLEDDAGRMKRKRKPSEKVLELQAEKVKKPSKSSKSEKPKSKSLADQDNGNGFHG

SEQ ID NO: 232143 - protein, 129 aa, Glycine max
  Coding DNA Sequence Number=SeqID_115365
MEGALEEKMHVKIAHNIVAQSVENAKEEKVKAADDSFSEAYPLSEMHPFSETSCPLSGWETLEEEKSEICALSTQPARPTRMLFLLALSAPTLVKRKFTNSRLASHARYASLQKFNSPRAFKTLRLTEF

SEQ ID NO: 232144 - protein, 785 aa, Glycine max
  Coding DNA Sequence Number=SeqID_115366
  Gene Ontology: Mol. function=DNA binding; Biological process =regulation of transcription
  Homolog annotation: Hit_ID=Q9S7B1; Match level="QueryCoverage=99%, HitCoverage=100%, E-value=0.0, Identity=53%"; Hit description=Nodule inception protein
  Pfam annotation: Domain name=PB1; Domain location=687-770; Score =93.3; E_value=7.2e-25; Accession=PF00564.15; Description=PB1 domain
  Pfam annotation: Domain name=RWP-RK; Domain location=515-566; Score =100.2; E_value=6.3e-27; Accession=PF02042.6; Description=RWP-RK domain
  Pfam module annotation: Pfam domain module=PB1::RWP-RK; Domain location=687-770::515-566
MEYGGLVQNSAYGSFSEIFGPETDFIDELFVEGCWVETRVGSYLNCGGEANSSKPNTMASMETSAQIIFQEESLSDPEISLMVGKRWWIGPRENPGPSSSVKERLVIAVGYLKEYAKNSNLLIQVWVPERRRSARAQPQDNYPYAALLNTTSAFQFQEDWVHDQWTPNIRFFRSHEYPRHLRRPGSLALPVFESGSAMCLGVVEILMPNNPDLHALQSVDFTSSTCHQNFIPPAAVTAKGFDELYQSALNEIVEVLTCVCKAHNLPLALTWAPCIQQGKSGCGHSNDENYVSIVDPASFVADVEVLGFLEACSECHLLGGQGVVGTAFTTTKPCFANDITAFSKAEYPLAHHANMFGLHAAVAIPLLSDSADFVLEFFLPKDCHDTQEQKQMLNSLSMLVQQACRSLHVVMGKEEEEEEEEEELIALPPVGKEMESSSSSSWIAHMMEAQQKGKGVSVSLEYLQEPKQEFRVTTNCNEQVSVGVESGGGEESYTAAFGGRRGARKSAGDKRRTKAEKTISLPVLRQYFAGSLKDAAKSIGVCPTTLKRICRQHGITRWPSRKIKKVGHSLRKLQLVIDSVQGAEGAIQIGSFYTSFPELSSANGVSESSNINNKFFSEYNQGATTFKSPTSPCSQTTILISENQQPLVLGASIQVQEEAKHFAHHLEPLPPAPLPQSSTSLWNTAGTFRVKATFGDEKIRFSLQPNWGFRDLQMEIARRFNLNEISNIQLKYLDDAREWVLLTCDADLDECKDINTSSQSRTIRLFLFQASPLNHANAFRGTSPS

SEQ ID NO: 232145 - protein, 105 aa, Glycine max
  Coding DNA Sequence Number=SeqID_115367
MLRHAAATTTDRVELMRFFCKPNETKLNLAKEKSLEEEEHRSNKQSTSSDAIKGGGGNKRKSMKIVKTVKVNRDPGERDVGGIKKSVGFHLTFVLQQSLSQSPRV

SEQ ID NO: 232146 - protein, 130 aa, Glycine max
  Coding DNA Sequence Number=SeqID_115368
  Gene Ontology: Mol. function=protein serine/threonine kinase activity; Cellular component=integral to membrane; Biological process=protein amino acid phosphorylation
  Homolog annotation: Hit_ID=Q8GSN9; Match level="QueryCoverage=100%, HitCoverage=28%, E-value=4e-57, Identity=69%"; Hit description=LRR receptor-like kinase
  Pfam annotation: Domain name=LRRNT_2; Domain location=6-51; Score =42.0; E_value=2.1e-09; Accession=PF08263.3; Description=Leucine rich repeat N-terminal domain
  Pfam annotation: Domain name=LRR_1; Domain location=103-126; Score =12.1; E_value=1.6; Accession=PF00560.23; Description=Leucine Rich Repeat
  Pfam annotation: Domain name=LRR_1; Domain location=55-77; Score=2.5; E_value=98; Accession=PF00560.23; Description=Leucine Rich Repeat
  Pfam annotation: Domain name=LRR_1; Domain location=79-101; Score =13.5; E_value=0.8; Accession=PF00560.23; Description=Leucine Rich Repeat
  Pfam module annotation: Pfam domain module=LRRNT_2::LRR_1::LRR_1::LRR_ 1; Domain location=6-51::103-126::55-77::79-101
MATCSSFSDMDALLKLKESMKGDEAKDDALHDWKFSTSHSAHCFFSGVTCDQDLRVVAINVSFVPLFGHIPPEIGNLDKLENLTIVNNNLTGVLPMELAALTSLKHLNISHNLFTGDFPGQATLPMTELQ

SEQ ID NO: 232147 - protein, 517 aa, Glycine max
  Coding DNA Sequence Number=SeqID_115369
  Gene Ontology: Mol. function=protein binding; Cellular component =clathrin vesicle coat; Biological process=ER to Golgi vesicle -mediated transport
  Homolog annotation: Hit_ID=Q93Y22; Match level="QueryCoverage=97%, HitCoverage=99%, E-value=0.0, Identity=67%"; Hit description =Coatomer delta subunit
  Pfam annotation: Domain name=Adap_comp_sub; Domain location=261-507; Score=148.6; E_value=1.7e-41; Accession=PF00928.11; Description =Adaptor complexes medium subunit family
MKKKNSLGSENVVLAASIVSKSGKVLVSRQFVDMSRIRIEGLLAAFPKLIGTGKQHTYVETENVRYVYQPMEALYLLLVPEYSYSLDEEDICQNAFELIFAFDEVISLGHAENVSVAQVKQYCEMESHEEKLHKLVMQSKINDTKDVMKRKANEIDKSKIEKNRGDKGGFGPLQSLGSGKIENSFSDLSITSSGPGFGSGSGFGLSSDVGSFSTKSKGGPTSSATAPPKGLGMKLGKSQRTNQFLESLKAEGEVILEHVQPKLAQAAAPPSTDPISLAVEEKLNVTLKRDGGVSNFDVQGTLSLQILDKEDGHIQVQVQTGENQAIIFKTHPNMNKELFANENVLGLKDPNRPFPTGQAGGSEGVGLLKWRMQSTDESMVPLTINCWPSSSGNETYVSIEYEASSLFDLRNVVISVPLPALRDAPSVRQIDGEWRYDSRNSFLEWSVLLIDNSNRSGSMEFVVPQAESSAFFPISVRFIATETFSDLKVTSIIPLNGGNPPKYSQRTQLITENYQIV

SEQ ID NO: 232148 - protein, 272 aa, Glycine max
  Coding DNA Sequence Number=SeqID_115370
  Gene Ontology: Mol. function=hydrogen ion transporting ATP synthase activity, rotational mechanism; Cellular component=proton -transporting two-sector ATPase complex; Biological process=ATP synthesis coupled proton transport
  Homolog annotation: Hit_ID=Q9C9Z8; Match level="QueryCoverage=67%, HitCoverage=80%, E-value=3e-55, Identity=59%"; Hit description =Putative vacuolar ATP synthase subunit E; 11053-12830
  Pfam annotation: Domain name=vATP-synt_E; Domain location=16-211; Score=156.1; E_value=9e-44; Accession=PF01991.8; Description=ATP synthase (E31 kDa) subunit
MKDADVSRQIQQMIRFIRQEAEEKANEISEFNIEKLQLLEAEKRKIRQEYERKAKQIDVRRKIEYSTQLNAARIKVLQAQDDAMGSMKDAAKKGLLRVSNDKKVYKKLLKDMIVQGLLRLREPSVLLRCRESDRKLVESLIEEAKKEYSEKASMQSPKISLDDRVYLPPPPKNGAVDSHEPYCHANRKRHWRVQAGVTRGTGLVSVTGDLSSMGLASLTGELSLVSLLSSMQLELKIYFINLLIKCTSAGMAIRGGDHVTCLCREHCNPMEL

SEQ ID NO: 232149 - protein, 816 aa, Glycine max
  Coding DNA Sequence Number=SeqID_115371
  Gene Ontology: Mol. function=binding; Cellular component=ubiquitin ligase complex; Biological process=protein ubiquitination
  Homolog annotation: Hit_ID=Q8GSZ9; Match level="QueryCoverage=79%, HitCoverage=98%, E-value=1e-167, Identity=50%"; Hit description =Armadillo repeat-containing protein-like
  Pfam annotation: Domain name=Arm; Domain location=240-279; Score=1.4; E_value=8; Accession=PF00514.13; Description=Armadillobeta-catenin -like repeat
  Pfam annotation: Domain name=Arm; Domain location=351-391; Score =28.0; E_value=3.4e-05; Accession=PF00514.13; Description =Armadillobeta-catenin-like repeat
  Pfam annotation: Domain name=Arm; Domain location=392-435; Score=4.9; E_value=3; Accession=PF00514.13; Description=Armadillobeta-catenin -like repeat
  Pfam annotation: Domain name=Arm; Domain location=477-517; Score=5.1; E_value=2.8; Accession=PF00514.13; Description=Armadillobeta-catenin -like repeat
  Pfam annotation: Domain name=Arm; Domain location=562-605; Score=1.4; E_value=8.1; Accession=PF00514.13; Description=Armadillobeta-catenin -like repeat
  Pfam annotation: Domain name=Arm; Domain location=610-652; Score =22.1; E_value=0.002; Accession=PF00514.13; Description=Armadillobeta- catenin-like repeat
  Pfam annotation: Domain name=Arm; Domain location=684-724; Score =17.5; E_value=0.047; Accession=PF00514.13; Description=Armadillobeta- catenin-like repeat
  Pfam annotation: Domain name=Arm; Domain location=728-768; Score =11.3; E_value=0.47; Accession=PF00514.13; Description=Armadillobeta -catenin-like repeat
  Pfam annotation: Domain name=HEAT; Domain location=361-393; Score =1.2; E_value=30; Accession=PF02985.12; Description=HEAT repeat
  Pfam annotation: Domain name=HEAT; Domain location=483-519; Score =9.8; E_value=2.7; Accession=PF02985.12; Description=HEAT repeat
  Pfam annotation: Domain name=HEAT; Domain location=618-654; Score =14.5; E_value=0.39; Accession=PF02985.12; Description=HEAT repeat
  Pfam annotation: Domain name=HEAT; Domain location=694-726; Score =11.3; E_value=1.8; Accession=PF02985.12; Description=HEAT repeat
  Pfam module annotation: Pfam domain module=Arm::Arm::Arm::Arm::Arm::Ar m::Arm::Arm::HEAT::HEAT::HEAT::HEAT; Domain location=240-279::351 -391::392-435::477-517::562-605::610-652::684-724::728-768::361 -393::483-519::618-654::694-726
MKEKRDFSEFLSELIVLADEVALFSKNPEIDIEDAFTEFAMLVEKFAPIFNDLRDKCTIIDKPAIRKSLESLMNELTRAKALIRSSSLKERNKRIEDIAHDLGRSLGMLLVASLEVSIDFREKIGTLQKQLMNARFGGNMSPTSSSISRFVNEAKEGGEIEEEIIDVTSDDVLLQLKNGDAEEFAVALLRLKKFIRGGKLDSGLINVEAAVSILFNRPFSSKAGNRLTIIQLLRSIAMRNDEMKEKMTNIELLSAVVKSLTRDTEERREAVGLLLELSALPAVRRKIGRIQGCIVMLVSILNGVDPVSSRDAAKLLDILSNNTQNALLMAEAGCDMTKILMATTLSRLVLTDHSKLTLGQDGAIEPLVRMFNSGKLESKLSALNALQNLSSLTENVRRLIGTGIVGSLLQLLFSVTSVLMTLREPASAILARIAESETVLVNLGVAQQILSLLNLSSPVIQGHLLEALNSIASLPCASKERRKMKEKGALQLILPLLKETKMKIRSKALNLLYTLSEDLTDESTAHFDETHLFYIVNIVLSSTSDSEKAAAVGILSNLPVSDKKVTDALKRANLLPILVSIMDLGTGSNSPAKSILMESIAGIAIRFTSSSDKKLQLLSAKHGVIALLVKLLSSGSAITKLKAATALGQLSQNSPSLRRSRKSRWLCVAPSVDAYCEVHDGYCFVSSTFCLIKAGAVSPLIQILEDKDWEAVEAALNALSTLLQDEIWEGGANCIAKLSGVQAIVNVLEAGDVKVQEKALWMLERIFRVEEHRMKYGELAQVVLIEMAQRSDSTLKSTVAKVLAVLELLLVQSSYF

SEQ ID NO: 232150 - protein, 143 aa, Glycine max
  Coding DNA Sequence Number=SeqID_115372
  Gene Ontology: Mol. function=electron transporter, transferring electrons within the cyclic electron transport pathway of photosynthesis activity; Cellular component=light-harvesting complex; Biological process=...
  Gene Ontology: Biological process=photosynthetic electron transport in photosystem II
  Homolog annotation: Hit_ID=Q8HT11; Match level="QueryCoverage=68%, HitCoverage=24%, E-value=4e-52, Identity=98%"; Hit description =Photosystem II CP43 protein
MQERKIVFIFQTLIKHHNNILSWLVTSNSKPPNPRTETTGFAWWAGNARLINLSGKLLGAHVAHAGLIVFWAGAMNLFEMAHFVPEKPMYEQGLILLPHLATLGWGVGPGGEVIDTFPYFVSGVLHLISSAVLGIIKSKFPSK

SEQ ID NO: 232151 - protein, 446 aa, Glycine max
  Coding DNA Sequence Number=SeqID_115373
  Gene Ontology: Mol. function=protein serine/threonine kinase activity; Cellular component=integral to membrane; Biological process=protein amino acid phosphorylation
  Homolog annotation: Hit_ID=Q8GSN9; Match level="QueryCoverage=97%, HitCoverage=54%, E-value=0.0, Identity=56%"; Hit description=LRR receptor-like kinase
  Pfam annotation: Domain name=LRR_1; Domain location=111-133; Score =8.6; E_value=6.9; Accession=PF00560.23; Description=Leucine Rich Repeat
  Pfam annotation: Domain name=LRR_1; Domain location=135-157; Score =6.7; E_value=16; Accession=PF00560.23; Description=Leucine Rich Repeat
  Pfam annotation: Domain name=LRR_1; Domain location=14-37; Score=4.0; E_value=50; Accession=PF00560.23; Description=Leucine Rich Repeat
  Pfam annotation: Domain name=LRR_1; Domain location=159-181; Score =7.1; E_value=14; Accession=PF00560.23; Description=Leucine Rich Repeat
  Pfam annotation: Domain name=LRR_1; Domain location=183-205; Score =6.0; E_value=21; Accession=PF00560.23; Description=Leucine Rich Repeat
  Pfam annotation: Domain name=LRR_1; Domain location=207-229; Score =9.6; E_value=4.6; Accession=PF00560.23; Description=Leucine Rich Repeat
  Pfam annotation: Domain name=LRR_1; Domain location=231-253; Score =6.3; E_value=19; Accession=PF00560.23; Description=Leucine Rich Repeat
  Pfam annotation: Domain name=LRR_1; Domain location=254-276; Score =13.2; E_value=0.94; Accession=PF00560.23; Description=Leucine Rich Repeat
  Pfam annotation: Domain name=LRR_1; Domain location=278-300; Score =5.8; E_value=24; Accession=PF00560.23; Description=Leucine Rich Repeat
  Pfam annotation: Domain name=LRR_1; Domain location=302-324; Score =12.7; E_value=1.2; Accession=PF00560.23; Description=Leucine Rich Repeat
  Pfam annotation: Domain name=LRR_1; Domain location=326-348; Score =10.4; E_value=3.2; Accession=PF00560.23; Description=Leucine Rich Repeat
  Pfam annotation: Domain name=LRR_1; Domain location=350-372; Score =6.6; E_value=17; Accession=PF00560.23; Description=Leucine Rich Repeat
  Pfam annotation: Domain name=LRR_1; Domain location=374-396; Score =15.9; E_value=0.15; Accession=PF00560.23; Description=Leucine Rich Repeat
  Pfam annotation: Domain name=LRR_1; Domain location=39-61; Score =20.9; E_value=0.0045; Accession=PF00560.23; Description=Leucine Rich Repeat
  Pfam annotation: Domain name=LRR_1; Domain location=63-85; Score =10.4; E_value=3.2; Accession=PF00560.23; Description=Leucine Rich Repeat
  Pfam annotation: Domain name=LRR_1; Domain location=87-109; Score =15.2; E_value=0.24; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::LRR _1::LRR_1::LRR_1::LRR_1; Domain location=111-133::135-157::14-37::159- 181::183-205::...
  Pfam module annotation: Domain location=207-229::231-253::254 -276::278-300::302-324::326-348::350-372::374-396::39-61::63-85::87 -109
LSGRIPKSLSKLKTLRILKLGYSNAYEGGIPPEFGTMESLRFLDLSSCNLSGEIPPSLANLTNLDTLFLQMNFLTGSIPSELSSLVRLMALDLSCNSLTGEIPESFSQLRNLTLMNLFRNNLHGPIPSLLSELPNLNTLQLWENNFSSELPQNLGQNGRLKFFDVTKNHFSGLIPRDLCKSGRLQIFIITDNFFHGPIPNEIANCKSLTKIRASNNYLNGAVPSGIFKLPSVTIIELANNRFNGELPPEISGDSLGILTLSNNLFTGKIPPALKNLRALQTLSLDTNEFLGEIPGEVFDLPMLTVVNISGNNLTGPIPTTFTRCVSLAAVDLSRNMLVEDIPKGIKNLTVLSFFNVSRNHLTGPVPDEIKFMTSLTTLDLSYNNFTGKVPNEGQFLVFNDNSFAGNPNLCSIHGCTLSIVGAAAPINILTFVNIVCTIIVIYKLLV

SEQ ID NO: 232152 - protein, 125 aa, Glycine max
  Coding DNA Sequence Number=SeqID_115374
  Gene Ontology: Mol. function=nucleic acid binding; Biological process= regulation of transcription, DNA-dependent
  Homolog annotation: Hit_ID=Q0ZCB8; Match level="QueryCoverage=61%, HitCoverage=11%, E-value=8e-18, Identity=57%"; Hit description =Integrase
EIEHKAYWAVKTYNFSIDQAGEERKFQESELDEIRLEAYEISNFSKEKPKNFHDSLIVKKDLGVGQKVLLYNFRLGFMSVGIKRESIDKSFKVNGYWLKPFLTNPSLGDVVGGEPSLLPLIFFPP

SEQ ID NO: 232153 - protein, 184 aa, Glycine max
  Coding DNA Sequence Number=SeqID_115375
  Homolog annotation: Hit_ID=Q1SBG7; Match level="QueryCoverage=48%, HitCoverage=40%, E-value=5e-16, Identity=48%"; Hit description=Heavy metal-associated domain, putative
  Pfam annotation: Domain name=HMA; Domain location=5-69; Score=41.0; E_ value=4.1e-09; Accession=PF00403.16; Description=Heavy-metal -associated domain
MKQKIVMKVHMNCQKCRTKALKVVAAASGVNFVGLEGEEKDKLVVIGDEVDPVKLTNSLRKKVGHTDIISLAEVKASVNSVNIEGESKDRVVVIGEDVDAANLTSCMRKKVGHTELVTVVELKALLKSFRSIIACKNAAFGLLRLEVREIKILVVKELMVSDQFSDDDTHHMNIYLERIKVLEQ

SEQ ID NO: 232154 - protein, 110 aa, Glycine max
  Coding DNA Sequence Number=SeqID_115376
MAGSDEGMQDLENNVSSTITTHSTSNESTTTNQEKGKEIDTTTANPENNIGVFSGVIDTEEVRGMMVSDPFIKQTVESFLKYSEPENKEDSQNDANQGSTIAPAKHTKTP

SEQ ID NO: 232155 - protein, 164 aa, Glycine max
  Coding DNA Sequence Number=SeqID_115377
  Gene Ontology: Mol. function=helicase activity
  Homolog annotation: Hit_ID=Q9LTU4; Match level="QueryCoverage=100%, HitCoverage=11%, E-value=7e-57, Identity=60%"; Hit description =Helicase-like protein
MYTVEFQKRGLPHVHLLLFLHANNKYPSPNDIDNIISAEIPSQKDDPELYKLVQNHMIHGPCEILRPASPCRKEGKCSRFYPKKFQPTTLIDGDGYPVYRRRNTGQTITKNGIIIDNRCIVPYNPRLLKKYQAHINIEWCNQSTSIKYLFKYINKGYDRVTAVM

SEQ ID NO: 232156 - protein, 184 aa, Glycine max
  Coding DNA Sequence Number=SeqID_115378
  Gene Ontology: Mol. function=hydrolase activity
  Homolog annotation: Hit_ID=Q0VNC3; Match level="QueryCoverage=58%, HitCoverage=86%, E-value=8e-18, Identity=35%"; Hit description=Ham1 family protein
KGGKAIQRQAAHRDFVFQFAHFSECLVAEDGFGGHARAVQPIHQFGKAFRVQPAPEDARQSGGQAIEPIQIQTGFSQFVTNQLHLIFGLNLFNTARNGHHFDTHRLKDVQPGDAYPAAVPAVIVRHAVAAPRGHSTLRRRHWRGTIGSRCARLRRYSASLIAGGVKYCALNVLIALFDAAYVKY

SEQ ID NO: 232157 - protein, 64 aa, Glycine max
  Coding DNA Sequence Number=SeqID_115379
MYQSHTVRGEKVASAQGKDYGELGFWLKACRTAGHDTCLDLASGSGIKGMSPHYSHDTHATNDD

SEQ ID NO: 232158 - protein, 107 aa, Glycine max
  Coding DNA Sequence Number=SeqID_115380
  Subcellular localization annotation: CTP_CleavageSite=45; ConfidenceScore=5.65e-01
MSPSTMPPPSNPSSPKKLTSPCGLSPTPILPPADFSQRDAVGDKLSMNVMSKTLWWQRRCGPSRQGSIGGDVCLGSVGDSGLWLARRMERGSCAMDSLSKPQIVPES

SEQ ID NO: 232159 - protein, 165 aa, Glycine max
  Coding DNA Sequence Number=SeqID_115381
  Gene Ontology: Mol. function=RNA polymerase II transcription factor activity; Cellular component=nucleus; Biological process =transcription from RNA polymerase II promoter
  Homolog annotation: Hit_ID=Q70I32; Match level="QueryCoverage=92%, HitCoverage=87%, E-value=2e-64, Identity=86%"; Hit description =Transcription factor homolog BTF3-like protein
  Pfam annotation: Domain name=NAC; Domain location=37-95; Score=109.6; E_value=9e-30; Accession=PF01849.8; Description=NAC domain
  Subcellular localization annotation: CTP_CleavageSite=24; ConfidenceScore=5.08e-01
MAGSVRTGGKGTVRSSLNVLSYARSRKKKAVHKTTTTDDKRLQSTLKRIGVNAIPAIEEVNIFKDDVVIQFLNPKVQASIAANTWVVSGSPQTKKLQDILPSIIHQLGPDNLENLKKLAEQFQKQAPEGATGSTTAQEENDDDDVPELVPGQDFETAAEETKAAS

SEQ ID NO: 232160 - protein, 97 aa, Glycine max
  Coding DNA Sequence Number=SeqID_115382
MMVTVHIATITRGHLPPLLSCTLLNLTISKVGVMDLIGAHSIAARNDGVAAVGKLPRLEGFYQFDDEEDSPVADMLMPESHVEELKDEASFGDDDGV

SEQ ID NO: 232161 - protein, 121 aa, Glycine max
  Coding DNA Sequence Number=SeqID_115383
MAAPWWKSYWLPYKGSGIVDFSWHAMAAAIRVVLMVSRTAMAEDDLVGSLWQNLWFEAPHDHSLEVVLQFHLRLVHEENELALVIAIFTIGDNKAIAKVKPVLLNGGHGGAMAVFRKNATE

SEQ ID NO: 232162 - protein, 77 aa, Glycine max
  Coding DNA Sequence Number=SeqID_115384
  Subcellular localization annotation: CTP_CleavageSite=35; ConfidenceScore=5.11e-01
MGLLKLRLLRENFSLQAAVPDRCVAAGARRCRLCRCVAAGGRRGCVRVRLRVSRLGARVGCGRDAAGAGEARGWVLS

SEQ ID NO: 232163 - protein, 258 aa, Glycine max
  Coding DNA Sequence Number=SeqID_115385
  Gene Ontology: Mol. function=metabotropic glutamate, GABA-B-like receptor activity; Cellular component=membrane; Biological process =ion transport
  Homolog annotation: Hit_ID=Q1T013; Match level="QueryCoverage=56%, HitCoverage=20%, E-value=3e-41, Identity=59%"; Hit description =Ionotropic glutamate receptor; Extracellular ligand-binding receptor
MIEAESPSFYQVTMRSKALNLVHVLDSAAAATTTAPVVVSPMRLWIHEIQQKSLMDGFSQITGVQYKFIMFGDGHKNPSYCDLVNMITSNVFDAAVGDIAIVSLRTKIVDFTRPYIESGLVVVAPVKKIEVKCLGFLATIYSTYVGCHCFFFLFVGAVVWILEHRTNDEFRGLPREHIVTVLCFSLSTMLFAHKKTHLVHLVELCPSMSCIYILTSLTCISPPKVTDMLNWATFVVDPPLRRSTDTTLTLDVFSMQFP

SEQ ID NO: 232164 - protein, 52 aa, Glycine max
  Coding DNA Sequence Number=SeqID_115386
MAADILESNKLFLYLKNRQEEQESKAAEGVKIGMAGMFGCSCRWQWAEAKSM

SEQ ID NO: 232165 - protein, 130 aa, Glycine max
  Coding DNA Sequence Number=SeqID_115387
MEITKSLVSNNNNKKNKCTPSRLVGPDGVGLLVLPRKVELKDDSSLLVATYQPLPAAFTKQSSYYTKANSFYITCSKLKYSNQNWRNNVGLGWKRMKERLRDRKMQRVQRPTKHEQVFGCWKIERAKCRE

SEQ ID NO: 232166 - protein, 607 aa, Glycine max
  Coding DNA Sequence Number=SeqID_115388
  Gene Ontology: Mol. function=sugar porter activity; Cellular component=integral to membrane; Biological process=carbohydrate transport
  Homolog annotation: Hit_ID=Q1T5Y7; Match level="QueryCoverage=96%, HitCoverage=79%, E-value=0.0, Identity=79%"; Hit description=Sugar transporter superfamily; Major facilitator superfamily MFS_1
  Pfam annotation: Domain name=MFS_1; Domain location=11-603; Score =49.1; E_value=1.5e-11; Accession=PF07690.6; Description=Major Facilitator Superfamily
  Pfam annotation: Domain name=Sugar_tr; Domain location=7-578; Score =54.1; E_value=4.7e-13; Accession=PF00083.14; Description=Sugar (and other) transporter
  Pfam module annotation: Pfam domain module=MFS_1::Sugar_tr; Domain location=11-603::7-578
MSGAVLVAVAAAIGNLLQGWDNATIAGSILYIKREFQLQSEPTVEGLIVAMSLIGATVVTTCSGALSDLLGRRPMLIISSMLYFVSSLVMLWSPNVYILLFARLLDGLGIGLAVTLVPLYISETAPSEIRGLLNTLPQFTGSAGMFFSYCMVFGMSLMKAPSWRIMLGVLSIPSLIYFALTLLFLPESPRWLVSKGRMLEAKKVLQRLRGREDVSGEMALLVEGLGVGGDTAIEDYIIGPANELADEEDPSREKDQIKLYGPEQGQSWVARPVAGPNSVGLVSRKGSMANPSSLVDPLVTLFGSVHEKLPETGSTLFPHFGSMFSVGGNQPRNEDWDEESLAREGDDYVSDAGDSDDNLQSPLISRQTTSLDKDIPPHAHSNLASMRQGSLLHGNSGEPTGSTGIGGGWQLAWKWSEREGPDGKKEGGFKRIYLHQDGGSGSRRGSVVSLPGGDLPTDSEVVQAAALVSQPALYNEDLMRQRPVGPAMIHPSETIAKGPSWSDLFEPGVKHALIVGVGMQILQQFSGINGVLYYTPQILEQAGVGYLLSSLGLGSTSSSFLISAVTTLLMLPCIAIAMRLMDISGRRYSSPHYHFPLTSLSNTKKYV

SEQ ID NO: 232167 - protein, 126 aa, Glycine max
  Coding DNA Sequence Number=SeqID_115389
  Homolog annotation: Hit_ID=Q1S726; Match level="QueryCoverage=42%, HitCoverage=10%, E-value=3e-14, Identity=72%"; Hit description =Phosphofructokinase, putative
MDEDRPETHDGRPKRSTKRSEKPSELKPNVSLSGVKVVTDLVVVFDDVEPCLIGSVRFLGTKFVDSDSDVLVIDKSFGFDTAVEEAQGAINFAHVEAESTENGNDIVKLIGRYSGKYHLHYGSLQF

SEQ ID NO: 232168 - protein, 245 aa, Glycine max
  Coding DNA Sequence Number=SeqID_115390
  Gene Ontology: Mol. function=ribonuclease P activity; Biological process=tRNA 5'-leader removal
  Homolog annotation: Hit_ID=Q2QZQ0; Match level="QueryCoverage=91%, HitCoverage=25%, E-value=2e-21, Identity=32%"; Hit description =Ribonucleases P/MRP protein subunit POP1 containing protein, expressed
  Pfam annotation: Domain name=POP1; Domain location=27-179; Score =86.5; E_value=8.1e-23; Accession=PF06978.2; Description =Ribonucleases PMRP protein subunit PO
MVTDGTKKPQVSVPTPPPPWKINLQKYAESHALELHSLQSIIENRVNSDYRSQKNKRRRKTVFDNQIARKGCRRKRQKLGIIDKALAKSGLEENHQKKLPRCVHRRYELKKNPENGFCTSGDVTKRLRTHVWHAKWFAMTKLWGYHLPLCLQGRFEGALEKGSNKRCLYMMQAIILPSNWRVQRLSCIHDSLMSVLRMMLEPYPTTTPHPGNHDDSVLYSVTYGRAMLHQCGAPVSQPIAPVTYM

SEQ ID NO: 232169 - protein, 68 aa, Glycine max
  Coding DNA Sequence Number=SeqID_115391
MEPPVKKQTESARTRNLWMWKSVSLSREPTTRASSPACEPPTKNDDGNQGSDSWIHDVLRGKSGWRCC

SEQ ID NO: 232170 - protein, 155 aa, Glycine max
  Coding DNA Sequence Number=SeqID_115392
MDVDKILPSSSTLGWHSLKVKGELKISVDPGIPDIGQPFELLLNPRAGKRQPAKWEQLNRENGVVGELYKCRAARRSSRECCTLDGESPVAESITSLRSDPSSMGHVESRVNQQGPPCKAKYSWVTDSEVVPETTGAVAKASLHRAIVTAYGPEP

SEQ ID NO: 232171 - protein, 90 aa, Glycine max
  Coding DNA Sequence Number=SeqID_115393
MLCLVSPSLLARVSGFELSASRALRQAEDNAALSALIRCLSTSVFAGPHRNPLQWCPFLDLFAGSFLGAISSEDTLAKAGDMEMPFEGQN

SEQ ID NO: 232172 - protein, 172 aa, Glycine max
  Coding DNA Sequence Number=SeqID_115394
MACIYTIMAFIMSSFIHFILKFRDGCKDYYSQLVVHSQFKITLSPILVQVFLSQSICLLTNNSNCNIGVVGGEVSRVRTSVVGSSGISRIGLLYAEVKVGPPLVQKALKWPQEISQEWQQLPVSPASSPTTNGFGMVASDGSSSICCGTWAEGMDPGGATTYKLCNKMICPL

SEQ ID NO: 232173 - protein, 90 aa, Glycine max
  Coding DNA Sequence Number=SeqID_115395
MASPMTCEGANEPVDAQRLTSSSSPFVIHGQQVRWQAEIPYGDSHLSSTRGIKPVDAQGLTSSSAPFVNHGRSKPVDPQRITSSSAPFVI

SEQ ID NO: 232174 - protein, 47 aa, Glycine max
  Coding DNA Sequence Number=SeqID_115396
MTKGAEDDVSLYASTGSFSPGSLPPLLTTGAEDDVSPYAATSLFTPG

SEQ ID NO: 232175 - protein, 86 aa, Glycine max
  Coding DNA Sequence Number=SeqID_115397
MSTVRPTDDKKERQLMHKLFIKEIATWRREGDIFGSDTLGMTLGEIEGKIESDPTSHHKHSAIFNGEDATRVYQNSDGVKPGICSN

SEQ ID NO: 232176 - protein, 131 aa, Glycine max
  Coding DNA Sequence Number=SeqID_115398
MEVEETKQGLWLSLNYRIDIRASLAYDTGIWGESYRLFVAKFLFGFVVDLGMAFMDNWVVGNEKLHPIRNHIKIVLILPNEGNHYVLPRMDSGRLQVSVPGNSYPSTTFLEEMYQQFLIFCLCPHLPTIHL

SEQ ID NO: 232177 - protein, 199 aa, Glycine max
  Coding DNA Sequence Number=SeqID_115399
  Gene Ontology: Mol. function=sequence-specific DNA binding
  Homolog annotation: Hit_ID=P55388; Match level="QueryCoverage=40%, HitCoverage=21%, E-value=1e-20, Identity=62%"; Hit description =Hypothetical 41.8 kDa protein y4cF
  Pfam annotation: Domain name=DUF1612; Domain location=1-80; Score= -160.9; E_value=1.4e-06; Accession=PF07756.3; Description=Protein of unknown function (DUF1612)
  Pfam annotation: Domain name=HTH_3; Domain location=145-198; Score =28.0; E_value=3.3e-05; Accession=PF01381.12; Description=Helix-turn -helix
  Pfam module annotation: Pfam domain module=DUF1612::HTH_3; Domain location=1-80::145-198
MKEHDRLSHARERMMRKLAGRRSSSRLPELVELVVSRPVVSAAMIVKELGTTPQGAIGLANQLELREVTGRGRFRAWGMLSTKRLCSSLRCNTDFFSGNAVAFGPATFLCRPHLSVHHQGDAIMTISVSQPDSDHETDAPFAKKVLAARNLAGYTIEQLAVTCGLTTSEIRALEDGTDSDPLRIRRVAAALHIPVETVI

SEQ ID NO: 232178 - protein, 108 aa, Glycine max
  Coding DNA Sequence Number=SeqID_115400
  Pfam annotation: Domain name=zf-CCHC; Domain location=38-55; Score =22.0; E_value=0.00024; Accession=PF00098.13; Description=Zinc knuckle
MVAGNAIIEKPREQWDEEERKMVQYNLKYQTTRMQKNGKCYECNQPGHLRVDYPSFKKRMEISERKTFNDKKANKAYVTWEDNNMDSSEDSKNEVMNLSLMAKNYESE

SEQ ID NO: 232179 - protein, 433 aa, Glycine max
  Coding DNA Sequence Number=SeqID_115401
  Gene Ontology: Mol. function=chitin binding; Cellular component =extracellular region; Biological process=chitin metabolic process
  Homolog annotation: Hit_ID=UPI00006A17C9; Match level="QueryCoverage =99%, HitCoverage=100%, E-value=3e-67, Identity=31%"; Hit description= UPI00006A17C9 related cluster
RGLHIVTIRGLHALTFRGLHVLAFRGLHVLPFRGLHVLAIGGLHVLTFRELHALAFRGLHALAFRGLHILGFRGLHVLAFRGLHALAFRGLHVLSFRGLHALTFRGLHVLALRGLHAIAFRGLHALPFRGLHVFAFRGMHVVAFKGLHMFAFRGLHALTFRGLHVLTFKGLHVLTFRGLHVLALRGLHVLAFRGLHILAFRGLQALAFRRLHILAFRALHTLAFRGLHVLAFKGLHVLVFRGLHALAFRGPDVLTFRGLRAFTFKGVHVFALRGLHAIAFRGYHVLPFRGLHVFTIRGLHIVTIRGLHALTFRGRHVLAFRGLHVLPIRGLHVLAIGGLHVLTFRGLHALALRGLHALAFRGLHVLTFRGLHVLAFRGLHTLAFRGLHILAFRGLHVLAFRGLHALAFRGLHVLSFRGLHALTLRGLHVLAFR

SEQ ID NO: 232180 - protein, 213 aa, Glycine max
  Coding DNA Sequence Number=SeqID_115402
  Gene Ontology: Mol. function=RNA-directed DNA polymerase activity; Cellular component=chromatin; Biological process=RNA-dependent DNA replication
MAPKDMEKMTFVTLWGMFCYKVMSFGLKNVGATYQWAMVALFHDMMHKEIEVYVDDMIAKSKTKEEHLVNLRKLFERLRKYKLRLNPAKCTFRVKSGKLFGFIVSHKGIEVDRNKVKAILEMHELHTESKSEWHSEGQAMPYESSYAYATGAREIPVEAKLSKFILMMPKTQVKNQESNKFQESKSHSIKNQDSSEDSREDSRYARTSRKASR

SEQ ID NO: 232181 - protein, 143 aa, Glycine max
  Coding DNA Sequence Number=SeqID_115403
MASRKRKAHSTPTQVRFDRSRFTSQEAWERYADVIVPRKPLLERNMVVYTIEFDEFLDEIARRHWDEELTDFIDGSIDVAIVKEFYANLYDPEDKTPKQVQVRGHLIKFDEDTLNTFLKTPVIVEEGESLCAYSRFALLRHDP

SEQ ID NO: 232182 - protein, 140 aa, Glycine max
  Coding DNA Sequence Number=SeqID_115404
MMEAMMSMRRMMEVNAAIVVVASTATKVDLTHPPGFNQICYRGVNIWWLPLPNTLGGPQYHPQPQPLHFVVGRAPPAIVEREKLDLIEERIRVIERGRNYAFADMAKLCLVFDMVIPPKFKVPDFNMYKGTTCPNNYLKM

SEQ ID NO: 232183 - protein, 66 aa, Glycine max
  Coding DNA Sequence Number=SeqID_115405
MADTYSAPEEIHGILSYLRIKSLPHIISSMHCMLVSSFVTGSRKVHITFLIVHMGHWAPKCASKKR

SEQ ID NO: 232184 - protein, 61 aa, Glycine max
  Coding DNA Sequence Number=SeqID_115406
MENVIIKLRCPKKHLFLVNHALEENARMSKHENKWYAILQIKSLLNAYDDAMTHAKCEAGI

SEQ ID NO: 232185 - protein, 131 aa, Glycine max
  Coding DNA Sequence Number=SeqID_115407
  Gene Ontology: Mol. function=sequence-specific DNA binding; Cellular component=nucleus; Biological process=regulation of transcription
  Homolog annotation: Hit_ID=Q9SV15-2; Match level="QueryCoverage=68%, HitCoverage=33%, E-value=1e-10, Identity=46%"; Hit description =Isoform 2 of Q9SV15
MRVEFPGDVVEVFTVVMAPLLDRSRREKRFFSGGVRKREDPSFLLETLSLSVMAKDMKEDFKEMSKVSLENLRSMDLALVVLKMLGFVKLRVRLDDCEGLVGAGDGARVLKVEGRGVQPKRAWPVQRLKKD

SEQ ID NO: 232186 - protein, 155 aa, Glycine max
  Coding DNA Sequence Number=SeqID_115408
  Homolog annotation: Hit_ID=Q9LJR0; Match level="QueryCoverage=63%, HitCoverage=68%, E-value=3e-17, Identity=44%"; Hit description =Arabidopsis thaliana genomic DNA, chromosome 3, TAC clone: K7L4
MPRPFMCKIPKLPLKEESPHSNGNVKHHTPLGKETLKVYVLNKSNHQEKESYCEQQQAREGIRGVNQKLIMGCCPLKLACGLGSMAKHRDLFGVEYHQSSTNDKGDQKHGRKISRKAQHGKFSGTRENFRVQKNEEDSQKGDLRSWESKLERKIC

SEQ ID NO: 232187 - protein, 260 aa, Glycine max
  Coding DNA Sequence Number=SeqID_115409
  Gene Ontology: Mol. function=hydrolase activity, hydrolyzing O -glycosyl compounds; Biological process=protein amino acid phosphorylation
  Homolog annotation: Hit_ID=Q9SWX8; Match level="QueryCoverage=72%, HitCoverage=26%, E-value=7e-32, Identity=42%"; Hit description =Receptor-like kinase CHRK1
  Pfam annotation: Domain name=Glyco_hydro_18; Domain location=9-190; Score=-55.0; E_value=0.058; Accession=PF00704.18; Description =Glycosyl hydrolases family 18
MARSFHHRYLFEPFSLEVLSLKSQDEPQATTHEPLLLGMSPCSDPYLHKARSRFSTITQVLQSLLNINPALYGSSSGWDNTGIKEWRRRGFSSKKLLIGLPYHGYAWTLVNPRENSGVGVPTSGPAITMDGSMAYKFIKSYIRSFGNVVSHYNATFVVNQFTVASTIGAKVSYARKNGLLGYNVFQIGNDKNWELSKAAQEVDEEVEDHHKKRLVIIVLLATLTLVLLLGIVFCYYRRGKTPLAASYPSATLYNIQKFIS

SEQ ID NO: 232188 - protein, 107 aa, Glycine max
  Coding DNA Sequence Number=SeqID_115410
MSSSSSCSSNIQIKSGPIDDDVLWMQAKHVSEHAWNEEEDRKLHIRRVVPICQGQEEILEEIIPLLRQSGLRVDEAPLIGPTNLGWADLCEELLRVKPQEGELQGSV

SEQ ID NO: 232189 - protein, 519 aa, Glycine max
  Coding DNA Sequence Number=SeqID_115411
  Gene Ontology: Mol. function=DNA-directed DNA polymerase activity; Cellular component=DNA polymerase III complex; Biological process =DNA replication
  Homolog annotation: Hit_ID=Q9SB72; Match level="QueryCoverage=98%, HitCoverage=56%, E-value=1e-102, Identity=43%"; Hit description=DNA polymerase III like protein
  Pfam annotation: Domain name=AAA; Domain location=327-517; Score= -1.1; E_value=0.00026; Accession=PF00004.19; Description=ATPase family associated with various cellular activities (AAA)
MDGRRHSVDIPISKTLMALRRVRSLRDPSTNGVSRLSPLIDDGDWEDGSSNGVSLSLRFLNGSHACDSNGNGLLRSSSLDFKGQREQDTAEFELDMWNSKMNHCGISCQEGQQDDGLVYSNPKQQCISGDKSSNESCCSNHEGRGLDLVSIMPSSNHLKDGESCYLSTATRVEHSKSARKSLRKNQVKPSEVIGDIASHVGSQQCLSVFDAPSARSASEHITQDEDVLDNYHGCGLRSCWSKSPRFRESNHYSEIEGLPLILQHVSETDLNGHRNMRHIGGEISPTLETPRSLSMKFRPKSFSDLVGHNVIGKSLLGAISTGRISSFYLFHGPRGTGKTSASRIFAAALNCLSPLEQKPCGLCRECVLFFLGRSKHVKEIDSLRINRADKVKSLVKNACIPRVSSCFKVFIVDECQLLHAETWACLLNSLENVSPHVVFVMITPDLDKLPPSALSRAQRYHFAKIKDVDIAIRLEKICVEEGLESEQVALDFIAARSCGSLRDAETMLDQLSLLDWGHF

SEQ ID NO: 232190 - protein, 116 aa, Glycine max
  Coding DNA Sequence Number=SeqID_115412
  Gene Ontology: Mol. function=transferase activity, transferring hexosyl groups; Biological process=carbohydrate biosynthetic process
MRHDLSLFIVRCSTSDLTFRSWAPSQTTLQRSWIIDSWKRGDEVLHINEGDKESDDIERRGKGIGEDDGGGGRRRSPDIGSDGVSGDGGARDRAAVSVREDRDLDAGICCGVFLIG

SEQ ID NO: 232191 - protein, 34 aa, Glycine max
  Coding DNA Sequence Number=SeqID_115413
MVVGKIFEQQLIPTSLGCKQGNLCLPAFMCLQCM

SEQ ID NO: 232192 - protein, 315 aa, Glycine max
  Coding DNA Sequence Number=SeqID_115414
  Gene Ontology: Mol. function=nucleotide binding; Cellular component =membrane
  Homolog annotation: Hit_ID=Q9SB72; Match level="QueryCoverage=46%, HitCoverage=17%, E-value=3e-20, Identity=38%"; Hit description=DNA polymerase III like protein
MDTDGDICSTSPKGDSLEHLATTGQCDDKSDTLGLGVREDHRRTLDSIWYKATEMCQSNRLKTFLRKQGKLSSVCISQVAELEFHHRDYVSRAEKSWRLIASSLQFILGCNLELRINCVPSCTSDSIYAKLKRTSFSFFGCSRRIRWKSISSNEQGSESDYADYTSQRPMMKTQTLTCSSNREPRVPSFESYNGMQVVTTLRSSEGNLLSSGKMFLNRPDQETPRISCSGVDSLKEEGCNYELLAPSTLDLDNQSDCFPRTRWLHKKFSSSYASQEKNFVLSIPKFKCSEAYGYDLEPRVFSHSSNNCINAIEEK

SEQ ID NO: 232193 - protein, 701 aa, Glycine max
  Coding DNA Sequence Number=SeqID_115415
  Gene Ontology: Mol. function=isomerase activity; Cellular component =cytoplasm; Biological process=protein amino acid phosphorylation
  Homolog annotation: Hit_ID=Q8LDN5; Match level="QueryCoverage=99%, HitCoverage=99%, E-value=0.0, Identity=68%"; Hit description =Topoisomerase-like protein
  Pfam annotation: Domain name=MA3; Domain location=122-233; Score =152.5; E_value=1.1e-42; Accession=PF02847.7; Description=MA3 domain
  Pfam annotation: Domain name=MA3; Domain location=286-397; Score =168.7; E_value=1.4e-47; Accession=PF02847.7; Description=MA3 domain
  Pfam annotation: Domain name=MA3; Domain location=419-530; Score =142.6; E_value=1e-39; Accession=PF02847.7; Description=MA3 domain
  Pfam annotation: Domain name=MA3; Domain location=582-691; Score =158.2; E_value=2.1e-44; Accession=PF02847.7; Description=MA3 domain
  Pfam module annotation: Pfam domain module=MA3::MA3::MA3::MA3; Domain location=122-233::286-397::419-530::582-691
MASSEGFLTDGQRELLKIASQNAENLSSSPKSPSSLLSDHHVKAPAGGKSQTSGIAVRHVRRSHSGKYGKVKKDGAGGKGTWGKLLDTDIDSHIDRNDPNYDSGEEPYQLVGTTVADPLDEFKKAVVSIIEEYFSNGDVELASSDLRELGSSEYYPYFIKRLVSMAMDRHDKEKEMASVLLSALYADVISPAQIRDGFFMLIESSDDLAVDILDAVDILALFLARAVVDDILPPAFLARARKALPESSKGVQVIQTAEKSYLSAPHHAELVERRWGGSTHITVEEVKKKIGDLLREYVDSGDTLEACRCIRELGVSFFHHEVVKRALILAMEIRSAEPLMLKLLKEAAEEGLVSSSQMVKGFSRLAESLDDLALDIPSAKALFQSFVPKAISEGWLDASLTKPATEDGEIQEDEKVRKYKKESVTIIHEYFLSDDIPELIRSLEDLGAPEYNPIFLKKLITLAMDRKNREKEMASVLLSALHIEIFSTEDIVNGFVLLLESAEDTALDILDASNELALFLARAVIDDVLAPLNLEEIGSRLPPKCSGSETVRMARSLIAARHAGERLLRCWGGGTGWAVEDAKDKIMKLLEEYESGGVVSEACQCIRDLGMPFFNHEVVKKALIMAMEKKNDHMLDLLQECFSEGLITINQMTKGFTRIKDGLDDLALDIPNAKEKFGFYVEHAQSKGWLLPLFDSPATDA

SEQ ID NO: 232194 - protein, 62 aa, Glycine max
  Coding DNA Sequence Number=SeqID_115416
MIFMDSKGDKILAQVKIQDIDRWKDQLKEKQTYIVKNFEVENSIGQYRPSNHKYKLTFARVM

SEQ ID NO: 232195 - protein, 346 aa, Glycine max
  Coding DNA Sequence Number=SeqID_115417
  Gene Ontology: Mol. function=nucleic acid binding; Cellular component= nucleus
  Homolog annotation: Hit_ID=Q9STM4; Match level="QueryCoverage=89%, HitCoverage=57%, E-value=4e-86, Identity=49%"; Hit description =Putative zinc finger CCCH domain-containing protein ZFN-like 6
  Pfam annotation: Domain name=zf-CCCH; Domain location=232-258; Score =38.4; E_value=2.5e-08; Accession=PF00642.15; Description=Zinc finger C-x8-C-x5-C-x3-H type (and similar)
  Pfam annotation: Domain name=zf-CCCH; Domain location=278-304; Score =42.2; E_value=1.8e-09; Accession=PF00642.15; Description=Zinc finger C-x8-C-x5-C-x3-H type (and similar)
  Pfam annotation: Domain name=zf-CCCH; Domain location=57-83; Score =47.7; E_value=3.9e-11; Accession=PF00642.15; Description=Zinc finger C-x8-C-x5-C-x3-H type (and similar)
  Pfam annotation: Domain name=zf-CCCH; Domain location=7-35; Score =15.6; E_value=0.011; Accession=PF00642.15; Description=Zinc finger C- x8-C-x5-C-x3-H type (and similar)
  Pfam module annotation: Pfam domain module=zf-CCCH::zf-CCCH::zf -CCCH::zf-CCCH; Domain location=232-258::278-304::57-83::7-35
MGKASLYDFFSCPNHYYQRSGGCKFGKSCKYNHTRGKISTAPAPLLELNFLGLPIRLGERECPYYMRTGSCKFGANCKFNHPDPTAVGGVGGDPASGYGNGGSISLQGVSQTSVPSWSSPRTLNESSPFVPMMLSPTQGVSTQSSDWNGYQTCHLSYVFCYRHIKESCRLSNAHLALCPGAILLIPKKASVYLPERNMHPPSTFVMNNPAIDTNVYMHHQKQMPVDEFPERPGEPECSYFLKTGDCKFKSNCKFNHPKNRVARLPPCNLSDKGLPLRPDQSVCSHYSRYGICKFGPACKFDHPINLQPVMIPGLGQQSYSNSASVEVAGIFGSTGVVTDATIQQSV

SEQ ID NO: 232196 - protein, 89 aa, Glycine max
  Coding DNA Sequence Number=SeqID_115418
MVIDYQRLICRYHPRYIAGQPPHKPPCFMDFVLLLVDCQELACLGGDRAMAQINSPTSTSQAQAYHPQLPTFNLSSRTPTCPYPRSSQY

SEQ ID NO: 232197 - protein, 68 aa, Glycine max
  Coding DNA Sequence Number=SeqID_115419
MQGKRKKEDTSNLKSVEKRRRRRIRGKVEPRCCTMMWITSLIISLVSLVLYSMIGIEHNFLIAKSTRI

SEQ ID NO: 232198 - protein, 91 aa, Glycine max
  Coding DNA Sequence Number=SeqID_115420
  Gene Ontology: Mol. function=DNA binding
  Homolog annotation: Hit_ID=Q1SXX9; Match level="QueryCoverage=79%, HitCoverage=7%, E-value=6e-30, Identity=84%"; Hit description=Zinc finger, RING-type
MEQLPRHCAEFISSLPFKEYTDPHKGSLNLAVKLPNGSLKPDLGPKTYIAYGFPQELGCGDSVTKLHCDMSDAVCSICLFLSWAVIFKDFF

SEQ ID NO: 232199 - protein, 134 aa, Glycine max
  Coding DNA Sequence Number=SeqID_115421
  Gene Ontology: Mol. function=DNA binding; Biological process=DNA integration
  Homolog annotation: Hit_ID=Q1SKC8; Match level="QueryCoverage=61%, HitCoverage=19%, E-value=1e-24, Identity=63%"; Hit description =Integrase, catalytic region
MKLCFYKLYKQKVKAYHDKKLLKKDFQPGQQVLLFNSRLKLFPSKLKFKWSGPFTIKEVKPYGAVELFEPQSTTPERSWIVNDQRLNLYHGWPQASLKLRMGNNLEKFSVIQLAEQVTLLLSAPTLIYWLLGSC

SEQ ID NO: 232200 - protein, 152 aa, Glycine max
  Coding DNA Sequence Number=SeqID_115422
MEPEVAPSTACVSTKESCIDPSGIYERSTTVCKVPLDNDQDKHIPKKPMKPIDRPKLDDDPVYQMTMMIPQLFLKPMQVSWDAIVFGVYNDNVPLYIKHEDLEEIAHSGQCLNITIIQLWIIALKGLNDSQGSNSKPTAKWISVKVSHLNNV

SEQ ID NO: 232201 - protein, 398 aa, Glycine max
  Coding DNA Sequence Number=SeqID_115423
  Homolog annotation: Hit_ID=Q20CD0; Match level="QueryCoverage=23%, HitCoverage=29%, E-value=7e-09, Identity=42%"; Hit description =Fgenesh protein 81
MGSKVYPKVHENPRAIFSSSSPSLLEPSIQYPWGVGLHQEGNFMINGAYCHQEVEKWGTPAISHETHKQLGYKSILPQAATLGIRITVSNLLDHHSARVQDRARTLFDNWKGVGNGDTESHEVEVAKVENATKAPDSVKEPTLEQNVEHNEDDVCHKLTTFASIRTLASDRSGEDDATSITQIFKAAKNDNDCCSNALQGTSISDSNLGKTKVLDMSVSGIEYVTALKEDKGHEKDTSIGSDCSKPGIDFRGSKIIHKRGSNNELDKNLIGSLRFNKAHIRVKLKAKKKEVEEEVCQLSAKLKGNHAKERAALGYISGNGNEKSNLDSLVKAIAGVSVTSQPEDTKVNKAKQRRDKKAQQEAEREQRIQAEQSDIISDRVIKNEKLENKFQASWLDCL

SEQ ID NO: 232202 - protein, 69 aa, Glycine max
  Coding DNA Sequence Number=SeqID_115424
MFLFLKDNENSPNKSSDCAQQITRGIVEGKGKSLDCVVEVERGKKRRAKWLMKGSTMHVVDTILCVLVA

SEQ ID NO: 232203 - protein, 235 aa, Glycine max
  Coding DNA Sequence Number=SeqID_115425
MVALTWLQWLYHTYVASETYVWATTTYLLHLLCNTIFVEKSSTHVHICYLQYHNDLDSCIEYAWGVLDYDRKKPFAARWLPLRGNDKATRIRQLSNQFQMIDVAWIPLDLLERLTTYDKCCEAWAEWEQHLVALGKASPHGTSWAYTIDYLPWYYEHLHPYMISAQEGEPPYHLVCISSQPQPQPGRGQIPDYVLGLIPNDVNIDTKIVGHETKEQPPLRKKAIRDGIECNRKGT

SEQ ID NO: 232204 - protein, 122 aa, Glycine max
  Coding DNA Sequence Number=SeqID_115426
MGHLLVPVNSALQSLLPLEVGAGNNGGSCLGVTCLAGSMVLHVVVINTRVTGGEVTMSGGYDRTKQNRFIHGGLPPHSREHPTSSSVSNVLVRMNWCKVKNEKLVNDYPKLQHSLQLHPFCS

SEQ ID NO: 232205 - protein, 97 aa, Glycine max
  Coding DNA Sequence Number=SeqID_115427
MLLAAMRKAFTNAIGGEGCVEYVCMEIKNDNEVGKIFFIFSQFSSKCLIELYAMIDKSPKEILVLLCKPRKPRSVEDVIGLMHGSMATSSNEDDKSM

SEQ ID NO: 232206 - protein, 470 aa, Glycine max
  Coding DNA Sequence Number=SeqID_115428
  Homolog annotation: Hit_ID=Q1T2D5; Match level="QueryCoverage=23%, HitCoverage=7%, E-value=1e-21, Identity=51%"; Hit description=Chromo
ASKHCYFISYLPLKRISKSNWQSSYGRSGLEEIRKFLKLWKSHIISLSNSSQLLVEWKHERKRNSVNTPSPQSQAHAIWIPPTSGSLKLNVDAAIFLSISCFGAGMCIRDENGRFLQARTQWNYGEPSPLEAEAWALLQGINWIHELYIRGDVYQQWPLFDCELSKGSFRARQGSHHVPRGQDHKQQFVEEFHPQGRFDMDEIPQILLNGHVHNLGLPICLWMGGKPVMKSRERSFYTWKGMGRGCNNPIDFLEQYLGDKPVMKSRERSFYTWKGMGRGCNNPIDFLEQYLGPKPWYPKRQYVPSKQLETDKRAFLYVEMEVILLEYSKDLSKMFPMKFWRTTIYQSIAKEDDDVLVEKWPEKVIHGGLQSDWRIAELKGHDTVFIMSIVGAKCRFGNVLGLKVHQIEMKTNEEDVAIADEKEDLILPMDPLRNWGHTQIEKYWASWLLWANFCRCIARVDNPSGYAPIV

SEQ ID NO: 232207 - protein, 101 aa, Glycine max
  Coding DNA Sequence Number=SeqID_115429
  Subcellular localization annotation: CTP_CleavageSite=35; ConfidenceScore=5.67e-01
MVHVSLPPPTFTAFISLPPSLPHWPSSSWFFFQVVAGLRKALSALCSPRELRLLPPHRESVFCDCAVVGVEYSRHFEAGGVPLRRHCRGYSSSWWLEFLSL

SEQ ID NO: 232208 - protein, 512 aa, Glycine max
  Coding DNA Sequence Number=SeqID_115430
  Gene Ontology: Mol. function=UDP-glucose 4,6-dehydratase activity; Cellular component=cytoplasm; Biological process=UDP-rhamnose biosynthetic process
  Homolog annotation: Hit_ID=Q9SYM5; Match level="QueryCoverage=99%, HitCoverage=77%, E-value=0.0, Identity=71%"; Hit description =Probable rhamnose biosynthetic enzyme 1
  Pfam annotation: Domain name=3Beta_HSD; Domain location=11-282; Score= -27.8; E_value=5.5e-11; Accession=PF01073.9; Description=3-beta hydroxysteroid dehydrogenaseisomerase family
  Pfam annotation: Domain name=Epimerase; Domain location=10-253; Score= 218.6; E_value=1.4e-62; Accession=PF01370.11; Description=NAD dependent epimerasedehydratase family
  Pfam annotation: Domain name=NAD_binding_4; Domain location=12-237; Score=28.6; E_value=1.7e-10; Accession=PF07993.2; Description=Male sterility protein
  Pfam annotation: Domain name=Polysacc_synt_2; Domain location=10-296; Score=-94.5; E_value=1.4e-07; Accession=PF02719.6; Description =Polysaccharide biosynthesis protein
  Pfam annotation: Domain name=RmlD_sub_bind; Domain location=9-323; Score=-146.3; E_value=0.00019; Accession=PF04321.7; Description=RmlD substrate binding domain
  Pfam module annotation: Pfam domain module=3Beta_HSD::Epimerase::NAD _binding_4::Polysacc_synt_2::RmlD_sub_bind; Domain location=11 -282::10-253::12-237::10-296::9-323
MANTYKPKNILITGAAGFIASHVCNRIVRNYPDYKIIVLDKLDYCSNLKNLIPSRSSPNFKFIKGDIGSADLVNYILLTESIDTIMHFAAQTHVDNSFGNSFEFTKNNIYGTHVLLEACKVSKGQVKRFIHVSTDEVYGETDEDAVVGNHEASQLLPTNPYSATKAGAEMLVMAYGRSYGLPVITTRGNNVYGPNQFPEKLIPKFLLLAMKGRTLPIHGDGSNVRSYLYCEDVAEAFEIILHRGEVGHVYNIGTKKERRVIDVARDICRFFNLDPDTHVKFVENRPFNDQRYFLDDEKLKDLGWSEGTTWEEGLRKTMDWYVKNPDWWGDVSGALLPHPRMLTMPGVEKYYDGSDNVTGTASNGDVNHSNQNRMVVVPATRNNVSPQKASLKFLIYGGAGWIGGLIGNICEKQGIPFEYGMARLDDRSQILFDFRTIKPTHVFNASGVIGALNVKWFEAHKPETIRAVVVGVLTLADVCRDHGLLMMNYAFGGNLEDKAYSTDAFYFRTQAK

SEQ ID NO: 232209 - protein, 477 aa, Glycine max
  Coding DNA Sequence Number=SeqID_115431
  Gene Ontology: Mol. function=zinc ion binding; Cellular component =nucleus; Biological process=regulation of transcription
  Homolog annotation: Hit_ID=Q84PD2; Match level="QueryCoverage=77%, HitCoverage=79%, E-value=3e-67, Identity=37%"; Hit description=AOBP -like protein
  Pfam annotation: Domain name=zf-Dof; Domain location=114-176; Score =131.1; E_value=3.1e-36; Accession=PF02701.6; Description=Dof domain, zinc finger
MVKEDCYSCYVLLEVEECIFYANPYILSELAPLVLTLIASCLSHNGLEESTNDEVDVPLNEVSSKQIDPQEDGNSAPNIYKNPTLKLVAKVVNGNNEHRNAKRDIDHQEKVLKRANKVLPCPRCNSSETKFCYFNNYNVNQPRHFCKNCQRYWTAGGTIRNVPLGAGKRKNKHSTLQYCLIPVTPDAASVSQTDSKPASDMLLSSSRLIKGMENISSLREETPLSESLETVLSLNGQTNIEMASSTLKDDAEESSSSSMRSNEVEQVCLAQHSLVPLQSFQYYPVPSWSYQWNPCWNVKELRPRSLSSRPVYTGSPTMIAVPGFSLPTVILPGVPYSYSGFMSNWDEQKEDASLVGSAFSGISLSPSSVSNSTCSGNRSPTLGKHSRDGSTLGEDAMKQNLWVPKTVRINDPEEAANSSIWSTLGTKSEQNKLIMKGSIFKSFEPKASASSHILEDNQILRANPAAFSRSESFQESM

SEQ ID NO: 232210 - protein, 722 aa, Glycine max
  Coding DNA Sequence Number=SeqID_115432
  Gene Ontology: Mol. function=protein kinase activity; Cellular component=integral to membrane; Biological process=protein amino acid phosphorylation
  Homolog annotation: Hit_ID=Q2HVC0; Match level="QueryCoverage=95%, HitCoverage=84%, E-value=3e-89, Identity=47%"; Hit description =Protein kinase
  Pfam annotation: Domain name=LRR_1; Domain location=107-129; Score =5.7; E_value=24; Accession=PF00560.23; Description=Leucine Rich Repeat
  Pfam annotation: Domain name=LRR_1; Domain location=131-153; Score =15.2; E_value=0.23; Accession=PF00560.23; Description=Leucine Rich Repeat
  Pfam annotation: Domain name=LRR_1; Domain location=155-177; Score =10.5; E_value=3.1; Accession=PF00560.23; Description=Leucine Rich Repeat
  Pfam annotation: Domain name=LRR_1; Domain location=179-201; Score =10.3; E_value=3.4; Accession=PF00560.23; Description=Leucine Rich Repeat
  Pfam annotation: Domain name=LRR_1; Domain location=203-224; Score =21.4; E_value=0.0031; Accession=PF00560.23; Description=Leucine Rich Repeat
  Pfam annotation: Domain name=LRR_1; Domain location=226-245; Score =6.9; E_value=15; Accession=PF00560.23; Description=Leucine Rich Repeat
  Pfam annotation: Domain name=LRR_1; Domain location=247-269; Score =8.6; E_value=6.9; Accession=PF00560.23; Description=Leucine Rich Repeat
  Pfam annotation: Domain name=LRR_1; Domain location=271-293; Score =8.2; E_value=8.3; Accession=PF00560.23; Description=Leucine Rich Repeat
  Pfam annotation: Domain name=LRR_1; Domain location=295-314; Score =6.1; E_value=21; Accession=PF00560.23; Description=Leucine Rich Repeat
  Pfam annotation: Domain name=LRR_1; Domain location=319-338; Score =5.7; E_value=24; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1::LRR_1; Domain location=107 -129::131-153::155-177::179-201::203-224::226-245::247-269::271 -293::295-314::319-338
MAPKPVSLSHLLHLTLFLATIQLSEQLEFSQSQTLLKVQQLLGYPSALGTLSSNIDFCNIDPTSYLTLVCYEDSLTQLHVVGSNEYTPLPQNFSSDTLFATLGTLSSLKVLSLVSLGLWGNLPESIAQLSSLEILNISSNHFNGAIPSQLSLLRNLQSVVLDDNNFNGEISNWVGSLQGLAVLSMRNNWLSGSLPTSLNALHTLRVLDLSNNQLSGELPHLKNLANLQVLNLENNTFGPHFPSLPTKLVSLVLRNNSFRLSVPSNLSSFYLLQRLDLSLNGFVGPFPPSLLLMPSINYLDVSSNKFTGMLFNNMSCNDDLHFVNLSSNLLKGELPTCLEPKTRVVLYARNCLSNKNQDQHPSDFCSNEALAVTIIPHQQKHKRTTSKAIIVSSMGGLVGGMLIVGVVILVVSRVHKKQVGKIPSKSTLEHVISQEHNEDEVKTTTRSIMEHIIKRVPDKGAVETLTRSIKEYVMSRVNNKRVVRASTMSIIEHVSSANTAKLLTDARYISETMKMGASLPAYRTFALDELKEATNNFDESSFISEGPHGQIYKGVLSDGMHIAIRGLKMRKKQGPQTYMHHVEIISKLRHSHLVSALGHAFECNQDDSSVNNRITAAIGVVKGIQFLHTGIVPGLYSNNLKITDILLDNNHNVKISSYNLPLSAENKRMISKGTSPGLKGKVQARIQDADKNDVYDIGVVLLEIILGRPIMFHNEVGTLKDL

SEQ ID NO: 232211 - protein, 262 aa, Glycine max
  Coding DNA Sequence Number=SeqID_115433
  Gene Ontology: Mol. function=RNA-directed DNA polymerase activity; Biological process=RNA-dependent DNA replication
  Subcellular localization annotation: CTP_CleavageSite=38; ConfidenceScore=5.04e-01
SHPSNQFNKDQGGPSNRPIQQGPNIFQRTTKLEETLTQFMQIADKSSNSFMANIEKNPKEDYKAVMTRSKRFVEAEDEDSVVPKKKATKKKGTDDKKDDVRVPYPVVPSKKEKDHHLARFLDIFRKLEITMPFGEALQQMPLYSKFLKDMLTRKHKYIHQENIIVEGNCSVVIQKILLPKHKDLGSVTIPCSIGEVTVGKALIDLGASINLMPLSMCRRLGELEIMPTKMTIQLADRSITRPYGVIEDVLVRDTFYLPGRLC

SEQ ID NO: 232212 - protein, 254 aa, Glycine max
  Coding DNA Sequence Number=SeqID_115434
  Gene Ontology: Mol. function=ATP-dependent helicase activity; Cellular component=intracellular
  Homolog annotation: Hit_ID=Q9FF84; Match level="QueryCoverage=93%, HitCoverage=20%, E-value=1e-113, Identity=83%"; Hit description=ATP -dependent RNA helicase A-like protein
  Pfam annotation: Domain name=dsrm; Domain location=155-217; Score =44.4; E_value=3.8e-10; Accession=PF00035.15; Description=Double -stranded RNA binding motif
MDDGQVLLYANSVNARYQTIPYPWLVFGEKVKVNAVFIRDSTGVSDSILILFGGALSNGIQAGHLKMLDGYVDFFMDPNLADSFLKLKEELNKLIQKKLEDPSIDIHKEGKYLMLAVQELVSGDQCEGRFVFGRESRKPKASNDENKFTKDGTNPKSLLQTLLMRAGHSPPKYKTKHLKTNEFRALVEFKGMQFVGKPKRNKQLAERDAAIEALAWLTHTSDNNQHEDDKSPPDVTDNMLKLLGKRRKSKRGHG

SEQ ID NO: 232213 - protein, 80 aa, Glycine max
  Coding DNA Sequence Number=SeqID_115435
MNSQNLLENPNLNSQLMATTTLLGIGWGYARVTLGMVVGGTRAHVVRVVLIGGGGNIVVASLEVIELHLEEERQWLRLRL

SEQ ID NO: 232214 - protein, 261 aa, Glycine max
  Coding DNA Sequence Number=SeqID_115436
  Gene Ontology: Mol. function=ATP-dependent helicase activity; Cellular component=intracellular; Biological process=protein modification process
  Homolog annotation: Hit_ID=Q9FF84; Match level="QueryCoverage=90%, HitCoverage=20%, E-value=1e-116, Identity=87%"; Hit description=ATP -dependent RNA helicase A-like protein
  Pfam annotation: Domain name=HA2; Domain location=93-184; Score =109.0; E_value=1.4e-29; Accession=PF04408.13; Description=Helicase associated domain (HA2)
MAVMAEKWRKIWKLQEYTTNWVRRGRAGRVQPGECYHLYPKCVYDAFSEYQLPELLRTPLNSLCLQIKSLQVESIGGFLSAALQAPEPRAVQNAIDFLKMIGALDEQENLTNLGKFLSMLPVDPKLGKMLIMGAIFRCFDPVLTIVAGLSVRDPFLLPQDKRDLAGTAKSRFSAKDYSDHMALVRAYEGWKDAEREGSAYEYCWRNFLSAQTLQAIHSLRKQFSFILKEAGLVDAEANVINKLSHNQSLVRAVICSGLFPA

SEQ ID NO: 232215 - protein, 86 aa, Glycine max
  Coding DNA Sequence Number=SeqID_115437
QEAKRIIKRGQIAGVLFGDDKNDVVHTFKEIEERDWKEIQRIKILTLNIKGLEGRIKWKEIFLYQASASLGSTPQEMWLAELINVS

SEQ ID NO: 232216 - protein, 239 aa, Glycine max
  Coding DNA Sequence Number=SeqID_115438
MERKRSHASFTMFAMLVGLLSQSLVIPVISTTVADQKNYYTPDPHAGSPPTGSHNSSPPSHGHGSSPPSHHNSPSTPSTPSGGNCGSSPPQHHDPTPSTPSTPSNPPSGGYYGGSPPTPVTVSPPSTPVDPGTPSIPSPPLIPSPSPFTGTCNYWRNHPAIIWGILGWWGTLGSAFGVTGALYREGTASFLNSMVNNKFPYTTNQVRDRFVASLNSNKAAEAQAQLFKMANEGRMKPRP

SEQ ID NO: 232217 - protein, 126 aa, Glycine max
  Coding DNA Sequence Number=SeqID_115439
MVASWPPIGLWSFIWPLVLNLVISIVKQIVGIQVKPDRPCPYHADNVRGKLHVTQETDRRNTYNVSFFDSNEGKMGIGSHVARHRGLRSEHRGHELKVTRTTRADSLTRLRRFWMMPLPVKEDKSG

SEQ ID NO: 232218 - protein, 112 aa, Glycine max
  Coding DNA Sequence Number=SeqID_115440
  Homolog annotation: Hit_ID=O04379; Match level="QueryCoverage=38%, HitCoverage=4%, E-value=7e-09, Identity=67%"; Hit description =Protein argonaute
MAKQHSSELHDITLPLNKTLACNFQQSGDLPVIKPFRVPLTFHKHTTFYLKQIARQTDKLLTFFGLIMNLAKAVLANHAYKILVETTLVEYPVGVLTNAGKLMTSIPWRFNS

SEQ ID NO: 232219 - protein, 311 aa, Glycine max
  Coding DNA Sequence Number=SeqID_115441
  Homolog annotation: Hit_ID=Q47522; Match level="QueryCoverage=16%, HitCoverage=62%, E-value=2e-21, Identity=94%"; Hit description=LacZ protein
MVKVGTSYVPINVSFSPKVGPGLPGINRDTRIYLFCEVLQWLLFLSAVPPVQLLTGWCVTAKAPPDISAGKCSGRVPFAIQAAQLLGRAIGAGLFAITPAGERGMCCKAIKLGNARVFPVTTLANWSSTAVAAALELVDPPGCRNSMDGLFQIVQRLYGIQIIERHAPVWQNDVRYFEIEDQGQVVGGFYFDLYIKLIDTVDLEGGPVGKPVVPAALMNRPTRGERRFAYWALAECILAYYVGTDEGVSEVLHVAGEKRLHRCVSRICDTGYIPLPRSLTRYARSFDCGERKWLTNGAEISWKMPGRYLTG

SEQ ID NO: 232220 - protein, 104 aa, Glycine max
  Coding DNA Sequence Number=SeqID_115442
  Homolog annotation: Hit_ID=Q1SYN6; Match level="QueryCoverage=57%, HitCoverage=8%, E-value=6e-10, Identity=50%"; Hit description=Zinc finger, BED-type predicted
MYETDKKQLKVLLKNVSNIILRVDMCKSSHQVVEYMILTSHFIGAGNLKDNLSLSTKLVLNGDLSHVRCAYILNLLVQDGLSKIWDIVHNVRESVKYINYTNSR

SEQ ID NO: 232221 - protein, 74 aa, Glycine max
  Coding DNA Sequence Number=SeqID_115443
MSNLNGIHINSAHRAKVTPKCKENHPKMLPIESLNMPPQAAMPCTHLAAPSELHFVHSQRGSLFDPSLTHIFPP

SEQ ID NO: 232222 - protein, 107 aa, Glycine max
  Coding DNA Sequence Number=SeqID_115444
  Homolog annotation: Hit_ID=Q2QNZ9; Match level="QueryCoverage=55%, HitCoverage=6%, E-value=6e-13, Identity=58%"; Hit description =Expressed protein
MKAARSSMLLEFDLGSSTSYCPKHMVLWPECGWQSVCVNDLITVAAIRKVYKKVTLCTHPDKVQQKLIEVRGLFATSSVSWLDLLDVILQILRYDLIEVRADQDTFP

SEQ ID NO: 232223 - protein, 141 aa, Glycine max
  Coding DNA Sequence Number=SeqID_115445
MSGFTCDSPQSSASPHQLDLAPYASGPYNAQWNAPGLLHDKHTLRSSRILGEMEVDEPWLRLSRYKIHFLVGVLVYAKGMAFVDNWAVGKEKVCYWLSNDIVGLVGNLATHIDPFTGKDQIRKALKVPLELPGSPPLGVFF

SEQ ID NO: 232224 - protein, 212 aa, Glycine max
  Coding DNA Sequence Number=SeqID_115446
  Gene Ontology: Mol. function=serine-type endopeptidase inhibitor activity
  Homolog annotation: Hit_ID=P01070; Match level="QueryCoverage=84%, HitCoverage=84%, E-value=4e-45, Identity=53%"; Hit description =Trypsin inhibitor A precursor
  Pfam annotation: Domain name=Kunitz_legume; Domain location=27-196; Score=222.1; E_value=1.3e-63; Accession=PF00197.9; Description =Trypsin and protease inhibitor
MKSSTLFALFLLSAIFTSYLPSATADVVLDTDGGVLQNGGQYSVLPVMRGSGGGLVVRATGNERCPLTVAQTRNELDKGIGTIISSPLRVAVIAEGHPLSISFGFFPVMPSCIPLTGDWGIVDGLPEGPAVKLAEYKNIVDGWFKIEKAHPLGYKLLFCPLLEGSTCGDIGIQTDDDGIRRLVVTKNNPLLVQFQKIGWILTKNNLLLPGSE

SEQ ID NO: 232225 - protein, 172 aa, Glycine max
  Coding DNA Sequence Number=SeqID_115447
  Pfam annotation: Domain name=DUF593; Domain location=12-71; Score= -26.6; E_value=0.027; Accession=PF04576.6; Description=Protein of unknown function, DUF593
MEAANGVVSKKIEALERENAAKKDEIRRLKKEIDSLRREAAELRDSETSAALKNLLEERERTVTFLERETESLKQLKAESEMKVRDLERKLSVVEVRESEERSKRVRAEEETKEKVGEKEREIEEMRQRIEDLEKVRVVEMREKGERVDGEWTKWLGIVWPVVATGSGAVAA

SEQ ID NO: 232226 - protein, 645 aa, Glycine max
  Coding DNA Sequence Number=SeqID_115448
  Gene Ontology: Mol. function=protein serine/threonine kinase activity; Cellular component=nucleus; Biological process=protein amino acid phosphorylation
  Homolog annotation: Hit_ID=Q5ZCI1; Match level="QueryCoverage=93%, HitCoverage=98%, E-value=0.0, Identity=67%"; Hit description=Mitogen- activated protein kinase 10
  Pfam annotation: Domain name=Pkinase; Domain location=23-314; Score =296.4; E_value=5.3e-86; Accession=PF00069.15; Description=Protein kinase domain
  Pfam annotation: Domain name=Pkinase_Tyr; Domain location=23-312; Score=33.3; E_value=1.6e-14; Accession=PF07714.7; Description =Protein tyrosine kinase
  Pfam module annotation: Pfam domain module=Pkinase::Pkinase_Tyr; Domain location=23-314::23-312
MLNMLQSSAEMDFFSEYGDANRYKIQEVIGKGSYGVVCSAIDTHTGEKVAIKKIHDIFEHISDAARILREIKLLRLLRHPDIVEIKHIMLPPSRKDFKDIYVVFELMESDLHQVIKANDDLTKEHYQFFLYQLLRALKYIHTANVYHRDLKPKNILANANCKLKICDFGLARVAFSDTPTTIFWTDYVATRWYRAPELCGSFYSKYTPAIDIWSIGCIFAEVLTGKPLFPGKNVVHQLDLMTDLLGTPSLDTISRVRNEKARRYLTSMRKKQPVPFAQKFPNADPLALRLLEKLLAFDPKNRPTAEEALADPYFKGLAKVEREPSCQPITKMEFEFERRRVTKEEIRELIFREILEYHPQLLKDYMNGTERTNFLYPSAVDQFRKQFAHLEENGKNGPVMPLDRKHVSLPRSTIVHSNTVHPKEQTNIASSKNRPTAEEYNKHPRDTEIPVPRSMQGPQRIPLAKPGKVVGPVVPYEYGNIVKDSYDPRSFIRGSVLPTQPVPPAYYYQRSSTGNQERPSTEADKSVPLQAKHAQQCGVNAKMAPDIAINIDTNPFFMTRAGVNKLEQGDQIAIETNMLQPKAHQYGGISAAAGATAHRKVGPVQYGGAILVEKKELFRDGAAVVSGDGLYKNERVRGLLEAVLP

SEQ ID NO: 232227 - protein, 91 aa, Glycine max
  Coding DNA Sequence Number=SeqID_115449
  Subcellular localization annotation: CTP_CleavageSite=22; ConfidenceScore=5.36e-01
MAATTTRAKALCFYFLHASMISAATTRATKMFTRRRATGEGQTGGQLIESLRENLIENYPRRKSLAWVDSTSMDQSLEQEVRDFKKSLTRN

SEQ ID NO: 232228 - protein, 55 aa, Glycine max
  Coding DNA Sequence Number=SeqID_115450
MSCEGVVVEKGFEDNKVDAGKWVGEQVIPLKDKVQVTVDLRVLESRYNRKLGIFQ

SEQ ID NO: 232229 - protein, 96 aa, Glycine max
  Coding DNA Sequence Number=SeqID_115451
MVPVSEQRKTVLIPRGRTQTLMHKTDMGFYEGSTTAHHVPLGNDMVKVGVKEVRDVDARVHVSTEEDKQVPKRPIKPADRSEPDDNLIYQMALMTP

SEQ ID NO: 232230 - protein, 220 aa, Glycine max
  Coding DNA Sequence Number=SeqID_115452
  Gene Ontology: Mol. function=DNA binding; Biological process=DNA integration
  Homolog annotation: Hit_ID=Q2C9E4; Match level="QueryCoverage=48%, HitCoverage=38%, E-value=1e-21, Identity=52%"; Hit description =Putative transcriptional regulator, Fis family protein
MEIKLHANATTTPRIRRYLQQSDKSDRELAVELGISVTTVRRWRNRDRVSDNHTTPKVIHKALRQEQVALVNALRDISGAPLDELLQIVNDILGIPVSRATLSRYLKPAPAKQKGASLQGKKALKAGIRPHTLLLYHQPLSLHMDDGGEQHLLWAREPVSGCCSLPGRARCWRPAPLIYNLLRLSVLNRRCLHKTLLLTLIHTSTMRCRWRYRSGILFRE

SEQ ID NO: 232231 - protein, 226 aa, Glycine max
  Coding DNA Sequence Number=SeqID_115453
  Gene Ontology: Mol. function=arsenate reductase (glutaredoxin) activity; Biological process=response to arsenic
  Homolog annotation: Hit_ID=Q5PL40; Match level="QueryCoverage=50%, HitCoverage=95%, E-value=4e-46, Identity=78%"; Hit description =Putative arsenate reductase
  Pfam annotation: Domain name=ArsC; Domain location=48-159; Score =160.1; E_value=5.7e-45; Accession=PF03960.6; Description=ArsC family
  Subcellular localization annotation: CTP_CleavageSite=24; ConfidenceScore=5.28e-01
PARRSNSAACNRPATTRVSTSCVVCNNALSRTRRCNQGEVMTDAVKIYHNPRCSKSRDTLSLLKSNGIDPDVVLYLDTPPDAQTLRQLLHMLGMGSARELMRQKEDLYKSLNLDDTYLSEDQLIQAMVENPKLIERPIVVANGKARIGRPPEDVSTSSSPYAAALPETPAAYFLPVFSAFYPALTTTSCAGSVGSKPKVSTDCISAGQASSSARVQVVSNCGERPA

SEQ ID NO: 232232 - protein, 119 aa, Glycine max
  Coding DNA Sequence Number=SeqID_115454
MQRNFELESVAFWVTGSSNSFLHSLWVIILIRGTAYTMVIDQSLFYDLTKLPSEGVPFEGALIDEWKFDFSVHDARRLVCTNQADMTGRLLAGSLAFECRILHYLIVCILLPRSSNLAQ

SEQ ID NO: 232233 - protein, 194 aa, Glycine max
  Coding DNA Sequence Number=SeqID_115455
  Homolog annotation: Hit_ID=Q47522; Match level="QueryCoverage=29%, HitCoverage=77%, E-value=2e-19, Identity=74%"; Hit description=LacZ protein
VLQWLLFLSAVPPVQLLTGWCVTAKAPPDISAGKCSGHAARRVPFAIQAAQLLGRAIGAGLFAITPAGERGMCCKAIKLGNARVFPEASTAKYIVQQYIAATGGQPALNAVDSMCVTGQIKISASDFIKLIDTVDLEGGPVGKPVVPAALMNRPTRGERRFAYWALAECILAYYVGTDEGVSEVLHVAGEKRLH

SEQ ID NO: 232234 - protein, 62 aa, Glycine max
  Coding DNA Sequence Number=SeqID_115456
  Subcellular localization annotation: CTP_CleavageSite=23; ConfidenceScore=5.07e-01
MNVDSQIMIDLAFGTNCNSNNPPASRYFTMESSLRVLIVVCGEILVVNLLNITVKFHTVGYF

SEQ ID NO: 232235 - protein, 66 aa, Glycine max
  Coding DNA Sequence Number=SeqID_115457
MQEVECNGKHSANVSICSLSASVSLSQHSVTCALSEFYNSDWSATSAKQAMNGVKAKLHDESTMIQ

SEQ ID NO: 232236 - protein, 80 aa, Glycine max
  Coding DNA Sequence Number=SeqID_115458
MLKFNLVCRPKKRRYKKMLMNSLTKVDWLNKPYPLSEAVSSLSGCKTLEEDESEISSLSVQPARPARMLSLLVLSAHKVA

SEQ ID NO: 232237 - protein, 371 aa, Glycine max
  Coding DNA Sequence Number=SeqID_115459
MASKKRRASSCRPQEPYDTSRFVSEVAWERYETNVHNMNILPARNVELVYSYYNEFLRELERRQWHRALTRQMDNHIDLALVKEFYANLYDPEDRSPRQCKVRGKLIKFNAATLNAFLETPVVLQLGERYSAYSRFCHTHLDAQELASKVCIPGKDMTTLVQTLSVLSYSNLAPTSHTSDLNMDRARLVYGLVMKMDMDSNSSRLDFPALLTALSIARGVVSDSLTFESLSPTINLAYIRKNCWNPDDPTITFPRSREAKARAPSDASSSIPAPTPAPVPPTPAPTPAPSIHNLAQQRPIIRIEDFMAQVAWLGVQPSFSGEETPEETPADTPMEATKEEGAAKAGIDEDYVEDVTVAQGDLRSMAYFSLR

SEQ ID NO: 232238 - protein, 146 aa, Glycine max
  Coding DNA Sequence Number=SeqID_115460
MEREKFDHLEERLRAIEGGGDYPFVDMAKLCLVPNVIIPPKFKVPNFDKCFYTTCPKNDLKMYCRKMGAYAKDKKLLMHFFQREFDRGSNHLYEKMVGYYRNLSFGRRATRDSLVHLPRKENAWSRHQCLFEENIGKTRKDVVYEL

SEQ ID NO: 232239 - protein, 437 aa, Glycine max
  Coding DNA Sequence Number=SeqID_115461
  Homolog annotation: Hit_ID=Q4ALU5; Match level="QueryCoverage=44%, HitCoverage=69%, E-value=4e-32, Identity=37%"; Hit description =Probable glycosyltransferase
SEKGLLPESVLAFKEYGLEIKACEDLKSYKKIIPLLKEDSNSFIVTADDDLYYPDNWLNDLIGAWNGNYKTVVAHRAHKILLNQDGMPVPYSKWEWEYNLSTDESSLIFPTSGAGVLYPPHCFYRDVINENLFSKLSPGADDVWLYWMCRMNGVKFKVVGKKMELLEWEGITEKPLWHENLLNGGNDNNINKMIAHYGLKTNDDEQGYDGSFEDIFSFSCENQLVRMHLPNKNDYIQNVIKSTGTFYEPEMLLDISNRVKKGSTILDVGANIGNHTLYFSLFCGANKVISFETQKNVYDTLCENIKLNFLEEKIVAYQIGLGSYETTANLGAVDEKNIGMTKLDINSSGDVRIATLDSVVEKEPLNSISVIKLDVEGMEMEVLRGAIQTFERHQPVLYVEAASKKEFDEVSAFLLSFNYIPTRRFNATATYLFEKKI

SEQ ID NO: 232240 - protein, 482 aa, Glycine max
  Coding DNA Sequence Number=SeqID_115462
  Gene Ontology: Mol. function=solute:hydrogen antiporter activity; Cellular component=integral to membrane; Biological process =regulation of pH
  Homolog annotation: Hit_ID=Q1XS04; Match level="QueryCoverage=92%, HitCoverage=63%, E-value=1e-146, Identity=59%"; Hit description =Sodium/hydrogen exchanger
MITDIATLLVLAVVVELAGIEAIIGAFFAGLALNRLIPHTSSLMNRVEFVGNAIFIPFFLISVGMLIDFTVFFKSFETLKVAAIMLVASIGGKYISAVITQKTFRFTKEEGKLIFGLSSASAAATLATVMVGYNIIVSETETGEPVRLLNEHVLNGSILLILISCTISSFVSMASAQKIAETDNEDTVSGNSHEEESLLLAINHQETVERMVNLGILIKAHSNTEDFFALNVINEDKNESSVKNAEKLLHQATDAAASADVKLQPLKRYDNDVVNGVNNVIKEQEITDLMIGLEDEKGFSPSFVYNLYNGYLQNDHVNVLVYHAAQPISTIKKYAVMIPENSDKEAGFFHALLRVWNIARNSGATMIFYAPESIIDLLQRIIKKANIEAEFIIMNTWHDGEKTAAGLKEDEALIVFMAKRGMVSYIPQMRLMPELLNKNLKENNYLLIYPFSEYDKNSPEKRSFGNHRDFIEIGNVIQKIFK

SEQ ID NO: 232241 - protein, 370 aa, Glycine max
  Coding DNA Sequence Number=SeqID_115463
  Gene Ontology: Mol. function=transposase activity; Biological process= transposition, DNA-mediated
  Homolog annotation: Hit_ID=Q18PD1; Match level="QueryCoverage=97%, HitCoverage=85%, E-value=1e-152, Identity=73%"; Hit description =Transposase
  Pfam annotation: Domain name=Transposase_mut; Domain location=1-341; Score=455.1; E_value=9e-134; Accession=PF00872.9; Description =Transposase, Mutator family
MEADVDGLIGAGRYERSGERSTYRNGYRERSLDTRLGSLNLKIPKLRTGSYFPGFLEPRKTVEKALVAVIQEAWIAGVSTRRVDDLVQAMGLSGISKSSVSKLCKDIDERVNAFLKRPLSGAWPYLWLDATYLKVREGGRIVSVAAIVAVAVDTEGRREIIGLHIGPSEAEVFWTDFLRDLVKRGLSGVQLVISDAHEGLKAAICRVLKATWQRCRVHWTRNALAYVPRAQQTMVAAGLRHAFQQPDQEAARAALHHLAEQLHNRWPKLKGFIDATSEDVLAYLTFPLQHRTKLHSTNPLERLNKEIKRRADVVGIFPNTDSIQRLIGAVLLEANDEWQLQHRYMQIEGMAGFTPSLLDDTLTAIPPQAA

SEQ ID NO: 232242 - protein, 77 aa, Glycine max
  Coding DNA Sequence Number=SeqID_115464
MFNNCCFETHVILWHHQNISLILCLQLRLMSVEIKSESTDKSFKLNGHRLKPFLTNPSLVDVVVEETSLLHPTSFLP

SEQ ID NO: 232243 - protein, 156 aa, Glycine max
  Coding DNA Sequence Number=SeqID_115465
YTMNSVITVLYFNGRVYEDNDGVIFEGKYIALLICDDEDVDMMLESFKQQQEMSVLELYIEKDVASGSMFHSANSLTSCGNYLSNDDTQSPTNMSNLNLDEDDDHDDDDYLVSNSYVEESLDEDDSVDGISDTDNEVPDMIPPVRIVHPAEGVISS

SEQ ID NO: 232244 - protein, 150 aa, Glycine max
  Coding DNA Sequence Number=SeqID_115466
AVDESESAADKRMARKKRILRDLQREHTLKLHENEDLRNKLAAVNLTIDKKRATAKNIKKIKLGIIKSRGTLEIAQAILNPPKSVEAQCDTPNLGSEKTVEDQILEPVCSAANVPSNKREIGARKRPLLLPDLNQPPEEYLNTEFLGFSQ

SEQ ID NO: 232245 - protein, 582 aa, Glycine max
  Coding DNA Sequence Number=SeqID_115467
  Gene Ontology: Mol. function=enzyme inhibitor activity; Cellular component=cell wall; Biological process=cell wall modification
  Homolog annotation: Hit_ID=Q1STF3; Match level="QueryCoverage=99%, HitCoverage=100%, E-value=0.0, Identity=69%"; Hit description =Pectinesterase; Pectinesterase inhibitor
  Pfam annotation: Domain name=PMEI; Domain location=53-206; Score =125.6; E_value=1.4e-34; Accession=PF04043.6; Description=Plant invertasepectin methylesterase inhibitor
  Pfam annotation: Domain name=Pectinesterase; Domain location=255-555; Score=640.8; E_value=1.1e-189; Accession=PF01095.10; Description =Pectinesterase
  Pfam module annotation: Pfam domain module=PMEI::Pectinesterase; Domain location=53-206::255-555
MSEGNAGKGKRIAIIGVSTLLLVAMVVAVTIGVNLNENGSNNDIEDNKKNHVASSIKAVQTLCHPTNYEKECEESLIAGAGNTTDPKELIKIFFNITITKIGDKLKETNILHEIEEEPRAKMALDTCKQLMDLSIGELTRSLDGINEFNLINVDKILMNLKVWLSGAVTYQDTCLDGFENTTSDAGKKMKDLLTIGMHMSSNALAIVTDLADTVNDWNITKSFGRRLLQDYELPSWVDQHRLLNENASPFKRKPNVTVAIDGSGDFKSINEALKQVPEKNRKPFVIYIKEGVYQEYVEVTKKMTHVVFIGEGGKKTRISGNKNFIDGTNTYRTATVAIQGDHFVAINMGFENSAGPHKHQAVALRVQADKSIFYNCSMDGYQDTLYAHTMRQFYRDCTISGTIDFVFGNALAVFQNCTFVVRKPMENQQCIVTAQGRKERQQPSGIVIQGGSIVSDPEFYSVRFENKAYLARPWKNYSRTIIMDTYIDDLIDADGYLPWQGPEGPSGMDTCFYAEYHNIGPGSDKSKRVKWAGIWNLNSKAARWFSPSKFFHGTDWIEVTGIPCFPGVPKHHRHKKTILNWQ

SEQ ID NO: 232246 - protein, 68 aa, Glycine max
  Coding DNA Sequence Number=SeqID_115468
EHFLDVFRNLLYLSNHFCNLPVDGRVRRKAKGHFGAVIARPSELKLSVEAMSSPRQDGARLGKLVSSP

SEQ ID NO: 232247 - protein, 103 aa, Glycine max
  Coding DNA Sequence Number=SeqID_115469
MENLGFRFSRSHSHLVYEQEEVWKVCYFVRMRIMIVVGRWNCLLFACKLGFFLKSVEVANGCGPFVRPTEEQTVRLKIHHGGMFIYQPLTVYINGQIEEEEWG

SEQ ID NO: 232248 - protein, 863 aa, Glycine max
  Coding DNA Sequence Number=SeqID_115470
  Gene Ontology: Mol. function=calcium ion binding; Cellular component =nucleus; Biological process=regulation of transcription, DNA -dependent
  Homolog annotation: Hit_ID=Q6NPP4; Match level="QueryCoverage=91%, HitCoverage=75%, E-value=1e-172, Identity=45%"; Hit description =Calmodulin-binding transcription activator 2
  Pfam annotation: Domain name=Ank; Domain location=549-581; Score=1.3; E_value=20; Accession=PF00023.20; Description=Ankyrin repeat
  Pfam annotation: Domain name=Ank; Domain location=582-614; Score =31.4; E_value=3.2e-06; Accession=PF00023.20; Description=Ankyrin repeat
  Pfam annotation: Domain name=IQ; Domain location=758-778; Score=23.3; E_value=0.00086; Accession=PF00612.17; Description=IQ calmodulin -binding motif
  Pfam annotation: Domain name=TIG; Domain location=348-434; Score =15.6; E_value=0.026; Accession=PF01833.14; Description=IPTTIG domain
  Pfam module annotation: Pfam domain module=Ank::Ank::IQ::TIG; Domain location=549-581::582-614::758-778::348-434
MEKKMKIFRGEAIGCLNRFFTFQVNKTNVGGKTYSDEVTSDSQKSSSLSSGFPRNYGSVPSGSTDSMSPTSTLTSLCEDADSGDHGQLPVSGAEYIPHVLGDKSRASDTTYIEGQRAQGIASWDNTMEQSAGEYADPSLVSSTTIPSSAVGNILEENHTVPGKLLGRKNALTEEERGSQPVQSNWQIPFEDNTGELPNWGFTQSLGLEFGSDYGASLLGDVTNNAGPEIVPELFTFNGELKEQSVHQNFSKLYTHGQSQPTLKSNSEYEVPGEASINYALTMRRGLLDGEESLKKVDSFSRWMTKEFAGVDDLHMQSSPGISWSTDECGDVIDDTSLNLSLSQDQLFSINDFSPKWAYAESEIEVLIVGTFLKSQPVVAKCNWSCMFGEVEVPAEVLADGILCCQAPPHKIGRVPFYVTCSNRFACSEVREFEYREGFDRNIQFADCFNNSTEMVLHLRLVGLLSLNSVRTSNQVFEGDMDKRSLIFKLISLKEEEEYSSKEETTAEMDISKHKLKELMFHKQVKEKLYSWLLHKVTETGKGPLVLDEEGQGVLHLIAALGYDWAINPIITAGVNINFRDVNGWTALHWAAFCGRERTVAVLVSMGAAAGAWTDPCPEFPSGRSPADLASSKGHKGISGFLAESLLTGHLESLTMDENKDGRKETSGTKVVQTASERTATPVLYGDIPDAICLKDSLNAVRNATQAADRIYQVFRMQSFQRKQFAQYEDDEFGLSDQQALSLLASKTCKSGQGEGLANAAAIQIQKKFRGWTKRKEFLIIRQRIVKIQSQRTSPGAAVKLCLGDLLVMGSNPETVSLHMQVSPDNIALEGSIDENLGFKYFAISVCPLYNLHARRDHVGCQYW

SEQ ID NO: 232249 - protein, 231 aa, Glycine max
  Coding DNA Sequence Number=SeqID_115471
MGAGWSGVCCGGLLLLSIPAAGKPTFSLRLDNKNKLKQGIGFVTHTVEQSRKALKTGGGDDGGGGGFGGGGGCGGRDFVAMAMARKSDSRAIGATVLSSGWWETAKGGGANVGVVVGCGLGKDGDVVGVVKVSTGGGASVGDELGGKGVSMRADSRSRMTSSLTIISRVLVVISKVWVVMEDRFKVEAAIGGNHGWQEHEQLGSNAGPQVAVIQAENRIFGRRKEARRGYE

SEQ ID NO: 232250 - protein, 251 aa, Glycine max
  Coding DNA Sequence Number=SeqID_115472
  Gene Ontology: Cellular component=integral to membrane
  Homolog annotation: Hit_ID=Q9FEG2; Match level="QueryCoverage=90%, HitCoverage=92%, E-value=8e-68, Identity=50%"; Hit description=TOM1 protein
  Pfam annotation: Domain name=DUF1084; Domain location=12-251; Score =458.3; E_value=9.8e-135; Accession=PF06454.2; Description=Protein of unknown function (DUF1084)
MAFGLRTKSFGFIEGEGEFVGALQWWNQIDDSDQWQRGTYYALCAAYTLVSFVALVQLVRIQMRVPEYGWTTQKVFHLMNFVVNGLRAVLFGLYRNVFAIRPKALEQVLMEVPGLLFFSTYALLVLFWAEIYHQVCLWIYMSVSRTAAGLGAAKLFLAVISFFAALGFLLYGGRLFFLLRRFPIESRGRQKKLYELAFSAFDENADLDVLDHPILNLVYYLLVEIVPSTLVLFILRKLPPRRVSDQYHPIR

SEQ ID NO: 232251 - protein, 320 aa, Glycine max
  Coding DNA Sequence Number=SeqID_115473
  Pfam annotation: Domain name=zf-CCHC; Domain location=192-209; Score =7.9; E_value=0.049; Accession=PF00098.13; Description=Zinc knuckle
MAWEKLSSLAPTSGTCDQESSSSSLSYHDTDTVIDVFRAWKEQDHFLLAWLQSTIFSDILVTNPHGSYGTGFNHTFNCLLELNLVNELTFIGESMPTFEHLNPILDGFPNEYDSSIFVINTGFDPLSINENAFDPNFAPVMNPNSQGQVNLTTQSSSSENSSNDYGGTHFFNGCGGRNSGRGGVGRGRFADVQCQICYKFGHVTSFCYHRLKENYVPTLPPTTSLAPAFAQTASTQFVQWTSIIPAQQVQYAQPVQYIIPSLHGNAQPYIVVVQHQLADIQPPLQTNHQVSQQQANPQVYLTSSSVPSQNWYPDSSASHH

SEQ ID NO: 232252 - protein, 136 aa, Glycine max
  Coding DNA Sequence Number=SeqID_115474
MAVNYDGENRLFPKFTLAPVAFDQLLSTMEESIVFYVESALLTIASAIARTIKVGHLSILNMDRGRFGRVCMLRNGFESVQKAAQGIVPGADTGLVPSTTQPSPDKRLKTGRPHMGSGLLLLGKNENRKRIRWRRK

SEQ ID NO: 232253 - protein, 146 aa, Glycine max
  Coding DNA Sequence Number=SeqID_115475
MKSECEWGSGVGRVMFLGKEGWCCDWSRCHAWRHQHWRLRGGDDTWHVAIVIGDTGCMSPLRCRRRLQHLLLVRRSWMVPPMLASCVWEGVANRGSAFSLVDKYPQVQRGWLRFLVKYLCREGEKRGCFVSREVAGGAQTLCSSIF

SEQ ID NO: 232254 - protein, 112 aa, Glycine max
  Coding DNA Sequence Number=SeqID_115476
  Subcellular localization annotation: CTP_CleavageSite=68; ConfidenceScore=5.46e-01
MQQPFNAGFLKTALKTAFQICGHVTPSHKLSAYIPLSSFQLQTSNSNPIPNLSLSNGIHQTPASIFISLDRERERERERACGVGIMFSDCTDGSVYGHQRIADLVESFESHR

SEQ ID NO: 232255 - protein, 328 aa, Glycine max
  Coding DNA Sequence Number=SeqID_115477
MSSRKRKSIDARPTTQYDIRRFHSFEAWTRYTDNVLGRHILAERKVEIYHTELDEFKAELERRNFHKRLTNLADSSIDLALVKEFYANLYSPKGPSPEQVRIRGHLIKIDADSLNTFLETPVVLAEGESLPAYSRYCRMPTDIGEIEAALCIPSRGVLSYSNLAPTSHTSDLTLDRARLIFGLVSQLDMNVGALISSQITSMAQSNSSRLGFPALITALCRSRGVASDSLVFERLRPVINLAYIRKNCWNPADLTVTIRGARRARARPAEAPSTSAAPPLTRTLAAPSTPSSADFQHSIPSVERFNEWVAWPGTQPPLHREDEGLIAQ

SEQ ID NO: 232256 - protein, 32 aa, Glycine max
  Coding DNA Sequence Number=SeqID_115478
MEMNALAYLFGLRRLVVGSGGQSVVMMDLQLA

SEQ ID NO: 232257 - protein, 81 aa, Glycine max
  Coding DNA Sequence Number=SeqID_115479
MSKRDKKESLQQNKGSVWANTGRGDLSHERLGVHRPRRGDLSHDDHRRTTQSSEVTRVLFESRDYTDAPTTMVFTKAKSSK

SEQ ID NO: 232258 - protein, 98 aa, Glycine max
  Coding DNA Sequence Number=SeqID_115480
  Homolog annotation: Hit_ID=Q10SS1; Match level="QueryCoverage=97%, HitCoverage=15%, E-value=2e-21, Identity=46%"; Hit description =Expressed protein
MDENWEATRKMVAGRFVNAYSRTDWMLGVAFRARNTNIALEPYFKWKFLLTKGLAGIQPVDIPGIQNVDVTEHIEGHSSYLWATQKILDQLQLDTYYP

SEQ ID NO: 232259 - protein, 108 aa, Glycine max
  Coding DNA Sequence Number=SeqID_115481
  Subcellular localization annotation: CTP_CleavageSite=89; ConfidenceScore=5.20e-01
MQVGTIGNIVSISGPFLTKLSAPYPLLLPLFWTMESGVPFLDCLLQNTLRSICSFPTSSTSSKWVYAVFWRIVPRNFPPPRWEFGGTALDRSKGNKRNWQVWWNCDKP

SEQ ID NO: 232260 - protein, 108 aa, Glycine max
  Coding DNA Sequence Number=SeqID_115482
MRCWLEWVSRWFLPLPPESPPSVDVNLSYLAFIGPFPVDLNPVLYPPLSLAMAISAVPKITPCVCVQAKSYIGADGDGGASHSSGNTLDKSLIVLKKKKKKNLYAPII

SEQ ID NO: 232261 - protein, 89 aa, Glycine max
  Coding DNA Sequence Number=SeqID_115483
  Gene Ontology: Mol. function=oxidoreductase activity; Cellular component=endoplasmic reticulum; Biological process=electron transport
  Homolog annotation: Hit_ID=O81117; Match level="QueryCoverage=62%, HitCoverage=13%, E-value=2e-10, Identity=49%"; Hit description =Cytochrome P450 94A1
MCATVAGLPVMTWRRPMGRWRVNVVAGEILTMSDSHWIRRGYGFGIVMLLLVGHEDVRKKKKNTGKMKKRKKGANSCKFRSISIIFPKF

SEQ ID NO: 232262 - protein, 79 aa, Glycine max
  Coding DNA Sequence Number=SeqID_115484
MGCQLPKKMVYGVRPSVDEYDKLIQSLWLEALDCKMTEKVHEEMKGSGLRVKGITGGLIRVVKETKKEVVEAESITTVA

SEQ ID NO: 232263 - protein, 561 aa, Glycine max
  Coding DNA Sequence Number=SeqID_115485
  Homolog annotation: Hit_ID=Q6D5S6; Match level="QueryCoverage=48%, HitCoverage=35%, E-value=1e-132, Identity=81%"; Hit description =Putative molybdopterin oxidoreductase
  Pfam annotation: Domain name=PTS_EIIC; Domain location=324-560; Score= 42.9; E_value=1.1e-09; Accession=PF02378.9; Description =Phosphotransferase system, EIIC
RTDVAGHRRHHFQRLLRIGKTFQAALAQGIEGHNSGAVIGGVTQAVQHARMVGAGVLAKDKNRISVVEIVQANGAFTDANATFQSGAAGFVAHVGAVREIVGAQHAAKQLVQPRGFIAGATGGVQLQLIRMIHCQQMLRDQRKGVIPANRFIVIGRAVVAHRVGQTALILKEIVALLIQSADAVLGKKFWLDDAACRFPGHGFRAVFTEAKSALVIIAPGTARAVKAARLVHAHQVTHVFQGSFTVKDKTGGGFQRAPAASSGAIGLNLTFKFHDSRRLIVYELLSEYDFCWGKSVIGIINYPLPRAGGARSMKQLASQVHAFGKALMMPISVIAAAGIFLGLAAALQNPAITGEAFASLQVPQLIIGFIRKVAGALFANLPVFFAVASAIGLAKAEKPTAAFAAVIGYIAMNVGISATLAAKGLTAATTTPEALQQAGMDQTSAMMTSAEYIDMLGIFTYNMSVLGGVIAGLLTVMLHNRFYTQQLPTAISFFGGRRFVPIVTVVVLPLTGVLLALIWPTIGQGIAWVGQMIGKSGQYGAFLLGACERLLIPTGPASHPQ

SEQ ID NO: 232264 - protein, 226 aa, Glycine max; identical to SEQ ID NO: 122407
  Coding DNA Sequence Number=SeqID_115486
  Gene Ontology: Mol. function=transcription factor activity; Biological process=regulation of transcription, DNA-dependent
  Homolog annotation: Hit_ID=Q1MF05; Match level="QueryCoverage=91%, HitCoverage=97%, E-value=1e-70, Identity=67%"; Hit description =Putative TetR family transcriptional regulator
  Pfam annotation: Domain name=TetR_N; Domain location=41-87; Score =62.6; E_value=1.3e-15; Accession=PF00440.13; Description=Bacterial regulatory proteins, tetR family

SEQ ID NO: 232265 - protein, 78 aa, Glycine max
  Coding DNA Sequence Number=SeqID_115487
  Gene Ontology: Mol. function=O-methyltransferase activity
  Homolog annotation: Hit_ID=UPI00006DBCE3; Match level="QueryCoverage =94%, HitCoverage=33%, E-value=3e-21, Identity=71%"; Hit description =COG4122: Predicted O-methyltransferase
MAHPTNEAFRVMSDEEQTRLLQSKTDYRELYGHLKDVPLAVSRETGKLLYMLARSSRAQHIVEFGTSFGLSTLHLAAA

SEQ ID NO: 232266 - protein, 178 aa, Glycine max
  Coding DNA Sequence Number=SeqID_115488
MSRARRLHSLQRAAFRHGEIIGIQLRRTGKGRQLLPLFIHLFGIPVRARKVSRAGGGDIRLRIKHIQRRFTLNLHHHHIAVQPVAAVAFQQMKLPAGIINDTRGILRDELLKFLRLHARPQRQIVGTENARGAAAGIKARATRQRTVRILCQQIEMGENCRAPREGCQLAPLAEQRVR

SEQ ID NO: 232267 - protein, 113 aa, Glycine max
  Coding DNA Sequence Number=SeqID_115489
  Homolog annotation: Hit_ID=P28904; Match level="QueryCoverage=41%, HitCoverage=8%, E-value=5e-08, Identity=53%"; Hit description =Trehalose-6-phosphate hydrolase
MEIESEAALNVFYPQPDIATASAADFARAHRDTKQMYEEWKQLASFSGSPQLYTDYLAVAECGTLKRRCLTVITHQYLPVAFNFRQQQWLRAVTQVRHHQQAFTRRIATITPD

SEQ ID NO: 232268 - protein, 303 aa, Glycine max
  Coding DNA Sequence Number=SeqID_115490
  Gene Ontology: Mol. function=chitin binding; Cellular component =extracellular region; Biological process=chitin metabolic process
  Homolog annotation: Hit_ID=UPI000044A8F0; Match level="QueryCoverage =94%, HitCoverage=99%, E-value=5e-46, Identity=30%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
GLHALAFRGLHALAFRGLHALTFRGLHVLAFRGLHALAFRGIHALAFKGLHALTFRGLHAITFRGLHVLAIRGSYALAIRGLRTLAFRGLHVLTFRGLHGLTFRGLHVLAFRGLHALAFQGLHVLTFRGLHALTFRGIHVFTFRGLHVLTFRGLHTLAFRGLHVLTLRGLHTLAFRGLHVLAFSGLHVLAFTGLHAFTLRGLHALAFRGLHILAFRGLHILTFRRLDALAFRGLHALTFRGLHILTFRGLHALAFRGLHALAFKGRHVRDFRGLHALAFRGLCVLTFSGLHIRTLREFKVLYP

SEQ ID NO: 232269 - protein, 101 aa, Glycine max
  Coding DNA Sequence Number=SeqID_115491
YYYYYYYYYYYYYYYYYYYYYYYYYYYYYYYYYYYYYYYYYYYYYYYYYYYYYYYYYYTHIYKGESLRFRTCTFEKKTHSAKSSWKMLKDDCDRSAHVIKF

SEQ ID NO: 232270 - protein, 90 aa, Glycine max
  Coding DNA Sequence Number=SeqID_115492
  Subcellular localization annotation: CTP_CleavageSite=21; ConfidenceScore=5.22e-01
MTMTTTMIGMVLVLTGMVAVVVSTVVVVTIMMMTVVMTMTITIKRTMSNAKFSYIHLIKQQLKPLLCITKCTTTQIVAKGKKQERPCAMN

SEQ ID NO: 232271 - protein, 41 aa, Glycine max
  Coding DNA Sequence Number=SeqID_115493
MVVIQKPSTEVNNGAVLATDGADINAKMRSILVDWLIEVHR

SEQ ID NO: 232272 - protein, 708 aa, Glycine max
  Coding DNA Sequence Number=SeqID_115494
  Gene Ontology: Mol. function=nucleic acid binding; Cellular component= beta-galactosidase complex; Biological process=DNA integration
  Homolog annotation: Hit_ID=Q0KIN0; Match level="QueryCoverage=95%, HitCoverage=61%, E-value=5e-68, Identity=50%"; Hit description =Integrase core domain containing protein
  Pfam annotation: Domain name=rve; Domain location=106-235; Score =12.2; E_value=0.00057; Accession=PF00665.16; Description=Integrase core domain
  Pfam module annotation: Pfam domain module=RVT_2::rve; Domain location=338-538::106-235
MATIEAYCRKKAQEPSKSANVAQVTSITSSASPDSPPDVTISAYDYHDFLQFQAAQQSASPITIMAQSSNLVAFISQSPSLGPWILDSGASNHMTGNQSLFTQLSLSDSLRSVTLADGSQIKSPWHWIGIPNGRLEQDIRRLHRLSLLVTCVSSSADLAHSVLGILHQTSCAHTPQQDGVVERKNRHVVETTCTLLLHHKVPLCFWDDAILTACYLINRMPSSILNNQIPYNILYPQHDLYPVLLRVFGCTTDVSFFESSPFFSEDADSLTHLDDQPDVSVAAPAAVADPPPLLVYRRREEHPQVVPHTDPLAPSPAPNSNLATPPTHEPPLPEFPIAIRKGIRSNCNPAPLYAFGCQWVYTVKVAPDDSIYRFKARLVAKVYTQIYGLDYGDTFSPVANMTFVRLFLAMTATPVYMDQTPGFIASSGSHLVCRLRRSLYGLKQSPRAWFGRFSSALIEFGMTRCEADHFVFFLHSSSGLCTYLVVYVDDIVITGDDFNDIFRLKSHLQRQFQMKDLGPLKYFLGIEVAQSAFSLFPNRNMHWTFSLRLGEPLDDPERYRRLVGRLNYLTVTRLDITFPVSVGEARSKIQLLDPVQKLNIALRQQLRVKLHGYNNFFSNSKLETLRELNSCDNQVALCIASNLVFHERIKHIEIDCHFVREKVLSGEITTKFVYSSDQLANVFTKSLKGPQVDYICNKLGANDIYAPA

SEQ ID NO: 232273 - protein, 58 aa, Glycine max
  Coding DNA Sequence Number=SeqID_115495
  Homolog annotation: Hit_ID=Q1S1I5; Match level="QueryCoverage=72%, HitCoverage=6%, E-value=3e-16, Identity=95%"; Hit description=SART-1 protein
MASRARQTSDPKSGFATVEKDLPGGLTPMLGDRKVEHFLGIKRKAEPSSSDTPKKPKS

SEQ ID NO: 232274 - protein, 741 aa, Glycine max
  Coding DNA Sequence Number=SeqID_115496
  Gene Ontology: Mol. function=RNA-directed DNA polymerase activity; Cellular component=chromatin; Biological process=RNA-dependent DNA replication
  Pfam annotation: Domain name=rve; Domain location=371-562; Score =13.5; E_value=0.00044; Accession=PF00665.16; Description=Integrase core domain
  Pfam module annotation: Pfam domain module=RVT_1::rve; Domain location=75-245::371-562
MAERRSKGLCYFCDEPFTPEHGLTHKRLHIHVLEIEDEEEGPGPQQLDANVGTEPDSEPLISVNALKGEPSGLPLCRVGHDHKIPLMQGANPVNKRPYRDLNKATVKNKFPIPLVEDLMDELYGSTIFSKIDLRADYNQVRMDAVDIHKIAFRTHAGHFEYLVMPFGLTNAPATFQGLMNSAFQHYLRRFLLVFFDDILIYNRSMEDHLSHLYQVLLTMRTHSLYAKKSKCYFAVDKVEYLGHFITKEGVSTDPSKIAALKDWALPQNLKQLRIFLGLAVQKWRHYLLPKKFIIRTDHRSLKYILEQRLSTTFQQKWLVKLMEFDFNIEYREGRENMAAYALSRLDSPEIMALQVHQPDSSMLSRIQQSWQKDPILQHLVSDLKSNPSSHKHYTWVRNELRRKGRLVIGSDSQLRQDILFWIHVSACGGHSGLSKAIKMPLAKGVNMTQLHLQACLGLYLFLSMLSKATHFMALSHPYTVADVAQCFLDNVFKLHGFPDTITTYHPQTDGQSEVVNRCLETYLRCMCSDSPTQWSKWLPLAEWWYNSTYHNIIKASPYEIVYGQALLVHLPSLLGESKIALVDRSLQKREEMLKLLKFHMKRAQDRMKQLVDRGRSDRSFQIGDLVYVKLHAYRQVSVQARTNAKLAPKYYGPFPIVDKIGAIAYKLKLALGSMVHNVFHVSHLTKFNGTATVGNFSPSPLLDTSQKEPAAIIDRMTVKRGSRAITKVLVQWKHQLPEDAT

SEQ ID NO: 232275 - protein, 80 aa, Glycine max
  Coding DNA Sequence Number=SeqID_115497
  Homolog annotation: Hit_ID=Q1S1I5; Match level="QueryCoverage=91%, HitCoverage=11%, E-value=1e-31, Identity=89%"; Hit description=SART -1 protein
LTPKEAFRMISHKFHGKGPGKMKQEKRMKQYYEELKMKQMKSSDTPSLSVERMREAQARLQTPYLVLSGHVKPGYDFNNS

SEQ ID NO: 232276 - protein, 157 aa, Glycine max
  Coding DNA Sequence Number=SeqID_115498
  Gene Ontology: Mol. function=RNA-directed DNA polymerase activity; Cellular component=chromatin; Biological process=RNA-dependent DNA replication
MADPVCLAVVHFEGKALQWHSAYIKSVGLENLPSWNEYQILLLDHFGDVCEDPMADLMKLRQTGSIIEYHEEFDSIVSRVDLSDEHQLSCFLGGLKQEVQMIVQMFQPNSIRKAYSLAKMYESSFSNTQAKPFVKNQKSSFVPKPPLLPNLLDQPIL

SEQ ID NO: 232277 - protein, 102 aa, Glycine max
  Coding DNA Sequence Number=SeqID_115499
MESWKVQPSQSKEEITRRRLITDSMWHNVEASAAKEKTMVHNVEVEPVREVEEVIIKVPYSEGVCGDAESLVIVVVMEVRRGGTQAGKVRQSKTKEAKGGGR

SEQ ID NO: 232278 - protein, 98 aa, Glycine max
  Coding DNA Sequence Number=SeqID_115500
MSKYSTWVHKRVGPHIMGKSMSTQIFGQAKYLGSFKSRSFYNGQDCEYLIIRPSRVPSISSWLSVEDSEDSKGLGEHSLLPTMVDVVDGSTSKPICPT

SEQ ID NO: 232279 - protein, 373 aa, Glycine max
  Coding DNA Sequence Number=SeqID_115501
  Gene Ontology: Mol. function=calpain activity; Cellular component =intracellular; Biological process=proteolysis
  Homolog annotation: Hit_ID=Q1S3Q9; Match level="QueryCoverage=90%, HitCoverage=68%, E-value=7e-51, Identity=35%"; Hit description =Cyclin-like F-box; F-box protein interaction domain
  Pfam annotation: Domain name=F-box; Domain location=2-49; Score=36.3; E_value=1.1e-07; Accession=PF00646.23; Description=F-box domain
MSGAPVLPRELIVEILSWLPVKALMRFRYVSETWNSLIFDPTFVKLHLERSPKNTHVLLEFQAIYDRDVGQQVGVAPCSIRRLVENPSFTIDDCLTLFKHTNSIFGSCNGLVCMTKCFDVREFEEECQYRLWNPATGIMSEYSPPLCIQFKDNNNTYYPWKCGFGFDDSSDTYKVVALLCDIKSQTKEIKVHCLGDTCWRKTSNFPAFPVLGEGHFACGTVNWLALRVSSFHYLWENVTIDHIDQLVIFSYDLMYETYTYLSMPEGLLEVPRMEPYFGVLKGCLCLSLDHMKTHCVVWLMREFGVENSWTKLLNVNYEQLLNHDRPLCMSQDEDVVLLTSYAVYGLEIIYRSEESSPILTLLIAYRHHHTWNL

SEQ ID NO: 232280 - protein, 536 aa, Glycine max
  Coding DNA Sequence Number=SeqID_115502
  Gene Ontology: Mol. function=sugar binding; Cellular component =histone methyltransferase complex; Biological process=histone H3-K4 methylation
  Homolog annotation: Hit_ID=Q9LJC6; Match level="QueryCoverage=90%, HitCoverage=86%, E-value=1e-173, Identity=64%"; Hit description =Retinoblastoma-binding protein-like
  Pfam annotation: Domain name=WD40; Domain location=183-220; Score =13.7; E_value=0.66; Accession=PF00400.22; Description=WD domain, G -beta repeat
  Pfam annotation: Domain name=WD40; Domain location=302-340; Score =23.4; E_value=0.00079; Accession=PF00400.22; Description=WD domain, G-beta repeat
  Pfam annotation: Domain name=WD40; Domain location=33-70; Score=22.8; E_value=0.0012; Accession=PF00400.22; Description=WD domain, G-beta repeat
  Pfam module annotation: Pfam domain module=WD40::WD40::WD40; Domain location=183-220::302-340::33-70
MSMQSVVGTNLDVYAGCNNGSCVIWDFETRGIAKELRDNECSSPITSVCWSKCGHRILVSAADKSLLLWDVMSGKRITRIVLQQTPLQARLHPGSSKPSLCLACPLSCPPMIVDLNTGNTTSLKVSILEISNNGPTPTSRNKCADGITSFSPTAACFSKYGNLVYVGNSKGEILVINYVDGEVRAMVPIPGGSVVKNIVFSRNGQYLLTNSNDRIIRIYENLLPLKEEVRTLDELNGNLNDLNDVEKLKAVGSKCLTLFREFQDSITKVHWKAPCFSGDGEWVVGGSANKGEHKIYVWDRVGHLVKILEGPKEALIDLAWHPVRPIVVSVSLNGIVYIWAKDYTENWSAFAPDFKELEENEEYVEREDEFDLIPETEKVKGSDVNEDDEIDIVTVEKDPAFSDSDMSEEELCFLPATPSCDAPEQPDKFVNSSSKLVDSNNSGSPLSEEAGPNENTMNHNSSPVEVFTYSLQNFFADDAGGTRIKRKWKPSEKVLELQAEKMKKPTKSGKSSKSKSKYLVDEDDGIGFYGDDLSDG

SEQ ID NO: 232281 - protein, 107 aa, Glycine max
  Coding DNA Sequence Number=SeqID_115503
  Gene Ontology: Mol. function=DNA binding
  Homolog annotation: Hit_ID=Q1SFS3; Match level="QueryCoverage=96%, HitCoverage=25%, E-value=2e-10, Identity=44%"; Hit description =Lambda repressor-like, DNA-binding
MVEVSTEAIASLAQYYDQPLRCFTFGDFQLAPTVEEFEEILGCPLGIRPREASQKWGSWGTKEMFGSKGESLGKSRRRGPVHGHLGTFDLRGGPLSKYGWVSGPGSD

SEQ ID NO: 232282 - protein, 70 aa, Glycine max
  Coding DNA Sequence Number=SeqID_115504
  Homolog annotation: Hit_ID=Q5KT13; Match level="QueryCoverage=53%, HitCoverage=8%, E-value=4e-11, Identity=84%"; Hit description =Tryptophan synthase beta subunit
MTHVSDIKLIRTDTTLDLSQKAEKETTHNIMDSVAGPYPYPVMVREFHAVIDKETRKQALEKCIRNQMCW

SEQ ID NO: 232283 - protein, 91 aa, Glycine max
  Coding DNA Sequence Number=SeqID_115505
MKKVLEGTVVEEWLCGDLGASSYVSSDAYGNVFVDEDEEDEVEDDDNDNEKDEESIEYRVEEDYDSHSIGCGKSGGFCAEDDWRCSTVEFL

SEQ ID NO: 232284 - protein, 425 aa, Glycine max
  Coding DNA Sequence Number=SeqID_115506
  Gene Ontology: Mol. function=DNA-directed DNA polymerase activity; Cellular component=intracellular; Biological process=DNA replication
  Homolog annotation: Hit_ID=Q3LHS9; Match level="QueryCoverage=61%, HitCoverage=23%, E-value=5e-96, Identity=64%"; Hit description=DNA polymerase
  Pfam annotation: Domain name=3_5_exonuc; Domain location=186-410; Score=-5.0; E_value=0.00017; Accession=PF01612.11; Description=3'-5' exonuclease
MTEEEELNSLHSCETQVRTMGMASCNNEFSTTTSGKKLSGGDYRGWTIAKDKLTENKKEMNGSNKFESENGSFCASNGVASIDQNQAVPKNGDSNIVLQDPGAHVPSSVNYSVLNNSKVLMDSERVIHQHNGSSLGIGKEKVPVVNGDHGLDGTAKDSTNVTLTKQARGTDQSKLRDRLCSIYDDILVVDNIHLAEEVAKMLTTKYRHLIYACDTEVAKIDVKQETPVDHGEITCFSIYCGPEADFGGGKSCIWVDVLDGGGKEILEKFAEFFSDSSIKKVWHNYSFDCHVIENYGFKVSGFHADTMHMARLWDSSRHLDGGYSLEGLTGDRRVMSRAQLNHEKDLIGKVSMKTIFSKKKLKKDGSEGKTSIIAPVEELQRDERIPWICYSALDASSTLKLYESLKSHLSDMPWKFDGVPVYGKT

SEQ ID NO: 232285 - protein, 74 aa, Glycine max
  Coding DNA Sequence Number=SeqID_115507
MWNDCIFLLQFTSCNKNKEAEKVKWKEERRDLRSGGGGIKGSVALKQRPPLRQKSPPSAPAPSTVKQIRSQLLK

SEQ ID NO: 232286 - protein, 415 aa, Glycine max
  Coding DNA Sequence Number=SeqID_115508
  Gene Ontology: Mol. function=protein binding; Cellular component =nucleus
  Homolog annotation: Hit_ID=Q3UNW7; Match level="QueryCoverage=81%, HitCoverage=28%, E-value=1e-34, Identity=30%"; Hit description=Adult male kidney cDNA, RIKEN full-length enriched library, clone:F530006K24 product:...
  Homolog annotation: Hit description=Similar to protein BAP28, full insert sequence
MASSIASQLEVIRSFAKTDSDPLKRPLTRPSILYDPKKAADISTEAIFTEALRGLEILIGMDERFRNYKNDLFSHRSTELDRELMGIEQNNQLNVSIASYLKLLSGYFLHTAALQTLEYLIRRHKIHVYNNEDLMLCALPYHDEPEFVRIVQILDTRNTKWGFLDGVKASGARLPRMVIVQQCIRDKGILDALCNYASPTKKSGPSVPAIRFCTAVFVEVLGTVVTVDDGLVKRILPFVSLQPGIKEVSDHKAGSLMIIGLLGNKTALAPKLLNSLIRLVAEVARQEATELTDLHWFRLSLITLISLVQSQNVEILPLKALEILKEIRDLAGVLLELSKEFNIEKFLLVLLDSLIDCSSSDEYCQRTLLSLIEKVPINGLVYHVVTKILSTCVKLSQKVSDSTSSMSGVYSDFEL

SEQ ID NO: 232287 - protein, 423 aa, Glycine max
  Coding DNA Sequence Number=SeqID_115509
  Homolog annotation: Hit_ID=Q9FFU2; Match level="QueryCoverage=90%, HitCoverage=90%, E-value=2e-66, Identity=42%"; Hit description =Genomic DNA, chromosome 5, P1 clone:MBG8
  Pfam annotation: Domain name=DTW; Domain location=44-413; Score=82.6; E_value=1.2e-21; Accession=PF03942.6; Description=DTW domain
  Subcellular localization annotation: CTP_CleavageSite=50; ConfidenceScore=5.27e-01
MVVFLGTRIQSITWFRFNPSHSHKLLQRRALEISMLTMQQGQSKRPICPSCSKPSRTCLCSRILTPGLQNSVHVTILQHSLERKHPLNSTRIAILGLKNLTVATVSDVNFEARFLIRLLDPNYHSGHAGNEPTALFSRQCWEIGDTQKLLSEKDSNLIDTDSAGKCGLRNDVGDVLDSASNAEVVKQVSISDGAVMDDEVEKNAISPKCDLARGVHEESGELAVTVTIGKYGAISSLSHIWMTQAQCQSPELSFDNILAYPEACEALSKGFLVKKFQRKQLNRDEELEECEEFELEVRPGSVLLFPSEMAVDVSDLDAIGFEVKNLIVLDGTWAKAKRIYSENPWLNILPHVKLEVNKTSLYSDVRHQPKAGYLSTIESIVFALKAVGELNHEGLEGLLDTFESMVGDQRRCKEERLSKHFSC

SEQ ID NO: 232288 - protein, 282 aa, Glycine max
  Coding DNA Sequence Number=SeqID_115510
  Gene Ontology: Mol. function=ATP-dependent helicase activity; Cellular component=nucleus; Biological process=rRNA processing
  Homolog annotation: Hit_ID=Q9FFT9; Match level="QueryCoverage=88%, HitCoverage=34%, E-value=1e-49, Identity=44%"; Hit description =Probable DEAD-box ATP-dependent RNA helicase 32
MQHRAQRAFITYLRSIHIQKDKDIFDVMKLPINEYSASLGLPMTPKIRFLNPKINSKDVSKSILVEPEDSDKETIFEVSRKLDTAAFKDEETENDILQLADTANEGEVKSSEIEEIIPATRVLKKKKLKINVHRPLGTRVVFDDEGHTLPPLARIADTQSGKEMLLDPEKKAEYYRRMRDDLKKADNEDKLIERQRLREKRIKQKMKWKAGNAEEDDQDDISGSEVDETVDRWHKKSKVYFDSDSDEGERNDVTGNAGITTGAVTLEEQEALALKLLNSMHS

SEQ ID NO: 232289 - protein, 343 aa, Glycine max
  Coding DNA Sequence Number=SeqID_115511
  Gene Ontology: Mol. function=transmembrane receptor activity; Cellular component=membrane; Biological process=defense response
  Homolog annotation: Hit_ID=Q19PI9; Match level="QueryCoverage=91%, HitCoverage=19%, E-value=2e-35, Identity=43%"; Hit description=TIR -NBS-LRR type disease resistance protein
  Pfam annotation: Domain name=TIR; Domain location=216-343; Score =137.7; E_value=3.2e-38; Accession=PF01582.10; Description=TIR domain
  Pfam annotation: Domain name=TIR; Domain location=54-180; Score =109.2; E_value=1.2e-29; Accession=PF01582.10; Description=TIR domain
  Pfam module annotation: Pfam domain module=TIR::TIR; Domain location =216-343::54-180
MDKKTKTPSIHLVRSTHVHVLYFSLRARSQPDKQATLCYRFSSIMSNELKNYDVFLNFHGKDSGYTFTGTLYNALRSKRIKTFFTKHEYGRKLHTDDSHIPPFTLKAIKESRISVVVLSENYASSSRCLDELVAILECKRTINQLVWPIFYKVDPSQVRHQKDYNDSNERVKQWRAALSEVSKLSGWLYNDRSQYEYEFIERIVESTVQALPGYDVFLSFTGEDTRYTFTGFLYNAFRREGFKIFMDDEELESGNQISQKLMRAIESSKISIVVLSENYAYSTWCLDELAKIIECMKTNNQMVWPIFYNVQKSDVCNQTKSYGEAMTEHEKRFGKDSEKVQKW

SEQ ID NO: 232290 - protein, 243 aa, Glycine max
  Coding DNA Sequence Number=SeqID_115512
  Gene Ontology: Mol. function=ATP-dependent helicase activity; Cellular component=nucleus; Biological process=rRNA processing
  Homolog annotation: Hit_ID=Q9FFT9; Match level="QueryCoverage=92%, HitCoverage=30%, E-value=8e-91, Identity=73%"; Hit description =Probable DEAD-box ATP-dependent RNA helicase 32
  Pfam annotation: Domain name=Helicase_C; Domain location=136-212; Score=85.1; E_value=2.1e-22; Accession=PF00271.21; Description =Helicase conserved C-terminal domain
MTEGYRKVLLQVPQPDNRYVLVLDEADRILDSGFKKELNAIISQLPKRRQTLLFSATQTKSIQDLARLSLKDPEYLSVHEESVTSTPTLLKQIVMIVPLEQKLDMLWSFIKTHLQSKTLVFLSSCKQVKFVFEAFKKLHPGIPLKCLHGRMKQERRMAIYSEFCEKRSVLFSTDVAARGLDFNKAVDWVVQVDCPENVASYIHRVGRTARYKSDGKSVLFLLPSEIQMLEKLKAAKVPVHFNK

SEQ ID NO: 232291 - protein, 136 aa, Glycine max
  Coding DNA Sequence Number=SeqID_115513
MGETHEMPHHNLADFEPCLGYATKGQTVGGITLQNTLEGPQFRPQPQPSHSTMVKNPYAWLKWEKLDPLEERLKAIEGGEDYAFANLKELFLVPNIITPPKFKVSDFDTYKGTTCLMNHLKMYCRKMGYTQEMRNC

SEQ ID NO: 232292 - protein, 227 aa, Glycine max
  Coding DNA Sequence Number=SeqID_115514
  Gene Ontology: Mol. function=ATP-dependent helicase activity; Cellular component=proton-transporting two-sector ATPase complex; Biological process=ATP synthesis coupled proton transport
  Homolog annotation: Hit_ID=Q9FFT9; Match level="QueryCoverage=92%, HitCoverage=29%, E-value=9e-81, Identity=67%"; Hit description =Probable DEAD-box ATP-dependent RNA helicase 32
  Pfam annotation: Domain name=DEAD; Domain location=90-227; Score =78.5; E_value=2.1e-20; Accession=PF00270.19; Description=DEADDEAH box helicase
MRRPKSKEFRKQQRVSEEEEINLLNSWIQFQPPDSGSNPMSLPRLPKNSPVGRLEDNTYSRYAGASRFDQFPLSKKTKDALRESKFVAMTDIQRASLPHALCGRDILGAAKTGSGKTLAFIIPVLEKLYRERWGPEDGVGSIIISPTRELAGQLFDVLKVVGKHHNFSAGLLIGGRKDVDMEKERVNELNILICTPGRLLQHMDETPNFDCSQMQLYYPPPPPPPLL

SEQ ID NO: 232293 - protein, 786 aa, Glycine max
  Coding DNA Sequence Number=SeqID_115515
  Gene Ontology: Mol. function=nucleotide binding; Cellular component =cytoplasm; Biological process=response to unfolded protein
  Homolog annotation: Hit_ID=Q96269; Match level="QueryCoverage=94%, HitCoverage=93%, E-value=0.0, Identity=50%"; Hit description=Heat -shock protein
  Pfam annotation: Domain name=HSP70; Domain location=3-669; Score =470.0; E_value=2.9e-138; Accession=PF00012.10; Description=Hsp70 protein
MSGVGIDIGNENCVIAAVKQRVIDVLLNDESKRETPGVVCFGEKQRFIGSAGAVSAMMHPKSTISQVKRLIGRRFTDPDVQNDLKLLPVETSEGPDGGILIRLKYLKEIHAFTPVQIVAMLFAHLKTIAEKDFGTAVSDCVIGVPSYFTNLQRQAYLDAAAIVGLKPLRLIHDCTATGLSYGVYKTDIPNAAHIYVAFVDIGHCDTQVSIAAFQAGQMKILSHAFDSSLGGRDFDEVLFSHFAARFKEQYSIDVYSNGRACRRLRVACEKLKKVLSANAVADLSIECLMDEKDVKGFIKREEFENLASGLLEKFNIPCNKALADAGMTVEKINSVELVGSGSRIPAITNLLTSLFKRELSRTLNASECVARGCALQCAMLSPIFRVKEYEVQDSIPFSIGLSCDGSPICEGSDGVLFPKGQPIPSVKILTFQCSNLLHLEAFYANPDELPPGTSPKISCFTIDPFHGSHGSKARIKVRVQLNLHGIISIESATLMEDHVDDSVTTGDYHSNSEAMNVEPVSETVENVTEDSINKKCEAPRHLADGTKKDKANRRLHVPVSENIYGGMTKAEILEAQEKELQLADQDRTIELTKDRKNSLESYIYETRSKLFSTYLSFSSEHERKDISRSLKATEDWLYDDGDDETVDAYSAKLEDLKQLVDPIEFRYKDTEARPQATRDLLSCIVEYRMSADSLPPQDKEQIINECNKAEQWLREMRQQQDLYPKNFDPVLLSSDIKSKTEDLNSYDFNFLFSFSEMHNCRSMPTDIEIQGFSISKRQGRRQAEYF

SEQ ID NO: 232294 - protein, 713 aa, Glycine max
  Coding DNA Sequence Number=SeqID_115516
  Homolog annotation: Hit_ID=Q4SN96; Match level="QueryCoverage=28%, HitCoverage=9%, E-value=3e-09, Identity=21%"; Hit description =Chromosome 8 SCAF14543, whole genome shotgun sequence
  Pfam annotation: Domain name=DUF827; Domain location=205-389; Score= -114.6; E_value=0.067; Accession=PF05701.2; Description=Plant protein of unknown function (DUF827)
  Subcellular localization annotation: CTP_CleavageSite=35; ConfidenceScore=5.30e-01
MKFSGKGSFPVGIALRSVNNPSPDSDLEPAKPFLRRNPRTPGTRLRRHGGKRSRPETPLLKWKIHDDPLEDDQKSSVAGSRRRTCRSAKKQAEVAVSARRLAAGLLRLHLPETATGDGRKGLEHKLHATRLLHLLYCRPPLTEEKELIHGIGHPGLQFLGHPNGMTHGSDLKKNSSQSPRSIFGTRNGHFCEPESFQLPNNEMEGATKWDPLCSKTSEGAQHIYSHMKHLDQKASAVSVVSALGAELEQARTRIQELETEHHSSKKKLEHFLKKVSEERAQWRSKEHEKIRAYIDDIKAELNRERKNRQRIEIVNSRLVNELADVKLSAKRYMQDYEKERKARELIEEVCDELAKEIGEDKAEVEALKRESMKLREEVEEERKMLQMAEVWREERVQMKLIDAKVALEEKYSQMNKLVADLESYIRSKSTEPNTMDMKEAQSLQQAAAAMNIQDIKGFSYEPPNSDDIFAIFEDANFGEANEREIEQYVSHSPASHASNIHMVSPEANEISKGGIQRRSDVFMDDNGDIEGDESGWETVSHVEDQGSSYSPEGSSRSLNRNHRESNVSGRSVLEWEETAGEETPITEISEVCSIPTKQAKKVSSITKLWRSTYPNNGDNYKIISVEGMNGRLSNGMLSNGVIMSPDHGSGKGGLSPQDLLYQLSPESGSPHAHQGMKGCIPRTAQKNSLKARLMEARMESQKVQLRHVLKQKI

SEQ ID NO: 232295 - protein, 603 aa, Glycine max
  Coding DNA Sequence Number=SeqID_115517
  Homolog annotation: Hit_ID=Q9LJU8; Match level="QueryCoverage=44%, HitCoverage=44%, E-value=4e-35, Identity=34%"; Hit description =Arabidopsis thaliana genomic DNA, chromosome 3, TAC clone: K10D20
MANFEVPSFSLGLDDTPPHSPIHPPLSPDLHVSDSDSDSDPESRPDPPRPLLKRLRRGPPPPCLDPDADADDDIEDFSSQEDPDQGHAVPSAWNRNHSVCSSSKVSLNRSGVLTPHSCSNSFRDRKRKELSNDVPASARLETGKSGLMFPKLTTSPLRRFQLIDSDSDDADVGVGAGTSDANKVNPNSHLEQEKKTSADENRNEDLWKDFSPVKNVSVNRFQLLSDSDDSDVDVGGANKVNTNSRLEQDNKTSVDVNGNKDQWKDFLPVKNVSVSKFQLLSDSDDSDVDVDVGGANKANPNRHLEQNKKTSPDDDLWKDFLPVKNVSVPTPAFNEICEEYFRSANCKEVGGDASKSFSERNPGVSSSCQRYQQRWESTDPVHPAHSYFFHEDPRIQQLVRSRLRNFNPLGTINTVNQQPNFSHIDYMGQFGNGGASNMQGVQNGFINCSTRGGNKSSNLNVDGSFNASGGWVDPKIVSPFSHGESSRKKATKRNGSKNSVSKSNSKANKSNPANQSCASGGWVEPRSCTSLPKDAGKRRVQASGESAGHWFTSPEGRKVYVNKSGEELTGRNAYRQYRKESGAGFKKSRKKKGAKTTNAKKRN

SEQ ID NO: 232296 - protein, 251 aa, Glycine max
  Coding DNA Sequence Number=SeqID_115518
  Gene Ontology: Mol. function=ATPase activity; Cellular component =chromosome; Biological process=chromosome organization and biogenesis
  Homolog annotation: Hit_ID=Q011Q9; Match level="QueryCoverage=92%, HitCoverage=12%, E-value=4e-46, Identity=43%"; Hit description=[Z] KOG0161 Myosin class II heavy chain
  Pfam annotation: Domain name=OTU; Domain location=20-130; Score =108.2; E_value=2.4e-29; Accession=PF02338.9; Description=OTU-like cysteine protease
VGKLSTICIMEGVILRRVIPSDNSCLFNAVGYVMDHDKKKAAELRQVIAATVASDPQKYCEAFLGKPNTEYCNWILDSEKWGGAIELSILADYYGREIAAYDIQTTRCDLYGQERNYSERVMLIYDGLHYDALVVNWEMSPFEEAPEEFDQTIFAVQKNRSIGPVEGLALNFVKDQQRASPGAAVKLCLGDLLVMGSNLETASLHMQGKRSYTDTSNFTLRCGVCQIGVMGQKEAVEHAQATGHVNFQEYR

SEQ ID NO: 232297 - protein, 135 aa, Glycine max
  Coding DNA Sequence Number=SeqID_115519
  Gene Ontology: Mol. function=RNA-directed DNA polymerase activity; Biological process=RNA-dependent DNA replication
MSLHSSSSVNGEGYTPKDPLYKILDELRSLKLWKEKQERKEKGCHSSHTKHHSQRREKDIRPQEVNIRLPYFHGKDNVEAYLDWQMKVEQLFACHHISEERKVPLATLSFQGYFLYWWTFLVKERRIHGNPPVEY

SEQ ID NO: 232298 - protein, 350 aa, Glycine max
  Coding DNA Sequence Number=SeqID_115520
  Gene Ontology: Mol. function=phosphoribosylformylglycinamidine synthase activity; Cellular component=cytoplasm; Biological process =glutamine metabolic process
  Homolog annotation: Hit_ID=Q896H5; Match level="QueryCoverage=98%, HitCoverage=27%, E-value=2e-90, Identity=50%"; Hit description =Phosphoribosylformylglycinamidine synthase II
KNIGSLVIEAKEELSAASLQLIGEVKDSGTLKINGIESDITDLVAANTNTFENLFPTVEKEKITVEIDAKHNSVNPRNIIIKKHGIAQPKVFAPVFPGTNCEYDTLNAFQKEGAVVSSLPLININHQLLDESIDAWLEEIRTSQILAFSGGFSAGDEPDGSAKFIVNVLKNEKMKNAVHELLDRDGMIIGICNGFQALVKSGLLPYGRIKDLDENSPTLAHNAIRRHISQMVTVQVVNDESPWLKGMKGQTFTIPISHGEGRFMASEDEIRKLYENGQIATQYIDLDGNIAHGMPFNPNNSLFGIEGITSPCGKIYGRMGHPERFAEGLMKNIPTANYHNIFKNGVEYFK

SEQ ID NO: 232299 - protein, 119 aa, Glycine max
  Coding DNA Sequence Number=SeqID_115521
  Pfam annotation: Domain name=Transposase_23; Domain location=33-103; Score=-7.2; E_value=0.0069; Accession=PF03017.5; Description =TNP1ENSPM transposase
GLALPPEPEVGPSTAHVSTKKSYVGPSRNDPDTGDSDKCGLYIKENPPRLGSLGRVYEGSTTVHSIPLLHDQVKVGVEEVKDADAPVPVPTNEVNLVGQTLNTFLVWPTRNSVYWRCAY

SEQ ID NO: 232300 - protein, 303 aa, Glycine max
  Coding DNA Sequence Number=SeqID_115522
  Gene Ontology: Cellular component=periplasmic space
  Homolog annotation: Hit_ID=P0AFX9; Match level="QueryCoverage=67%, HitCoverage=64%, E-value=5e-73, Identity=62%"; Hit description=Sigma- E factor regulatory protein rseB precursor
  Pfam annotation: Domain name=MucB_RseB; Domain location=1-205; Score =148.7; E_value=1.5e-41; Accession=PF03888.5; Description=MucBRseB family
YFEPGLDPFSLPGNHIIDALPALMFADFPRLGDAYDFIPVGRSRMADQMCEVVRIVSRDGTRYSYVVWLDVDTKLPLRIDLLDRDGETLEQFRVISFAVDEGVRNLMQGLEKANLPPSLSLPAGDKVQLSWQPGWLPAGMKLISQSRRDIPAMNKTVESRLYSDGLFSFAINITPADKSSSPQSLRTGRRTVQTEVRDNREITVGVATLHSEAKTSCNSCSARKGCGSHALNQLGPKNAHPARFCAAGVYDATVWSVPGRGPVPDAVPQRPGGGLRCAAGGRWRLYCCQRGFQPVWRSRSVPA

SEQ ID NO: 232301 - protein, 77 aa, Glycine max
  Coding DNA Sequence Number=SeqID_115523
MQSSLRPPGYARNYPPPIGDQPGAKRSSLPSDKPPQYKVHSATVIIFTMLYELRTWPKASAKDHGPIKAPKHPLRNA

SEQ ID NO: 232302 - protein, 54 aa, Glycine max
  Coding DNA Sequence Number=SeqID_115524
MKQYQSGRIDEMPPPQHLCSKGITYPESAFVCCADSSLLVICPLAAAKRRPQTY

SEQ ID NO: 232303 - protein, 44 aa, Glycine max
  Coding DNA Sequence Number=SeqID_115525
MASMPYALRFVKSSAQGPENDSVGCLCLAIGLRMSDRGDKVLDT

SEQ ID NO: 232304 - protein, 118 aa, Glycine max
  Coding DNA Sequence Number=SeqID_115526
MEHYLFTSLLFHNFLISPRQGEGTILPRQAATRLSELVISGLSLGSPRRAAIVPNAPFSINRREGEAERGFQGLEVERIEKREKEEEERRGNEVEALSNRDYDRPYVVSCSVFFAPVD

SEQ ID NO: 232305 - protein, 57 aa, Glycine max
  Coding DNA Sequence Number=SeqID_115527
MEFVRRDAWNVYKLLASSASLDEVKGIGPECWAIVANTLTRVFVVNPLLNSSPSRMT

SEQ ID NO: 232306 - protein, 87 aa, Glycine max
  Coding DNA Sequence Number=SeqID_115528
GVVLAEVLLADSRFTRPDMGFHPTKLNFVPSDADEAPLDVSICLHAFGIVGCGSFSGVKSCEREDPFHPGPLCWGTLEDFKVPHVKP

SEQ ID NO: 232307 - protein, 51 aa, Glycine max
  Coding DNA Sequence Number=SeqID_115529
MKMKAIKTRNELKVSDSNTYWLNYEKRTKNGEERRKIFTDLLTETSQKRYG

SEQ ID NO: 232308 - protein, 77 aa, Glycine max
  Coding DNA Sequence Number=SeqID_115530
MQGKIDCNNINEIREERMQTQFYTGSATTRAYVQYSSNPLEFSTIFVKSFTTSEPHRDNPSLVFRNPYNSRDPRSLN

SEQ ID NO: 232309 - protein, 47 aa, Glycine max
  Coding DNA Sequence Number=SeqID_115531
MASPLATGLQTFNAHAQDYPVLQIFNSPIFFLRSMDNDEDTGHNTDK

SEQ ID NO: 232310 - protein, 52 aa, Glycine max; identical to SEQ ID NO: 124036
  Coding DNA Sequence Number=SeqID_115532

SEQ ID NO: 232311 - protein, 165 aa, Glycine max
  Coding DNA Sequence Number=SeqID_115533
MQRESQSESVDVQIGDRLEEMICDLGKESFQQAHASMYDTLQSDSKKRLYLRRKKSLTLLSMVLSLVMSRPDIGGVTKASLHFFRWCRICFQRKTRCQKITIRCGVSRYKVKDDDECSSDESTKKGPLAKMTQKTLHDMQMEEIAMECSTIQLIPLSGRRLIVSI

SEQ ID NO: 232312 - protein, 46 aa, Glycine max
  Coding DNA Sequence Number=SeqID_115534
MTDSKRPLGVTVETEKIRKQQRSLHLLLKPEIANLCEILRLPMIDY

SEQ ID NO: 232313 - protein, 101 aa, Glycine max
  Coding DNA Sequence Number=SeqID_115535
  Subcellular localization annotation: CTP_CleavageSite=50; ConfidenceScore=5.58e-01
MSLPGAVHASSTNESGAPRSYCVALFANSPFSTFFRSPMNVIAWRCSCILHQRVWSPAKLLRSAFHQFSILHFFTEPHECHCLTQFMHPPATSLEPREVIA

SEQ ID NO: 232314 - protein, 327 aa, Glycine max
  Coding DNA Sequence Number=SeqID_115536
  Gene Ontology: Mol. function=transcription factor activity; Cellular component=integral to membrane; Biological process=regulation of transcription, DNA-dependent
  Homolog annotation: Hit_ID=Q2KD34; Match level="QueryCoverage=58%, HitCoverage=81%, E-value=9e-44, Identity=49%"; Hit description =Hypothetical conserved protein
  Pfam annotation: Domain name=Sigma70_r2; Domain location=10-79; Score= 74.2; E_value=4.1e-19; Accession=PF04542.4; Description=Sigma-70 region 2
MGDRSAFVSLYQATSPKLFAICLKILRDRTDAEEALQEIYIKVWQRARTFAASAGKPATWLATIARNHAIDTIRARRPAGDDIDEAYDLVDESVRDPEQNVVLADEGRRIDDCMRELETNLAAAQSSQTQRVHAAMTTGDHSGGMHSRDEILAGEYVLGVLPLEKRREVEQRIQEDRVFAQLVQRWETEFSEFNADYQEETPSAAILARIQERLFGSRAVNTNGTLWNSASFWRWISVATSATAVAAVVYAAFPDQRDGTSPLVAELATTDSQVNLLASYDAESGRMRIVPVATGKTDEKSLELWLVMDGGKTRSLGVFQPGTNGDL

SEQ ID NO: 232315 - protein, 167 aa, Glycine max
  Coding DNA Sequence Number=SeqID_115537
  Gene Ontology: Mol. function=chitin binding; Cellular component =extracellular region; Biological process=chitin metabolic process
  Homolog annotation: Hit_ID=UPI000044A8F0; Match level="QueryCoverage =89%, HitCoverage=99%, E-value=5e-15, Identity=25%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
RTTRPRHKRAARPRLRGLHVLAFIGLYALTFRGLLVLAFRGLHVLAFIRLCALTFRGLYVLAFRGLYILAIRGLHVLTFRGQHDLAFRGLHVLTFRGLHVFTFRRLHALTLKGLHALVFRGLHALAFRGLHVLAFRGLHVNAFRGLHVSTFIGLYLLTFKGLHALAF

SEQ ID NO: 232316 - protein, 327 aa, Glycine max
  Coding DNA Sequence Number=SeqID_115538
  Gene Ontology: Mol. function=chitin binding; Cellular component =extracellular region; Biological process=chitin metabolic process
  Homolog annotation: Hit_ID=UPI00006A17C9; Match level="QueryCoverage =94%, HitCoverage=100%, E-value=1e-39, Identity=29%"; Hit description= UPI00006A17C9 related cluster
  Subcellular localization annotation: CTP_CleavageSite=21; ConfidenceScore=5.39e-01
MTCSPLKARTCSPQKRRTYIPLKARACVPLKGRTCSPLMARTWSPLKARACSPLKARVCRPFKFSEGEGWSPLNARTCSPLKTKMCSSLKARTYSFLKVRADSPMKARTCNPVKARTYSPLKVRVYSPMKARTCSHLKARMCSPLKVRTCSPLKASTCSAPKARVCSPLKARTCSPLKVRAYSPMKARTCSHLKARTCSPLKVRPCSPLKASTCSAPKARACSPLKARTCSPLKVRAYSPMKARTCSHLKARTCSPLKVRPCSPLKASTCSAPKARACSPLKARTCSPLKVRTCSPLKARVCRPLNLSTCSPLMARTLVLRRGRVAL

SEQ ID NO: 232317 - protein, 178 aa, Glycine max
  Coding DNA Sequence Number=SeqID_115539
  Homolog annotation: Hit_ID=Q1SPD0; Match level="QueryCoverage=82%, HitCoverage=54%, E-value=2e-20, Identity=34%"; Hit description =Peptidase M, neutral zinc metallopeptidases, zinc-binding site; Nucleic acid-binding, OB-fold
MDLKENCTYVMHNFKVLKNNGQYRVCDHQFKLVFIGVTVVRECVLGDIPFRNTDIIGVVEEVVFQQVSGKGRRVVFKLKNLSQQLLSCTLWDDYCLQFLKFLDDYEGDGPITVLLSHCRIKEAQGSYPASINNSFKASKLIINQPMMEIQEFNERLAELGIEARSGFKSHGEGSTQLS

SEQ ID NO: 232318 - protein, 420 aa, Glycine max
  Coding DNA Sequence Number=SeqID_115540
  Gene Ontology: Mol. function=RNA-directed DNA polymerase activity; Cellular component=intracellular; Biological process=RNA-dependent DNA replication
MIQDCDEDGVILNVQHVRTPLVPIHIKMCEAALFDHDHAACEICPVNVKGCPKVQEDVQRLIDNRELIITRKDKEVCVITPEFQRLEISYNSGESTTTPLVVGLPGPMPYASLKAVPYRYSATMLEGGQEVPLPSLTPAISVDNIASDGKVLRNGRVIPTLFAKKVNDPAVKQATVNGPGTRKEVGQSNGTSKNSDHDEILKLIQKSEYKVVDQLLQTPSKISILSLLLNSEAHREALMKVLDQAFVERDVTVNQLDSIVGNITACNNLSFSDEELPEEGRNHNLALHISVNCKSDALSNVLVDIGSSLNVMAKSTLDQLSYRGPPMRRSGVVVKAFDGSRKSVIGEVDLPVTIGPFVFQITFQVMDIQAAYSCLLGRPWIHEAGAVTSTLHQKLKFVRNGKLITVSGEEALLKEPLSKA

SEQ ID NO: 232319 - protein, 59 aa, Glycine max
  Coding DNA Sequence Number=SeqID_115541
MARSQPSIYMEKLAVRRLSTQGWLSFIQMDRLFTMILGFTSKLQLRCPFEYQIGVILQA

SEQ ID NO: 232320 - protein, 281 aa, Glycine max
  Coding DNA Sequence Number=SeqID_115542
  Gene Ontology: Mol. function=transporter activity; Cellular component= integral to membrane; Biological process=transport
  Homolog annotation: Hit_ID=Q4BM43; Match level="QueryCoverage=94%, HitCoverage=66%, E-value=1e-58, Identity=47%"; Hit description=Major facilitator superfamily
  Pfam annotation: Domain name=MFS_1; Domain location=1-250; Score= -20.2; E_value=0.0027; Accession=PF07690.6; Description=Major Facilitator Superfamily
MGAGAGFIGPVLVALGSELVHEQQRGRAIGMVLLGVSMASLAGIPLAAWVASLWGAKALFVLVGLLSLLSGLNILLTVPDDSAGTRIRLREMAGVLADGRYLTAFLVVFFITCGVYSFYAFIAPLIRDTYTGGTHAVSAALAVLGVAGVLGNLWVTRAATRFTAEKLLLSGMTLLIVDTALIAVLPKALGVLLAALVVWAFATDLLWPSQQRRIVELASVRHRGIALALTSAFMFGGIGFGSAVASWIYPLAGFYGLIGMSVAFILLGCSVCSCQKSAGNR

SEQ ID NO: 232321 - protein, 43 aa, Glycine max
  Coding DNA Sequence Number=SeqID_115543
SRAQKELTAEPDESGNAQGDSEVAESWFNQAAEYWKQAIALTP

SEQ ID NO: 232322 - protein, 129 aa, Glycine max
  Coding DNA Sequence Number=SeqID_115544
MAESSKRCKGSSSSTTTATVLPVTLWYHPIHLFPHRPLSLYFPLMSNVRVDFMTKKLPYYPKLVRLFYNNLEIHEGVIFSEVNKIPIVVDQSLFYSLFRSLGYYLFVWMQNLPASAPGRQAQVLDTDVS

SEQ ID NO: 232323 - protein, 91 aa, Glycine max
  Coding DNA Sequence Number=SeqID_115545
NTDVLTDHVGFMLVDLKKLAYQNDLFMMAKQAKQGKTIGVNVEDDDSYIDTYANGYTTQLSSSSSSYWCSITVAIYLEAHKKRHTAKIIGD

SEQ ID NO: 232324 - protein, 183 aa, Glycine max
  Coding DNA Sequence Number=SeqID_115546
  Gene Ontology: Mol. function=endonuclease activity
  Homolog annotation: Hit_ID=Q1T6I5; Match level="QueryCoverage=96%, HitCoverage=43%, E-value=6e-52, Identity=58%"; Hit description =Calcium-binding EF-hand; Endonuclease/exonuclease/phosphatase
  Pfam annotation: Domain name=efhand; Domain location=82-110; Score =26.8; E_value=7.6e-05; Accession=PF00036.22; Description=EF hand
MQILTSGLVTEIIGEISVVLTSFGFAIPTKHFQLRKASLSEDDAFAFLKGDNYADSVTYFSFSEALRQVKLIGVPYGLRFQQLQDLWNQADADGNGVIDFEEFKQKIWNSTCPEHVLENLNGCTEDCNTEQEQEAIGFKVKNAMLYPREVEKGLWPEDYSLSDHARLTAVFSPARMRCSASQN

SEQ ID NO: 232325 - protein, 54 aa, Glycine max
  Coding DNA Sequence Number=SeqID_115547
  Subcellular localization annotation: CTP_CleavageSite=47; ConfidenceScore=5.54e-01
MVFGASVASVKFPKTLENSCRGASITLPRRFRKRFCGNSSSFFTVLRHSSVFNQ

SEQ ID NO: 232326 - protein, 229 aa, Glycine max
  Coding DNA Sequence Number=SeqID_115548
MTLSTKDVRRAVQGLLAVLWPSMYGWFHTFFAKRISKCSLDGDKGLHQLQSRGRLQHPVIDYQKAYYSYPKYLDIDFFNDETFDCYQVFQNSGLVDFMSLKLPYNPELVKVFYCNLKIQDDILSSEVHGIPMIIDQSLFFSLTKLPNQGAPFEGTIVDDWKFDYSCHDARRMVCNDQAEMTGRLLAGSLTFDNRIMHYIIVRILLPRSSNLAQASEEDLILMWAFLTGR

SEQ ID NO: 232327 - protein, 106 aa, Glycine max
  Coding DNA Sequence Number=SeqID_115549
MARRDQVWSFCTHDTRRYLTAIRTPLLGRHSCVRWHAETKQTQLCPMARRDQGWSFCTHDTRRYLTVICTPLLGRHSCVRWHAETKFGHSAHMIRGDTLRLSAPLC

SEQ ID NO: 232328 - protein, 248 aa, Glycine max
  Coding DNA Sequence Number=SeqID_115550
  Gene Ontology: Mol. function=catalytic activity; Biological process =spermidine biosynthetic process
  Homolog annotation: Hit_ID=Q1LHP3; Match level="QueryCoverage=99%, HitCoverage=51%, E-value=1e-65, Identity=55%"; Hit description =Spermine synthase precursor
  Subcellular localization annotation: CTP_CleavageSite=35; ConfidenceScore=5.40e-01
MAGSRSTRVTCSTCLYLRISRTARPSPPPSTSTLRAHGSACRPGITKLQVAVDVQPQVVVPARHDQPLVGRGLGVHHVVAVQALFGPRGHLAGKQEAQGQQSQHHAAAHGAFGRTPDLGAEQPGGPQRHAGIEHAEQETGAQQAQLGRQQQRKDQRHGQRAEIIEGQHAADDFAELGLALVEHPHHQRDLHADHQSDNEDARVQRRAKRRRQPGEHQEQDRGGNPAQQCDGQLDVDESIQNVVVSYIF

SEQ ID NO: 232329 - protein, 195 aa, Glycine max
  Coding DNA Sequence Number=SeqID_115551
  Gene Ontology: Mol. function=chitin binding; Cellular component =extracellular region; Biological process=chitin metabolic process
  Homolog annotation: Hit_ID=UPI00006A17C9; Match level="QueryCoverage =97%, HitCoverage=100%, E-value=1e-16, Identity=40%"; Hit description= UPI00006A17C9 related cluster
VDPWVLVPITFRGLHVLANRGLHALTFRGLHVLALRGLHVLTIRGLHALTSRGLHVLALRGLHALILGLHALTSRGLHVLALRGLPALALGTRYPHLQRTTCPHLQGYTPSPWVLVTLTVERTTRPRLERTTRPHHQRAARPHLQRTTCPRLERATCPHLGGLHALTSRGLHVLALRGLHALTLGTSYPHRQRTT

SEQ ID NO: 232330 - protein, 232 aa, Glycine max
  Coding DNA Sequence Number=SeqID_115552
  Homolog annotation: Hit_ID=Q7DFZ5; Match level="QueryCoverage=97%, HitCoverage=63%, E-value=3e-43, Identity=43%"; Hit description =Fimbrial protein
MPNGEDAYLYWDPETRMQNIHNSLEVGVTYLSTDIKPVKGQKTDIGPGTLCRRNRPGGACQSPATPQTVTVTYSVYIKATGNPPPSNGVINDTNRYAIFQVDGVGGLNSRPNSNFRAWVTGLGNIRFIACNPKITVSANNGSTVNFGSIPARNAVVGAIEKQVPFSVRADLTGAGQDCQGQTLMASFSTQQPTQDTNTILPSNDSGFGILLSRADAPTTWLSMNTPTRVGHD

SEQ ID NO: 232331 - protein, 216 aa, Glycine max
  Coding DNA Sequence Number=SeqID_115553
  Homolog annotation: Hit_ID=Q1SKD7; Match level="QueryCoverage=94%, HitCoverage=53%, E-value=5e-08, Identity=27%"; Hit description =Ankyrin
MAFRKRKAPTSVYQARYDRSRFTSQEAWDCYSDIVISRKILPERNVMIYHTKFDEFKAKLKRRNWHKELTNFMDRSTDVAIIKEFYANLYDPKDNSPKQVRVRGHLIKFDADALNTFLKTPMIIEEGEELSSYSRFCHLRPDPSELPAQLCIPGRGFELNADGLPLKILRKNLTTLAQTWSILSFSNLALTSHTSNITLDRARLIYGIIQKMDMNL

SEQ ID NO: 232332 - protein, 182 aa, Glycine max
  Coding DNA Sequence Number=SeqID_115554
  Gene Ontology: Mol. function=nucleic acid binding; Biological process= DNA integration
EVAYPLVPSKKDKERHLARFLDIFKKLEITLPFGEALQQMSLYAKFLKDMLMKKNRYIHSDTIIVEGNCSVVIRRILPPKHKDPGSVTIPCSIGEVAVGKALIDLGACINLMPFSMCRRLRELEIMPTRMTLQLVDRSITRPYRVIEDFCASLVLSAMSSHAKPMLLVLSALTLHQLARWFS

SEQ ID NO: 232333 - protein, 182 aa, Glycine max
  Coding DNA Sequence Number=SeqID_115555
MNILTAHDQEWEQELSPYNQYEEERTPNLESVFEEFMAYHASSKDNQNSIKNHEIHFSKSYLIENFHGGPKLQPYHQNEAERVSNLDKLLMQFMETAKSTQQALQSVEIQVSELAKAVTQFMVKQEISFVEVEAQKKSPVKEHESREKVEEKDEEQAQQQCEKYSIVKNQQENIFQSNNLPH

SEQ ID NO: 232334 - protein, 59 aa, Glycine max
  Coding DNA Sequence Number=SeqID_115556
MARECFPNEYMMWNCPSSVDKWHESFFSNARINETLGLIRILVVDLKRANKAALTLVNF

SEQ ID NO: 232335 - protein, 108 aa, Glycine max
  Coding DNA Sequence Number=SeqID_115557
MINYLFSCICQLLLTAIFHHDFSSTKKDVEENNRDVENEVACSRAWPKKILEVALLWRLARHIRVALPERSVGVKHQVEAPNPCKRGADRSKPSPDELAKRHRAKADN

SEQ ID NO: 232336 - protein, 60 aa, Glycine max
  Coding DNA Sequence Number=SeqID_115558
NNALKGLDNAPQPKSKAAARWIVVKCNRQKGSTDCGYYVMHWISTIILGSFTNNWEARPQ

SEQ ID NO: 232337 - protein, 112 aa, Glycine max
  Coding DNA Sequence Number=SeqID_115559
MHNNCHLQTWTNQVNKQQRLSLRVEEEEATQRGKKKKKKKKKQPTASYTVSGSSEVEQNSTKGIIVHFDSLFRLWVHQAKIGCAGGLDRKVLWYPGPFYIPGRVTVGEHQEA

SEQ ID NO: 232338 - protein, 52 aa, Glycine max
  Coding DNA Sequence Number=SeqID_115560
MEDMQLFELQEQGGTQENPDNCQFFQWVEEENQLSNSSSVSRETMVVADLRL

SEQ ID NO: 232339 - protein, 101 aa, Glycine max
  Coding DNA Sequence Number=SeqID_115561
MWKNVDGHITTINNVEVKEMKGVCVLKEFGAHFLTIKIGNKTTKVANSKEISVTIATNHSLSNVGKTGTIKNYKSHNREAQTKILIVYMTLKISSHTYARF

SEQ ID NO: 232340 - protein, 58 aa, Glycine max
  Coding DNA Sequence Number=SeqID_115562
MGDRSMILDLQPMEVGIVSFGGIRKGKIIGIDRYNYCIWICFDQLGHLIWEERNMALS

SEQ ID NO: 232341 - protein, 76 aa, Glycine max
  Coding DNA Sequence Number=SeqID_115563
MAAQLIHDRVEMECLEGTWETLEGNTRCRFWGTIRFTATSLVHPDEPARTLQRTEFDDCIHVAEATTMDTFALDDT

SEQ ID NO: 232342 - protein, 259 aa, Glycine max
  Coding DNA Sequence Number=SeqID_115564
  Gene Ontology: Mol. function=hydrolase activity
  Homolog annotation: Hit_ID=Q1IPD0; Match level="QueryCoverage=94%, HitCoverage=94%, E-value=1e-37, Identity=41%"; Hit description =Hypothetical protein precursor
  Pfam annotation: Domain name=Esterase; Domain location=34-234; Score=- 43.7; E_value=0.0071; Accession=PF00756.11; Description=Putative esterase
MVRSMSRWLPLLALLMMSGCTSLPDSARGRFEARAVKVEGETAYYQVFIPAGVQAAAPTHLPVILFLHGSGERGADGVKQTYAGLGPYLREHPDFPALVVFPQVPGHEEWSGRNNRAAVAALDATIAEFGADPARQYLTGMSMGGYGSWNIALDDPRRFAAIVPVCGAVLAPRAKRPTLFVEQVAQETDPYAVIAQRLRHTPIWIFHGALDDVVPPDDDRSCTPPSMAPAHATYAIPSTPTATTTPGMPPMRTRQCGRG

SEQ ID NO: 232343 - protein, 81 aa, Glycine max
  Coding DNA Sequence Number=SeqID_115565
MNETTNLTKSANPQSRECRGGKNKPQTVKKPYKQVTTYGHVITKEPKLNTELATKRCTSCYNHLKDGVVMHWGCNNKKFAA

SEQ ID NO: 232344 - protein, 59 aa, Glycine max
  Coding DNA Sequence Number=SeqID_115566
  Homolog annotation: Hit_ID=Q0H950; Match level="QueryCoverage=75%, HitCoverage=7%, E-value=3e-18, Identity=93%"; Hit description=Lethal leaf spot 1-like protein
MNSRGSWGFSGANEGNPQISAKFVAPCYMVNKIKIDTKLPVVGDQSAYFYGLSLIYLFK

SEQ ID NO: 232345 - protein, 111 aa, Glycine max
  Coding DNA Sequence Number=SeqID_115567
MRAAIVNGEKLGDVKGAAIVHGEKHADLAERRVGRHCVLPLHLVRAINAAIASCETGHWLGHCFITLHASWVTCIAAVQGSHGYNVPVKWPEDFGENWLHGHALMACVVFI

SEQ ID NO: 232346 - protein, 277 aa, Glycine max
  Coding DNA Sequence Number=SeqID_115568
  Gene Ontology: Mol. function=nucleic acid binding
MAPLSASDFIVDEHLFWGFDDDECNGIVAVAFVVVVIVHLTFVVKPLFLMFDEISLILHHNGKFIQNENEALEYVGGEFCIWEEVETYLVNVWTPQELCKACCNYEKFISVCYLVSGIGLQRLTNDHDVLSMCQTGLTDPKKEAHVYLENVDPEGVLLMKLENVAEVVAEKCTHNGIEDMDVDGAKGGSDDENEVVGTGVPDAETEVVETKPEVARVEIEVNNGADNDEVKIMYPQYNPTSSFGEVHLEVGMEFDTIKMFIEVVRDYTIFRSEMGKN

SEQ ID NO: 232347 - protein, 83 aa, Glycine max
  Coding DNA Sequence Number=SeqID_115569
  Subcellular localization annotation: CTP_CleavageSite=62; ConfidenceScore=5.63e-01
MAVLSSRELLASGSNETASTSAVSPLTMAAPSTSPSFSPLTMAASVSRHYCWRHPCATTFVRCEVQGSMWFYLHNSTLYCHMS

SEQ ID NO: 232348 - protein, 421 aa, Glycine max
  Coding DNA Sequence Number=SeqID_115570
  Gene Ontology: Mol. function=sulfuric ester hydrolase activity; Cellular component=integral to membrane; Biological process =metabolic process
  Homolog annotation: Hit_ID=Q0MAL1; Match level="QueryCoverage=97%, HitCoverage=71%, E-value=1e-134, Identity=54%"; Hit description =Putative membrane protein
  Pfam annotation: Domain name=DUF1705; Domain location=1-85; Score =3.6; E_value=4e-07; Accession=PF08019.2; Description=Domain of unknown function (DUF1705)
  Pfam annotation: Domain name=Sulfatase; Domain location=107-416; Score=255.7; E_value=9.2e-74; Accession=PF00884.13; Description =Sulfatase
  Pfam module annotation: Pfam domain module=DUF1705::Sulfatase; Domain location=1-85::107-416
MAIYGLVPSLVVVAVRIRHRPILDKLLWNTISILVCLAITGIISFANSKTFTTAIRQHKDIVKSVNPLSPIMSTVHYFTQAGKEVDIQVSPIGKDAKVLPALGNVHKPRITVIVAGETARAANFSLNGYGRETNPELKKRDVVYFPSTTSCGTATAISIPCMFSQFTRSQYSHKKALANENVMDVLVHAGVSATWLDNNTGSKDVADRIPYFDLPSTNDSRFCTGGECRDDIFFDKLDAWLDNVKKDSVIVLHQMGSHGPTYYLRYTDEFRKFTPDCRTAELGNCSDAEIVNSYDNTLLYTDHFLSTVIDKLKARSDKLATGMIYASDHGESLGENGVYLHGAPYLLAPDQQTHVPFLVWFDDDFAKSMGLDKACLAKSAAEGGRSHDNYFHSILGMMNVSTSVYDPSLDVFSGCTQRRTS

SEQ ID NO: 232349 - protein, 137 aa, Glycine max
  Coding DNA Sequence Number=SeqID_115571
MVETKNKRIKSIGHRLTATKTKSKKEKESANGGSSNNGFILLELLECHRLKKLVEMKDTFYLELVWEDIVGLSLKWMMVNDKGLQDASVKFNKVTKYNALMKDSSTFIVIVSKGKGKEIFGISPLLLEHRLLVYVIA

SEQ ID NO: 232350 - protein, 81 aa, Glycine max
  Coding DNA Sequence Number=SeqID_115572
MERRTHPYKQQILSTDDAEYTESTVTRTTHHHTYHTQVHVTEDRGDHLDKSFEEMEEYQELLRQLELMSEEENDDSSKDAS

SEQ ID NO: 232351 - protein, 258 aa, Glycine max
  Coding DNA Sequence Number=SeqID_115573
MVFRLNDLENYNLYRRNYGIARKMDILRHLHLALDNFSCANKPHKGRAIKSCTTEELDNKKLNYMMLHGTRNLIEEKKLLRNKNMCHKTDDASSSRLLELMKNVQMKYSSYNHHCKQKNCDKLHKEIKRFEVTRKKSAQLKQGIRNHVKIMSDELMEMRKKKHALETKIKHVNREIEVINEEIIRSFQKHLKGRFCRNDAYLFMLQEMKNKGYWVLNSIDLGYDQAFGFRDIYSKKFLCYNISTLNDDDLSCNKDFSK

SEQ ID NO: 232352 - protein, 368 aa, Glycine max
  Coding DNA Sequence Number=SeqID_115574
  Gene Ontology: Mol. function=chitin binding; Cellular component =extracellular region; Biological process=chitin metabolic process
  Homolog annotation: Hit_ID=UPI00006A17C9; Match level="QueryCoverage =96%, HitCoverage=100%, E-value=5e-43, Identity=29%"; Hit description= UPI00006A17C9 related cluster
GYTPSPLEDPHGLTFRGLRAFTFRELHALALRGLHALAFRGLHVLTFKGLHVFAFRGLHVVAFRGLHILVFRGLHVLAFRGLHALAFRGLHVLSFRGLHALTFRGLHVLAFRVLHALAFRGLHVLPFKGLHVLAFGGLHALAFRGIHVLAFRGLHAVAFRGPHVLTFRGLHALTFRGLHVLALRGAARRRIQRTTRRRLQRAARPHLQRTARPHFQRTPRPFPQRTTRPRLRGLHVVTFQGLHVLVFRGLHVLAFRGLHVLIFRGLHALSFRGLHILFFTGLHVLAFIGLHDLAFRGLLSLAFRGVHVLGFKGLLDLAFKGLHVLAFRWLHSLAFIGLHALSLEGLHLLAFRGLLVIAVIGLPTRHHQ

SEQ ID NO: 232353 - protein, 62 aa, Glycine max
  Coding DNA Sequence Number=SeqID_115575
MVTVCKSNKEGNILLFWECPLNHTTLCMGGNEPSSLSKAFGSAYVRLGSARLVYYKGQAQAF

SEQ ID NO: 232354 - protein, 45 aa, Glycine max
  Coding DNA Sequence Number=SeqID_115576
  Homolog annotation: Hit_ID=Q9CA40; Match level="QueryCoverage=71%, HitCoverage=22%, E-value=2e-07, Identity=60%"; Hit description=Nudix hydrolase 1
MVDVDVVKEQVSQNLEPTKCDGWDWYEWDHLSHPLFGPLEKMILG

SEQ ID NO: 232355 - protein, 264 aa, Glycine max
  Coding DNA Sequence Number=SeqID_115577
MESKDNVEDNDQFQISEKMIREEAHYYLYRHNDSTVRQKDILNHLRQALDNISFANKPHKGRAIRSCTTEEELDCKKLNYMMLHGRRNLAEEKQLFRNKNMCHKTDDASSSSLQEIMKNVQMKYSYYNRLYKQNNCHKLLKEIKHFEVTRKKSAQLKQSIRNQEKIMNDELIEMGKKRHALETKIKHVDREIDLIYEELKPFHKDYKEANCQKDASLFMLQMKRREYRVLKCSNLEYDFIRFHDIYLEKPLSQERSVYLHFFMV

SEQ ID NO: 232356 - protein, 50 aa, Glycine max
  Coding DNA Sequence Number=SeqID_115578
MSKKVDMNEEEPSVNEENGEELDVHQHVDCYYAFNISQVFATRDDVLHWA

SEQ ID NO: 232357 - protein, 207 aa, Glycine max
  Coding DNA Sequence Number=SeqID_115579
  Gene Ontology: Mol. function=DNA binding
  Homolog annotation: Hit_ID=Q1S0F5; Match level="QueryCoverage=50%, HitCoverage=21%, E-value=8e-11, Identity=37%"; Hit description=IMP dehydrogenase/GMP reductase
MARVAKVVKISAQELDRVKQNKNGVVGIPRKRLEEKAEALENQGEWTSFINILALLVFGTILFPNVDELVDLAVIDAFLAYHHSKESLVIVVLANAYDTFDLRCEKSDSRIVCCTPALFVWLVSHVFRHEGRPIGPLQGYPMRGAPSEEIIAPFIAWGFNEGNAKILQRIRKVWDMVERKDKELRGSNNDVISGYHKWLRARMQGMT

SEQ ID NO: 232358 - protein, 142 aa, Glycine max
  Coding DNA Sequence Number=SeqID_115580
  Gene Ontology: Mol. function=oxidoreductase activity; Cellular component=membrane; Biological process=metabolic process
  Homolog annotation: Hit_ID=Q1I900; Match level="QueryCoverage=95%, HitCoverage=53%, E-value=1e-52, Identity=77%"; Hit description =Putative oxidoreductase, short chain dehydrogenase/reductase family
MAPFFLAQAALPWMRRRGGGCLLVTSSVTGPRVAYPGLAHYAASKAGVNGFIRAAALELAAEKIRVNGVEPGMIRTPAMANLGDAQVNQAIAASVPLGRLGEPEDIAAAMVFLASPAAAYITGQTLVVDGGALLPETNSLLT

SEQ ID NO: 232359 - protein, 134 aa, Glycine max
  Coding DNA Sequence Number=SeqID_115581
  Gene Ontology: Mol. function=transcriptional repressor activity; Cellular component=intracellular; Biological process=regulation of transcription, DNA-dependent
  Homolog annotation: Hit_ID=Q8GFC5; Match level="QueryCoverage=93%, HitCoverage=85%, E-value=4e-46, Identity=73%"; Hit description=HpcR
  Pfam annotation: Domain name=HTH_10; Domain location=13-60; Score= -7.1; E_value=0.041; Accession=PF04967.3; Description=HTH DNA binding domain
  Pfam annotation: Domain name=MarR; Domain location=13-82; Score=62.0; E_value=2e-15; Accession=PF01047.13; Description=MarR family
  Pfam module annotation: Pfam domain module=HTH_10::MarR; Domain location=13-60::13-82
MGFFRPILKSHNLTEQQWRIIRVLANSRSIEFHELAAETCILRPSLTGILSRMERDKLIFRLKPVNDQRKLYVSLTQQGQDLYEVARHQVEQGYAEIEAAFSRQKMDQLMTLLDELITLGDSLPANVTAHPTKK

SEQ ID NO: 232360 - protein, 387 aa, Glycine max
  Coding DNA Sequence Number=SeqID_115582
  Gene Ontology: Mol. function=5-oxopent-3-ene-1,2,5-tricarboxylate decarboxylase activity; Cellular component=nucleus; Biological process=aromatic compound catabolic process
  Homolog annotation: Hit_ID=Q9RPU5; Match level="QueryCoverage=95%, HitCoverage=99%, E-value=1e-130, Identity=52%"; Hit description=4 -hydroxyphenylacetate degradation bifunctional isomerase/decarboxylase [Includes: ...
  Homolog annotation: Hit description=2-hydroxyhepta-2,4-diene-1,7 -dioate isomerase (EC 5.3.3.10) (HHDD isomerase) (5-carboxymethyl-2- hydroxymuconate Delta-isomerase); 5-carboxymethyl-2-oxo-hex-3-ene-1 ,7- dioate ...
  Homolog annotation: Hit description=decarboxylase (EC 4.1.1.68) (5 -oxopent-3-ene-1,2,5- tricarboxylate decarboxylase) (OPET decarboxylase)]
MGTLVSLKPGKSTQALLVIFFTDNVVNQTADALDLHHHFVARLHVGQPFRRAGGDHVARLQRHEFTQVGDQERNVENHVGGAAALAQLAVDVGAERQPVRIGDVVAIDDVRPDRRQGVAALHPQIRPVVVLQVIADGVVVAQGVTRHVLHGVLAADVARGLADHRHQLGFVMHVLHAGWAHRHLAVPGQGVRRLEEHQRFLRRLEFQLAGVVGIVQPEGEHRALRRRQPFHFALLQHLAVRQRDAQLVVHLDVDGLAMMANTGMFHDAAPAWVTRLVSVGRPAARTVTSSPGLISTRWCGVPISTASSGCMVMKSLMAAISSGTERTRSAVDQRSCSTPLISVTISSRSAASSWPISPSGQNPSRHLALIAGREKLLSGRLTSLADA

SEQ ID NO: 232361 - protein, 107 aa, Glycine max
  Coding DNA Sequence Number=SeqID_115583
MVHDIFVKVKLEVTRTSTILNVFGSRRSSDVYDPNMVGSWYRTHATKNERKTQGSCMSKHENKSPPNLSQKNDDLRLIHCWIVVKFEHHVRNSILSIFTVGNFDIMS

SEQ ID NO: 232362 - protein, 58 aa, Glycine max
  Coding DNA Sequence Number=SeqID_115584
MHFGYFGQKTRFREEIIESKCFRNASVSDSVEILHRSSSFFTVLRSLTVLFSSVFNVL

SEQ ID NO: 232363 - protein, 52 aa, Glycine max
  Coding DNA Sequence Number=SeqID_115585
GRIVLGNSQIPSQIQRQRRIEGYLAWASTPCTKWFKKRGGVQFSPKELLPLT

SEQ ID NO: 232364 - protein, 84 aa, Glycine max
  Coding DNA Sequence Number=SeqID_115586
MVTSMLQLDSMNLFVKARAWFNPITQGMAILIANTSSTFHRDERLGNMHAMHGKCNYEIEMSKEHPFLVNHALEENARVTHEQT

SEQ ID NO: 232365 - protein, 198 aa, Glycine max
  Coding DNA Sequence Number=SeqID_115587
  Gene Ontology: Mol. function=calpain activity; Cellular component =intracellular; Biological process=proteolysis
  Homolog annotation: Hit_ID=Q1S671; Match level="QueryCoverage=93%, HitCoverage=48%, E-value=1e-15, Identity=32%"; Hit description =Cyclin-like F-box; F-box protein interaction domain
MSDPYFIKLHLSKSAAKDDLEHLQLMKNVCLGSIPEIHMESCDVSSIFHSLQMETFLFNFANMPGYHLVGSCNGLHCGVSEIPEGYRVCFWNKATRVISRESPTLSFSPGIGRRTMFVFGYDPSSDKYKVVAIALTMLSLDVSEKTEMKVHGAGDSSWRNLKGFPVLGTLPKVGGVYLSGTLNWVVIKGKRKSFILKS

SEQ ID NO: 232366 - protein, 274 aa, Glycine max
  Coding DNA Sequence Number=SeqID_115588
  Gene Ontology: Mol. function=DNA binding
  Homolog annotation: Hit_ID=Q1SFS3; Match level="QueryCoverage=88%, HitCoverage=47%, E-value=3e-30, Identity=33%"; Hit description =Lambda repressor-like, DNA-binding
MEAIASLAQYYDQPLRCFTFGDFQFAPIVEEFEGILGCPLGGRKPYLFSGFYPSLDQGKQIENGVVGVPRKCLEEKARALASQDEWAPFIDVLALLIFGVVLFPNVDGLVDLAVIDAFLAFHNSRESPVVIILADLYDTFDRRCEKSSIRIVCCTSALYVWLVSHLFHQEKRHVCPLEGHRSCVEKREANWDRLIASKEGASVNWFPQWKEGRTGILFTCGGFPNIPLMGTRGCINYNPILTIRQLGYLMRGALSEEGLVGSSGLRIIKKGALN

SEQ ID NO: 232367 - protein, 83 aa, Glycine max
  Coding DNA Sequence Number=SeqID_115589
MLKSSPNMHVKQEVSTRVKPRLLCKQSMGQNTPNKIDDDGSNSHQGEKQGFQFTKCQETPISKTITHYMYITYNSKRHMQCCT

SEQ ID NO: 232368 - protein, 105 aa, Glycine max
  Coding DNA Sequence Number=SeqID_115590
  Subcellular localization annotation: CTP_CleavageSite=92; ConfidenceScore=5.21e-01
MGAKYLEVVKRGSYPNSGWSPNEIRARKASIAARSTNPSTFGKRTPPKINSARMSMNGAHSPLLAKILAFSSKYFLGIPTTPFSTCFLWSNSCAEIWTILEILAN

SEQ ID NO: 232369 - protein, 408 aa, Glycine max
  Coding DNA Sequence Number=SeqID_115591
  Homolog annotation: Hit_ID=Q1LMU0; Match level="QueryCoverage=34%, HitCoverage=34%, E-value=7e-45, Identity=60%"; Hit description =Monooxygenase, FAD-binding
GESTPVVGTATEVIRLTTSPPTCRRSMKATVRLWSEHGEIVRKRSQHACGSGNADPAFHYAFNAFPARNTGRLSRRIAHCGNSLLRCCPTVKHPRRWLLIGSITTATVGVIVLVLTTPLVSNALLLLMERSNFIPAESSILTFEPYAINDGSSNYWLFGKDRTYYYHFTYEDDVPYVYIPQDNRCPGFDRQNARTWCSALPGKARWRGGGATGCALPTELFPQISFDLRRRSAIVSILLHGVNRNFHVTSAAAFRRRCLLPSRAQAAAMEVDLLGDAPRGGRVQQRIERPIGLQVIHRPAQQALAAEGRGDLLCYPFGVRPLATQMAGNRLADRPAVPPRRMDAAGRQRRDDARRVTGQDQARAADRAVRPAARHQTGTGGRRARRGRNADHIAHMLKEAIDIWRPHP

SEQ ID NO: 232370 - protein, 210 aa, Glycine max
  Coding DNA Sequence Number=SeqID_115592
  Gene Ontology: Mol. function=chitin binding; Cellular component =extracellular region; Biological process=chitin metabolic process
  Homolog annotation: Hit_ID=UPI00006A17C9; Match level="QueryCoverage =88%, HitCoverage=100%, E-value=3e-25, Identity=33%"; Hit description= UPI00006A17C9 related cluster
  Subcellular localization annotation: CTP_CleavageSite=58; ConfidenceScore=5.58e-01
ALAFRGLHVLTSEDYSSSLQRTTRRQLQRTTRPHLQRATHPNLQRTTRPRLQRATRPRLQRATRPLLQRATRPRLKRATRPYLQRSTRPRLRGHHALAFVGLHALPFRGLHTLAFRGVHVLAFRATRPHLQGVTCPPLKRTTRPHLQRTTHPHLKRSTRPCLQRTTRPHLQRTTRPHIQRTIRPHLQRTTRPHLQRTTRPHLQRTTRPHL

SEQ ID NO: 232371 - protein, 101 aa, Glycine max
  Coding DNA Sequence Number=SeqID_115593
  Subcellular localization annotation: CTP_CleavageSite=37; ConfidenceScore=5.21e-01
MALTKESPSNITYCYPSAPTNKGNSCVHVALSLRKTRQQVSSNGGSWQPPMVLGDKGGAKLHFWRWAGHFALSKLPPHVGIMLSALVSLSEYPSWVGIALN

SEQ ID NO: 232372 - protein, 44 aa, Glycine max
  Coding DNA Sequence Number=SeqID_115594
MVIEGGQKVVEVDLVLAQMVKAKRVDIQHLQGHRIEFVEVQVDA

SEQ ID NO: 232373 - protein, 70 aa, Glycine max
  Coding DNA Sequence Number=SeqID_115595
MSVSEIYFAVDLFKRRMNELGRERDKGSGRGHEHERKLIERVERMCQSSGCWKLKRTSAWERHWAGDVVK

SEQ ID NO: 232374 - protein, 73 aa, Glycine max
  Coding DNA Sequence Number=SeqID_115596
MEIEARVGKLYLISNTALCGSRGRYGVDPTFSSLRCELGLRIYSSGFQSLRNSKNIFTKIAIFSAKTSNALIQ

SEQ ID NO: 232375 - protein, 123 aa, Glycine max
  Coding DNA Sequence Number=SeqID_115597
SFFTKIIIFEDGVAEAEEVLEGGASGGSRSRCRQWRPSSRQGPKGQSNGGRWRVPSFDHFHHWHIINTRRRGKKKKCTILQGDTHKGERSDLKVKVKTSEVGDSDHTWSSKDYTDPLPLLPLS

SEQ ID NO: 232376 - protein, 99 aa, Glycine max
  Coding DNA Sequence Number=SeqID_115598
  Gene Ontology: Mol. function=aldehyde dehydrogenase (NAD) activity; Cellular component=mitochondrion; Biological process=metabolic process
  Homolog annotation: Hit_ID=Q56YU0; Match level="QueryCoverage=81%, HitCoverage=16%, E-value=3e-24, Identity=62%"; Hit description =Aldehyde dehydrogenase 2C4, cytosolic
MTFNNGDAAAASLNKVPTVNFTKLFIDGHFVHSVSGKTFETIDPRTGDVIARISEGDKEDIDIAVKAARHAFDNGPWPRLPGSVRYFFPSLFLYYAQGD

SEQ ID NO: 232377 - protein, 47 aa, Glycine max
  Coding DNA Sequence Number=SeqID_115599
MGSESEREGQRNWAGEEMEATMVASNAREICYVAAASRMELTNYIDK

SEQ ID NO: 232378 - protein, 125 aa, Glycine max
  Coding DNA Sequence Number=SeqID_115600
  Gene Ontology: Mol. function=oxidoreductase activity
  Homolog annotation: Hit_ID=Q6L469; Match level="QueryCoverage=60%, HitCoverage=33%, E-value=8e-16, Identity=62%"; Hit description=RNA recognition motif containing protein, putative
MNSGGYTIEVTCLSPKATEKHQYDFLLSVVQLSMLKLPGFCYCNGRLLNEARELASPIRYPWELKPLDTWIKSITSSASLTGRSVAAAANTMVNSSYFSKGAMWVSGALNQVAKVAADLGSGAKQ

SEQ ID NO: 232379 - protein, 1448 aa, Glycine max
  Coding DNA Sequence Number=SeqID_115601
  Gene Ontology: Mol. function=RNA-directed DNA polymerase activity; Cellular component=chromatin; Biological process=chromatin assembly or disassembly
  Pfam annotation: Domain name=Chromo; Domain location=1355-1405; Score= 30.5; E_value=6e-06; Accession=PF00385.14; Description='chromo' (CHRromatin Organisation MOdifier
  Pfam annotation: Domain name=RVP_2; Domain location=327-451; Score= -19.9; E_value=3.6e-05; Accession=PF08284.2; Description=Retroviral aspartyl protease
  Pfam annotation: Domain name=rve; Domain location=1090-1246; Score =116.5; E_value=7.5e-32; Accession=PF00665.16; Description=Integrase core domain
  Pfam module annotation: Pfam domain module=Chromo::RVP_2::RVT _1::Retrotrans_gag::rve; Domain location=1355-1405::327-451::576 -745::95-185::1090-1246
MAEHGTRRTTTDRLEDAISILSEKHSDLASKVDAMYEQLSQIHSASHPSPQHSGHPRPPVKLEVPRFDGHDPLGWIFKISQFFEYQGTSEEDCITVASFYLDGAALSWFQWMYRNGFITSWSALLQAIENRFAPSFYDDPRGTLFKLMQRGSVTEYLTEFERLANRIVGLSPSVLLSCFISGLSPEIRHEVQALQPASLPHATALARLQEDKITDRRRSSRPSFSSPHTPTPTPSSQPSTSTPRPKTPFIQRTQEEMTYRREKGLCYNCDEKWNSSHHCKGRVLFFITASDDPSFSDTTSPEITTHSPNEPSPTFDPTSLHPHISLHAMADVPATETFRLYGLVNHARVTILVDSGSTHNFIQPRVAKFLNLPLEATTPLRVMVGNDSVLDCWQLCPATKLLIQDHSFTITLRVLPLSGADIVLGVEWLRTLGPIVTDYSAFTMHFNHQGQPITLHADVQSDTDPVSANQVRHMLHTQSTSALFHLSLLPVNSIEAPPDPPHPISAINALLLRFNSLFQQSSTLPPPRNHDHHINLLPSASPVNVRPYRYPHFQKTEIEKQVTALLESGFIQPSRSPYSSPVLLVKKKDGTWWMCVDYMALNSITVRDRFPLPTIDELLDELGRASWFSKIDLRQGFHQILMAPKDVSKIAFRNHHGHFEYRVMPFGLCNAPSTFQAAMNAVLGPHLRKFATVFFDDILIYNETLPDHVHHLERVFTSLTQAQYYLKRSKCLFGQRKLDYLGHVVSEKGVQPDPSKIQAILDWPAPRSAKELRAFLGLTGFYRKFVKGYAAIATPLTRLLCRDAFQWVPESQEAFLALKRAMTAAPVLALPNFSLPFALETDASGTTMGAVLQQQRHPIAFFSKPFCPRMQHASTYVCELHAITAAVRKWRQYLLGHKFTNFTDHRSLHDLMSQVIQTLEQQFYLAKLLGFDYDIQYKVGSSNIVVDSLSRIDHTGQAQCLLLSVPHHEFLTQLKQALFASPDFQTQKKAIQAHPKDHPHFTIANKLIFFKNAIWIDSRNPFIPALLHEYHATPLGGHFGVKKTLHRLRSNFQWTTMIADVKSFIRECRVCQQVKHVTRKSAGLLQPISPPTGIWEDLSMDFITHLPSSHSFTVILVVVDRFSKGPHLGALPTQFTAFKVATLFLDIVCKLHGFPSSIISDRDPVFINSFWRELFKLSGTTLRMTTAYHPQSDGQTEVMNRSVEQYLRSFVHKRPKEWHKFLPFAEWAYNTSQHSGTGVTPYEVIYGKPPPSVPGYVLGSSRNEVVDTLLHSRAELHESLRRKLLKAQAEMKHFADKKRRDVQYEIDHVAYRLQLPEGSRIHPVFHCSLLRPHHGPLDLPTSSLPADTSSPHPILEPLAILDSRMDFSVDPPTRFVLVQWVGLPPEDSTWEKWDDVCHAHHLEDKVSFTGSDDVSSSNTTKEDNNHDEPVPRRQRSSTRPKHLEDYVL

SEQ ID NO: 232380 - protein, 503 aa, Glycine max
  Coding DNA Sequence Number=SeqID_115602
  Gene Ontology: Mol. function=sucrose transporter activity; Cellular component=integral to plasma membrane; Biological process=sucrose transport
  Homolog annotation: Hit_ID=Q000Y6; Match level="QueryCoverage=99%, HitCoverage=78%, E-value=0.0, Identity=68%"; Hit description=Sucrose transporter 2A
  Pfam annotation: Domain name=MFS_1; Domain location=43-459; Score= -49.5; E_value=0.058; Accession=PF07690.6; Description=Major Facilitator Superfamily
MYFKVWQKTAVHSGRISYDMSGCDTHEHCRTFKGTRTRAALVFILGFWMLDLANNTVQGPARALLADLSGPDQRNVANAIFCSWMAVGNILGYSSGASGKWNKNTLALSLGLALALFMCFTVVLSMFAADYYFTLSHLCRWFPFLTTRACCEACGNLKAAFLVAVVFLTLCTLVTLYFADEVPLTTASQHHHLSDSSPLLDEQQQNGVDFSKLKPLSVMDESNSKRTENHIEKDTELKHGNFKAGEDHAENVMDGPGAVLVNLLTSLRHLPPAMHSVLVVMALTWLSWFPFFLFDTDWMGREVYHGDPKGDTSEVDLYDQGVREGAFGLLLNSVVLGISSFFIEPMCKWMGAKLVWALSNFIVFVCMAGTAIISLISVRDYSGGIEHIIGANEGIKMASLVVFVLLGFPLAITYSVPFAVTAELTADSGGGQGLAIGVLNLAIVVPQMIISLGSGPWDALFGGGNIPAFVLASVCALAGAVIATLKLPDLSSSSFQSTGFHIG

SEQ ID NO: 232381 - protein, 87 aa, Glycine max
  Coding DNA Sequence Number=SeqID_115603
AICEIPGHAGKQKKILMHKSVRFRDTPEIKWKHRCAISPLGLSRRFLQKAVASGGSNPACLGELGGKLLPQFSINRGRSEVKKGSAP

SEQ ID NO: 232382 - protein, 304 aa, Glycine max
  Coding DNA Sequence Number=SeqID_115604
  Gene Ontology: Mol. function=chitin binding; Cellular component =extracellular region; Biological process=chitin metabolic process
  Homolog annotation: Hit_ID=UPI00006A17C9; Match level="QueryCoverage =82%, HitCoverage=100%, E-value=1e-24, Identity=32%"; Hit description= UPI00006A17C9 related cluster
GLYVLAFRGLHVLTFRGLHVLDFRGLHVLDFRGLQVLTFRGLYVLSFRGPHVHAFRGLHGYTPFPSEDYTSSPSEDYTFPLSEDYTSSTSEDYTSTTSEGSRPHLQRAARPHLQRTACPHLQRTTHLPIRGLHVLTLRGLHVLSFRGLHALAFRGIHVLTFRGLHVPTFRGLHILNFKRLHIHDIRGLHVLTFRGQNALTFKGMHVLTLRGLRVLTFRGLHVPNLEGCSPSPSEDYTASPSEGRVPTPSEGYTPSPLEDYTSSPSEDYTSSPSEDYMSSPSEDYTSSPSEGHMSLPSEDYMPRH

SEQ ID NO: 232383 - protein, 59 aa, Glycine max
  Coding DNA Sequence Number=SeqID_115605
MQNEKFMIEQTRKSNSGAQLSWANKSSAYTHIPVKVKVVFGIGCAAGGLCGWFRGGISR

SEQ ID NO: 232384 - protein, 149 aa, Glycine max
  Coding DNA Sequence Number=SeqID_115606
  Homolog annotation: Hit_ID=Q6CQE3; Match level="QueryCoverage=28%, HitCoverage=35%, E-value=2e-13, Identity=80%"; Hit description =Kluyveromyces lactis strain NRRL Y-1140 chromosome D of strain NRRL Y- 1140 of Kluyveromyces lactis
  Subcellular localization annotation: CTP_CleavageSite=55; ConfidenceScore=5.04e-01
MRSRSLTELTRQIAPPTKNGHAPPPIESRKSSQSVNPYYVWTCTGGTTRPVKDRSASPAEGTSRPVHTGGGPIDPTQAGITAAAGTRLALQWILVKGFRLYSFQLPDSMSPVLLFIVTTSPCQDWVICAPAAFLGCGSRFSGSLSGIEP

SEQ ID NO: 232385 - protein, 56 aa, Glycine max
  Coding DNA Sequence Number=SeqID_115607
MTRRSEKVQGFVSRSRRKIKWCHQLSQPTLRREGDARLTDASSEGGRRMKSPLTFI

SEQ ID NO: 232386 - protein, 124 aa, Glycine max
  Coding DNA Sequence Number=SeqID_115608
MRLPGKESLLMKSPITINEILDVSISFLNDHLEETLGSTKIEEIHSKCINLAQGKVYGESGFWLKACRMARHDTCQGLVWFKDKRDAPHYFHDTNAKMMIWKLYAKLVMHAPMRTLKCQIFMVM

SEQ ID NO: 232387 - protein, 158 aa, Glycine max
  Coding DNA Sequence Number=SeqID_115609
MSGAYGQDGGGSAPPSYGSSGGYSSVGGYGATGGGGAGGGGSYGGGGYGGGGGGAGYGGSDGGGGYGTKGSGNGGGYGGNDSGGYGGRGGYGGNDGGGYGGRGGGGGAGQGGRGGGGYGGRGGGGGGGFQGGDRGGRGGGRGGGRGGGRDGDWRCPNQ

SEQ ID NO: 232388 - protein, 94 aa, Glycine max
  Coding DNA Sequence Number=SeqID_115610
MQKGRRKYLKVSVLRWRKRNVNPKGEKVVVTTTVLKVMALCPSKGCNNRIHRPMLKNKGVNDMGIDRGRGMVMVKGTMDVAALAKKLSEKLRGR

SEQ ID NO: 232389 - protein, 163 aa, Glycine max
  Coding DNA Sequence Number=SeqID_115611
  Gene Ontology: Mol. function=lyase activity; Biological process =metabolic process
  Homolog annotation: Hit_ID=O81396; Match level="QueryCoverage=53%, HitCoverage=8%, E-value=1e-11, Identity=51%"; Hit description =Aconitase-iron regulated protein 1
MPWKLKRNDLTSQYNVGGYIPQQDGAGDAAHGVFEIEALAEGTDSHTTMIYGPGVAGWGVGGIEAEVAMLGQTCVVLTIGGVIPMSMVQPGVVGLKLLGKLRDGVTATDLVLIVTQMLRKHGVVGKFVVITKKTIFLLGSINGHAVTLLVIWVESYVFGEMPK

SEQ ID NO: 232390 - protein, 80 aa, Glycine max
  Coding DNA Sequence Number=SeqID_115612
MWIVLRFSGSRTAMAWRSWPYTCATLLAWARGRRKVRRRGQRRWVGDKEKEIKKRGEKRVGGEGKKRGVEEVGREGKKRN

SEQ ID NO: 232391 - protein, 67 aa, Glycine max
  Coding DNA Sequence Number=SeqID_115613
  Homolog annotation: Hit_ID=Q1SP37; Match level="QueryCoverage=94%, HitCoverage=19%, E-value=8e-08, Identity=43%"; Hit description =Bacterial adhesion
MDTMKNIILACLILYNMIVEDERDTYNDNIDVDYDHIDEEILNIGVSRDVHPDIVAYLQTRHYMHIR

SEQ ID NO: 232392 - protein, 34 aa, Glycine max
  Coding DNA Sequence Number=SeqID_115614
MELVMACKETTEEDVADFCSKEVVGIVTQYTSFI

SEQ ID NO: 232393 - protein, 48 aa, Glycine max
  Coding DNA Sequence Number=SeqID_115615
WAPHVLFHMMGESDSPSQRGSQTPHATTLDEFTLQMTEMESGTRYVNV

SEQ ID NO: 232394 - protein, 121 aa, Glycine max
  Coding DNA Sequence Number=SeqID_115616
  Gene Ontology: Mol. function=hydrolase activity; Cellular component =integral to membrane; Biological process=hypersensitive response
  Homolog annotation: Hit_ID=Q9XI60; Match level="QueryCoverage=95%, HitCoverage=40%, E-value=5e-32, Identity=54%"; Hit description=Lipid phosphate phosphatase 2
  Pfam annotation: Domain name=PAP2; Domain location=3-114; Score=53.4; E_value=7.4e-13; Accession=PF01569.12; Description=PAP2 superfamily
MLSVFHKGNGDVVCTEIKAVIKEGYKSFPSEHTSWSFAGLGFLSWYLSRKVRVFDRRGNIGKLCLVLLPLLIAALVGITRVDDYWRHWTDVFVGGLIGLTVSSICYLLLFSLPTLPHGTNS

SEQ ID NO: 232395 - protein, 60 aa, Glycine max
  Coding DNA Sequence Number=SeqID_115617
MEYGGVELQRTPAITNPDNGHEPRGRSRTPTAVTNPSDDDGEEETTVTGLRGEGEKCFCF

SEQ ID NO: 232396 - protein, 76 aa, Glycine max
  Coding DNA Sequence Number=SeqID_115618
ACVESTSKDKKESSSDATRNPWGSLALAFGHDHTSYEVYVMGGALIGSWSLALTFGRDHSSYDTGSRVTVAKCTLY

SEQ ID NO: 232397 - protein, 460 aa, Glycine max
  Coding DNA Sequence Number=SeqID_115619
  Gene Ontology: Mol. function=RNA-directed DNA polymerase activity; Biological process=RNA-dependent DNA replication
MEMSMRRGTHLHLQGPELPKMEEEKKEKAKNSLSLLGQPAHNKRGGIELTSLLKSLLELTSNDAILAQNKLLPKKIEAFTDQFNKILQQLHSLQLTQPSNMQVKGCTLCGSAHKDAKIVKATNKEATKATIEREIKAKVLIRSMHEEGLAHDVVKGVVEDDSNDEEEKNRERERERERELSVENAEKMMKIRKIVSRRVGIHEVLIPKTKSHVVRKAKKGACIEPTKDVPYPLVPSRKEKEHYFARFLDIFNELEITIPFGEAPQQMLLYAKFLKELLTKKDKYINNESIIVEENCCAMLLKTPSKVQWPRKCDHPFLNRGISVGKTLIDLGASINLMNLSMLKRIGNIELKPTYMTLQLADQSIKRPHVIIEDVLVKVQEFTFLVYFVIMDIKENVEVTLIFERPFMLTAKYVVDMKNGNLEISMAAEWRRKKDDWRHQFKEKMSQTQAHHHRKPWIRA

SEQ ID NO: 232398 - protein, 248 aa, Glycine max
  Coding DNA Sequence Number=SeqID_115620
MASFVEAKESIDEEDPRATSSNGAYISGGAHKDGLCIGQEEANRELNYMASQNCQSYKQGGNQGYNQKGNQGYYRRWKFHLKNNFNKDQGGLSNQPPNQGPNLYDKTTKLKDTLTQFMQVSISNHKSIESTIKNLEVQEGIDEVLIPKTKSHVVRKAKKGACIEPTKDVPYPFVPSRKEKEHYFARFLDIFNELEITIPFGEAPQQMLLYAKFLKELLTKNDKYINNESIIVEGNCSAMLLKTPSKVQ

SEQ ID NO: 232399 - protein, 580 aa, Glycine max
  Coding DNA Sequence Number=SeqID_115621
  Gene Ontology: Mol. function=RNA-directed DNA polymerase activity; Biological process=RNA-dependent DNA replication
  Homolog annotation: Hit_ID=Q0ZCD0; Match level="QueryCoverage=17%, HitCoverage=9%, E-value=1e-41, Identity=74%"; Hit description =Integrase
MAGDGPSRLTLEDYSSSSTPQYFTSIFRLDVVKKFLKKYFPKSKTAQGKAKISSFHRFPSELLSEALNHFRGFLRKTLTHGFSEPIQLNISIDGLQPHLMQLLDAFASGKIKLKTPNEAMELIGNMAVSDHAILYDRAYTPTKKSGAHESGKCMTQEEVSKEGGNFSHNQGQGWRSHLGNNFNKDQGGLSNRPPNQDPNLYERAAKLKDTLTQFIQVGQLAKQLVEQSTGNFVTNTKKNPKKEHKVVLTRSKRKESLEKEEGVKGVVENKLEITIPFSEALQQIPMYTKFSKDLLTKKAKYINNENIMVEGNYSVVIQRILPQKFKDPESVSIPCSIVTNGNLEMSVEDQKVNFNLFEAMKHPIFTKTCFRVETIEQAKHAVQQFTIHSPLEKALMNAIECLLNKEEKDLRACLEDLVRLKEIPSGEYAFEELKKDTPTKKHKVELKVLPSHLKYIFLEAVCKEVLKLLEVVPKKGGMTVIHNDKNDLIPTQTIIRWQMCIDYHKLNDVTKKDHFPLPFMDQMLERLAGQAFYCFLDGYSGYNQIAVHLKDQEKTTIICPFGVFAYRQMSFELCNAPTTF

SEQ ID NO: 232400 - protein, 46 aa, Glycine max
  Coding DNA Sequence Number=SeqID_115622
MGLASHFHERLTNTKEIISESHDADGGLVWDNAESRCMVEGTKVVV

SEQ ID NO: 232401 - protein, 298 aa, Glycine max
  Coding DNA Sequence Number=SeqID_115623
  Gene Ontology: Mol. function=rhodopsin-like receptor activity; Cellular component=integral to membrane; Biological process=G -protein coupled receptor protein signaling pathway
  Homolog annotation: Hit_ID=Q336N0; Match level="QueryCoverage=70%, HitCoverage=60%, E-value=5e-65, Identity=55%"; Hit description=LrgB -like family protein, expressed
  Pfam annotation: Domain name=LrgB; Domain location=147-294; Score= -119.0; E_value=0.0019; Accession=PF04172.6; Description=LrgB-like family
  Subcellular localization annotation: CTP_CleavageSite=55; ConfidenceScore=5.02e-01
VFGVIHLAVSLGLILAVDKFLKQAFVAAAIKFPSALFGMFCIFSVLIILDSTVPAAATAFVSFFVPAFMFIQRWLPLFYVPSLVVLPLAVKDIPAASGAKIGLILVGGWLATFCVAGYAAIAVRKAVKTELVEAEPMGKPAPFSLKSLGTSARTCLPFLLAASVLGYMVGSGLPPNVKKVFHPIICCALSADLTAFAFGYFSRSGLEPVLGMVTRCITVALALSIVSLFDGANSSLTAAVVVLTGLVGANFVQATLDKLSFRDPIARGIATASRLGTAALSAKEPEALPFCAIAYALN

SEQ ID NO: 232402 - protein, 76 aa, Glycine max
  Coding DNA Sequence Number=SeqID_115624
MSLDDILSADSKGSKLHLDGFNDDIGQQKKETWAMRETCEWIVDCFHELVPDMALEIPFEWMHFRRRVQQSYSTYA

SEQ ID NO: 232403 - protein, 101 aa, Glycine max
  Coding DNA Sequence Number=SeqID_115625
MSKGSLDGTRGCINYNPVLAIRQLGYLMRGVPSDESITPFIARGFSDHNARLKPWNEKPRRPERKNTTKTSFEGLYRATIVSSSSEEVKGIMPLTREGKLR

SEQ ID NO: 232404 - protein, 254 aa, Glycine max
  Coding DNA Sequence Number=SeqID_115626
  Gene Ontology: Mol. function=hydrolase activity, hydrolyzing O -glycosyl compounds; Cellular component=membrane; Biological process =carbohydrate metabolic process
  Homolog annotation: Hit_ID=Q9FGH4; Match level="QueryCoverage=89%, HitCoverage=47%, E-value=4e-80, Identity=67%"; Hit description =Putative glucan endo-1,3-beta-glucosidase 9 precursor (EC 3.2.1.39) ((1->3)-beta-glucan ...
  Homolog annotation: Hit description=endohydrolase 9) ((1->3)-beta -glucanase 9)
  Pfam annotation: Domain name=Glyco_hydro_17; Domain location=1-247; Score=22.3; E_value=3.4e-12; Accession=PF00332.9; Description =Glycosyl hydrolases family 17
MVPSTYGSKYNSCRYVAVGDEPFLKSYGEQFHPFLIGAAMNIQAALKKAKLDSKVKVVVPCSFDSFESGFNLSSGVNFRPDLNKTMIELLAFLDKHGSPFFVTISPFITHLQTKNISLDFSLFKETARPHNLSHKTYKNSFDLSYDTVATVLSTAGYPNMDIVVAKIGWPTDGAANASSYLAETFIKGLINHLHSNLGTPLKPHKPPLETYILSLLDEDQRSITSGNFKRHWGLFTFDGQAKNHVDLGQVQRAS

SEQ ID NO: 232405 - protein, 74 aa, Glycine max
  Coding DNA Sequence Number=SeqID_115627
MAEPSKKRKGTSSHSQRHSGSQEMPIPSSIPSGSLFSLEEQSIQCLAPIIRQFVKFRDVPEIKRKHRCTNSEVP

SEQ ID NO: 232406 - protein, 312 aa, Glycine max
  Coding DNA Sequence Number=SeqID_115628
  Gene Ontology: Mol. function=ribonuclease H activity; Cellular component=membrane; Biological process=defense response
  Homolog annotation: Hit_ID=Q2HRG4; Match level="QueryCoverage=99%, HitCoverage=22%, E-value=1e-91, Identity=57%"; Hit description =Ribonuclease H
  Pfam annotation: Domain name=NACHT; Domain location=14-168; Score= -27.3; E_value=0.0077; Accession=PF05729.3; Description=NACHT domain
  Pfam annotation: Domain name=NB-ARC; Domain location=2-271; Score =54.3; E_value=9.4e-14; Accession=PF00931.13; Description=NB-ARC domain
  Pfam module annotation: Pfam domain module=NACHT::NB-ARC; Domain location=14-168::2-271
MNSLLKLELKDKVCFIGIWGMGGIGKTTLARVVFKKIRNKFDISCFLENVREISQNSDGMLSLQGKLLSHMKMKDLKIQNLDEGKSIIGGILFNNKVLLVLDDVNDIRQLENLSVNDQKWLGPGSRIIIITRDMEVLRSHGTVESYKIDLLNSDESLQLFSQKAFKRDQPLEHLLQLSKVAVQQAGGLPLAIEMMGSSFCGRSESQWKEFLEVKEYTKKDVVMDKLIISYDGLPPNYKILFLDIACFFNGWVKEHVTQILTICGRYPANGIDVLIDKSLATYDGSRLWMHDLLQEMGRKIVVEECPIDAGKR

SEQ ID NO: 232407 - protein, 130 aa, Glycine max
  Coding DNA Sequence Number=SeqID_115629
MITIENENAWDEQCTSHKSAKPFRFKVLQNWDDIVDLCAKDRAIGHGAEMAMDADEAMSRETNKVECIGLGVTATIDLEEPSSNTKGKRQGSTCSGTHSHKRRWEKKEGISASLDKMTNSFNRMVEKMDG

SEQ ID NO: 232408 - protein, 454 aa, Glycine max
  Coding DNA Sequence Number=SeqID_115630
  Gene Ontology: Mol. function=RNA-directed DNA polymerase activity; Cellular component=intracellular; Biological process=RNA-dependent DNA replication
MKYADLLPALLAKNLVQVRTPPRTPDVLPPWFRHDLTCAFHQGAPGHDVENCYVLKNEVQKLVRANLLSFKDQNPNVQANPLPNHGPAVNMIQDCDEDGVILNVQHVRTPLVPIHIKMCEAALFDHDHVACEICPVNVKGCPKVQEDVQRLIDNRELIITRKDKEVCVITPEFQRLEISYNSGESTTTPLVVGLAGPMPYASLKAVPYKYSATMLEGGQEVPLPSLTPAISVDNIASDSKVLRNGRVIPTLFAKKVNDPAVKQVTVNGPGTRKEVGQSNGTSKNSDHDEILKLIQKSEYKVVDQLLQTPSKISILSLLLNSEAHREALMKVLDQAFVERDVTVNQLDSIVGNITACNNLSFSDEELPEEGRNHNLALHISVNCKSDALSNVLVDTGSSLNVMAKSTLDQLSYQGPPMRRSGVVVKAFDGSRKSVIGEVDLPITIGPFVFQITFQ

SEQ ID NO: 232409 - protein, 52 aa, Glycine max
  Coding DNA Sequence Number=SeqID_115631
MHIVAVRQGQDHLELPFGVRTKCGQQKPIKVLRNGCKWGWGHDRLIVALSLR

SEQ ID NO: 232410 - protein, 61 aa, Glycine max
  Coding DNA Sequence Number=SeqID_115632
RFPDYGKLNPLLDLSCRYLIGNWSDSKVLDSTGLSCCAITRNRGQGWAIMRNRGLAVQETT

SEQ ID NO: 232411 - protein, 111 aa, Glycine max
  Coding DNA Sequence Number=SeqID_115633
MALLIGRGSINVCTNNPWISPHVIELDRLWDYDSLQIGRVWATICYLRASSDLSMKGADNHKVCPHATRPSGHDNRIETFSRSRPEDADISGKGADDHISLCVSTGSLASS

SEQ ID NO: 232412 - protein, 175 aa, Glycine max
  Coding DNA Sequence Number=SeqID_115634
  Homolog annotation: Hit_ID=Q2TE74; Match level="QueryCoverage=30%, HitCoverage=11%, E-value=4e-11, Identity=62%"; Hit description =Phytochelatin synthase PCS2-7R
ADIVEQIRTTGLFKHVTRWLDSESSCCNTLANLGDKDMLPALAATKASEAIALGKLKTLTESTIRERALTTQHSSMITISKFEYEYLTNHAASVEEIADKKVAAAEAWIEALKASEKEILMETKIAQRKLKESKLEQELEVYTKEKMLSRRVSSSEELDNWPRKREKSSSKNFIV

SEQ ID NO: 232413 - protein, 79 aa, Glycine max
  Coding DNA Sequence Number=SeqID_115635
  Subcellular localization annotation: CTP_CleavageSite=8; ConfidenceScore=5.07e-01
MQVSSPVRAELTWVSNPCTKRVKKGEGEGFCTQKTLPPPSFKKQRLTGFTSFASLRSPFFAFLIPFCSIIHLRQAYGAF

SEQ ID NO: 232414 - protein, 41 aa, Glycine max
  Coding DNA Sequence Number=SeqID_115636
MAQPLILRTYQMNTRLVGSKIMIVILTPLPGPKELSLYVLK

SEQ ID NO: 232415 - protein, 758 aa, Glycine max
  Coding DNA Sequence Number=SeqID_115637
  Gene Ontology: Mol. function=calcium ion binding; Cellular component =nucleus; Biological process=regulation of progression through cell cycle
  Homolog annotation: Hit_ID=Q1SYS5; Match level="QueryCoverage=46%, HitCoverage=80%, E-value=1e-155, Identity=51%"; Hit description =Pentatricopeptide repeat
  Pfam annotation: Domain name=PPR; Domain location=1-35; Score=24.0; E_ value=0.00052; Accession=PF01535.11; Description=PPR repeat
  Pfam annotation: Domain name=PPR; Domain location=139-173; Score =36.1; E_value=1.2e-07; Accession=PF01535.11; Description=PPR repeat
  Pfam annotation: Domain name=PPR; Domain location=174-208; Score =19.8; E_value=0.0095; Accession=PF01535.11; Description=PPR repeat
  Pfam annotation: Domain name=PPR; Domain location=209-243; Score=5.5; E_value=1.7; Accession=PF01535.11; Description=PPR repeat
  Pfam annotation: Domain name=PPR; Domain location=246-279; Score=9.5; E_value=0.56; Accession=PF01535.11; Description=PPR repeat
  Pfam annotation: Domain name=PPR; Domain location=280-314; Score =26.3; E_value=0.00011; Accession=PF01535.11; Description=PPR repeat
  Pfam annotation: Domain name=PPR; Domain location=36-70; Score=24.2; E_value=0.00046; Accession=PF01535.11; Description=PPR repeat
  Pfam annotation: Domain name=PPR; Domain location=71-105; Score=13.1; E_value=0.21; Accession=PF01535.11; Description=PPR repeat
  Pfam module annotation: Pfam domain module=PPR::PPR::PPR::PPR::PPR::PP R::PPR::PPR; Domain location=1-35::139-173::174-208::209-243::246 -279::280-314::36-70::71-105
VIYGALVEAFVAEGKVGLAFDLLKDLVSSGYRADLGIYICLIEGLCNLNRVQKAYKLFQLTVREGLEPDFLTVKPLLVAYAEANRMEEFCKLLEQMQKLGFPVIADLSKFFSVLVEKKGPIMALETFGQLKEKGHVSVEIYNIFMDSLHKIGEVKKALSLFDEMKGLSLKPDSFTYCTAILCLVDLGEIKEACACHNRIIEMSCIPSVAAYSSLTKGLCQIGEIDEAMLLVHDCLGNVSDGPLEFKYSLTIIHACKSNVAEKVIDVLNEMIEQGCSIDNVIYCSIISGMCKHGTIEEARKVFSNLRERNFLTESNTIVYDELLIDHMKKKTADLVLSSLKFFGLESKLKAKGYNYEWSRQNEEADVRAEAHHNWVDEVIRCEGRGGSVIGNDNRSSCLIIQQRPEIKGPSLLTREEIEKPEIWAQICIQRMVELAKESTTMRRVLDPIFVYFDSRQHWAPQKGLAMIILSRMAYFMENSGNQRLILASVIHHLDHKNVMNDPQLKTCVIQVATSLAMQIRSESGLAEIGFVGVLCRHLRKSLQASSEFVGEQELNLNISLQNSIDDCLLEIANGVIDAQPLFDLMAINLENIPSGVVGRATIGSLIILARAVTLALSHLHSQQGFPEALLVQLLKVMLHSDEEARVGAHLIFSILLFPSSFHTNEISSLRSRYLGQHNKRHSHAPSVSASASITALLEKLRRNRNTKAENHVNIVHDQERDIVAEDWKQGCGLKNSPNFYKLTSIIDKATGSPSLTDT

SEQ ID NO: 232416 - protein, 250 aa, Glycine max
  Coding DNA Sequence Number=SeqID_115638
  Gene Ontology: Cellular component=nucleus; Biological process =regulation of progression through cell cycle
  Homolog annotation: Hit_ID=Q10MI0; Match level="QueryCoverage=99%, HitCoverage=47%, E-value=6e-17, Identity=41%"; Hit description =Cyclin, putative, expressed
MAINLENIPSGVVGRATIGSLIILARAVTLALSHLHSQQGFPEALLVQLLKVMLHSDVEARVGAHLIFSILLFPSSFHTNEISSLRSRYVGQHNKRHSHAPSVSASASITALLEKLRRNRNTKAENHVNIVHDQERDIVAEDWKQGCGLKNSPNFYKLTSIIDKATGSPSLTDTDFPSNSAGEDDTISEASVSDLSRFIPKMPLSPSAPHVISIGQLMESALEVAGQVAGTAISTSPLPYNTMASQCESL

SEQ ID NO: 232417 - protein, 429 aa, Glycine max
  Coding DNA Sequence Number=SeqID_115639
  Gene Ontology: Cellular component=nucleus; Biological process =regulation of progression through cell cycle
  Homolog annotation: Hit_ID=Q10MI0; Match level="QueryCoverage=99%, HitCoverage=42%, E-value=1e-138, Identity=58%"; Hit description =Cyclin, putative, expressed
MGVISRKIFPACGNMCVCCPALRSRSRQPVKRYRKLLADIFPKSPDESPSERKITKLCEYAAKNPFRIPKIAKYLEERCYKELRYEHIKLVNIIAESFNKLLSICKVQIAYFAVDVLNVILELLSYSKDETIQTLGCQCLSKFIYCQMDATYTHNIEKLVPKVCMLSREHGEACEKRCLRASSLQCLSAMVWFMAEFSHIFVDFDEIVRATLDNYEWSRQNEEADVRAEAHHNWVDEVIRCEGRGGSVIGNDNRSSCLIIQPRPEIKGPSLLTGEEIEKPEIWAQICIQRMVELAKESTTMRRVLDPMFVYFDSRQHWAAQKGLAMIILSRMAYFMENSGNQRLILASVIHHLDHKNVMNDPQLKTCVIQVATSLAMQIRSESGLAEIGFVGVLCRHLRKSLQASSEFGGEQELNLNISLKNSIDDCLL

SEQ ID NO: 232418 - protein, 46 aa, Glycine max
  Coding DNA Sequence Number=SeqID_115640
MSPNFTGLGSTEIVCTDNCFGYLRMSPDFTGQDDKDAEDDDSEFDG

SEQ ID NO: 232419 - protein, 119 aa, Glycine max
  Coding DNA Sequence Number=SeqID_115641
  Gene Ontology: Mol. function=helicase activity
  Homolog annotation: Hit_ID=Q1SRJ5; Match level="QueryCoverage=98%, HitCoverage=14%, E-value=1e-28, Identity=49%"; Hit description =Probable helicase [imported]-Arabidopsis thaliana-related
YIYLPNRYICPCESTWRIFGFPIHGRKPAVERLHFHLPGQHSVLYEDHDDIDDVLSKPSISDSKFISWMNTNQNSVEGRNLTYAEFVSKFLYNKKKRCWHLRKKGYTIGRLLWVPPITG

SEQ ID NO: 232420 - protein, 102 aa, Glycine max
  Coding DNA Sequence Number=SeqID_115642
MKEVQWGSASGKQDLSPRGGGREVADDQGVIRKYGRKAHMSGLRKDINVLRNYLTSRRLQKPRDRSGGETEPSPWRPPWRPGRPPPYRSPIRTLLCGRSPPT

SEQ ID NO: 232421 - protein, 39 aa, Glycine max
  Coding DNA Sequence Number=SeqID_115643
MYISTSGVKLRRQQRRVKQLQSAEEVREVWGVVSNNKQQ

SEQ ID NO: 232422 - protein, 102 aa, Glycine max
  Coding DNA Sequence Number=SeqID_115644
MLAIVGYGDDVDVGSRDNPRASIKDGDGVDVGIEDGPCASRCDGDGLTSVRGGDGVDTTSEDLTSIDTVDEDGVDDVKLSLGGSSLTTSFFLPTCPFPTRFM

SEQ ID NO: 232423 - protein, 316 aa, Glycine max
  Coding DNA Sequence Number=SeqID_115645
MEDLPLMIFLCYTYRWSVAAKAVTLSIRQQFGHLWPTWGGIPKDRQELFFQFHPSKVATKAVTLFIRQQSGHPWPTWGAIPKDCEELYFQHFKDTGQFVDDRSRQTHAKLSQVRSNVASSVGESQHIPVDPAEEQRLMSWCRLQLGDQSVRDKFMALETLLVLMNLKMKTSCNIRKDLPVALKMPERLTDQGRSFVNQRNKCVNFSQLSFSSYLLKCETLFININNPTSNIMTSNSRTSSSNKTMTKQTTSNNIMSSRDTLAMTILIIDGVSNHSSSLSNTLPLIFKKKMTPLMKKIQGLQAPHGATSCGIKSIFV

SEQ ID NO: 232424 - protein, 219 aa, Glycine max
  Coding DNA Sequence Number=SeqID_115646
MAYSLVDASIEAPQASFHHWRSKGFDLGGYSDLTSKYALAHDKEGKDDKVCKKYDISKEKWTQFCQRRRDPSWEDVRKKAQAIQKQNIAPHGNFVAHGRQDVLTAAIKRPEHPSRVCAAGVGVMIKNYFGPASRSSRISSSMAIEDLEYTKEICVDPSRQDPETGDSDKCGLYVDDSPPRLVALLRVYEGSTTVHNIPLGNDQVKVSIEEARHADAHIP

SEQ ID NO: 232425 - protein, 131 aa, Glycine max
  Coding DNA Sequence Number=SeqID_115647
MACLAEGFGLSAWARSARKPLPLDEGLVHLGRVSVAQRVAYVSLSAGVALSDASSIGACRPRIFFINGFLCFLEDEWQRNEERKRERRRHFKEKMSLEEAHHHRRPWIRAWRKKEMNEGRGREEHEILCSK

SEQ ID NO: 232426 - protein, 340 aa, Glycine max
  Coding DNA Sequence Number=SeqID_115648
  Homolog annotation: Hit_ID=Q1SKD7; Match level="QueryCoverage=57%, HitCoverage=50%, E-value=1e-06, Identity=24%"; Hit description =Ankyrin
MASKKRHTSSSRPQEPYDTSRFVSEIAWERYETNLHHRNIPPEWNVELAYSYYDEFLRELERHQWHKNLTRQMENHIDLALVKEFYSNLYDPEDYSPKQCKVQGKMIKFDAATLNIFLETPVMLEPRERYSAYSRYCHTNPDHQVIAAKLCLPGWGFILNAEGASWKLLRKDLTTLAQTWSVLSYSNLAPTSHTSDLNMDRARGVVSDSLTFESLSPAINLAYIRKNYWSPADPSITFPSDPIMPMLQSIHHGLCLVMQSMQNLSQQQPIMTMQEYLAQAPQAQDAQAQAVEGSPKDKEAAEDTPEAREDIGAVEADVDADYVADVTAAQRTWDPWPIPA

SEQ ID NO: 232427 - protein, 154 aa, Glycine max
  Coding DNA Sequence Number=SeqID_115649
  Gene Ontology: Mol. function=transition metal ion binding; Cellular component=cytoplasm; Biological process=cytoskeleton organization and biogenesis
MGDRLEDMICDLAQESFQQAHVPMYHTFQIDSKKPLYLGCNKSLTLLSAVLSLVNVKAKYGWSDKSFKSLLQVGHDMLPKENMLPKSYYQANKILCPMGMEYQKIRACPNDCILYRHELEEMHKCPRCGVSQYKVMDDDECSSDKNLKKAPLAK

SEQ ID NO: 232428 - protein, 1003 aa, Glycine max
  Coding DNA Sequence Number=SeqID_115650
  Gene Ontology: Mol. function=transmembrane receptor activity; Cellular component=membrane; Biological process=defense response
  Homolog annotation: Hit_ID=Q1SI46; Match level="QueryCoverage=95%, HitCoverage=90%, E-value=0.0, Identity=58%"; Hit description=Leucine Rich Repeat, putative
  Pfam annotation: Domain name=LRR_1; Domain location=606-627; Score =3.4; E_value=65; Accession=PF00560.23; Description=Leucine Rich Repeat
  Pfam annotation: Domain name=LRR_1; Domain location=629-650; Score =8.3; E_value=8.1; Accession=PF00560.23; Description=Leucine Rich Repeat
  Pfam annotation: Domain name=LRR_1; Domain location=652-671; Score =7.9; E_value=9.4; Accession=PF00560.23; Description=Leucine Rich Repeat
  Pfam annotation: Domain name=LRR_1; Domain location=673-701; Score =10.6; E_value=3; Accession=PF00560.23; Description=Leucine Rich Repeat
  Pfam annotation: Domain name=LRR_1; Domain location=716-737; Score =8.3; E_value=8; Accession=PF00560.23; Description=Leucine Rich Repeat
  Pfam annotation: Domain name=LRR_1; Domain location=739-760; Score =14.3; E_value=0.43; Accession=PF00560.23; Description=Leucine Rich Repeat
  Pfam annotation: Domain name=LRR_1; Domain location=783-810; Score =3.7; E_value=58; Accession=PF00560.23; Description=Leucine Rich Repeat
  Pfam annotation: Domain name=LRR_3; Domain location=606-625; Score =22.1; E_value=0.002; Accession=PF07725.3; Description=Leucine Rich Repeat
  Pfam annotation: Domain name=NACHT; Domain location=214-365; Score= -16.5; E_value=0.0011; Accession=PF05729.3; Description=NACHT domain
  Pfam annotation: Domain name=NB-ARC; Domain location=174-468; Score =108.4; E_value=2.2e-29; Accession=PF00931.13; Description=NB-ARC domain
  Pfam annotation: Domain name=TIR; Domain location=19-149; Score =155.5; E_value=1.4e-43; Accession=PF01582.10; Description=TIR domain
  Pfam module annotation: Pfam domain module=LRR_1::LRR_1::LRR_1::LRR _1::LRR_1::LRR_1::LRR_1::LRR_3::NACHT::NB-ARC::TIR; Domain location =606-627::629-650::652-671::673-701::716-737::739-760::783-810::606 -625::214-365::174-468::19-149
MVAASKQMLDNVPQMKYDVFVNFRGKDIRDGFLGYLTRAFHQKQIYAFIDDKLEKGDEIWPSLVGAIQGSSISLTIFSENYTSSRWCLEELVKILECREKYRQTVIPVFYGVNPTDVRHQKGNYGEALAVLGKKYNLTTVQNWRNALKKAADLSGIKSFDYKTEVDLLGEIINTVNLVLISLDTHPFNIKGHIGIEKSIQHLESLLHQESKYVRVIGIWGMGGIGKTTIAEEMFKKLYSEYDSYYFLENEEEESRKHGTISLKEKLFSALLGENVKMNILHGLSNYVKRKIGFMKVLIVLDDVNDSDLLEKLIGNLDWFGRGSRIIITTRDKQVLIANKVDDIYHVGALNSSEALELFSFYAFNQNHLDMEYYKLSKRVVNYSQGIPLVLKVLGHLLCGKDKEVWESQLDKLKNMPNTDIYNAMRLSYDDLDRKEQKILLDLACFFMGLNLKVDHIKVLLKDSEKDDSVVVGLERLKDKALITISEDNIISMHDIIQEMAWEIVRQESIEDPGNRSRLMDPNDIYEGTEAIRSIRADMSVIRKLQLSPHIFTKMSKLQFLYFPSKYNQDGLSLLPHGLQSFPVELRYVAWMHYPLKSLPKNFSAKNIVMFDLSCSQVEKLWDGVQNLMNLKELKVSGSENLKELPDLSKATNLEVLDINICPRLTSVSPSILSLKRLSIAYCSLTKITSKNHLPSLSFLNLESCKKLREFSVTSENMIELDLSSTRVNSLPSSFGRQSKLKILRLRDSGINSLPSSFKNLTRLQYLTVYKSRELCTLTELPLSLKTLDATDCTSLKTVLFPSIAQQFKENRKEVLFWNCLKLDEHSLKAIGLNAHINVMRFAYQHLSAPDENYDDYDRTYESYQVKYVYPGGIVPEWMEYKTTKDYIIIDLSSSPHSSQLGFIFSFVISGPMVKAIMGYRFTFYITVSDDEDENKKDSIDIYMSDSIVWVASDHLLLDGKDTMPMVTKGCLVISADKGYKAIYILSGPSSLVLCDAITKAIIL

SEQ ID NO: 232429 - protein, 75 aa, Glycine max
  Coding DNA Sequence Number=SeqID_115651
MEAPFPESMNPYLRHKIISHRTRSSEGHTCGCCTANEWVPRTRRSVTTNWVYGKVDMTVSVSVTVDWVRVLVDTG

SEQ ID NO: 232430 - protein, 303 aa, Glycine max
  Coding DNA Sequence Number=SeqID_115652
  Homolog annotation: Hit_ID=Q9AVH2; Match level="QueryCoverage=16%, HitCoverage=15%, E-value=1e-13, Identity=79%"; Hit description =Putative senescence-associated protein
MFTHALQNGCFDPGHYVNESRVSREFGSAQTTCARHEFWALTPCRTAVFALCHYIRHVNESRLSRELGSAHTSCARHEFWALTPCRTAVFAPCHYIRHVNESRVSREFGSAQTTCARHEFWALTPCRTAVFDPRTLYSSRERKSGFPGIRQRTDHVRVQRILGTLAMPNFSFCPLPLYSSRERKSGFPGLSHLWALKPYIVDMSHSIDSSVIMRGFSPPPVRKGASRRPATARRPSRLSQWHGPLGRERPNVGRGERRAQAPVASLDSDLEAFSHNPAHGSFAPLAFQPSAMTNCVNQRFLSY

SEQ ID NO: 232431 - protein, 68 aa, Glycine max
  Coding DNA Sequence Number=SeqID_115653
MRRRPGIGGLQMHAAAKRSISTDLMKEQLATIRSQLEDFARKHSSKKVRARKRERLCCKGCCAWRRGE

SEQ ID NO: 232432 - protein, 92 aa, Glycine max
  Coding DNA Sequence Number=SeqID_115654
MANKEEPTRRCFSGSVEFLVLGVFGGMGWVEFGFCEDLFDFEFLEMRCVFCGGVRRDLFGWVLGVWRGKSTSAARGFYHSPYQPSMTVVNRL

SEQ ID NO: 232433 - protein, 958 aa, Glycine max
  Coding DNA Sequence Number=SeqID_115655
  Gene Ontology: Mol. function=protein kinase activity; Cellular component=intermediate filament; Biological process=protein amino acid phosphorylation
  Homolog annotation: Hit_ID=Q2R3D9; Match level="QueryCoverage=16%, HitCoverage=56%, E-value=9e-21, Identity=38%"; Hit description =Expressed protein
MDQEDNKMDTVNPHEMSSNPLSLEKDEIMGTENPLSSGKDDVMGTKNPPEVSSNSLSSAKDGMVDTANPTKVLSNPTLSVKDNMMGTEIHPSSGKNGEMCAENPPEVSSNSPSSGRDSLMGTENPTEVFSNPLSSRKDDMMSSENLPEVTSDHTTSRKEDGKKETDSPEGSSKPELSDKNTPQSLKVKSKIVKKSQTVKLKAKKKNGSQQICGKRVMSSKEVVDNSENCHIADEKQISDDSELKETNDEPPKGKSEEAENKMKGSQNTCTGNKSPIEELDGIQLKDTDPPEGFSKPELSDKNTLKSLKENSNIVKKSQAVKVKAKKYHGSQQVHGKKRIVTSKKVVDNAESCHNADEKQISDNGELKETNDEAPKGKWEEVENKIKESQNTSISDKSPKEESNGSQLKDTDPPDGSSKAELSDKNTPQPLKAKSKIVKKSRAGKLKAKMNNGPQQIRGKRGIRRTSKKVDNSESCHNADEKQILDNSQLKETNDGPPKEKSQEAENKVKGSQNRSTSGKSPREMSQQAQKDKTSQLDKTEQKQKSKEKHRKLSKGSMIRKNKDKSSGMERNQLKGKKGEKLGGFIFLCNAKTKPDCFRYHVMGVSAGKKDDVLQIKPGLKLFLYDFDLKLLYGIYKASCSGGMKLEPKAFSGKFPAQVRFKIASDCFPIPESIFKKAIKDNYNEKHKFRTELTVRQVRKLTQLFRPVGIHSAVHPVHSQPKVIIQEREIRSAVQPVHSQPKVIIRERESSDSVRGSWTHLQRESYNVRSINRDQFDRREEIADDLFRVEIPHDLFRMEGYTPSHLPRDRRNVATTSHVNPLLEYYEGDYQPYHLDRGYPRNVSAHVESLRTDPLYLDDSWDPYHAYHRGVSARDAYFAPLSREEISPNSYLAGGRPFVGTDNLPRREAVQDRHYPIYSAPDALSDHHRMRPYHGDKFEASRGPVSSRYSFAGPSFHRQ

SEQ ID NO: 232434 - protein, 162 aa, Glycine max
  Coding DNA Sequence Number=SeqID_115656
  Gene Ontology: Mol. function=structural constituent of ribosome; Cellular component=intracellular; Biological process=translation
  Homolog annotation: Hit_ID=Q9LJA1; Match level="QueryCoverage=72%, HitCoverage=37%, E-value=3e-24, Identity=48%"; Hit description =Arabidopsis thaliana genomic DNA, chromosome 3, BAC clone:F16J14
  Pfam annotation: Domain name=Ribosomal_L18p; Domain location=40-157; Score=12.1; E_value=5.6e-07; Accession=PF00861.12; Description =Ribosomal L18pL5e family
MESDAKLQSSNEAHMAPRSFFGVEDFLDDDNSRPYTYQKGKKSKNPNKHISFKQRTIAYMEPFTLDVFISKRFVSASLTHRVTSKQVAVAGTNSKDIKAVLRSRSDIPACIAIGRILAERAKEADVYTGSYTPRDRDKFEGKIRAVVQSLIDNGIDIKVYLD

SEQ ID NO: 232435 - protein, 67 aa, Glycine max
  Coding DNA Sequence Number=SeqID_115657
MSLQSENTYKVQMKLESKGGWCCEFMEAILVRVVDWRSGVTDDEGWAKCGLCRANRKRRKHCSLVGT

SEQ ID NO: 232436 - protein, 225 aa, Glycine max
  Coding DNA Sequence Number=SeqID_115658
  Gene Ontology: Mol. function=transcription factor activity; Cellular component=nucleus; Biological process=regulation of transcription
  Homolog annotation: Hit_ID=Q1SA40; Match level="QueryCoverage=94%, HitCoverage=94%, E-value=1e-82, Identity=76%"; Hit description =TAFII55 protein conserved region
  Pfam annotation: Domain name=TAFII55_N; Domain location=1-158; Score =211.6; E_value=1.8e-60; Accession=PF04658.4; Description=TAFII55 protein conserved region
MEEQFILRVPPNVAERIERLLNENNASSSEDKSLDLSFREDGRSGTFMIGNEQFPASLLDLPCVVESYKTYDDNSLIKTADIGQMIMVRESGDAAPDVIEYRHGLTPPMRDARKRRFRREPDLNPELVSRVEKDLLKIMAGGTADNLDILTSFCPPDSGNKLNFGYFLDRNSHVETAEQEEGDENARGANKKSAPKPAPKHDIPENLTNAGEADRSDSEESDDSV

SEQ ID NO: 232437 - protein, 136 aa, Glycine max
  Coding DNA Sequence Number=SeqID_115659
MDFSEYLALVGQICVVLGQCVANYIDWFYMIYHPLIRPTQPKDPTRHQPVVQDDTYVEPDIPQYSVAAAAVEEAPADAPSHVEQPQHAVDVCQAIAERLEWLLNLKIVIEVIEAYSVMEGCLRIARGVTTKRNVYV

SEQ ID NO: 232438 - protein, 540 aa, Glycine max
  Coding DNA Sequence Number=SeqID_115660
  Homolog annotation: Hit_ID=Q2R3D9; Match level="QueryCoverage=33%, HitCoverage=54%, E-value=2e-26, Identity=42%"; Hit description =Expressed protein
MRRDRKKGSKNPPGESSNPQSSEKDDHNKDTNLAEGSSKPEQSNKNTPQSLKAKSKIAKKSKGGKFKTIMNKGSQQIGGGRRLRKNNKVVGNSDELPKEKSEKDGRNKEKESQNRSTDDKSPIDNSHQAEKNKIIKVDKSEQKQKSKEKHTESDKGAGSRINRTKHSRVENTNSSEKRREKPSGFIFMCSAKTKPDCFRYRVMGVSATKKDIVLSIKPGTKLFLYDFDLRLLYGIYRASSSGGMKLEPRAFGGNFPAQVRFNVASDCFPLPESIFKKAIKENYNEKNKFKTELTARQVKKLTELFRPVDVRSGLQPVRSPPKAIIPDRVAPDGVRGSWSYLHRERDPQIERQEEIPRDLFLTEKSYRAYGLQGDKRNAIPAPQVNPTLDPYERDYERDHLHHVDPLYRTNVPSYRESLHADPHHFNESEHQTYLRGGISAHADDPYHQYPYGASPRDPYLPPMSRQEISSSTYLAGGRSLTASDNLQRREAVQDRLYSTYSAADALSEYNRMQHYQESLKATAVPVSSRYSFAGPSYSLR

SEQ ID NO: 232439 - protein, 115 aa, Glycine max
  Coding DNA Sequence Number=SeqID_115661
  Subcellular localization annotation: CTP_CleavageSite=37; ConfidenceScore=5.78e-01
MAKAKASTGIVGFPSRASPKTGSTCAKRRRTVKTSKNATALKSLGRLLFDGVLFLVDSELPNRTTKLSFAKGVSLARSRRFTNNRLSMGITCQPQYLHKHNDSLSKRLITTIIRT

SEQ ID NO: 232440 - protein, 171 aa, Glycine max
  Coding DNA Sequence Number=SeqID_115662
  Homolog annotation: Hit_ID=Q1T1Y0; Match level="QueryCoverage=38%, HitCoverage=14%, E-value=2e-08, Identity=52%"; Hit description =Ankyrin
  Pfam annotation: Domain name=DUF1723; Domain location=105-154; Score =43.5; E_value=7.3e-10; Accession=PF08330.1; Description=Protein of unknown function (DUF1723)
  Subcellular localization annotation: CTP_CleavageSite=42; ConfidenceScore=5.27e-01
MILPPPSLRVVLPPRCRHQIALSPLRSSPPPLFLFCRQACARRQREAAPSFEDVQHMDHAADEVHEQPKEATVDDEVVDVEGFPSGLHDTSVLNGYANHVAVIVWNREGLISVFAERWHNEISSFHLPVVEVTITLNDVAFLLHLPITGAFHSFETVHVEEVVLLLVELLE

SEQ ID NO: 232441 - protein, 114 aa, Glycine max
  Coding DNA Sequence Number=SeqID_115663
MKIGCGVGDVGSGCGDDDKGNLIGSGGGDNDGDGNNINGDVDIDDNDDDDDDGVGSGTNCGGSDEGGGGSGDGDGGRCVVVASNDKGGGSGNDNGDGDGGNGSDGDSKEYHCQM

SEQ ID NO: 232442 - protein, 115 aa, Glycine max
  Coding DNA Sequence Number=SeqID_115664
  Homolog annotation: Hit_ID=Q03943; Match level="QueryCoverage=44%, HitCoverage=15%, E-value=1e-07, Identity=63%"; Hit description =Membrane-associated 30 kDa protein, chloroplast precursor
  Subcellular localization annotation: CTP_CleavageSite=66; ConfidenceScore=5.05e-01
MERSSNDSLGEFYIMFQLNRDPLSDSSFDNRGSKPSMSSSEAIQNFRTATKVSEMLGNVNTSSALSAFEKMEEKGSKCHDHFCVDEEEVGDYITRPLLHVMLHTLSGIRFRLHLF

SEQ ID NO: 232443 - protein, 1464 aa, Glycine max
  Coding DNA Sequence Number=SeqID_115665
  Gene Ontology: Mol. function=nucleoside-triphosphatase activity; Cellular component=membrane; Biological process=defense response
  Homolog annotation: Hit_ID=Q1RTS6; Match level="QueryCoverage=98%, HitCoverage=99%, E-value=0.0, Identity=44%"; Hit description=TIR; Disease resistance protein; AAA ATPase
  Pfam annotation: Domain name=LRR_1; Domain location=564-589; Score =2.8; E_value=85; Accession=PF00560.23; Description=Leucine Rich Repeat
  Pfam annotation: Domain name=LRR_1; Domain location=607-627; Score =8.2; E_value=8.4; Accession=PF00560.23; Description=Leucine Rich Repeat
  Pfam annotation: Domain name=LRR_1; Domain location=629-650; Score =7.9; E_value=9.5; Accession=PF00560.23; Description=Leucine Rich Repeat
  Pfam annotation: Domain name=LRR_1; Domain location=652-674; Score =12.5; E_value=1.3; Accession=PF00560.23; Description=Leucine Rich Repeat
  Pfam annotation: Domain name=LRR_1; Domain location=676-698; Score =4.1; E_value=48; Accession=PF00560.23; Description=Leucine Rich Repeat
  Pfam annotation: Domain name=LRR_1; Domain location=699-721; Score =9.8; E_value=4.2; Accession=PF00560.23; Description=Leucine Rich Repeat
  Pfam annotation: Domain name=LRR_1; Domain location=723-744; Score =11.0; E_value=2.5; Accession=PF00560.23; Description=Leucine Rich Repeat
  Pfam annotation: Domain name=LRR_1; Domain location=746-768; Score =10.1; E_value=3.6; Accession=PF00560.23; Description=Leucine Rich Repeat
  Pfam annotation: Domain name=LRR_1; Domain location=770-792; Score =9.0; E_value=5.9; Accession=PF00560.23; Description=Leucine Rich Repeat
  Pfam annotation: Domain name=LRR_1; Domain location=801-824; Score =9.1; E_value=5.7; Accession=PF00560.23; Description=Leucine Rich Repeat
  Pfam annotation: Domain name=LRR_1; Domain location=826-847; Score =2.5; E_value=95; Accession=PF00560.23; Description=Leucine Rich Repeat
  Pfam annotation: Domain name=LRR_1; Domain location=849-870; Score =9.1; E_value=5.6; Accession=PF00560.23; Description=Leucine Rich Repeat
  Pfam annotation: Domain name=NACHT; Domain location=218-373; Score= -23.5; E_value=0.0039; Accession=PF05729.3; Description=NACHT domain
  Pfam annotation: Domain name=NB-ARC; Domain location=178-475; Score =111.3; E_value=2.9e-30; Accession=PF00931.13; Description=NB-ARC domain
  Pfam annotation: Domain name=TIR; Domain location=22-155; Score =171.8; E_value=1.8e-48; Accession=PF01582.10; Description=TIR domain
  Pfam module annotation: Pfam domain module=LRR_1::LRR_1::LRR_1::LRR _1::LRR_1::LRR_1::LRR_1::LRR_1::LRR_1::LRR_1::LRR_1::LRR_1::NACHT::NB- ARC::TIR; Domain location=564-589::607-627::629-650::652-674::676 -698::699-721::...
  Pfam module annotation: Domain location=723-744::746-768::770 -792::801-824::826-847::849-870::218-373::178-475::22-155
MAVMLCGGASSSAFGRGWTYDVFLSFRGEDTRRTFTGSLYHGLHQRGINVFIDDEKLRRGEEISPALIGAIEESRIAIIVFSQNYASSTWCLDELAKILECYKTRGQLVWPVFFHVDPSAVRHQRGSFATAMAKHEDRFKGDVQKLQKWKMALFEAANLSGWTLKNGYEFKLIQEIIEEASRKLNHTILHIAEYPVGIENRISELKLLLHIEPGEDIRVIGIYGLGGIGKTTIARALYNLIAGQFEATSFLTDIRESSNQRQGLVQLQETLLFDTVGDKNIKLGSIYKGIPIIKKRLCCKKVLLILDDVDKLEQLQALAGGRDWFGFGSVIIITTRDKHLLAAQQVDKTYEVKKLNHDEAFDLFTWSAFKRKAPDAGYFDISNRVVLYAEGLPLALKVMGSNLFGKTVEEWKSALGKYEKIPNKEVQNVLRVTFDNLEENEKEIFLDIACFFKGETMEYIEKTLQACGLYPKFGISVLVDRSLVSIDKYDRLRMHDLIQDMGREIVREVSPLEPGKRSRLWYHEDVFEVLSENTGTYRIQGMMVDLPDQYTVHLKDESFKKMRNLKILIVRSGHFFGSPQHLPNNLRLLDWMEYPSSSLPSSFQPKKLVVLNLSHSRFTMQEPFKYLDSLTSMDLTHCELLTKLPDITGVPNLTELHLDYCTNLEEVHDSVGFLEKLVELRAYGCTKLKVFPSALRLASLRSLILNWCSSLQNFPAILGKMDNLKSVSIDSTGIRELPPSIGNLVGLQELSMTSCLSLKELPDNFDMLQNLINLDIEGCPQLRSFLTKLRDMGQSTLTFGNIQSLNLENCGLIDEDLPIIFHCFPKVSSLVLSKNDFVALPICIQEFPCLELLHLDNCKKLQEIPGFPPNIQYVNARNCTSLTAESSNLLLSQETFEECEMQVMVPGTRVPEWFDHITKGEYMTFWVREKFPATILCFALAVESEMKESFDCEIRFYINGDEVYELEMPRNFSDMVTDHVWLYDLRTHPSIQWRSLDLYLMDDWNQVEISCEKILGASNVTVSWCGVHVIKQETNMKDILFADPDPDLDSSLHSEKIDIDLDTDGEESTKSIEDSQYCNLVDDNCYINFETPDRQMEEWWNISKEAENNRVVCHTEMDQNQDKNLLPEKTLYSVTEDSLFSLYLEDIGSVKASGSNSSILVVDHPVKNQPQSQVTGFIQTPNVQEPRTTVSMDHKVTRGESPQKTNSTMELPTTIDSLKKQTNLTINDADMEAFYAVLDAETSDSRVVSKLAHKIPSEETKKALKTFQDFVTKDFSVLLGPSEYSTMKDTLDYLTNLPAEDGISVEIRSLVIQVSRQFTHWSKDYTYESKKLESTTAKLLKADELEEGLEANKTHFKEVMCLENELCSELAYLEQRKKELEEQINAVKSNISASQAARNMASQRKREIFGEAKILKAQRDGLREQMPHLRDEQELAKKIKANIREEWSKLGEKFNNILRHEGFD

SEQ ID NO: 232444 - protein, 98 aa, Glycine max
  Coding DNA Sequence Number=SeqID_115666
MDSNHNPNPRSKTLYTSASRNPMLETLTLVRESNALHHALEILLLYANASRNPMLQTLTLTLTLGQGIQCFIAVRQRHFYFLEVHQRHFCFLPGNPML

SEQ ID NO: 232445 - protein, 302 aa, Glycine max
  Coding DNA Sequence Number=SeqID_115667
  Gene Ontology: Mol. function=transcription regulator activity; Cellular component=nucleus; Biological process=regulation of transcription
VSMNKIPIMVKHLVKEGMPQSLGTSTSLNSTVAEFSADPGFAEKATKLSCFGNRSFNGMTTQLCVNIAELAQRSYPLVENGKKQLLTVSSSPSLKVFGSQMGTQENNNSPLQDLMEVANSQEMSAIYEQTPNGDTGEKPSAYATEASEDSNEKRSKPNKGEGNENGQVKAEEESKGSTRGQATNSHSLAKRGKSTIPQQVTTFQIQYTLNTNFFNTKEQKAENTKEHKRLSSTWTNGFAYCNTMSMVSGKLRGLHSGATRRDAGCAIMDYALRPRSRQGHNILKFQTNREVGARARARLECS

SEQ ID NO: 232446 - protein, 133 aa, Glycine max
  Coding DNA Sequence Number=SeqID_115668
MRSFNGDFPPWRCSGRQRRRGERRRHPLGNKPWKKELHHQDEPWIRSLEGCFNGEKERGRERERGEHEIEGIKEGEKWNFEVLFPKKRSNYRFHDLGFGTNIKTKLKMDIGEPEKPLILSVGSWSFNVRCSNR

SEQ ID NO: 232447 - protein, 109 aa, Glycine max
  Coding DNA Sequence Number=SeqID_115669
MVPPFTEIVASYATISSCYGCEEGNTTNATARKSNSKVFRKIALSFLEFQIMYRWVSILQARGSAYVRTKPTFNHHYNFQTEETNGHRIINWLSEISHEKWTLAWDGGR

SEQ ID NO: 232448 - protein, 115 aa, Glycine max
  Coding DNA Sequence Number=SeqID_115670
MTSSSVNAIVYYNDTITTTKHGSMFVSSSPMIVQLDNIMLLDAFKQAIGNKISLPNGKVVKDIIDFRLPVSSVGDYGQYRACTLHNDEDALSVMHKLSEQPTLSARKIILESEGA

SEQ ID NO: 232449 - protein, 57 aa, Glycine max
  Coding DNA Sequence Number=SeqID_115671
MRRTMITLLKKRYKKLSLTQMLVRVRRPQPLKNEEKGKLQLKVVVILLQGLHQAPSQ

SEQ ID NO: 232450 - protein, 118 aa, Glycine max
  Coding DNA Sequence Number=SeqID_115672
MKKKKKKSFWPRSIILREGMMTSIAQRLKDLSETDEDNESFVVTKANPKFGDKEWAIIFIGKKDDPASSLLDSESTDDTPISPLPMFRRTTPREPLTDAQRFPLAFINGNPTPATPYS

SEQ ID NO: 232451 - protein, 79 aa, Glycine max
  Coding DNA Sequence Number=SeqID_115673
MGLKMERFNNITVSLEMAVVVERMELVEESEPWLAMNECCNNSKHKHLILLNVLQKDNTEVRELSCDCILHREHELLIL

SEQ ID NO: 232452 - protein, 181 aa, Glycine max
  Coding DNA Sequence Number=SeqID_115674
MPTRKMNMGLVNFPCNWSPLFHGKHMIRTPNAHDARTSWSQIMWIDSLKASTFGYDGSNNVMHHNLDASVQAESSTKGMDDTIVCGVIIDLTSIGVMDKTSEASNAAMVDEVEPYIQDPTSKQSTTSKEATSRDKGNREVVIVYSTSSGPTPLNYAQPPTTVTRDQVQDMIGQAIESFVEC

SEQ ID NO: 232453 - protein, 42 aa, Glycine max
  Coding DNA Sequence Number=SeqID_115675
MGYFCHHLRIQPARAAVLAVAGIVAHQRTARAAVTAAAARQT

SEQ ID NO: 232454 - protein, 194 aa, Glycine max
  Coding DNA Sequence Number=SeqID_115676
  Gene Ontology: Mol. function=serine-type peptidase activity; Cellular component=membrane; Biological process=signal peptide processing
  Homolog annotation: Hit_ID=Q9LW08; Match level="QueryCoverage=85%, HitCoverage=92%, E-value=2e-74, Identity=84%"; Hit description =Signal sequence processing protein; peptidase-like protein
  Pfam annotation: Domain name=Peptidase_S24; Domain location=52-124; Score=35.5; E_value=1.9e-07; Accession=PF00717.13; Description =Peptidase family S24
MGWIGETVDSIKSLQIRQVLTQAVSLGMIVTSALIIWKALMCVTGSESPVVVVLSGSMEPGFKRGDILFLHMSKDPIRAGEIVVFNVDGREIPIVHRVIKVHEREDTGEVDVLTKGDNNYGDDRLLYAHGQLWLQRHHIMGRAVGFLPYVGWVTIIMTEKPIIKIVYGLKLNNSVVMSDLLHKAIYEDDHFKDA

SEQ ID NO: 232455 - protein, 47 aa, Glycine max
  Coding DNA Sequence Number=SeqID_115677
QARPPLSHRPVQTSHVSRSGGTRSSECIPMNDPMGERRSKEGHVLAN

SEQ ID NO: 232456 - protein, 101 aa, Glycine max
  Coding DNA Sequence Number=SeqID_115678
  Pfam annotation: Domain name=LEA_1; Domain location=1-68; Score=34.5; E_value=3.7e-07; Accession=PF03760.6; Description=Late embryogenesis abundant (LEA) group 1
MQAVKEKLKDLNAARKAKAEARAEEKAEKEIADARKNVAHEVRLAKEAEAEMDIHVEKAGKIAEKEISKHASKNPNVGYSNMNTTDHAMLEAANGPASTIN

SEQ ID NO: 232457 - protein, 113 aa, Glycine max
  Coding DNA Sequence Number=SeqID_115679
MMQVPQVTQERRKKQIYVSLLTLMKTKNNHLQCKIDYLEKILSKFTSGRANIDALLSSQKCVIELYGVPSGMHRHMNEDKSKFFYLMEKQGGFVPYGDNNKGKILGIGNGGNS

SEQ ID NO: 232458 - protein, 396 aa, Glycine max
  Coding DNA Sequence Number=SeqID_115680
  Gene Ontology: Mol. function=metal ion binding
  Homolog annotation: Hit_ID=O80498; Match level="QueryCoverage=88%, HitCoverage=56%, E-value=1e-100, Identity=50%"; Hit description =Putative RING zinc finger protein
MELPPQSGSIGAEALKHIAPGSSISVAYHSSFGPYEDLLFLELDEKLLPDVLNERVVLRGQPDEDAVLCTQSKTYAMKFVGTSNSVLLVPPANHSEYYENQLKNDSNSDEEKVVAPVLKVVSGNMELIETAPRLDKLKSLLSEKPYKLEEDDMGNLEENQESRIGLYNWNDLVDNIQASDEELLSGLQALSALEIYGYWRLVDGSYMDMILGMILKNAVLNDWSLNALNEDEVVSTLESDGFPGVLARHCLNVYGNRVNECMPSFVWKLDEKRVCIHFARDILKGGKRKLESFMDEWRQKIPDGMQPTFDLVEGEVLTEKIGVETWVHAFSVASLPSTPAERFSILFRERPKWEWKDLQPYIRDLKLPGLSSEGLLLKYTRRTQPSADAEPVFSAR

SEQ ID NO: 232459 - protein, 117 aa, Glycine max
  Coding DNA Sequence Number=SeqID_115681
MDESTRSKTSSDRLEDAISKLASHQITLGESLNAMTLKLDELIQKLLTSESPCHSPSSSSAKPPVASPSSFHRIKLEVPHFDGVDPLGWIFKFNQFFEYHSMPEHERLTISSFYTEG

SEQ ID NO: 232460 - protein, 466 aa, Glycine max
  Coding DNA Sequence Number=SeqID_115682
  Gene Ontology: Mol. function=helicase activity; Cellular component =cytosol; Biological process=DNA replication
  Homolog annotation: Hit_ID=Q6M931; Match level="QueryCoverage=52%, HitCoverage=16%, E-value=1e-33, Identity=32%"; Hit description =Related to DNA helicase
  Pfam annotation: Domain name=Dna2; Domain location=232-424; Score =288.9; E_value=9.8e-84; Accession=PF08696.1; Description=DNA replication factor Dna2
MPMRVRGMGLSWMLLHAVVELKRGVQLVKQSQDEVVDEVTWKISPVNERLQAVSKYTPEVIKALAASSKINLSPIRSSGNKETCLDKVITSPTPKVPLSFKRISSARDVSGQSPFRTPPSYRPDKVQRVKDIERIRPCDNLLLRQNKKALLELLDQVEDAIAVDDVTVCNNNTYSFKVPQDLIANELPVKVNPTVERTKSDIPKEVVDVFSSNYLVLEVSELRSADSSDAPCSSYKVLRLLNEQTGEERAVNLHNEWFDSVIAPGDTVHIIGQFDLGGNCDIDHNKNFLIVHPDILVSGTRVAASLSCPRRTVLDERLKNNDYSIIALTGTLLHQIFQAGLTKENPTVNFMEDYAEVVLQRNIESLYACGVNENDVRKTLRDAIPRILSWIKQFKNTKVIDIEEMAWAPKYGLKGMIDASVRVKIQSQKDDPEEKIMPLEFKTGKAPYSQASSGPHLNSIIKNEIR

SEQ ID NO: 232461 - protein, 497 aa, Glycine max
  Coding DNA Sequence Number=SeqID_115683
  Gene Ontology: Mol. function=helicase activity; Cellular component =cytosol; Biological process=telomere maintenance
  Homolog annotation: Hit_ID=Q5KGD7; Match level="QueryCoverage=89%, HitCoverage=41%, E-value=1e-95, Identity=44%"; Hit description=DNA replication helicase dna2, putative
RLRIPGSSSTAHDLSQQVWRIDKDEYVTSFAIMRFNLVQLFLQNDQSAHLRRMIVDLEAPRFDSGSLVSQDPAISYVWSEKSLNDDQRGAILKILTAKDYALILGMPGTGKTSTLVHAVKALLIRGTSILLTAYTNSAVDNLLIKLKAQGIDFVRIGRHEVVNEEVREHCLSAMNVQGVEDIKIRLEQVKVVAVTCLGISSPLLANTRFDVCIMDEAGQTTLPVSLGPLIFASTFVLVGDHYQLPPLVQSAEARENGMGISLFCRLSEAHPEAISALQSQDIMDLSNALIYGDRLRCGSFEVANSKLEFSGLNCDLPWLEDVLNPRRPVIFIDTDKLPALEARDQKIVNNPIEAQIIAEVAKELVKNGIGSEHIGIITPYNSQANLIRNAASMTSLEIHTIDKYQGRDKDCILVSFVRSTENPTSCAASLLGDWHRINVALTRAKKKLIMVGSRRTLLRVPLLKLLIKKVEEQSGILTVTKKDIYRKSELKRCSQMR

SEQ ID NO: 232462 - protein, 318 aa, Glycine max
  Coding DNA Sequence Number=SeqID_115684
  Gene Ontology: Mol. function=metal ion binding; Cellular component =integral to membrane; Biological process=ubiquitin cycle
  Homolog annotation: Hit_ID=Q9LF64; Match level="QueryCoverage=55%, HitCoverage=51%, E-value=2e-58, Identity=56%"; Hit description =Probable RING-H2 finger protein ATL5G
  Pfam annotation: Domain name=PHD; Domain location=135-180; Score= -1.2; E_value=0.074; Accession=PF00628.19; Description=PHD-finger
  Pfam annotation: Domain name=zf-C3HC4; Domain location=136-177; Score= 34.2; E_value=4.6e-07; Accession=PF00097.15; Description=Zinc finger, C3HC4 type (RING finger)
  Pfam module annotation: Pfam domain module=PHD::zf-C3HC4; Domain location=135-180::136-177
MGSMSNSNPNPWTPKDCSEGICSIYCPQWCYIVYSPPTPILLGDGDDDPSGFEFSPLIVAAIGILASTFILVTYYTIISRLCRQRHNTNDPTEDDGNSELARISSSANSGLDEALIKSIRVCKYNKGGGLVEGHDCSVCLIEFQENENLRLLPKCNHAFHLPCIDTWLKSHATCPLCRSSVTACPNPNPNSSMEPPPRVIVNALGHQLRSNHVVVVESSEEQQKDGEANIWGTDLLQQVHRDPCSQGIYYTYIIILVVVTVAVTPTTTTVTTTNVVTKTLGAPPSRIYTIIPKTFTIVLVASNPSATNTMSLPSTAIH

SEQ ID NO: 232463 - protein, 58 aa, Glycine max
  Coding DNA Sequence Number=SeqID_115685
MDGFGGNREGRDMVLADIVVVPIAKATTTVVAMIVALATVAAIVVVLKPNVEVLKREE

SEQ ID NO: 232464 - protein, 81 aa, Glycine max
  Coding DNA Sequence Number=SeqID_115686
  Subcellular localization annotation: CTP_CleavageSite=29; ConfidenceScore=5.18e-01
MEKDAWHVGPWNGGFNPFSFSLTSRNSNRATGGRALESTRNATIDNGECFSDYIECCYGVIPKIIQVLEFENIVRFEVHVY

SEQ ID NO: 232465 - protein, 271 aa, Glycine max
  Coding DNA Sequence Number=SeqID_115687
  Gene Ontology: Mol. function=carboxypeptidase activity; Cellular component=membrane; Biological process=auxin mediated signaling pathway
  Homolog annotation: Hit_ID=O24091; Match level="QueryCoverage=94%, HitCoverage=65%, E-value=7e-86, Identity=65%"; Hit description=MtN21 protein
  Pfam annotation: Domain name=DUF6; Domain location=73-208; Score =39.0; E_value=1.7e-08; Accession=PF00892.11; Description=Integral membrane protein DUF6
  Pfam annotation: Domain name=TPT; Domain location=64-208; Score= -34.0; E_value=0.054; Accession=PF03151.7; Description=Triose -phosphate Transporter family
  Pfam module annotation: Pfam domain module=DUF6::TPT; Domain location= 73-208::64-208
MEKINMKKVRCQAKVVGTLVTVAGAMLMTLYKGPMVWTKDAPHNGQINNATNTTTYSDKDWFIGSILLIIATLAWASLFVLQVRPLKAKAIETYKNHQLSLTSLICFIGTLQAIAVTFVMEHKPSVWTIGWDMNLLAAAYAGIVTSSITYYVQGLVIKKKGPVFATAFSPLMMIIVAIMGSFILSEQLFLGGVLGAILIVIGLYSVLWGKHKEQVVKNEVEDIPLPVKGAQLDGNPETLIDSTDQKSDSNKISSHIINVSIPELPMKSNNS

SEQ ID NO: 232466 - protein, 44 aa, Glycine max
  Coding DNA Sequence Number=SeqID_115688
MKLQLEAENQKVHCVNSNNKLEKQSKAFDTIGLAKDKFSHGYCE

SEQ ID NO: 232467 - protein, 247 aa, Glycine max
  Coding DNA Sequence Number=SeqID_115689
  Gene Ontology: Mol. function=oxidoreductase activity; Cellular component=integral to membrane; Biological process=electron transport
  Homolog annotation: Hit_ID=Q8S9F0; Match level="QueryCoverage=73%, HitCoverage=24%, E-value=2e-09, Identity=27%"; Hit description =Cytochrome P450
VYSEISIVGRNPSKYEHEDVYRMPLLLATIYESARLLPTGPMLQRCSLKHDLCFATGLTIPAGAVLVVPVELVHKDDSSWGSDASDFNPYHFLSTGTKGSELRGLLSLNNHRVRGLTKNHKRSVKKVVKGSTEDLSITGVSSCVLNDPNENAAFLPFGSGTRACIGQKFIIQLVASVLASLLKKYEKMKHIKRNGDEEMDKESNCMNAKWSVLRLNSGSDEDSNTTLKNNLHQHHPNSQILFVKRDQ

SEQ ID NO: 232468 - protein, 99 aa, Glycine max
  Coding DNA Sequence Number=SeqID_115690
  Subcellular localization annotation: CTP_CleavageSite=47; ConfidenceScore=5.35e-01
MLGAPAIMLGAPSNTQVSIFVSFLPRSVAQTHQTRCDYSCTDFPLLYAFARTCVWFQFNGGSVLKDLGLLSTRRLTQRACLAEREVFYPLIELVASLSR

SEQ ID NO: 232469 - protein, 76 aa, Glycine max
  Coding DNA Sequence Number=SeqID_115691
  Homolog annotation: Hit_ID=Q9XIS5; Match level="QueryCoverage=83%, HitCoverage=7%, E-value=9e-15, Identity=64%"; Hit description=Starch branching enzyme
MDTPSGIKDSIPAWIKFAVQAPGEIPYSGIYYDPLEENSCVAPLIEDLKVRCERRRKNLLGVSSNFGGSYMHISHD

SEQ ID NO: 232470 - protein, 120 aa, Glycine max
  Coding DNA Sequence Number=SeqID_115692
MYEAKGVKSSSKGTSNALEVLTQCKEESKGLATFEGEKGREINGKIGNDVVGRKSDKKAKPDSTTRATIKEVVTSASQAMTSLAKKFNEEDKQRIAYMGTSVLVVALGVYATYKLHSRVP

SEQ ID NO: 232471 - protein, 563 aa, Glycine max
  Coding DNA Sequence Number=SeqID_115693
  Gene Ontology: Mol. function=sugar binding; Cellular component =histone methyltransferase complex; Biological process=histone H3-K4 methylation
  Homolog annotation: Hit_ID=Q9LJC6; Match level="QueryCoverage=84%, HitCoverage=86%, E-value=1e-172, Identity=64%"; Hit description =Retinoblastoma-binding protein-like
  Pfam annotation: Domain name=WD40; Domain location=185-222; Score =15.1; E_value=0.25; Accession=PF00400.22; Description=WD domain, G -beta repeat
  Pfam annotation: Domain name=WD40; Domain location=304-342; Score =22.9; E_value=0.0012; Accession=PF00400.22; Description=WD domain, G- beta repeat
  Pfam annotation: Domain name=WD40; Domain location=36-73; Score=22.5; E_value=0.0015; Accession=PF00400.22; Description=WD domain, G-beta repeat
  Pfam module annotation: Pfam domain module=WD40::WD40::WD40; Domain location=185-222::304-342::36-73
MGLCAICSNVGGVNIIAIGCNDGSCVIWDFETRGIAKILRDDECSSPITSICWSKYGHRILVSAADKSLILWDVMSGKKITRIVLQQTPLQARLHPGSSTPSLCLACPLSCAPMIVDLNTGDTTLLIVSVSETCNGPTPPPRNKCSDGITSFTPTAACFNKYGTLVYVGNSKGEILVIDYKNGDVRAVVPISGGSVVKNIVFSRNGQYLLTNSNDRIIRIYENLLPLKDEVRALDDLSGNHNDLNNIENLKAVGSKCLTLFREFQDSITKVHWKAPCFSGDGEWVVGGSASKGEHKIYIWDRAGHLVKILEGPKEALIDLAWHPVHPIVVSVSLNGLVYIWAKDYTENWSAFAPDFKELEENEEYVEREDEFDLIPETEKVKGPDVDEDEEVDIVTVEKDATFSDSDMSQEELCYLPSTPSHDVPEQQEKCVESSSKLLDSNNTGSPLSEEAGPNGHMMNHASSPLEDDAGRMKRKRKPSEKVLELQAEKVKKPSKSSKSEKPKSRSLADEDNGAAGRFDDAESVRVGFFKCRKMLLEIGVMQDASFGQNTKMLGLANLLEIK

SEQ ID NO: 232472 - protein, 143 aa, Glycine max
  Coding DNA Sequence Number=SeqID_115694
  Homolog annotation: Hit_ID=Q1SW20; Match level="QueryCoverage=60%, HitCoverage=9%, E-value=6e-14, Identity=45%"; Hit description =Disease resistance protein; AAA ATPase
MGVKMQEGISCLKSLQKLYFLDADHGGLDLLEELKRLKKLRKLGIRRMQTEYATLNLSILKSVSIDKGALVGLEHFRFKDNPQMKVVPQDIKDLENLQFLGFADMPTELVESIDPAKGGKQYSTIHHIPLVLIRQHVGPGFND

SEQ ID NO: 232473 - protein, 546 aa, Glycine max
  Coding DNA Sequence Number=SeqID_115695
  Gene Ontology: Mol. function=nucleic acid binding
  Homolog annotation: Hit_ID=Q2R2A2; Match level="QueryCoverage=45%, HitCoverage=93%, E-value=2e-36, Identity=37%"; Hit description=Zinc knuckle family protein, expressed
  Pfam annotation: Domain name=zf-CCHC; Domain location=161-178; Score =25.3; E_value=6.5e-05; Accession=PF00098.13; Description=Zinc knuckle
  Pfam annotation: Domain name=zf-CCHC; Domain location=183-200; Score =16.6; E_value=0.0018; Accession=PF00098.13; Description=Zinc knuckle
  Pfam annotation: Domain name=zf-CCHC; Domain location=202-219; Score =28.3; E_value=2.1e-05; Accession=PF00098.13; Description=Zinc knuckle
  Pfam annotation: Domain name=zf-CCHC; Domain location=229-246; Score =9.3; E_value=0.029; Accession=PF00098.13; Description=Zinc knuckle
  Pfam annotation: Domain name=zf-CCHC; Domain location=280-297; Score =6.1; E_value=0.098; Accession=PF00098.13; Description=Zinc knuckle
  Pfam annotation: Domain name=zf-CCHC; Domain location=330-347; Score =36.6; E_value=8.4e-08; Accession=PF00098.13; Description=Zinc knuckle
  Pfam module annotation: Pfam domain module=zf-CCHC::zf-CCHC::zf -CCHC::zf-CCHC::zf-CCHC::zf-CCHC; Domain location=161-178::183 -200::202-219::229-246::280-297::330-347
MGRKEKQNTKAIEEERDQDNFNGASTPPLVFSSDDDEANQDLSLKIIKKAMRMRTAKHAPNDDVSSPFSQKPDLALPPSGGVSDGPSAIADSEVMEKKKTAKLKVEAGDQSVVIAEEQEMEETINATENHVEGRPEIGDNMVLRKLLRGPRYFDPPDNSWGACFNCGEEGHAAVNCSAVKRKKPCYVCGCLGHNARQCSKVQDCFICKKGGHRAKDCPEKHTSTSKSIAICLKCGNSGHDIFSCRNDYSQDDLKEIQCYVCKRLGHLCCVNTDDATAGEISCYKCGQLGHMGLAAMALGFKLYSIYKFENQLLQACLRLQDEIASGATPSSCFKCGEEGHFARECTSSINSGKGNWESSRTKDKRSQKENRYMGNRSAPNDISGARRKKRSPTEERGFSTPKKSKSRGGWMAEYPTKERGFTTPKKSKSRGGCTTEHPSEQQDYATPKKSKSRGGWTSEHPEEFFPPLSSRSKGYRSPGTPSSRNDRIHSFGGGSHTPSYKSSKVWNGHTGTSMSQGSARSNHHRYSASRFGNSSSDGHGRNYNWW

SEQ ID NO: 232474 - protein, 99 aa, Glycine max
  Coding DNA Sequence Number=SeqID_115696
MRGTVHEPQANLGTDQKFLPENPQGFALAHMRRKLIRPGARGKCPKENCDGRVHLMLVAHADSLGFFLNPRVAFVVQILLGSAHVIKFQRDRQILGITL

SEQ ID NO: 232475 - protein, 55 aa, Glycine max
  Coding DNA Sequence Number=SeqID_115697
MLGDLKFLEVCLKARDLLWYLDSDCSRHMTGDKSRLTDFVSKEEDLSLLETKIRE

SEQ ID NO: 232476 - protein, 142 aa, Glycine max
  Coding DNA Sequence Number=SeqID_115698
  Gene Ontology: Mol. function=ubiquitin-protein ligase activity; Cellular component=chromosome, pericentric region; Biological process=cell division
  Homolog annotation: Hit_ID=Q00SR2; Match level="QueryCoverage=66%, HitCoverage=20%, E-value=2e-18, Identity=47%"; Hit description=[S] KOG1426 FOG: RCC1 domain
  Pfam annotation: Domain name=RCC1; Domain location=25-74; Score=41.3; E_value=3.2e-09; Accession=PF00415.9; Description=Regulator of chromosome condensation (RCC1)
MTRVLNCVIVGVNAVSCHCVALDVEGRCYTWGRNEKGQLGHGDTIQRDRPTVVSELSKYKIVKAGSGRSHTVVVTDDGNSLAFGWNKHGQLGSGSVRNGFFGYFMSGIDSMMEWSKACSYLGLQRWNGVKLVVVWVFNHGME

SEQ ID NO: 232477 - protein, 149 aa, Glycine max
  Coding DNA Sequence Number=SeqID_115699
  Gene Ontology: Mol. function=DNA binding; Cellular component =mitochondrion; Biological process=DNA integration
MTLLERTRFMLSNLGLNMSLWIEANTTYYLMNHSPSIAIDFNTLIEVWSNKPAKYSMLKVFGCPTYYHISKGKLEPRAKKVVFIGNRDGVKGFRIWSPSEIKFILSRDVIFDELSMLHSKFEEDSGKAKDVTKQVEFERPTIRIFSDQK

SEQ ID NO: 232478 - protein, 118 aa, Glycine max
  Coding DNA Sequence Number=SeqID_115700
  Homolog annotation: Hit_ID=Q10NU0; Match level="QueryCoverage=96%, HitCoverage=25%, E-value=1e-21, Identity=50%"; Hit description =Glyoxal oxidase, putative, expressed
MIGGIPTLHHEGIICFLPVTRFAWTEGSYFAFAIVVAAGLDEEGAEGVACNVVFEECAVQSVMLRTLSEGSWRHVPLGRVRLEKTKSVRSLLRSCMCMATYRCFCGGAATGRWNWKLR

SEQ ID NO: 232479 - protein, 429 aa, Glycine max
  Coding DNA Sequence Number=SeqID_115701
  Gene Ontology: Mol. function=transcription factor activity; Cellular component=nucleus; Biological process=regulation of transcription, DNA-dependent
  Homolog annotation: Hit_ID=Q0PWL2; Match level="QueryCoverage=73%, HitCoverage=95%, E-value=3e-93, Identity=57%"; Hit description=GAGA -binding transcriptional activator
  Pfam annotation: Domain name=DUF1004; Domain location=223-337; Score =322.1; E_value=9.8e-94; Accession=PF06217.3; Description=Protein of unknown function (DUF1004)
MEGTKQQININLLRDSIYSLLRKWLMQHQPSMKQIMAIMAERDAAIQERNLAISEKKAAYAERDMAFMQRDAAIAERNNAILERDNAIATLQYRETSLSSGSMPSCPPGCQISRGVKHIHHPQQQVHHIPNMGDASYSTREMHTTDALPAAPIPSEAGKPRRAKRPKEPKSASPNKKTSKPAKKVKKESEDLNKVMFGKSHEWKSGQEMVNGGDDLNKQLTVSKADWKGQDLGLNQVAYDESTMPAPVCSCTGVLRQCYKWGNGGWQSACCTTTLSMYPLPAVPNKRHARVGGRKMSGSAFNKLLSRLAAEGHDLSNPVDLKDHWAKHGTNRYITIKMHKPGVKVILVRHLYALNFLRWSDGANGILVSSVILEPLCGGGEYEPYEPIPWFISKSVLLPLLSLLLINKGGVRYAVGRKGMFKRNFSRLD

SEQ ID NO: 232480 - protein, 70 aa, Glycine max
  Coding DNA Sequence Number=SeqID_115702
MMKMFHALNAARMEEPHNFIFTRAGGTDRQTDRVKTRAFSFFVIANDERETMDILQSYTHVSSSFLSFLT

SEQ ID NO: 232481 - protein, 44 aa, Glycine max
  Coding DNA Sequence Number=SeqID_115703
MARRTSASNACIEGLVVVILLAADSNFHLEPTGMGICGEGTKET

SEQ ID NO: 232482 - protein, 56 aa, Glycine max
  Coding DNA Sequence Number=SeqID_115704
MEKCPNQETVGNAAMLSAVGTFHSEALQHQSDGGLNIAHKIKNSGASRQVNEESVF

SEQ ID NO: 232483 - protein, 48 aa, Glycine max
  Coding DNA Sequence Number=SeqID_115705
MATSTHVTLWAFSLRPIFISGVLSVLPDRKENPPLSKIPRPTLSAKST

SEQ ID NO: 232484 - protein, 111 aa, Glycine max
  Coding DNA Sequence Number=SeqID_115706
MGKPPKGYIFNFTVILYLGEKWTNSTTTQSLGVFSAVNDGSFSIFLSMTVHGREEKREYIMRPSRVPKKVVKKATSDSYPSDIVPKKVVKKATSDSYPSDIKIKIFNGWDV

SEQ ID NO: 232485 - protein, 884 aa, Glycine max
  Coding DNA Sequence Number=SeqID_115707
  Gene Ontology: Mol. function=microtubule motor activity; Cellular component=microtubule associated complex; Biological process =microtubule-based movement
  Homolog annotation: Hit_ID=Q9FH58; Match level="QueryCoverage=96%, HitCoverage=98%, E-value=1e-149, Identity=37%"; Hit description =Kinesin heavy chain DNA binding protein-like
  Pfam annotation: Domain name=Kinesin; Domain location=36-355; Score =446.6; E_value=3.2e-131; Accession=PF00225.13; Description=Kinesin motor domain
MVKTRDTAASMTDVIEEQGNMALSNAQEERIFVSIRVRPLNEIEKARHDVSDWECISGNTIRYKNNGHAEPRPLSMDTYAFDRVFGEKCNTKQVYEQGIKEVALSVVRGINSSIFAYGQTSSGKTHTMSGITEYALRDIYEYIEKHKDREFVVKFSAMEIYNEAVRDLLNAGATSLRILDDPEKGTVVEKLTEETLTEKRQLQQLLSICAAERTTEETAMNETSSRSHQILRLTVESNPRDYADTARSGALFASVNFVDLAGSERASQAMSAGTRLREGSHINRSLLSLGTVIRKLSKGRNEHIPYRDSKLTRILQNSLGGNARTAIICTISPARSQSEQSRNTLLFASCAKQVTTNAQVNLVMSDKVLVKQLQNELARLENELRSFTPNTMLLKERELRIQQMEKEIKELTRQRDLFQSRAENMVQSVGKDRLLRGADKDSASESTGVANDLLRRTDSASESLDRTTSSLLHTANSEEDFLLDGNSPTFAGPDPCHGWEEMTTSRESEDNYKEVPCIEIKEVETEHKTDVNNTPPIPVSEENGGNTPMIQVVNVNAKSSSGNEPIELTPVAIDNTQGALQGKTEESLQNTKDLAVDITKKSNGSSESESRISNAMSPPQIDKETSTHPQISSNLEQNESPRFNKLDQESASPPRCDVQELKTTLPPQLDKPDSTSLVCFEDKLPESKLQAAKRNSSRKYSPIHYRDASVEDVESLWDSDAEDTASVLNFVGRMNKKAKQKAFNKDMDDIMVRARTSGINKRVNKVIGVNFERQQRDTIQLWDALFTLFSLNSLMSLNRERKMLSKQVHKKFTRKEREELYVKWGIDLRSKHRSVQLAWRLWTNTEDLNHVRESAALVAKLVGFINSGDAPKKIFGFGFLARRK

SEQ ID NO: 232486 - protein, 90 aa, Glycine max
  Coding DNA Sequence Number=SeqID_115708
MGSTWISEHGETPEVGSHQGGEIIAGSVAEKDVIGKRHARKKGVRPETSLGSRQNTAGGWPKNDVEFVAKVRRVEGLTGRRMASEMAHQG

SEQ ID NO: 232487 - protein, 154 aa, Glycine max
  Coding DNA Sequence Number=SeqID_115709
MAIYAICTSSTLIPPSSTPTHDQVKVNGGDEYHADNYGIWNPSPGNWGRGRGAPIFLINERKRNHHESWYVIQHTLILSMNDTTPTADSPSCGHGQKTRSQDDVCEIMESSARFEQPFGGGDPYRLRQENDSSLCTIQGRAMMLATMWLCVSRA

SEQ ID NO: 232488 - protein, 340 aa, Glycine max
  Coding DNA Sequence Number=SeqID_115710
  Gene Ontology: Mol. function=zinc ion binding; Cellular component =intracellular
  Homolog annotation: Hit_ID=Q1S9J1; Match level="QueryCoverage=63%, HitCoverage=98%, E-value=2e-44, Identity=40%"; Hit description=Zinc finger, B-box
  Pfam annotation: Domain name=zf-B_box; Domain location=11-58; Score =44.3; E_value=4.2e-10; Accession=PF00643.14; Description=B-box zinc finger
  Pfam annotation: Domain name=zf-B_box; Domain location=64-111; Score =53.0; E_value=1e-12; Accession=PF00643.14; Description=B-box zinc finger
  Pfam module annotation: Pfam domain module=zf-B_box::zf-B_box; Domain location=11-58::64-111
EYQNQFNFELVMKIHCDVCNKHQASFFCTADEAALCDGCDHRVHHANKLASKHQRFSLTHPSAKHFPLCDVCQERRAFVFCQQDRAILCKECDVPIHSANDLTKNHSRFLLTGIKFSASATPYDYSSPPPPPPPPPPKRNPVLDSPSTPSPPKPGGNSLTNEEEPGFTGSSISEYLINSIPGMKFEDFLDSHSLPFACSKGNMVSFSPGGFWVPQAPPSSVQMDRQSGYRETREGSIRSSFGDDNFIVPQMSPPSNVSNKRSRLLWFGTMRKSFTAVRYDAKKLDVQMHYLTMWMRYLIMGTKWCLTGLKKRIEIKEVFLLSIFDGEIRGSEAAGGLRMS

SEQ ID NO: 232489 - protein, 50 aa, Glycine max
  Coding DNA Sequence Number=SeqID_115711
MEIREKNEYKIFENVLLLSQGLAGIQPVDVTQLIEGHSSYLRMTKNPGAA

SEQ ID NO: 232490 - protein, 35 aa, Glycine max
  Coding DNA Sequence Number=SeqID_115712
MSWNFADYLTMDVKYLGAVKQRLQAIKKWSLDEIR

SEQ ID NO: 232491 - protein, 134 aa, Glycine max
  Coding DNA Sequence Number=SeqID_115713
  Pfam annotation: Domain name=GRP; Domain location=40-110; Score= -19.0; E_value=0.0064; Accession=PF07172.2; Description=Glycine rich protein family
MKTGLRRSSRVLCLILAIVGLIRCDNEVINGNASSSPSQASNATFLTFPSQVINEVVKEKHNSSYNNNNKVHVKSTSWYYGGSGGGGGGGGSGGGWKCGKRKGGGRGAHHYQYKPYNKKGMLDEKEYRVGEYAE

SEQ ID NO: 232492 - protein, 104 aa, Glycine max
  Coding DNA Sequence Number=SeqID_115714
  Gene Ontology: Mol. function=sequence-specific DNA binding; Cellular component=nucleus; Biological process=regulation of transcription, DNA-dependent
  Homolog annotation: Hit_ID=Q5VKS3; Match level="QueryCoverage=97%, HitCoverage=35%, E-value=3e-31, Identity=70%"; Hit description=MADS -box protein GmNMH7
MSQYKVITNQIDTQRKKFNNEKEVHNRLLHDLIYLTASLQPNPWHDAKAEDPRFALIDNGGEYESVIGFSNLGPRMFALSIQPSHPSAHSGGAGSDLTTYPLLF

SEQ ID NO: 232493 - protein, 70 aa, Glycine max
  Coding DNA Sequence Number=SeqID_115715
MTIMLVVTTMTRCENNDVNENSNNDDAKWWWDVVVVTTIEMTMIIEIMKGWINGPRSMNCPAGSTILTGN

SEQ ID NO: 232494 - protein, 1078 aa, Glycine max
  Coding DNA Sequence Number=SeqID_115716
  Gene Ontology: Mol. function=protein transporter activity; Cellular component=cytoplasm; Biological process=intracellular protein transport
  Homolog annotation: Hit_ID=Q9C698; Match level="QueryCoverage=99%, HitCoverage=99%, E-value=0.0, Identity=46%"; Hit description=Mysoin -like protein; 11013-7318
  Pfam annotation: Domain name=DUF593; Domain location=169-247; Score= -32.0; E_value=0.088; Accession=PF04576.6; Description=Protein of unknown function, DUF593
  Pfam annotation: Domain name=DUF869; Domain location=90-964; Score =1158.7; E_value=0; Accession=PF05911.2; Description=Plant protein of unknown function (DUF869)
  Pfam annotation: Domain name=Pox_A_type_inc; Domain location=223-245; Score=0.5; E_value=69; Accession=PF04508.3; Description=Viral A-type inclusion protein repeat
  Pfam annotation: Domain name=Pox_A_type_inc; Domain location=64-86; Score=1.3; E_value=53; Accession=PF04508.3; Description=Viral A-type inclusion protein repeat
  Pfam annotation: Domain name=Pox_A_type_inc; Domain location=797-819; Score=0.9; E_value=60; Accession=PF04508.3; Description=Viral A-type inclusion protein repeat
  Pfam annotation: Domain name=Pox_A_type_inc; Domain location=874-896; Score=13.6; E_value=0.7; Accession=PF04508.3; Description=Viral A -type inclusion protein repeat
  Pfam annotation: Domain name=Pox_A_type_inc; Domain location=897-917; Score=0.9; E_value=60; Accession=PF04508.3; Description=Viral A-type inclusion protein repeat
  Pfam annotation: Domain name=Tropomyosin; Domain location=50-263; Score=-113.1; E_value=0.036; Accession=PF00261.10; Description =Tropomyosin
  Pfam module annotation: Pfam domain module=DUF593::DUF869::Pox_A_type_ inc::Pox_A_type_inc::Pox_A_type_inc::Pox_A_type_inc::Pox_A_type _inc::Tropomyosin; Domain location=169-247::90-964::223-245::64 -86::797-819::874-896::897-917::50-263
MDRRWPWKKKSSEKSVIEKATTALDSSDASNNQDNKKKPNYVQISVESYSHLSGLEDQVKTYEEKVQTLEDEIKEMNEKLSAANSEINTKESMVKQHAKVAEEAVSGWEKAEAEALALKNHLESVTLLKLTAEDRATHLDGALKECMRQIRNLKEEHEQKIQEVALSKTKQLDKIKGELEAKIVNFEQELLRSAAENGALSRSLQECSNMLIKLSEEKAHAEAEIELLKGNIEACEKEINSLKYELHVVSKELEIRNEEKNMSMRSAEAANKQHMEGVKKIAKLEAECQRLRGLVRKKLPGPAALAQMKLEVESLGRDFGESRLRKSPVKPATPNLSPLPDFSLENVQKFQKDNEFLTERLLAMEEETKMLKEALAKRNSELQASRSMCAKTLSKLQSLEAQSQTSNQLKLSPKSIVQLTHESIYNQNASSAPSLVSMSEDGNDDAASCAESWSTAIVSGLSQFPREKCNEESNKSEVTNKLELMDDFLEVEKLARLSNDSNVDATVSNNKTTDIVTGDVSEVCTGKEGLSEKNGNSDPLPNQVSSDPLMSAPDFQSDLSGLLLTELRSRILLVFESLAKDADIGKIVEDIKHVLEDSHDTTIHHSVDAHPSDATCDRKDNPEDAGLNLEKEVISSQQPKGYVQITSDLEAAISQIHDFVLFLGKEAMTFHDDVSSDGNEMRQKIEEFSITFNKVLCNNASLLQFVLDLSYVLDKASEFRFNVLGYRGTEAESSSPDCIDKIALPENKLVHDNSSGERYQNGCSHIINPCSNPEVPDDGNLVSGYKADAASQKLSIEEFEELKLEKEKVVIDLSNCTENLEMTKSQLLDTEQLLAEVKSQLASALKSKSLAETQLKCVAESYNSLETRAQVLETELNHLQIKIESLENELQDEKRAHEVAMARSKELEEQLQRIECSAADDDHKTSHERDLTAAAEKLAECQETILLLGKQLNSLRPQTEPNDSLYSKINPKDEGFTEDEHTTNQNFQELGQLEMDSSTSAFVQRLSSESPLHFSNSLFSPSDSESTIPARSPVQHSKSKPKHRPTKSASCSVSSATTPEKHARGFSRFFSPKGKSGH

SEQ ID NO: 232495 - protein, 68 aa, Glycine max
  Coding DNA Sequence Number=SeqID_115717
MEPHGTEPHRQFKEREKVLHDQVASSFTETVSSPKPEVEGDTKQKPYLLINFSLRRKQAASELEKESE

SEQ ID NO: 232496 - protein, 312 aa, Glycine max
  Coding DNA Sequence Number=SeqID_115718
  Gene Ontology: Mol. function=RNA-directed DNA polymerase activity; Cellular component=exocyst; Biological process=RNA-dependent DNA replication
  Homolog annotation: Hit_ID=Q1RV13; Match level="QueryCoverage=50%, HitCoverage=37%, E-value=2e-32, Identity=43%"; Hit description=IMP dehydrogenase/GMP reductase
MCRAKLEGGRFNQISESENNGLIAWFVESKVKEAVWEYGENKSPGLDGYNFHFIKAFWSLLKNDVMKFIGDFHTNGVFPRERILHLFRSFRKFMTHKDWNNIGLSRWLDAFNGSPTKEFSVSEGLRQGDPLASFLFNIFAEGLTGLMREALRKNMLASLLVWENEVPVNLLQYADNTIFIGEASLQNVITIKSLRTCFELVSGIQVNFNKSGFGTIGVDKVVTERYANLLNCRVMHVPFVYLGIPIGANPRIADTWSPVIFKLAKKLGAGGEAQIIVFLQGGWELMEEKEDLWCDILESKYRDGEVWDRLLA

SEQ ID NO: 232497 - protein, 433 aa, Glycine max
  Coding DNA Sequence Number=SeqID_115719
  Gene Ontology: Mol. function=methyltransferase activity; Biological process=metabolic process
  Homolog annotation: Hit_ID=Q1SW51; Match level="QueryCoverage=85%, HitCoverage=88%, E-value=3e-61, Identity=35%"; Hit description =Generic methyltransferase
  Pfam annotation: Domain name=Methyltransf_11; Domain location=269 -364; Score=14.3; E_value=0.0021; Accession=PF08241.2; Description =Methyltransferase domain
MGSVSLKIGDGTARFRRATVCSSAVNILMIFSVITTNLFALYAFSSSPKDPHSHLHLLDKNFSLISEQVTLILREIDMSQKKLAQIEKDLLGYESLDLSRPNIANELKLFLHHHQLPLGKDSKSGITEMVSSVGHSCEKSSDLLSQYMSYKAFGPCPNDWSVAQKLILKGCEPLPRRRCFAKTISKVGLLHPFPTSLWKAPVNNTVNWSGLGCKNFECLKGKKLSRDCIGCFDLVNGYENQRFVKSRSKNDFLIDDVLALGSGGIRIGLDVGGGSGSFAAVMAERNVTVVTSTLNVDAPFSEFIAARGLFPLFLSLDHRFPFYDNAFDLVRASSGLDGGGREEKLEFLMFDIDRVLRAGGLFWLDNFYCVDEEKKRALTRLIERFGYKKLKWVVGEKADILGSGSRASNNMMARCEYNAIASAGSASLHTQFV

SEQ ID NO: 232498 - protein, 170 aa, Glycine max
  Coding DNA Sequence Number=SeqID_115720
  Gene Ontology: Mol. function=RNA-directed DNA polymerase activity; Biological process=RNA-dependent DNA replication
MESTIMEANSIKDLLFSSLTHLPNDLKCKFSMILWSIWKNRNEKVWNNLDISPATSISLSDQFYSEWSHARRKSNNIPSLPAQQVHGTWEPPPLGYITCNVAIFQDINAFGADLCIRGHDMMETLFDQKHASLMANQLFIKQKDGHYSKQFNGYPNLISTTPFLSRIANL

SEQ ID NO: 232499 - protein, 61 aa, Glycine max
  Coding DNA Sequence Number=SeqID_115721
  Homolog annotation: Hit_ID=Q1S393; Match level="QueryCoverage=72%, HitCoverage=30%, E-value=5e-07, Identity=60%"; Hit description=Auxin responsive SAUR protein
  Subcellular localization annotation: CTP_CleavageSite=52; ConfidenceScore=5.17e-01
MARGPWLEKPYSSSASTSSLLNTGWFRRYSVGRRTGLATPPPQHLAEPDYVADSAAFSKCR

SEQ ID NO: 232500 - protein, 413 aa, Glycine max
  Coding DNA Sequence Number=SeqID_115722
  Gene Ontology: Mol. function=protein serine/threonine kinase activity; Cellular component=chloroplast; Biological process=protein amino acid phosphorylation
  Homolog annotation: Hit_ID=P46573; Match level="QueryCoverage=99%, HitCoverage=99%, E-value=1e-148, Identity=64%"; Hit description =Protein kinase APK1B, chloroplast precursor
  Pfam annotation: Domain name=Pkinase; Domain location=73-355; Score =164.5; E_value=2.8e-46; Accession=PF00069.15; Description=Protein kinase domain
  Pfam annotation: Domain name=Pkinase_Tyr; Domain location=73-355; Score=113.0; E_value=8.6e-31; Accession=PF07714.7; Description =Protein tyrosine kinase
  Pfam module annotation: Pfam domain module=Pkinase::Pkinase_Tyr; Domain location=73-355::73-355
  Subcellular localization annotation: CTP_CleavageSite=32; ConfidenceScore=5.60e-01
MGACWSSRIKAVSPSNTGFTSRSVSRDGHDIQSSSRNSSASIPMTPRSEGEILQFSNLKSYSYNELKMATKNFCPDSVLGEGGFGSVFKGWIDEHSLAVTRPGTGMVIAVKKLNQDSFQGHKEWLAEINYLGQLQNPNLVKLIGYCLEDQHRLLVYEYMPKGSVENHLFRRGSHFQQLSWTLRLKISLGAARGLAFLHSTETKVIYRDFKTSNILLDTNYNAKLSDFGLARDGPTGDKSHVSTRVMGTHGYAAPEYLATGHLTAKSDVYSFGVVLLEMLSGRRAIDKNRPSGEQCLVEWAKPYLSNKRRVFRVMDSRLEGQYSLTQAQRAATLAFQCLSVEPKYRPNMDEVVKALEQLRESNDKVKNGDHKKCRVSGSGLGHPNGLPASTSKGSIDAAKKFNYPRPSASLLYS

SEQ ID NO: 232501 - protein, 101 aa, Glycine max
  Coding DNA Sequence Number=SeqID_115723
MMEDASKFTHISPKKNGYVTYGDNNKGRILGVGKVGTNSSSSIENVLLVEGSFRPDDSTVTVGPSQDIPLDVGAQVKGEPEERGDTREIVSNCPWFQKGKK

SEQ ID NO: 232502 - protein, 110 aa, Glycine max
  Coding DNA Sequence Number=SeqID_115724
  Subcellular localization annotation: CTP_CleavageSite=30; ConfidenceScore=5.32e-01
MSPPPTLASCWIPIAPSPLATPPPPSFLIPQQHHFSFLPCACQTVIILVSYSLVIATVVMIFPATVREIFDETTMVVVGVVVCKIAMGVGCLIICPTRIWILVNDVQLSK

SEQ ID NO: 232503 - protein, 63 aa, Glycine max
  Coding DNA Sequence Number=SeqID_115725
MPSTSRHLWHLRSGGLTPTTNNFQEEPQHDLEFLLTPVGTMGGATFVNIAWSKCTQWRLQRTK

SEQ ID NO: 232504 - protein, 1065 aa, Glycine max
  Coding DNA Sequence Number=SeqID_115726
  Gene Ontology: Mol. function=protein binding; Cellular component=cell surface; Biological process=chitin metabolic process
  Homolog annotation: Hit_ID=Q1SR04; Match level="QueryCoverage=35%, HitCoverage=84%, E-value=1e-109, Identity=58%"; Hit description=Zinc finger, CCCH-type
  Pfam annotation: Domain name=zf-CCCH; Domain location=1013-1039; Score=15.1; E_value=0.013; Accession=PF00642.15; Description=Zinc finger C-x8-C-x5-C-x3-H type (and similar)
LLESTPKNKPIHFKCDPSKSDSAWKWLERWMSVSSKDIAECKEISSLIEQSRESKDSTPMFQFEMGIPSEPFPQAVDSKLTVEDSLLPSEDEEKLITCDADDFEFQASYSTSSIVKDDLVQVPPEEKIAYDAKVASDDADSFQNEKSASDASAPSELNSIHKGPEIAPPSELNSVHKGPEIAPPSEHNSLQKGTDIAPPSEHNSLQKGTDIAPPSEHNSLQKGTDIAPPSEHNSLQKGTDIAPPLEHNSLHKGPETAPPSELNSFNQKPEIDGEQGKQSMKRFASDQLEAEGKKPVNGSRKVSNPAFIAAQSKFEELSSIENSGRTSSLSYQDSAVESQGDTSSVGNDTAYRSKEFAFENPAAYLSRFAGSECGTELSISSTLDSPDISEPGAMENERDAKDLMEGIGNLENTINHDDEANDNVSRVIPASNLATSVLDKSEIVDDISANLGHSVVAVDSEEPAIKTEKNAPDLQRELPESVLQDLRSSPEASPRSHLTVPESQGTPSSEVSVKPKDSTINKTRSGNKRRSLSLSNKSPTNPNHDSGSKDSREQLPKDQQNGKRRNSFGSVKPDNIDQESRDNSTNNNSLPHFMQATESARAKVNANNSPRSSPDVHEGDIEVKKRHSLPGATGRQVSPRIQRSTSKAQQSAKGNNVHPPQEESPSQVGLNSQDNLQAKTSLSLRPGGAGSDDILPPGFEGTHASSQFEIKPSQIPVIKWITPQKIVLNVTWRVVSGEESKEAEDQCQREMRVLEAIYPRISSIPLNPSVSMDVEEFHCIDGQTTLIPITPVEDEDAAAETLSYSLEPFHVSQSLQLASGVLKDSNSATSMQLACGLASDVAVAASVALTNLVKSNEHGNFVDHELLNNILNNPEVIEKLVGDYGAINNSQYVHNAGSSLAAFSNPPIPIQGQTTTPSSVVFSTTSSYTPPIGGQAEPVTTQWPPRPAVSSAIVSSPIEVPPARDVNYYKSLIQQHGGHKETLPYSSKRQIPQAATNYETTSYNHRGKVSKPKIMKPCIFFNSSRGCRNGANCAYQHDASFQPRGNTVSGIQSSKRMKMDHEISN

SEQ ID NO: 232505 - protein, 404 aa, Glycine max
  Coding DNA Sequence Number=SeqID_115727
  Homolog annotation: Hit_ID=Q00SR2; Match level="QueryCoverage=36%, HitCoverage=30%, E-value=1e-33, Identity=48%"; Hit description=[S] KOG1426 FOG: RCC1 domain
  Pfam annotation: Domain name=RCC1; Domain location=100-151; Score =16.1; E_value=0.013; Accession=PF00415.9; Description=Regulator of chromosome condensation (RCC1)
MASSTRGVLVVMEGHREQKDEWVPRRVEVFQNRNVLPPDAIISAGSVNSSCTAGGGQLYMWGKLKNTGDDWMYPKPLMDLSGWNLLCMDSGNMHHFVGADSSCISWGHAQNGELGYGPTGQKSSAVPKKVDLLEGMHVISVACGMGHSMVIVDRANVADRLDQLDIYDGKAVGEGNEAVNTTPVPKQAAKKGAKGADNSKKRKQSKDSSDSDEDAEESEEDSEDQINGEAEAKRPRGSGKGRGKTPKKSGAKGKGSVSGRGRGGTAANKNSSKSPQVQLLYKIKIESYVLKGPGMISVDNKGLYLILWSILTTVSESHMLKQDHFWSKLTILEYDSEVKHEHERRDPNSKSMQWISFKRDEAMHMQQQQQHKPFMIHSLGTVDACLDEIFYETTTLWLSLLDPM

SEQ ID NO: 232506 - protein, 79 aa, Glycine max
  Coding DNA Sequence Number=SeqID_115728
THQPSAPTDSDRFGSDNTDSSESEQNEIESSPVRCLVSEVKHTACGGDFTVWLSSIEGASILTAGLPQYGQLGHGTDNE

SEQ ID NO: 232507 - protein, 97 aa, Glycine max
  Coding DNA Sequence Number=SeqID_115729
MVEASGNRLPACVIDYTEEWVTVVMRQMIVMAAQLIRDRVEMECLEGAWETLEGNTRCRFRGTIGFTATSLVHPDEPARTLQRMVEWTAPWISFVYF

SEQ ID NO: 232508 - protein, 68 aa, Glycine max
  Coding DNA Sequence Number=SeqID_115730
  Gene Ontology: Mol. function=nucleic acid binding; Biological process= DNA integration
MTGDKSKFTHISPKKSGHVTYGDNNKGRILGVGKIGTNSSTSIENVLLVEGLKHSLLSVSQLCDKGYL

SEQ ID NO: 232509 - protein, 112 aa, Glycine max
  Coding DNA Sequence Number=SeqID_115731
MASKKRRAPSTPSQVRFDLSQFTSQEACERYTNIVVPRKLLPERNVIVYYTEFDKFKEELERRDYDEELTDFNDSSIDIGIVKEFYTNLYDLEDKSPKQVCTPEALSSGVGC

SEQ ID NO: 232510 - protein, 153 aa, Glycine max
  Coding DNA Sequence Number=SeqID_115732
QWNLKAVGRGALTTYKDIPNLATAFEEGPQVKAMDTLWLGNNVVVRPEHPTVLKTKMKGQKRRFEQTTMVTNNGLADEVTGGGPATFRRLEGNAWLSRTETGANLRRHVEAHGWDSGQATCKDGDGWRPAVAKDGGDVGDNQNGIVPTLIPSC

SEQ ID NO: 232511 - protein, 278 aa, Glycine max
  Coding DNA Sequence Number=SeqID_115733
  Gene Ontology: Mol. function=hydrolase activity
  Homolog annotation: Hit_ID=UPI00003CC6BD; Match level="QueryCoverage =99%, HitCoverage=86%, E-value=2e-82, Identity=53%"; Hit description =COG0491: Zn-dependent hydrolases, including glyoxylases
  Pfam annotation: Domain name=Lactamase_B; Domain location=47-252; Score=76.1; E_value=1.1e-19; Accession=PF00753.17; Description =Metallo-beta-lactamase superfamily
MLGSFEVTASSDGIIRLPADNLLLNTTPQQIAAGLAERHQSLSVVTSVNAYLINTGDKLVMIDSGAGQLLGDGLGKMVDNVREAGYQPEQVDEIYLTHMHPDHLGGLTHDGKAVFPNAVVRAASQDADFWLSADRLKQAKAQNKGNLEKAMAAIKPYQAAGHFKPFNGDGELSPGIAAFAAHGHTPGHSVYQVTSQGKKLLLLGDLIHVAAVQMPHPKVAISFDSDAKAAVAQRLRVFSDSARQNELVGGAHLSFPGLGYLNRQGEGYSWVPLNYGAL

SEQ ID NO: 232512 - protein, 60 aa, Glycine max
  Coding DNA Sequence Number=SeqID_115734
MDTLEPYTGAMKGTMHKPQVNLGEDKKFSPNRFPATRGDKPWDFNAFIKRLHCRHPKIVK

SEQ ID NO: 232513 - protein, 186 aa, Glycine max
  Coding DNA Sequence Number=SeqID_115735
  Pfam annotation: Domain name=Transposase_23; Domain location=31-96; Score=7.8; E_value=0.00016; Accession=PF03017.5; Description =TNP1ENSPM transposase
  Subcellular localization annotation: CTP_CleavageSite=20; ConfidenceScore=5.03e-01
MQSQGLALPPEPLVSPSDPQVSTKGSCVNPSRNDPETADPARLVALGRVYEGSTVVHNTPLFPGQVKVGVEEVTDADAPVPVPTDEVSLVGQALHTFLAWPTHLVKSLSQQVAVSPAKPPPKPDPEVDDPLYLMTLTIPELFLRPYQVTWDGTVFGVFNPDFPLYIKHEDLSEIAHGGQCLSISVL

SEQ ID NO: 232514 - protein, 66 aa, Glycine max
  Coding DNA Sequence Number=SeqID_115736
NVYTDNHSGISARQHDSKVSMTDLVSVEDDVNLLVSTGLSVAIDEGCRMTTLAAACHRARRLWMTK

SEQ ID NO: 232515 - protein, 141 aa, Glycine max
  Coding DNA Sequence Number=SeqID_115737
  Gene Ontology: Mol. function=protein serine/threonine kinase activity; Biological process=protein amino acid phosphorylation
  Homolog annotation: Hit_ID=Q1SQC9; Match level="QueryCoverage=92%, HitCoverage=36%, E-value=2e-22, Identity=36%"; Hit description =Protein kinase
MATKEKNPEFMAPELYDENYNELADIYSFGMCILELVTSEYPYSECRNSAQIYKKVSSDIVLPKFGAFESRCMLSEGRASAHKGDISMGLGDTRRARNIHFIFYLESDGAVSISSETVEQLELAGHNVKFIAELIDLLLIS

SEQ ID NO: 232516 - protein, 93 aa, Glycine max
  Coding DNA Sequence Number=SeqID_115738
  Gene Ontology: Mol. function=protein serine/threonine kinase activity; Biological process=protein amino acid phosphorylation
  Homolog annotation: Hit_ID=Q1SQC9; Match level="QueryCoverage=67%, HitCoverage=12%, E-value=1e-18, Identity=59%"; Hit description =Protein kinase
MPLFVESLTPNELSSIIIDFDSEGHLEPPDPDVLDIDPTCRYIKIDEVLKSPADLERRYSEVHLLSSLKHNNAVRFYNSWILMTSARRVVYFG

SEQ ID NO: 232517 - protein, 41 aa, Glycine max
  Coding DNA Sequence Number=SeqID_115739
  Gene Ontology: Mol. function=DNA binding; Cellular component=nucleus; Biological process=regulation of transcription, DNA-dependent
  Homolog annotation: Hit_ID=Q9FHJ4; Match level="QueryCoverage=85%, HitCoverage=10%, E-value=3e-09, Identity=77%"; Hit description =Arabidopsis thaliana genomic DNA, chromosome 5, P1 clone:MFC19
MRWEKVAAAVPGRSKAACMKRFAELKKGFRTAKAAAELSAW

SEQ ID NO: 232518 - protein, 47 aa, Glycine max
  Coding DNA Sequence Number=SeqID_115740
IGIGIVAPICYPIRIPQLLKPHIVISKLELGECFMRTNVGLGYMYLN

SEQ ID NO: 232519 - protein, 119 aa, Glycine max
  Coding DNA Sequence Number=SeqID_115741
  Homolog annotation: Hit_ID=Q1SQB8; Match level="QueryCoverage=85%, HitCoverage=15%, E-value=4e-30, Identity=68%"; Hit description=IMP dehydrogenase/GMP reductase
MTETLEAGGFFPIRKSQDAAVGVLVHMLKKAPPLRQDFSTSQHLSQGSHPETRNHNTRGPNQILEPSRPVSIMSSGIIATRKTTADALEEFHGYKEMKNLLLTRGSLSWLAGMVQPYIV

SEQ ID NO: 232520 - protein, 499 aa, Glycine max
  Coding DNA Sequence Number=SeqID_115742
  Gene Ontology: Cellular component=membrane; Biological process =protein transport
  Homolog annotation: Hit_ID=Q1SQB8; Match level="QueryCoverage=91%, HitCoverage=74%, E-value=1e-121, Identity=54%"; Hit description=IMP dehydrogenase/GMP reductase
MASSHGNAHSDAAKMEQIITEFFAKSLHIILESRALYVSSRNSYGDQAVSSPCSSSSSSSNVRPRDKWFNLALRECPAALENIDLWRQNNLECIVIDVILVQRPLVSVSFSPKRVIPRSSSLKERCPFGWNTDQEELGVVGRSEKIVERWVVQYESRKTRDSNSGSRRSSNVSLHNLYKKSTLLLRSLYVTVRLLPAYKLFRELNSSGQIRDFTLAHRVSSFVEPFTRKEEAEMTKFGFTPVDTSSGRLCLSVMYCSLASDVSSEPSTPMSPQVITDYVGSPLADPLRRFPSHLVAGLPSHGSPSSLPSSRQRSWSFDHYRASPPSYLPSPTHSESLSSVYNASLPPHPTEMSMIQKKNTNFEDYHHFASPSISNSGPFPCKPLLRSESAPVSIPIAEIANSPGYSNSHNVPPSPPLRGSRGTAKIDRNTMQTGATAEKLFSLGKDESRKYSGVKISANSSPQISISRSSSRSYQNDFDDTDFTCPFDVDDDDMTDPGS

SEQ ID NO: 232521 - protein, 208 aa, Glycine max
  Coding DNA Sequence Number=SeqID_115743
  Pfam annotation: Domain name=Hep_Hag; Domain location=117-144; Score =19.9; E_value=0.0091; Accession=PF05658.4; Description=Hep_Hag
  Pfam annotation: Domain name=Hep_Hag; Domain location=145-172; Score =23.2; E_value=0.00095; Accession=PF05658.4; Description=Hep_Hag
  Pfam annotation: Domain name=Hep_Hag; Domain location=173-200; Score =7.8; E_value=2.2; Accession=PF05658.4; Description=Hep_Hag
  Pfam annotation: Domain name=Hep_Hag; Domain location=90-116; Score =15.6; E_value=0.17; Accession=PF05658.4; Description=Hep_Hag
  Pfam module annotation: Pfam domain module=Hep_Hag::Hep_Hag::Hep _Hag::Hep_Hag; Domain location=117-144::145-172::173-200::90-116
MNRIYRRVWNRARQCWVVSSELASSAGKPRSTAAGAVLLGLVLAVPSAEAGDIIAADECDESIWQALCLNSEVRAGSSSAYSLFSATPRAGINALELGYQAKANGYGSSAVGPEARSENFYSAAFGWRALAGEHYSVAVGANAQAGGGSAIAMGNDSNASASSAVAIGRQANSSGKSSVALGASPIASADIAPALGYLSQSTANYESA

SEQ ID NO: 232522 - protein, 231 aa, Glycine max
  Coding DNA Sequence Number=SeqID_115744
  Gene Ontology: Mol. function=zinc ion binding; Cellular component =integral to membrane; Biological process=ubiquitin cycle
  Homolog annotation: Hit_ID=Q1SN88; Match level="QueryCoverage=98%, HitCoverage=94%, E-value=5e-71, Identity=62%"; Hit description=Zinc finger, RING-type; RINGv
  Pfam annotation: Domain name=zf-C3HC4; Domain location=145-189; Score= 25.2; E_value=0.00023; Accession=PF00097.15; Description=Zinc finger, C3HC4 type (RING finger)
MYASSSFTSQLVHDLLVDTNSRKLLLQDPLLHQSMNSANSPDSMSYNTTDSYFTGRDFDANVVMILSVLLCAVICSLGLNSIIKCVLRCSNIVINNNDPSSSSSSASYNPSPRLANRGIKKKALKTFPTVSYSTEMKLPGLDTECVICLSEFANGDKVRILPKCNHGFHVCCIDKWLSSHSSCPKCRQCLIETCKKIVGSQIQPVAPVPETIIRIQPLEPEGLERNYREVC

SEQ ID NO: 232523 - protein, 289 aa, Glycine max
  Coding DNA Sequence Number=SeqID_115745
MDNILGRHILPERKVEIYHTELDKFKAELERRNFHKRLTNLVDNNIDLALVKEFYANLYRSEDPPPKHAKVRGHLVKIDADNLNTFLETPVILVEGETLPAYSRYCRLLTNYKEIEAALCIPGRGFVLNSEGHPGKILRNDLMTLAQVWSVLSYSNLAPTSHTSDLIVDRARMIFGLVSQMDMNVGALISGQITSIAQSNSSRLGFPALITVLCKDRGVTSDSLVFERLSPVINLAYIKKNNWNPDDLTVSIRGARQARMRPAEPPSTSTTPIPARTSVAHFVLAYADF

SEQ ID NO: 232524 - protein, 305 aa, Glycine max
  Coding DNA Sequence Number=SeqID_115746
  Gene Ontology: Mol. function=ATP-dependent DNA helicase activity; Cellular component=cytoplasm; Biological process=DNA repair
  Homolog annotation: Hit_ID=UPI00005FA09A; Match level="QueryCoverage =100%, HitCoverage=25%, E-value=1e-126, Identity=76%"; Hit description=COG1074: ATP-dependent exoDNAse (exonuclease V) beta subunit (contains helicase ...
  Homolog annotation: Hit description=and exonuclease domains)
  Pfam annotation: Domain name=UvrD-helicase; Domain location=1-304; Score=-102.2; E_value=3.5e-08; Accession=PF00580.11; Description =UvrDREP helicase
MIDEFQDTDPQQYRIFQKLYVGRPDCGLLLIGDPKQAIYAFRGADIFTYMRARSEVSAHYTLETNWRSSPSMVASVNHLFSQVEKPFLFGQIPFIEVSAAEKNQGLAFDLHGKPQPAMQFWLQQGEGAGVSDYQQLMARLCATQIRDWLSAGQQGQAWLQGGKEPRPVQASDITVLVRSRNEAALVRDALSALSIPSVYLSNRDSVFDTPEAKDLLWLLQAVLAPEQERTLRSAMATGLMGLDAPTLDGLSRDERAWDELVNEFDDYRTLWLRRGVLPMLSEVMKARQLAENLLASAGGERRLTD

SEQ ID NO: 232525 - protein, 95 aa, Glycine max
  Coding DNA Sequence Number=SeqID_115747
MGSSKDLSVLLTQAAIPSPFLPHRSGSKDLYVLLTQAAIEVLDIVLVLGWWVREFMSWWVCEFLSWWVREFVSWWVRGFMSSLFRRLLSLALLIL

SEQ ID NO: 232526 - protein, 56 aa, Glycine max
  Coding DNA Sequence Number=SeqID_115748
MTQSLNKGFSMGIPDGASSEVLCLALDVFEGYFLIDIFCLKWTGHDKFIPVVFDLW

SEQ ID NO: 232527 - protein, 213 aa, Glycine max
  Coding DNA Sequence Number=SeqID_115749
MGVTKEQVELSLKAKLNPSHLEKKTRRKLKVELGVDDNGITSGDVAALLGGRELAWECSNSNSNSKNPICTMQIMMIVDEKETLASQGKYKSIPQTHCILTYPIVLHTWQDGTGHIQICNMYQIVLRILKPPELISLAVWFLLTGFYCFAPFNELKYFLFQVISLSSFFGVSAATSLIPCAKYSNPHHLANLSGLVISISDCNHFVDIKELLT

SEQ ID NO: 232528 - protein, 221 aa, Glycine max
  Coding DNA Sequence Number=SeqID_115750
  Gene Ontology: Mol. function=structural molecule activity
  Homolog annotation: Hit_ID=Q06Z48; Match level="QueryCoverage=74%, HitCoverage=71%, E-value=1e-40, Identity=55%"; Hit description =Fibrillin 5
  Pfam annotation: Domain name=PAP_fibrillin; Domain location=76-217; Score=62.4; E_value=1.4e-15; Accession=PF04755.3; Description=PAP _fibrillin
  Subcellular localization annotation: CTP_CleavageSite=24; ConfidenceScore=5.35e-01
MVTKLVQPPMTDSHVSPLICRTMNAMKLQNFVPSRNHSRINTSRFGERPLWFRPITIIKVAEHNPGSGLAELETLAQKKRELCQAVEEWQKNMFQGINRGIFGIPATKKSEIERLVKQIESLNPTPCPTLELEKVAGCWRLVYSTISILGSKRTKLGLRDFISLDDFFQTIDISKSKAVNVIKFSAMGLSLLSGQLNIEASFRIASSTVKTPLLVWSLISL

SEQ ID NO: 232529 - protein, 207 aa, Glycine max
  Coding DNA Sequence Number=SeqID_115751
MMMTSNHIPYTGAAIIHSVDNEYDDGLPMNMKYDLTGVCNGLICLRAETLKDGFYLTWVRFWNPDTRLISKKSPCIQFQIQTPRRGCKMMGFGSRDTYKVVTVVVDWESMKTNSKVWSCRVLNAVAECVTYNHHPDFFRSFCLGVVFPLSMSENGDLVFLGSKCKPGPLIFTYHQRDNIVEHSKIYHQRVWLDSTDYVQSLVLPYRN

SEQ ID NO: 232530 - protein, 355 aa, Glycine max
  Coding DNA Sequence Number=SeqID_115752
  Gene Ontology: Mol. function=carbohydrate binding; Cellular component= cell surface; Biological process=protein amino acid phosphorylation
  Homolog annotation: Hit_ID=Q63FD2; Match level="QueryCoverage=53%, HitCoverage=23%, E-value=4e-14, Identity=34%"; Hit description =Collagen-binding surface protein
MSFTFKNEDKRGSTENEKNKVEESVKEEVLEVKKPAEDTKSNEPTVKQESLKPEEKLSEESKNNESSKQEYETLKAETHVNEPSKETVKRESEAEKPSEETHISEPVKETEKLESETEKPSVETHISEAAKETVKLESKAEKPSEETHINEPDKKTVIVESEAKKPSEETHINEPVKETVIVEAEKPSEETHINEPAKEIMIVESEAENPSKETLVNEPAKETVKLESDAEKPSEENNQSSESLKEEFVEAMEAPSEETQSIEPIKLKEEPIEPSEEGKPSGESEKNASETKTLIVESINSEVAPVPEERVIEEIPTAAKSFEKVTKEAASSTEEKSHNGVENAPKAVDAGAEIH

SEQ ID NO: 232531 - protein, 149 aa, Glycine max
  Coding DNA Sequence Number=SeqID_115753
  Gene Ontology: Mol. function=cytochrome-c oxidase activity; Cellular component=membrane; Biological process=electron transport
  Homolog annotation: Hit_ID=Q9FGG3; Match level="QueryCoverage=90%, HitCoverage=38%, E-value=2e-31, Identity=49%"; Hit description =Nodulin-like protein
MKKSMLYVDTIEDLKVKSARGVAKLVGVVACFTGSAILAFFKGPHLELLSHYHLLGYHKNQQHLGRVASGSWIKGCFLLLLSNTFWGMWLVLQTYVIKEYPSKLLLTTLQCFLSSIQSLSIALAVERDIDQWKLGWNVRLLAVAYCVIL

SEQ ID NO: 232532 - protein, 57 aa, Glycine max
  Coding DNA Sequence Number=SeqID_115754
MALLGDDKKFGSQQNTHYPKKKWPKIITHKWKFGNLLEAPNTLPMKGLFVTKLESNE

SEQ ID NO: 232533 - protein, 121 aa, Glycine max
  Coding DNA Sequence Number=SeqID_115755
  Homolog annotation: Hit_ID=Q1T344; Match level="QueryCoverage=66%, HitCoverage=28%, E-value=1e-10, Identity=39%"; Hit description=RNA polymerase, RBP11-like
MGVPFKLRGKPVVGGQGWTVKLICVIHNHELVKSLVGHPYVGRLSKAEKTLIADMMKSMVKPKNILLTLKEHNANSYNTYKTNRYRLSLLDFVGITPTGMTFFASFAYLEGERLNNVVWAL

SEQ ID NO: 232534 - protein, 333 aa, Glycine max
  Coding DNA Sequence Number=SeqID_115756
MMGVYPHCILSGTSIDFELIKELVEFSGMKDDQITDCVVVSDFHSLTKLEVEQYARQFLQDHQVDQLDAVVSRISDFELCHGRPCFISYILGTYMKSNDIDAAIGKFITGISNVDDQIFPLRFLKNDLDGGIRSFDITGNDAATAIRYGLGFVQTVDGTISSIEIQELAVIECLCYFLPFAHTVKSLYQRIGLYPNPNPQTVGYLVEYLVAFALVANYSGSDAANSIKASRDSASSYLLFGDSDQVYFPNHMCGPDIIYKCANTKTVYIVQIKLVKKMSKQQAANAYNTTVPERFYCKRNGGGVLKGFEEKRTHLLSTLSKLHKSGYSLQQTL

SEQ ID NO: 232535 - protein, 197 aa, Glycine max
  Coding DNA Sequence Number=SeqID_115757
IPLKVKGEVQTKKGLWWIPRHPETRKGVVSDEMLRGVENKRRSGDSRYRSTFRTAAESTGRQETTCLNRENGVVGELYKCRAARRSSRECCTLDGESPVAESITSLRSDPSSMGHVESRVNQQGPPCKAKYSWVTDSEGNHRSRSESESFTGQLSLLMDPNMGDLSHDQDEAWVKLSGGPEPTDVEESADELWLGVK

SEQ ID NO: 232536 - protein, 143 aa, Glycine max
  Coding DNA Sequence Number=SeqID_115758
  Gene Ontology: Mol. function=histone-lysine N-methyltransferase activity; Cellular component=nucleus; Biological process =multicellular organismal development
  Homolog annotation: Hit_ID=P59467; Match level="QueryCoverage=76%, HitCoverage=90%, E-value=1e-30, Identity=56%"; Hit description=LOB domain-containing protein 23
  Pfam annotation: Domain name=DUF260; Domain location=4-104; Score =165.7; E_value=1.2e-46; Accession=PF03195.5; Description=Protein of unknown function DUF260
MSSRCAACKNQTRKCSSDCIFFPYFPANDPQRFACVHRIYGGSNVGKMLQQIPPYLREQAANTLYFEAQRRIQDPVYGCTGIISKLYEQINNTEIALAHIQTQIACLKLQVPQEKAESNFNVLRAQSSGTTEFQWQSQVCWFN

SEQ ID NO: 232537 - protein, 90 aa, Glycine max
  Coding DNA Sequence Number=SeqID_115759
MTNHEAKVSSPLPPNIDLLTTIMSFQSDQPSRDSGATVRIGLGLDRLPINSEDSTREITVIESEPKIGIRRGNIVRVIGGGRIHHRSRVE

SEQ ID NO: 232538 - protein, 120 aa, Glycine max
  Coding DNA Sequence Number=SeqID_115760
MVAMIGRRRRCEGKDYLGSNAKVWYISRIKSKSQCWFYRHVSIKATLFEWERNIELVFSSYNFLEEDEIKLAIYKSIDYASIWWDQFVSSMRRCEEKSTDTWDEMKVVMRKRFIPNYQRD

SEQ ID NO: 232539 - protein, 76 aa, Glycine max
  Coding DNA Sequence Number=SeqID_115761
MQYLGSDPRSSPKFNINNKTLKRAMLNPQEKTTLEIQPSINNKNETETEIKSRKRNWNLKQKTKLEFYVNSTMREQ

SEQ ID NO: 232540 - protein, 76 aa, Glycine max
  Coding DNA Sequence Number=SeqID_115762
MGARKKKVVPSSTIVGVAIVVEQQMVELMHTPSLSTLAWPGQPIKKRLQKVIGEFKGVKEFKSSAVAFQSAWIFTH

SEQ ID NO: 232541 - protein, 153 aa, Glycine max
  Coding DNA Sequence Number=SeqID_115763
MQYYDNTLEAVILPMQLCFLKGNSPLHQPYHHPSYSILVSGDPRGSYPRLKVRLISGPCNRGTKQLGGRPRERTEVPALLVQGLPVEALIQLHLTPVISRLLASHMLHIRVHLELYPPQVVMAHVWLVATGPPPAAVVLNLADVPAWACNISL

SEQ ID NO: 232542 - protein, 96 aa, Glycine max
  Coding DNA Sequence Number=SeqID_115764
MERTGKGVFKEERESQREVKCAVLREGMVGVGLEWGKMEGWDGKGCHTEGSIGRIDCIIRKLGESNIVQRQAAATSNLKWGKVTAFSALPHFIFPK

SEQ ID NO: 232543 - protein, 72 aa, Glycine max
  Coding DNA Sequence Number=SeqID_115765
MEKIMRATWGSLCLYVVILSGASGGPYPIVTNITIEPDSPTSWTYHFEQQVVESAAAGLADPFQSNGLGAQT

SEQ ID NO: 232544 - protein, 141 aa, Glycine max
  Coding DNA Sequence Number=SeqID_115766
  Homolog annotation: Hit_ID=Q3ADV0; Match level="QueryCoverage=45%, HitCoverage=14%, E-value=2e-12, Identity=53%"; Hit description =Putative type I restriction-modification system, S subunit
  Pfam annotation: Domain name=DUF86; Domain location=65-133; Score =65.3; E_value=2e-16; Accession=PF01934.8; Description=Protein of unknown function DUF86
FDADLLTKGVVSEGEGESEKWRLRNEKIDKFKDSPLGRIPEEWEVVRLGETGRIVSGATPDTSKPQFWNVLKALENIGEAVKQIPDDKRELYPIEWKKIAGLRDILIHEYFGIDAEIIWEVIKKKLPELEKAVKFLLEKES

SEQ ID NO: 232545 - protein, 141 aa, Glycine max
  Coding DNA Sequence Number=SeqID_115767
  Gene Ontology: Mol. function=RNA-directed DNA polymerase activity; Cellular component=chromatin; Biological process=RNA-dependent DNA replication
MGLGQNGDGMASLVRFVENRGRVPICHISKNFVSAGWMHENQVGMLDEETDQEQPKWVASIVPIPKKDVKVRMCVDYQDQNRASPKDKFPLPHIDVLVDNTTSFFPILFHGWIFGLQSDKDGTGRYGKDNLHHSMGNLLLQ

SEQ ID NO: 232546 - protein, 100 aa, Glycine max
  Coding DNA Sequence Number=SeqID_115768
MSQPTLRRGREKADIMGQGILLRGRKRAESPPAFIRGKRRKNQKNKEVSQPTLRQEGGARPMGASSIGGKCAESPPTFIQGKRQKNWNVWSTNFTKDGSL

SEQ ID NO: 232547 - protein, 48 aa, Glycine max
  Coding DNA Sequence Number=SeqID_115769
MGSRWRKFEGLDSESREEWTIFSFLIQAAGEQRSSLPPFSTYIGYIGS

SEQ ID NO: 232548 - protein, 319 aa, Glycine max
  Coding DNA Sequence Number=SeqID_115770
  Gene Ontology: Mol. function=CTP synthase activity; Cellular component=cellular_component; Biological process=pyrimidine nucleotide biosynthetic process
  Homolog annotation: Hit_ID=Q9LTW8; Match level="QueryCoverage=99%, HitCoverage=53%, E-value=1e-132, Identity=73%"; Hit description=CTP synthase
  Pfam annotation: Domain name=CTP_synth_N; Domain location=1-284; Score=689.5; E_value=2.4e-204; Accession=PF06418.4; Description=CTP synthase N-terminus
MKYLLVTGGVVSGLGKGVTASSIGVLLQACGFRVTSIKIDPYLNTDAGTMSPFEHGEVFVLDDGGEVDLDLGNYERFLDLKLTRDNNITTGKIYQSVIEKERRGDYLGKTVQVVPHITDAIQEWIERVAQIPVDGKEGPADVCVIELGGTIGDIESMPFIEALGQFSYRVGPGNFCLVHVSLVPVINVVGEQKTKPTQHSVRQLRGLGLTPNLLACRSSKELDDNIKEKLSQFCHVPSSSILTLYDVPNIWHIPLLLSDQKAHDAILKTLNLRGVATEPNFKEWITTTKVYDKFHEMVRIAMVGKYTNLSDAYLSVLKA

SEQ ID NO: 232549 - protein, 112 aa, Glycine max
  Coding DNA Sequence Number=SeqID_115771
MTNEEHRMKNDIEVDYSRDSVAPPKKGTWGLAARPGELLLHFEVNCLTQASCSSPRLASSFTLKQFGSPGELEASLGELEASLGEPGSRKLPEMTLLPLPFGIFCTLDQNIQ

SEQ ID NO: 232550 - protein, 1025 aa, Glycine max
  Coding DNA Sequence Number=SeqID_115772
  Gene Ontology: Mol. function=protein binding; Cellular component =thylakoid; Biological process=photosynthesis
  Homolog annotation: Hit_ID=Q4W7J1; Match level="QueryCoverage=95%, HitCoverage=71%, E-value=0.0, Identity=53%"; Hit description=TONSOKU protein
  Pfam annotation: Domain name=LRR_1; Domain location=821-842; Score =3.7; E_value=59; Accession=PF00560.23; Description=Leucine Rich Repeat
  Pfam annotation: Domain name=LRR_1; Domain location=879-900; Score =1.7; E_value=1.4e+02; Accession=PF00560.23; Description=Leucine Rich Repeat
  Pfam annotation: Domain name=LRR_1; Domain location=956-982; Score =12.2; E_value=1.5; Accession=PF00560.23; Description=Leucine Rich Repeat
  Pfam annotation: Domain name=TPR_1; Domain location=162-195; Score =17.5; E_value=0.043; Accession=PF00515.18; Description =Tetratricopeptide repeat
  Pfam annotation: Domain name=TPR_1; Domain location=205-238; Score =11.2; E_value=0.25; Accession=PF00515.18; Description=Tetratricopepti de repeat
  Pfam annotation: Domain name=TPR_1; Domain location=245-278; Score =28.6; E_value=2.2e-05; Accession=PF00515.18; Description =Tetratricopeptide repeat
  Pfam annotation: Domain name=TPR_1; Domain location=382-415; Score =17.5; E_value=0.044; Accession=PF00515.18; Description =Tetratricopeptide repeat
  Pfam annotation: Domain name=TPR_1; Domain location=422-455; Score =13.2; E_value=0.14; Accession=PF00515.18; Description=Tetratricopepti de repeat
  Pfam annotation: Domain name=TPR_1; Domain location=65-98; Score=5.6; E_value=1.2; Accession=PF00515.18; Description=Tetratricopeptide repeat
  Pfam annotation: Domain name=TPR_2; Domain location=162-195; Score =16.9; E_value=0.073; Accession=PF07719.7; Description=Tetratricopepti de repeat
  Pfam annotation: Domain name=TPR_2; Domain location=205-238; Score =20.4; E_value=0.0067; Accession=PF07719.7; Description =Tetratricopeptide repeat
  Pfam annotation: Domain name=TPR_2; Domain location=245-278; Score =28.8; E_value=1.9e-05; Accession=PF07719.7; Description =Tetratricopeptide repeat
  Pfam annotation: Domain name=TPR_2; Domain location=25-58; Score=4.9; E_value=8.9; Accession=PF07719.7; Description=Tetratricopeptide repeat
  Pfam annotation: Domain name=TPR_2; Domain location=382-415; Score =16.7; E_value=0.083; Accession=PF07719.7; Description=Tetratricopepti de repeat
  Pfam annotation: Domain name=TPR_2; Domain location=422-455; Score =15.0; E_value=0.26; Accession=PF07719.7; Description=Tetratricopeptid e repeat
  Pfam annotation: Domain name=TPR_2; Domain location=65-98; Score=8.9; E_value=3; Accession=PF07719.7; Description=Tetratricopeptide repeat
  Pfam module annotation: Pfam domain module=LRR_1::LRR_1::LRR_1::TPR _1::TPR_1::TPR_1::TPR_1::TPR_1::TPR_1::TPR_2::TPR_2::TPR_2::TPR _2::TPR_2::TPR_2::TPR_2; Domain location=821-842::879-900::956 -982::162-195::205-238::...
  Pfam module annotation: Domain location=245-278::382-415::422-455::65- 98::162-195::205-238::245-278::25-58::382-415::422-455::65-98
MDADLKSAKAAYRNAKAEGNHREEARWANVIGDILKNRGEYVQALKWLRTDYDVSLKHLPEKHLLPTCQSLGEMYLRLEHFSDALIYQKKHLELARDADDVVEQQRASTQLGRTYHELFSRSEHDHNSIRNAKKYFKSAMDLAVKLKENPPNSKSSFLKEYIDAHNNIGMLEMDLDNLHEARKILTRGLEICEEEEVAEFDDGRSRLHHNLGNVYMELRDWDKARKHIKTDIVICNRIGHVQGEAKGYINLGEVHYRTQKYEDASAYYLKALGLAKSLEDEDALVRQIEQNIKIVREAVKVMADIKKNEQSLKKLKRDIATARGTPNERKFLLQQNAVLERLVEKARMISAWEKRLFEAKHCEFAKEKKRIASELCDRQRLADSYLDVAESYQKLRKFNKAIKWYKKSWEMYKNIGNLEGQAMVKINIGNVYDSTENWRKALDAFQESYSIAVEADLPDVQLSALENMHYSNMIRFDDEDETRRLKLLIDKLKKSEEKEAEAKSMPEDFCSETDTEADDYLSNSGSDDLCFPKTTSRSKTLTTGEEMKNDMPLMSVYQSIKGSSKKKAGHKESLTNSTKQDEQSPSSLKNQTSDHQTVVSRKRVRVILSDDDDDDEEVECSSRKNHHCPVEDLPTYDAIKTKASPCKIQFISENGSKCTINVEESSCSYKCSSPHTATKTGRHSRSLSNDIVAEPDFRIGSKCGTDVSGKQNDISQPMLHHSQNDLQQYITCRIGNDLIHVETTLCATGDQLNIDSLKAAVACLYYLQFPTEKRSEGLLPIIEHIKCAGRDLKSLETVEHLKEVLGNSMVEASVDGWIHKCLIKMYVDGCKELSEVPNIKVLKKLYNLEVSDDEIAVSDCDLQDLSITPLINALHSQKSFAMLDLSHNLLDCAVFALSSNCLVVAFSFGNGTIEKLQKVFTASGQSYGGLTLDLHCNRFGPTALFQICECSLLFARLEVLNISGNRLTDACGSYLSTILKNCTEWCGGFFANRHREFVKGDLPCQCHRPQWHVYMAEFWPCAICR

SEQ ID NO: 232551 - protein, 116 aa, Glycine max
  Coding DNA Sequence Number=SeqID_115773
  Gene Ontology: Mol. function=ribonuclease H activity; Cellular component=mitochondrion; Biological process=DNA integration
MTTSKNLTIHGAFGSGPSMSIPHMEKGQGELKLWRLLEGVHGMFAKLLASSGSPSEVEGVGPECWPIVFSTYHFGCKGGSLGMEAADPFIKFSNLECLLDDSLEIPDLFGIGQLVK

SEQ ID NO: 232552 - protein, 596 aa, Glycine max
  Coding DNA Sequence Number=SeqID_115774
  Homolog annotation: Hit_ID=UPI0000E478F5; Match level="QueryCoverage =27%, HitCoverage=9%, E-value=2e-09, Identity=31%"; Hit description =PREDICTED: similar to plus agglutinin
MSFISDFAISMGGSDYGGSIQQPLVKREVIPIGGSSLERTCQEAYDNESSSSERLVDSHRVGRGSSHLRRRARPSIASLDGEPFLVTTILPPSTSGGARRSRGEDPLSPSTVAGYEWVTNDVLKYRSSITSVASVAALERQLRLANPENSCKMAVQACESDDFTFLRAVSGCPPFFFMYHYLYDVVGLVVSSSPPTMVVASIPLASLVVAPPPTIVVPWLSASVTTISALGMSPPSSFASPITFTLLVILIQCGAWDIGGTRELQLALCLLLTRILFGQLGFKMPLTLQRATTRTVWRVEHPKVANATIAFVEAVKSNHQLSSKVGDVLAKLLEKNEYAGKVESSIVEKDELAKVVANLQAQLRELESKLEEFEHRVSKERKANKELEEELLVVRQVKFFTKDLDLGLVDPLKDMKDGELLDEEEITVVEEDAGKEQGDRANSFSLEACETWNQRGSPRANLRFDKPLEKGDSQVADLGFDESLEKRDSPGKNLEFNEPLEKRDLPRADLGFKKPLEKQDSPRVDLGFDEHLEMRDSPRVDLGFDEPLEKVDLRFDKPLEILGGSPRVDLGFDKPFEMRPRTRSSRVLLRLTKGGP

SEQ ID NO: 232553 - protein, 75 aa, Glycine max
  Coding DNA Sequence Number=SeqID_115775
MRVELETKDEVQEMPKSKKRPLNSEHQGDTIQRFILKPFSLPFVPIEENQGFGLRGFNEAKLVNEGNSYSVDYIE

SEQ ID NO: 232554 - protein, 310 aa, Glycine max
  Coding DNA Sequence Number=SeqID_115776
MIGPDTQINVLGRNILPERKVEIYHSELDEFKAELERRNFHKRLTNLVDESIDLALIDADSFNTFLETPVVLAEGETLPTYSRYCRLLIDYREIEAALCIPGRGFILNSEGHPGKILRKDLTTLAQVWSVLSYSNLAPTSDTSDLTVDRARLIFGLVSRIDMNIGALISGQITSIAQSNTSRLWFLALIIALCRARGVVSDSLTFERLSPVINLAYIRKNCWNPEDLTVFIRGARRARARLVELPSTSAASTPASTSAAPSVPAQTDSQRFEAMLQSIHQEQIILLQSLQVVAPLGSIPSVEQFTEMVAW

SEQ ID NO: 232555 - protein, 199 aa, Glycine max
  Coding DNA Sequence Number=SeqID_115777
MRRIFIGLHPADVCRQFHHPPPFSSLPSHWDPWGVPNDYRCKVIENDAPVPKHGLEEALSSEMWLSKKCGYVFTWRLLKDRLPTKGNLLRRNVAIQEAVCPLCGQAVGPLPASPTSHFAQFCDGFGADINDSSWCGWWVALTSAIWQHRNLLIFQGNPFDSSKVMEEAMFLVWSWLKPRDKGFNTSFNHWSSNISDSFG

SEQ ID NO: 232556 - protein, 58 aa, Glycine max
  Coding DNA Sequence Number=SeqID_115778
MGLTTTNVRRQRRKGWWMMKLATNISWMKSYEDPPHSQRGERATILRAPRADTQEACT

SEQ ID NO: 232557 - protein, 143 aa, Glycine max
  Coding DNA Sequence Number=SeqID_115779
MKPRRYRIVTEIIYYVIFLFYVLRATVSYFTPCQNVAVFDPPTDDMRCHMKQLHLTTMVENQIINKILVDGGTVFSILPRSMLQRKQLKVGELAEEVTQFMSRREKYFVEVEAQEESPVKEHESREKDEEQALWKQSFMMNQQ

SEQ ID NO: 232558 - protein, 136 aa, Glycine max
  Coding DNA Sequence Number=SeqID_115780
MTSLFSKEQNNVSPLLDGIDGFSLLNSTKEIITDQKVILIIFRGRVLGLRVCGRWWRVFGNWWWWEIFFFFLLVGSNFFFFLFFEGNFFVFLFFVLLGGWLLLLWLFFLEIEKGSGGWLVERRRTQLLLLCQVGEW

SEQ ID NO: 232559 - protein, 140 aa, Glycine max
  Coding DNA Sequence Number=SeqID_115781
  Gene Ontology: Mol. function=serine esterase activity
  Homolog annotation: Hit_ID=P76561; Match level="QueryCoverage=75%, HitCoverage=45%, E-value=4e-45, Identity=85%"; Hit description =Esterase ypfH
MSLESIKAEPGLASRVIAFNGRYASLPQTATTQTTVHLIHGGEDRVIDLAWAVSAQERLQELGGDVTLDIVEDLGHAIDDRSMQFALDRLRYTVPKHYFDEALSGGFSRMRRVAPSPGYQIAQRCSPGKRQRHRGVQRGE

SEQ ID NO: 232560 - protein, 376 aa, Glycine max
  Coding DNA Sequence Number=SeqID_115782
  Gene Ontology: Mol. function=RNA-directed DNA polymerase activity; Biological process=RNA-dependent DNA replication
MDIVEQENQSLREEVATLREGMDRLTTMMSALLSAQNSQAAAATVEQPLVSTTPLSTVTSPPLFLPPGCTWGMPPPVCGSPQPAVSEIPPPFAQQSAPVPQPSTSFPQAAMTYSAPLIHTIQQEVEPIFQAENVVAFDKMEELQERFDGMQREVEALRGRDLFGKDACELCLVPNVTIPHKFKVPDFDKYKGNSCPRSHLVMYARKMSMYTDNHKLLIHFFQDSLTGAALKWYMNLDSASIRTFNDLGEAFIRQYKYNLDMAPDRDQLRAMTQKEKETFKEYAQRWREVAAQIVPPLEEREMTKIFLKTLSQFYYEKMVASAPTDFTEMVNMGVRLEEGVREGRLTGESAPAASNAKKFGGHFAKKKDQEVGMVAH

SEQ ID NO: 232561 - protein, 288 aa, Glycine max
  Coding DNA Sequence Number=SeqID_115783
  Gene Ontology: Mol. function=protein binding; Cellular component =membrane; Biological process=defense response
  Homolog annotation: Hit_ID=Q1SW19; Match level="QueryCoverage=99%, HitCoverage=32%, E-value=1e-101, Identity=62%"; Hit description =Disease resistance protein
TLDIRNTLVHELPSEINMLKKLRYLLAFHRNYEADYSLLGSTTDHGGIDLIQEMRFLRQLRKLGLRCVRREYGNAICASVEEMKQLESLNITAIAQDEIIDLNSISSLPQLRRLHLKARLEKMPNWISTLEFLVKIRLALSNLKDDPLRSLEKLPSLLKVSIWDNAYDGQILHFRSGGFRKLKELYLARLDRVNSVLIDKGSLLSLENFIICKIPHLKKLPSGIEALDNLKVIDFRDMPTELVESIDPKKGQDYEIINQVPLVIIRHWIGPKLSDFEVRAIHSSSQKS

SEQ ID NO: 232562 - protein, 894 aa, Glycine max
  Coding DNA Sequence Number=SeqID_115784
  Gene Ontology: Mol. function=protein binding; Cellular component =membrane; Biological process=defense response
  Homolog annotation: Hit_ID=Q1SW20; Match level="QueryCoverage=99%, HitCoverage=95%, E-value=0.0, Identity=65%"; Hit description=Disease resistance protein; AAA ATPase
  Pfam annotation: Domain name=LRR_1; Domain location=574-595; Score =8.2; E_value=8.5; Accession=PF00560.23; Description=Leucine Rich Repeat
  Pfam annotation: Domain name=LRR_1; Domain location=597-618; Score =14.0; E_value=0.53; Accession=PF00560.23; Description=Leucine Rich Repeat
  Pfam annotation: Domain name=LRR_1; Domain location=620-641; Score =9.5; E_value=4.8; Accession=PF00560.23; Description=Leucine Rich Repeat
  Pfam annotation: Domain name=LRR_1; Domain location=825-850; Score =2.5; E_value=97; Accession=PF00560.23; Description=Leucine Rich Repeat
  Pfam annotation: Domain name=NB-ARC; Domain location=147-459; Score =303.0; E_value=5.6e-88; Accession=PF00931.13; Description=NB-ARC domain
  Pfam module annotation: Pfam domain module=LRR_1::LRR_1::LRR_1::LRR _1::NB-ARC; Domain location=574-595::597-618::620-641::825-850::147 -459
MAEIAVAFALGQVFQILNDETNLLGGIHKDFSNIRDELESIQAFLKDADRKAADEANTNHGIRTWVKQVREASFRIEDIIDEYLRVIHVVPHLGCEASICKITSLIKTSISRHQIATKIQDIKLSISVIKERSERYKFQPSQEPPSSSSTRMGSLFIEETEIVGFKLPRDELVGWLLKGTEERTVISVVGMGGLGKTTLAKHVFDSEKVKGHFDYRACITVSQSYSVRGLFIEMIKQFCREAKDPLPEMLHEMDEKSLISEARQYLQHKRYLIFFDDVWHEDFCDQVEFAMPNNNRSSRIIITTRMMHVAEFFKKSFPVHILSLQLLPPDKAWELFCKKAFRFELHGQCPALLEGMSNEIVRKCKGLPLAIVAIGGLLSTKSKTVFEWQKVNQNLNLELQRNAHLTSITKILSLSYDDLPYYLKPCILYFGIYPQDYSINHNRLTRQWIAEGFVQSDGRRTSEQIADEYLSELIYRSLVQVSTVGFEGKVKSCQVHDILHEMIVRKLKDLCFCHFVHGGDESATSGTTRRLSVDISSNNVLKSTNYTHIRAIHVFGKGGLLELFTGLLSSKSRVLKVLDLHGTSLNYISGNLGNLFHLRYLNLRGTKVQVLPKSLGKLQNLETLDIRDTLVHELPSEINMLKKLRHLLAFHRNYEARYSLLGFTTGVLMEKGIKNLTSLLKLCYVEVDHGGIDLIQEMKFLWQLSKLGLRRVRREYGNAICASVVEMKHLESLDITAIGEDEIIDLNPISSLPQLQRLKLKTRLEKMPNWISKLEFLVEIRLGLSNLKDDLLRSVENLPNLLKLGIWDNAYGGEILHFQSGGFPKLKELYLARLNRVNSVLIDKGSLLSLEYFIIAKIPHLKKLSSGIKALDNLKVIDFRDMSTELVESIDPKK

SEQ ID NO: 232563 - protein, 85 aa, Glycine max
  Coding DNA Sequence Number=SeqID_115785
  Gene Ontology: Mol. function=catalytic activity; Biological process =metabolic process
MWHVEFTGNQDTTITTTLDHNIQSQDMTQTLYAGEHLRCLMDDDGGSRGWLVQFYVYPYACIQSTLCELGQCFSKKMIISVREES

SEQ ID NO: 232564 - protein, 565 aa, Glycine max
  Coding DNA Sequence Number=SeqID_115786
  Gene Ontology: Mol. function=protein binding; Cellular component =membrane; Biological process=defense response
  Homolog annotation: Hit_ID=Q1SW20; Match level="QueryCoverage=99%, HitCoverage=64%, E-value=0.0, Identity=63%"; Hit description=Disease resistance protein; AAA ATPase
  Pfam annotation: Domain name=NB-ARC; Domain location=156-473; Score =170.1; E_value=5.6e-48; Accession=PF00931.13; Description=NB-ARC domain
MAETAVSFALERVFQILTEETNLLRGTHKDFLGIRDELESIQAFLKDADRRAADEANTKAGIRTWVKQVREASFRIEDVIDEYLRVIHGVQHLGCGASICKITSLISTVTSRHQIATEIQDIKVSLSLIKERSERYKFQVSQEQQSSSNTEAIEGSRWHDSRMRSLFIEETEIVGFEFPKDELVGWLLKGTKEPTVISVVGMGGLGKTTLAKHVFCSEKVKRHFDCRACITVSQSYTVKGLFIDMIKQFCKETKNPLPEMLHEMDEKSLISEVRQYLQHKKYLIFFDDVWHEDFCDQVELAMLNNNESSRIIITTRMMHVAEFFKKSFPVHILSLQLLPPDKAWELFCKKAFRFELHGQCPALLEGMSDEIVRKCKGLPLAIVAIGGLLSTKSKTVFEWQKDYSINHNRLTRQWIAEGFVQSDGRRTSEQIADEYLSELIYRSLVQVSTVGFEGKVKSCRVHDLLHEVIVRKMKDLSFCHFVNEGDDESATIGATRRLSIDTSSNNVLKSTNSTHIRAIHCFGKGEQLEPFMGQLFSKSRVMKVLNLEGTLLTYVPSNLGNLFHL

SEQ ID NO: 232565 - protein, 84 aa, Glycine max
  Coding DNA Sequence Number=SeqID_115787
MEEVQEQMKADMEAMKEQMTTMMEAMMSMTKMMEVNTATVVAASTSTEVDPTHLSGINQAIHPFSDMVGQGGEALGSTGGPYFV

SEQ ID NO: 232566 - protein, 187 aa, Glycine max
  Coding DNA Sequence Number=SeqID_115788
  Gene Ontology: Mol. function=nucleic acid binding
MELHHLPRYHPHLNKYKEKILREVLPCIQNNIHLERNLWHKAATWRDIIWVLGEIQQVVCFLSSPSNKSMINAASGGALMDRTPIAARQLISNMAANNQQFGTRVATPPRAVASEVFVSMVVDNQRLENKLIQLTSLVRQMHVSHFKKQNKLLLFLPCNLGSYSNLNNNNTILTPTPTILVGKIIQT

SEQ ID NO: 232567 - protein, 139 aa, Glycine max
  Coding DNA Sequence Number=SeqID_115789
MRAKARVMSEIEEVQEQMKTDMEAMKEQMAIMMSMRRMMEVNATTFVAISTVTEVDLTHPSGLNQINHPTSNMNKHSFPPYGLPPNYTPPNVLHTLDGNVDNSAPIPIESQKPQSDHAQSLNPWGRHMKHPETSQSSRL

SEQ ID NO: 232568 - protein, 125 aa, Glycine max
  Coding DNA Sequence Number=SeqID_115790
MRLHCYQASQRPNMTIDRPPLLMAHIVPGTGPNISTCVRGIGVIGVANCRNLSFGGWARRDKKVCLLMKKMRGVATNVYLRKNVRKTKKRSMELEKKGSGVVYVRERVLSLLLRILKCDEEFRPT

SEQ ID NO: 232569 - protein, 943 aa, Glycine max
  Coding DNA Sequence Number=SeqID_115791
  Gene Ontology: Mol. function=protein binding; Cellular component =membrane; Biological process=defense response
  Homolog annotation: Hit_ID=Q1SW19; Match level="QueryCoverage=99%, HitCoverage=98%, E-value=0.0, Identity=70%"; Hit description=Disease resistance protein
  Pfam annotation: Domain name=LRR_1; Domain location=586-607; Score =10.2; E_value=3.5; Accession=PF00560.23; Description=Leucine Rich Repeat
  Pfam annotation: Domain name=LRR_1; Domain location=609-630; Score =12.5; E_value=1.3; Accession=PF00560.23; Description=Leucine Rich Repeat
  Pfam annotation: Domain name=LRR_1; Domain location=632-653; Score =9.4; E_value=4.9; Accession=PF00560.23; Description=Leucine Rich Repeat
  Pfam annotation: Domain name=LRR_1; Domain location=788-810; Score =0.9; E_value=1.9e+02; Accession=PF00560.23; Description=Leucine Rich Repeat
  Pfam annotation: Domain name=LRR_1; Domain location=861-883; Score =4.6; E_value=39; Accession=PF00560.23; Description=Leucine Rich Repeat
  Pfam annotation: Domain name=NB-ARC; Domain location=158-470; Score =321.3; E_value=1.7e-93; Accession=PF00931.13; Description=NB-ARC domain
  Pfam module annotation: Pfam domain module=LRR_1::LRR_1::LRR_1::LRR _1::LRR_1::NB-ARC; Domain location=586-607::609-630::632-653::788 -810::861-883::158-470
MAETAVSFALGEVYEILKDEAKLLRGIHKDFSDIKDELESIQAFLKDADRRAADEANTNDGIRTWVKQVREASFRIEDVIDEYLRVIHVVQHLGCGASICKITHLISTLISRHQIATEIQDIKLSLSVIKERSERYKFQVSQEQPSSSSTGGIEGSRWHDPRMSSLFIEETEIVGFELPRDELVAWLLKGTEERTVISVVGMGGLGKTTLCKHVFDSENVKSHFDCRACITVSQSYTVRGLFIDMIKQFCRETKDPLPQMLHEMDEKSLISELRQYLEHKRYLIFFDDVWHEDFCDQVEFSMPNNNKRSRIIITTRLMHVAEFFKKSFPVHVHSLQLLPPDKAWELFCKKAFRFELGGKCPAELQGMSNKIVRKCKGLPLAIVAIGGLLSTKSKTVFEWQKVIQNLNLELQRNPHLTSLTKILSLSYDNLPYHLKPCLLYLGIYPEDYSINHTSLTRQWIAEGFVKSDGRRTIEQVADEYLSELIYRSLIQVSSIGFEGKVKNCQVHDLLHEVIVRKMEDLSFCHFLYEGDDESATLGTIRRLSIDTSSNKVLKSTNNAHIRAIHAFKKGGLLDIFMGLLSSKSRPLKVLDLEGTLLSYVPSNLGNLFHLRYLNLRNTKVQVLPKSVGKLKNLETLDIRDTLVHEFPSEINKLKQLRHLLAFHRNYEAEYSLLGFTTGVVMKKGIKNLTSLQNLCYVEVEHAGIDLIQEMRFLRQLRKLGLRCVRREYGNAICASVEEMKQLESLNITAIAQDEIIDLNSISSLPQLRRLHLKARLEKMPNWISTLEFLVKIRLALSNLKDDPLRSLEKLPSLLKVSIWDNAYDGQILHFRSGGFPKLKELYLARLNRVNSILIDKGALLSLENFKLNKMPHLKEVPSGIKALDNLKALDFLDMPTEFVESIDPQNGQNYWIINHVPLVFIRHWIGPKLNDFEVRTIRLFYRE

SEQ ID NO: 232570 - protein, 83 aa, Glycine max
  Coding DNA Sequence Number=SeqID_115792
MLQLPKSDHFPINRRPKGVLRGSKGSEVERIDRREKEEEERRGNEAEVLPNRDCDRPHIISCSVFFAPVELRRSEFLIAPEDT

SEQ ID NO: 232571 - protein, 66 aa, Glycine max
  Coding DNA Sequence Number=SeqID_115793
MSSPKRAGFFTMKIFGGPGKREAGLGELGEVKIRTLISFGRLCYSTGQLTKTKEVKLKKQEDIEVL

SEQ ID NO: 232572 - protein, 140 aa, Glycine max
  Coding DNA Sequence Number=SeqID_115794
MAASHFNRENKKCLEHLKHAKQISDPPDHKDWKALMPVIVDPPLKVSNATWLSEEGDERIGPNATFLLLSCATCYIVLNDIISSYHPDSLKSACARKIEPCFSVQSRGCTCGGAYSLDFDSECVKNSTPYGGLKSSKSVS

SEQ ID NO: 232573 - protein, 60 aa, Glycine max
  Coding DNA Sequence Number=SeqID_115795
MRRVKSEEFDKFYNKECRKISTICTYKMDTNNMRPISDATNIEANGWKSKDNRNMMAKRM

SEQ ID NO: 232574 - protein, 269 aa, Glycine max
  Coding DNA Sequence Number=SeqID_115796
  Gene Ontology: Mol. function=sequence-specific DNA binding; Cellular component=intracellular
  Homolog annotation: Hit_ID=Q1SNM1; Match level="QueryCoverage=80%, HitCoverage=92%, E-value=2e-45, Identity=41%"; Hit description =Histone-fold/TFIID-TAF/NF-Y
MVMPFVVPVTMCLLFYVSMPRIGSKKKISEKNDVSDENNNLQARIKKIMQADEDVGKIADIVSRVPDYGHGHGHGHSEAGADDRALPKRRKAVGDDGNDSDEEAKRSKMRELGHTGTPGRGRGRGRGRGRGRGARTIERDICHQQVESEPCTSILQSSNDIPNTSVPIDNGPQSKELPKENFVISEESTQSFRNIDLNANLNENEDKNAGTAVPASLPEPTSMDTAMEIKHEEIPGWSLSDVDKMGIDTMQLANLGSRLEEDEEDYDEE

SEQ ID NO: 232575 - protein, 303 aa, Glycine max
  Coding DNA Sequence Number=SeqID_115797
  Gene Ontology: Mol. function=nucleic acid binding; Cellular component= intracellular; Biological process=regulation of transcription
  Homolog annotation: Hit_ID=Q9LEU3; Match level="QueryCoverage=96%, HitCoverage=96%, E-value=4e-20, Identity=31%"; Hit description=Zinc finger-like protein
  Pfam annotation: Domain name=zf-C2H2; Domain location=118-140; Score =22.2; E_value=0.0018; Accession=PF00096.16; Description=Zinc finger, C2H2 type
MASSHFLEGCPSEGSSISATSEGISHKPSAEEEKNHDEVTTMKEKDVKSEQDQASNSNSHMVLDFVKLSKDYSIRGSKVELDFFNPMSLGGSSSSRTNNNEGRDENNNEEKSSEAKTFSCNFCKKEFSSSQALGGHQNAHKQERALAKRRQGIDAGAFGNPHFLYYPYHPTHSFYGSYNRALGVRMESMIHKPSYPSPSLGFRFGQGWSRSQEMLNPSLDRLRMETLHANSGTRILGSDNTNLRTQDDRGTIGHNIPFLGESSTNVVTKSNSAPLSNLGGDHPKQEAPSSPDSSDEIDLSLKL

SEQ ID NO: 232576 - protein, 149 aa, Glycine max
  Coding DNA Sequence Number=SeqID_115798
  Subcellular localization annotation: CTP_CleavageSite=45; ConfidenceScore=5.06e-01
MRLFSNIFQHGAVLDVLCMHAASKPPESLASLVSVSKSLFTLAIRACCVKEPPALLAISVSMGIASQTGEFQVAEKQAFFRRVQAFFMCFFREGSFFKLREVATVIDELRASCNSHWRVRAEGIAIPDDDLGPLYTRKFFQCCCVFTSS

SEQ ID NO: 232577 - protein, 48 aa, Glycine max
  Coding DNA Sequence Number=SeqID_115799
MGMQDVRPMERGCALWHQWPQSWSMWSIIEMPKVKDNMVDASCKELGA

SEQ ID NO: 232578 - protein, 56 aa, Glycine max
  Coding DNA Sequence Number=SeqID_115800
MRRIKGENTHIESLESELWGTRLSGPWPSSGLGSLFGSYYLILINSYYKVLKDFYP

SEQ ID NO: 232579 - protein, 90 aa, Glycine max
  Coding DNA Sequence Number=SeqID_115801
MDKQKGGCFAHKLYASPKQTASQTGEFAGSEEVAIPIDDFAMHGGTASQTGEFVAGETASCRAYVQECRLDVAGQESPLVQARCRKNSPV

SEQ ID NO: 232580 - protein, 68 aa, Glycine max
  Coding DNA Sequence Number=SeqID_115802
MVMVMLVSECMCVLAFTLVHSLIHDRLIFYKCLFLCLVLMVMVSEKLGLALGFDGDGLCAGGRIMPQP

SEQ ID NO: 232581 - protein, 80 aa, Glycine max
  Coding DNA Sequence Number=SeqID_115803
MESQLSIEAPMVEGLQNLKVGDIFDSVNGCLNDGLIRHLLFHKLSSNERTNLRDRGVDSSMKLFSMLAKISLGVGGEGPS

SEQ ID NO: 232582 - protein, 50 aa, Glycine max
  Coding DNA Sequence Number=SeqID_115804
MVDPVILERDDNFLFFRANENEALVIRRILDEYASASGYPYIMDEPLSNT

SEQ ID NO: 232583 - protein, 412 aa, Glycine max
  Coding DNA Sequence Number=SeqID_115805
  Homolog annotation: Hit_ID=Q8H6Q7; Match level="QueryCoverage=73%, HitCoverage=24%, E-value=9e-39, Identity=37%"; Hit description=CTV.22
MAKCEHHKRALENTFALFQVNKSEITPDFEQRVDNIEKYIYSITKPKYVSSQLQISQVEATSTNIPTSQVMGPHDSHMTQPNSHQVANQSSAADPQEESVKQQGYGNVVQQQTSGEITPPVISTSGILASPLLENCNEENENCQGHIVISDDASPAMQHSINVMNFVSAEALVDSCEDIGMVFHLNDGKSTLEPLNGPPLSAIGSDLEGVNVTDSQARYLTRRKFAPRERNMNHFINSMPASEIFLQLTSSEKLFSNSSTSQENNALSEEIKEINMRLIDTEVVADKGKIVTTAAEGYIAHGEGLTVKLLFNSPIIQPLWLHIPASYPHCSVAIIDEMPLEARKDLDEDLSMKAKLKLTLCLQRLSQPLSLKDIAVSWDRCVREAICEYAQLFGGGTFTSKYGGWEICPNDI

SEQ ID NO: 232584 - protein, 45 aa, Glycine max
  Coding DNA Sequence Number=SeqID_115806
RKYIIYVREPKGKKMKTISGHCVLVKDISVSKAAKILTKFVSADD

SEQ ID NO: 232585 - protein, 80 aa, Glycine max
  Coding DNA Sequence Number=SeqID_115807
MSIRTCRKAWSEQMRKQSCQIVQQILPIMQKKNGCAVLVSAVTGKSGTWRYVARVRRPWGRQVGCYCPKPSLANPDPTRA

SEQ ID NO: 232586 - protein, 113 aa, Glycine max
  Coding DNA Sequence Number=SeqID_115808
  Gene Ontology: Mol. function=oxidoreductase activity; Cellular component=mitochondrial outer membrane translocase complex; Biological process=electron transport
  Homolog annotation: Hit_ID=Q1SFF8; Match level="QueryCoverage=99%, HitCoverage=27%, E-value=2e-54, Identity=87%"; Hit description =Pyridine nucleotide-disulphide oxidoreductase, class I; FAD -dependent pyridine ...
  Homolog annotation: Hit description=nucleotide-disulphide oxidoreductase
VMEGVKEITRNGAKFMDGKEKEFDAIILATGYKSNVPTWLKGCDFFTKDGMPKTPFPHGWKGEQGMYTVGFTRRGLHGTSCDAIKIAEDIAEQWRTVEDKSHCDSHIILLNNS

SEQ ID NO: 232587 - protein, 112 aa, Glycine max
  Coding DNA Sequence Number=SeqID_115809
  Homolog annotation: Hit_ID=Q1S1X7; Match level="QueryCoverage=36%, HitCoverage=3%, E-value=7e-07, Identity=70%"; Hit description =Integrase, catalytic region; Zinc finger, CCHC-type; Peptidase aspartic, catalytic
MSIYLIELNVTQLESEREYMSYVRYASVVGSLMYAMVRTRLELAQTVSEVSRYMGCFVTMALSTYFNFDTLQSPNLETNTFDESMLEEVAAPNLQHLFPYSDESLFLSNTFF

SEQ ID NO: 232588 - protein, 109 aa, Glycine max
  Coding DNA Sequence Number=SeqID_115810
EALMTVASSIRRLADAMEQSKCSFDASELLHAVMEIDGLEEGKQMYAFEYLNADPVKARAFLTYNARMRKTYLFRQFWWWRIIECIDSRLIGDSHMPETLETSSLPSNH

SEQ ID NO: 232589 - protein, 215 aa, Glycine max
  Coding DNA Sequence Number=SeqID_115811
MELQYWKLDVLGMVVKVAKIPNQGAPFEGTIIDDWKFDYSSFDARHMVSNDQADMTGRLLVGSLTFNCHIMHYIIVRILMPRSSNLAQASEEDLILMWAFLTDRQIDWAHLIRYHMHKALRSTVTSFSYHKELDGSWVKKDAPPQVADEHTPYPLRHDSSVLLNDLLMELRGFRAHVDDRLDGIDTRFDAMDLRIDQLSNDMNFIHRSFDPPADP

SEQ ID NO: 232590 - protein, 204 aa, Glycine max
  Coding DNA Sequence Number=SeqID_115812
  Gene Ontology: Mol. function=nucleic acid binding; Cellular component= intracellular; Biological process=DNA integration
MYDGIVRTLIEVLITVGAMDSKCFSFWIEGGVMQIKRKGKFVVMQRTKQGSLYILQGSPVTGTISTVSQVGSYAFNGSSNENYLWHLCLGHMSEKGLEVLRLNRSLWAKAVSTTCYLVNHSLSTAKHFKTSIKILTYYHVSEGKIESRAKKGVFMGYGNGVKGFRIWSLLKRKVILSRDVIFDEFSMLNSKSKEDSGKAKDVTM

SEQ ID NO: 232591 - protein, 72 aa, Glycine max
  Coding DNA Sequence Number=SeqID_115813
MQRRKQYQQNRIDEDWIPIANQITESECRSSASLECREGFLGKNDEKILSFHFLEDQMRKRKGSGRFSQGIR

SEQ ID NO: 232592 - protein, 37 aa, Glycine max
  Coding DNA Sequence Number=SeqID_115814
MEKARKTLVFKRSKGPGVGYAKGSYAKISLNAPDPLK

SEQ ID NO: 232593 - protein, 158 aa, Glycine max
  Coding DNA Sequence Number=SeqID_115815
  Gene Ontology: Mol. function=GTP binding; Cellular component=signal recognition particle, endoplasmic reticulum targeting; Biological process=SRP-dependent cotranslational protein targeting to membrane
  Homolog annotation: Hit_ID=Q9ZRD1; Match level="QueryCoverage=96%, HitCoverage=45%, E-value=3e-47, Identity=60%"; Hit description=NTGP4
  Pfam annotation: Domain name=AIG1; Domain location=11-158; Score =214.7; E_value=2.1e-61; Accession=PF04548.7; Description=AIG1 family
  Pfam annotation: Domain name=Dynamin_N; Domain location=13-135; Score= -38.1; E_value=0.021; Accession=PF00350.13; Description=Dynamin family
  Pfam annotation: Domain name=MMR_HSR1; Domain location=11-126; Score =16.5; E_value=3.1e-05; Accession=PF01926.13; Description=GTPase of unknown function
  Pfam module annotation: Pfam domain module=AIG1::Dynamin_N::MMR_HSR1; Domain location=11-158::13-135::11-126
  Subcellular localization annotation: CTP_CleavageSite=34; ConfidenceScore=5.50e-01
MAKTSSSNEVRTLVLVGRTGNGKSAVGNSVLGRRAFKSKSSSSGVTRVCELQRTIIKDGPIVNVIDTPGLFDGTHSAGKEIVKCIDMAKDGIHAILMVFSVKTRFSEEEQATFLALQALFGHKIVDYMIVVFTGGDELEENEETLDDYLGHECPQPLK

SEQ ID NO: 232594 - protein, 388 aa, Glycine max
  Coding DNA Sequence Number=SeqID_115816
  Gene Ontology: Mol. function=transcription regulator activity; Cellular component=nucleus; Biological process=regulation of transcription
  Homolog annotation: Hit_ID=Q1PF17; Match level="QueryCoverage=67%, HitCoverage=81%, E-value=3e-25, Identity=34%"; Hit description=Basic helix-loop-helix family protein
  Pfam annotation: Domain name=HLH; Domain location=185-234; Score =35.9; E_value=1.4e-07; Accession=PF00010.16; Description=Helix-loop -helix DNA-binding domain
MGEPCQQYWFSDMEIRDFDFFNQSQNHKIGSLDRDEDRIFREIMMHQPVFSSDSDTHSPKILSKSIHGGDSGYNTYTALANNKSSNSNLVMKSNSSNFIFSSQHAPPEKPSTATVASPTAYILSFGDSTLVAATRQNYGGKQPYHEEVVVGSGGVCLPSKGVSEKHDVEPTTANQTTKRSRSSAETLDHIMTERKRRRELTERFIALSATIPGLKKIDKATILSEAITHVKRLKERVRELEEQCKRTKVESVSFVHQRPHITTDKGTTSGAMNSDEWCRTNEALPTVEARVFKKDVLLRIHCKIQSGILIKILDHLNSLDLSTISNSVMPFGSSTLDISIIAQMGDKFKVTMNDLVKNLRLALLQSSEMIAQFSLFSIRASSSNFQDS

SEQ ID NO: 232595 - protein, 123 aa, Glycine max
  Coding DNA Sequence Number=SeqID_115817
  Gene Ontology: Mol. function=GTP binding
  Homolog annotation: Hit_ID=Q9ZRD1; Match level="QueryCoverage=75%, HitCoverage=27%, E-value=3e-16, Identity=44%"; Hit description=NTGP4
MRDNQQKALDSLKGYSKEEMFEIKMQMQQKYDDELKRMINMVESKLKEETANLLKKLEEERVARLKAEENYRSFQNASNDEIRRLKEDLEKANRRRDPGLPFPFNLLIPFRGRRPIPPPCPIL

SEQ ID NO: 232596 - protein, 174 aa, Glycine max
  Coding DNA Sequence Number=SeqID_115818
MGEVEEVQEQMKADTEALKEKMATMMEAMMTIKEIMEVSAAYQTRARARVMGEVEEVQKQMKADTETLKEKMATMMEAMMSIKEIMEVSAAYQTRARARVMGEVEEVQEQMKADMEAMKVKMATMMEAMMSMKKIMEANAVPVAATRAVAKVNPMPPSDLMNHPTSDMVDKDLG

SEQ ID NO: 232597 - protein, 239 aa, Glycine max
  Coding DNA Sequence Number=SeqID_115819
  Gene Ontology: Mol. function=hydrolase activity, acting on ester bonds; Biological process=lipid metabolic process
  Homolog annotation: Hit_ID=Q7X9E8; Match level="QueryCoverage=36%, HitCoverage=87%, E-value=6e-17, Identity=47%"; Hit description=Lipase
  Pfam annotation: Domain name=Lipase_GDSL; Domain location=22-238; Score=-14.1; E_value=0.026; Accession=PF00657.12; Description=GDSL -like LipaseAcylhydrolase
MTDVETLVLLFEESNDVEYGNFYISGDVGTAVVSCAFYIVFHKAMMLNMGTSTSVVTNDVEYENFYISGDIGTDDLPGFMESLVKQMSVNLKRIHSLGIKKVAVGLLQPIGCLPVLNVISFRTNCIGLLNVISKDHNKMLLKAVQELNKEAADKSVFITLDLYNSFLSAIETMQKKRAEKSTLMNPLQPCCEGNNLEDSCGSVDDEGSKKYSLCENPKLSFFWDTLHPSQNGWFAVYTQ

SEQ ID NO: 232598 - protein, 264 aa, Glycine max
  Coding DNA Sequence Number=SeqID_115820
  Gene Ontology: Mol. function=DNA binding; Cellular component=cytosol; Biological process=regulation of transcription, DNA-dependent
  Homolog annotation: Hit_ID=Q8S8I2; Match level="QueryCoverage=85%, HitCoverage=96%, E-value=3e-60, Identity=49%"; Hit description =Protein ULTRAPETALA2
DPPKQKRSQGNEKKTEDDNITQGPSKRRKQFRVGDDGKILFDEEELKMILDFKRGEDYIEVLCGATNKKYGDYVGRLKINNEGQYFITCECCPECPLVSVTLEAFEKHALREGSGRWKRNIWVHCEDEDKVPLWKTPLIKYYLHQANVTNRKDSAMRKQNFHRDEFLRCTRCGKERRFHLQSRPDIRNYHDALNNKCWICSLWPYQKITCDDDEERSSLKASRGCSRSSTCQGCSTCYCEGCIKYRFEDCNCQECRDFMLYAKP

SEQ ID NO: 232599 - protein, 122 aa, Glycine max
  Coding DNA Sequence Number=SeqID_115821
AFKTLETKSEGKFGHSTPRWIEVKSHVQSGTYECGYFVMHWMWNIIVGQLKTNWTLWFNDGTPLDINIMTTLRKKWAEYFVKLRSIQCEDDVAADGNKENPTNEAEQKEPENKEYSGVLLNQ

SEQ ID NO: 232600 - protein, 56 aa, Glycine max
  Coding DNA Sequence Number=SeqID_115822
MGGDNDKRRETLDKEDKLKKGMGDFLDEMLTMMSQTKSNGKSNEKRDLNWLCLCVS

SEQ ID NO: 232601 - protein, 32 aa, Glycine max
  Coding DNA Sequence Number=SeqID_115823
MKVGASHRMSFIKGKIGNGSEETLHEEVCGIL

SEQ ID NO: 232602 - protein, 211 aa, Glycine max
  Coding DNA Sequence Number=SeqID_115824
  Gene Ontology: Mol. function=transcription factor activity; Cellular component=nucleus; Biological process=regulation of transcription, DNA-dependent
  Homolog annotation: Hit_ID=Q6RUR2; Match level="QueryCoverage=33%, HitCoverage=35%, E-value=2e-09, Identity=45%"; Hit description =Ethylene-responsive element binding factor
  Pfam annotation: Domain name=AP2; Domain location=79-143; Score =124.1; E_value=3.8e-34; Accession=PF00847.10; Description=AP2 domain
MNGELFLHAPTTTTTNFLLPKKSQTASSETLDPSQKLRRYETALEGIAAVVGEHVLFGTTLSHVSETPKKTNGVSSSLSKSYRGVRKRPWGRWSAEIRDRIGRCRHWLGTFDTAEEAARAYDAAARRMRGAKARTNFKIPSVLPLSPEGVHGSAVKPKTARSNARKCSSVEQLFSGVPQLRKDDGIGENGNVEVDLKLGVNFGVTSSRMVL

SEQ ID NO: 232603 - protein, 111 aa, Glycine max
  Coding DNA Sequence Number=SeqID_115825
  Homolog annotation: Hit_ID=Q9C8G9; Match level="QueryCoverage=100%, HitCoverage=6%, E-value=2e-29, Identity=52%"; Hit description =Multidrug resistance-associated protein 1
MGFQPLNWYCRPAENSIWAKAVDSAFGSYTPCAINTLVISISNLVLVGLCLYRIWLITCNAKAQRFCLSSNCYSYLMGMLAAYCAVQPILRLLTGNSAFNLNGETEFAPVE

SEQ ID NO: 232604 - protein, 937 aa, Glycine max
  Coding DNA Sequence Number=SeqID_115826
  Gene Ontology: Mol. function=hydrolase activity, acting on ester bonds; Cellular component=nucleus; Biological process=nucleobase, nucleoside, nucleotide and nucleic acid metabolic process
  Homolog annotation: Hit_ID=Q2HUT6; Match level="QueryCoverage=67%, HitCoverage=39%, E-value=1e-175, Identity=51%"; Hit description=SH2 motif; Alcohol dehydrogenase, zinc-containing; Resolvase, RNase H- like fold; ...
  Homolog annotation: Hit description=Nucleic acid-binding, OB-fold, subgroup
MSEHNVQNFSQQMEGVPPVVLGDEGLPRLYEDSKISENQLPRQHGIVKRAVALGRYLLNPLAMVATLCGVKNEIVSWKLNTLEKFLTSDEKLEIIEWVMTDVTNQVGIDINLAIRHDWLLAPLQFVSGLGPKKAGVLHRELLGGTDVRNRRDLAKFGLDKEKVFCNAVGFLKVSCDEENFVDNGSNTLDHTRIHPESYNLSEELALAVYKKHVPDPEANFSGVNAIEYIQNDPNLLENFDLNEYADRLEIEKGEYKRITLIDIKMELLHGFKDPRIPYTELTQEEEFYMITGETGDALVEGKRVQATVRNVMSKQAFCVLDSGMTGVLFKEDFSDETENISLTDKLHQGAVLTCKIKLIDKNKCWVNLTCKLSELKNDGEQGFHDMDPYYHEGNIISISQVERADKMELGTKNFKPRMISHPNFQNITADQAKQFLADQEVGEYIFHPSSRGLSFLILSIKIFNGVYVHKDIVEGGKSQNLPELGETLKIGEETFKDINQVIEHYVNPLVVHLKDMINFRKFKKGTKAEVDELLKLEKDEYPNRIAYGFGISYEHPGTFILSYIRSRNPHHEFVAIQRKGFKFRKQIFKNIEQLVAYFQNHINDNVAPAKSCIAVGSFRESLSGGWRSNNVDQHTESIAYSSEKNSDLGLFVRIQAYNDSGNGSNAGRGRGRGGRGQGRDRGGCGRGRDSGGCGRGFGHRSGSRDYFNGDDNDGSSFPSSNWGSGSRDSPDDSFGAGKSWEVRGSGEGNGGRQGRGRGRGRGSRGSQGDGQGRVPWGGNSHERGGYSDGNSDSGWGQGQDQGRGSDGNGQGRGRWGGNNSNEERNKDEESRGNGSWGFGNAGSGNENSGWGKNATPSGDGSGWGGTGGSSWEKTEFDDNLDLGRVQSSSPISLVSATFCSVHWQRLGSVKVKVPVFSVAVVVGGIRGTVDRADQVDP

SEQ ID NO: 232605 - protein, 396 aa, Glycine max
  Coding DNA Sequence Number=SeqID_115827
  Gene Ontology: Mol. function=transporter activity; Cellular component= integral to membrane; Biological process=transport
  Homolog annotation: Hit_ID=Q6J1S8; Match level="QueryCoverage=78%, HitCoverage=71%, E-value=4e-52, Identity=55%"; Hit description =Nodulin 26-like protein
  Pfam annotation: Domain name=MIP; Domain location=200-379; Score =44.6; E_value=9.3e-13; Accession=PF00230.10; Description=Major intrinsic protein
  Pfam annotation: Domain name=zf-XS; Domain location=115-155; Score =41.3; E_value=3.3e-09; Accession=PF03470.5; Description=XS zinc finger domain
  Pfam module annotation: Pfam domain module=MIP::zf-XS; Domain location=200-379::115-155
MAADRLAGMIYRSIQVVVFSNKLNLLMPFGPLAILVQKLTGHLGWVFGLSLLGIMPLAERLGYATEAATGSSMNLARTLGPAIAAHNYKGMWIYLTAPILGSLCGAGAYTVLKLPDHIRKSDSNTARDLVQHASGVGKSSANRSAQQKANHLALGKYLETDLACEAEPIQRPALPQAEKKRKLDSWSRDLNKREALTDQEKKKLEEDNKKVGAEFLGTFLLIFAAISAAIEKEKSQGQETMMGCAEMTGVVPLYIGAQVLASVSAAFALKLIFHPFMSGGVTVPSVGYGQAFVAEFSVSFTLMFVVTAVANGTRAVRLFAGIVVGATVMINIHMAGAATGSSMNPARTLGPAIAAHNYKGIWIYLTAPILGSLCGAASEGDDMINHIPGNSSSHAA

SEQ ID NO: 232606 - protein, 153 aa, Glycine max
  Coding DNA Sequence Number=SeqID_115828
  Gene Ontology: Mol. function=ATPase activity, coupled to transmembrane movement of substances; Cellular component=integral to membrane; Biological process=protein amino acid phosphorylation
  Homolog annotation: Hit_ID=Q9C8H1; Match level="QueryCoverage=91%, HitCoverage=9%, E-value=4e-54, Identity=63%"; Hit description =Multidrug resistance-associated protein 12
MQAELPDHGEYEPLCGDDQVCPERHANIFSRICFGWITPLMKQGYRKPITEKDVWKLDEWDRTETLTEKFQKCWMLEFQSSNPWLLRALNSSLGKRFWMGGIFKIGNDLSQFVGPILLNHLLDSMQRGDPSWIGYIYAFSIFVGVVWLLSLII

SEQ ID NO: 232607 - protein, 74 aa, Glycine max
  Coding DNA Sequence Number=SeqID_115829
MDGWRGVLLGMLLLEIFGAIIALEMTKEKGWNRTWLECDFTLVIHAFKKPSIVPWQDYNFLVGLHTFLCQRGVP

SEQ ID NO: 232608 - protein, 124 aa, Glycine max
  Coding DNA Sequence Number=SeqID_115830
  Gene Ontology: Mol. function=ATPase activity, coupled to transmembrane movement of substances; Cellular component=integral to membrane; Biological process=response to oxidative stress
  Homolog annotation: Hit_ID=Q9C8H1; Match level="QueryCoverage=68%, HitCoverage=5%, E-value=1e-27, Identity=72%"; Hit description =Multidrug resistance-associated protein 12
VAAIFRKSLRLTNDGRKNFPSGRLMNMITSDANALQQICQQLHGLWSAPFRITVAIVLLYQQLGVASLIGSLMLVLIIPLQASFVTSFIPQICVLWFLLSERQILGKNPENPCLAALDIFLFFV

SEQ ID NO: 232609 - protein, 272 aa, Glycine max
  Coding DNA Sequence Number=SeqID_115831
  Gene Ontology: Mol. function=ATPase activity, coupled to transmembrane movement of substances; Cellular component=integral to membrane; Biological process=transport
  Homolog annotation: Hit_ID=Q9C8H1; Match level="QueryCoverage=95%, HitCoverage=59%, E-value=1e-109, Identity=48%"; Hit description =Multidrug resistance-associated protein 12
  Pfam annotation: Domain name=ABC_tran; Domain location=128-272; Score= 70.8; E_value=4.4e-18; Accession=PF00005.17; Description=ABC transporter
  Subcellular localization annotation: CTP_CleavageSite=66; ConfidenceScore=5.63e-01
MTKHVLRMLLNSFILNSIPVLVTVTSFGMFTLLGGELTPARAFTSLSLFSVLRFPLNMLPNLLSQVANANVSLQRLEELFLAEERNLKQNPPIEPGLPAISIENGYFSWDRKEEKPTLSDINVEIPVGSLVAIIGGTGEGKTSLISAMIGELPPLANGNATIRGTVAYVPQISWIYNATVRENILFGSKFEYEQYRKVIDMTALQHDLNLLPGRDFTEIGERGVNISGGQKQRVSIARAVYSNSDIYIFDDPLSALDAHIAQEVSSLFLIKL

SEQ ID NO: 232610 - protein, 566 aa, Glycine max
  Coding DNA Sequence Number=SeqID_115832
  Gene Ontology: Mol. function=ATPase activity, coupled to transmembrane movement of substances; Cellular component=integral to membrane; Biological process=transport
  Homolog annotation: Hit_ID=Q9C8H1; Match level="QueryCoverage=97%, HitCoverage=36%, E-value=0.0, Identity=65%"; Hit description =Multidrug resistance-associated protein 12
  Pfam annotation: Domain name=ABC_membrane; Domain location=139-416; Score=70.2; E_value=6.5e-18; Accession=PF00664.13; Description=ABC transporter transmembrane region
VFRNCIKEGLRGKTRVLVTNQLHFLPQVDKIILVSEGMIKEQGTFEELSKSGPLFQKLMENAGKMEQADNNEDRESHGTDNDLPMNNEAIEELPSDASYEKKGKLRKSVLIKKEERETGVVSWKVVMRYKSALGGLWVVSILFSCYTLTEVLRISSSTWLSVWTSQDSTADYDPTYFLLIYALFSFGQRVIFISFWENEMNISFAAFSLRAAKNLHDAMLDKILRAPMVFFQTNPVGRIINRFAKDTGDIDTNVFNLVNMFLGQVWQLLSTFVLIGTVSTISLWAIMPLLIFFYAAYLYYQSTAREVKRMDSITRSPVYAHFGESLNGLSSIRAYKAYDRMAHINGKFMDKNIRFTLVNISSNRWLTIRLETLGGLMIWLIATSAVLQNARAANQAMFASTMGLLLSYTLNITNLLSGVLRQASRAENSLNSVERVDTYINLETEAPGVIETHRPPPGWPTSGSIEFEDVVLRYRPELPPVLHGLSFTVPPTEKIGIVGRTGAGKSSMLNALFRIVELQKGKIIIDGCDISTFGLEDVRKVLTIIPQSPVLFSGIFHEQNSCSVLN

SEQ ID NO: 232611 - protein, 112 aa, Glycine max
  Coding DNA Sequence Number=SeqID_115833
MTLSLSLSLSLSLSLSLSPCICIVAHIYLIWQDPAETEEIWNFWNPILWTFEHCILSHNVSFCVRSSLYKKLFYIAPAPAKMGYGAAVKRFLKVMAMVWAGSQITKLVRAGG

SEQ ID NO: 232612 - protein, 60 aa, Glycine max
  Coding DNA Sequence Number=SeqID_115834
MANGYLLIARGVCPWLREYPTVAEECLIFIIWKGLCGHVNVTSAIPIDNDVIAKGQTTDA

SEQ ID NO: 232613 - protein, 58 aa, Glycine max
  Coding DNA Sequence Number=SeqID_115835
MPPPPPPVNTSGGKRKNPSTSNLEDVREKKWKATTLPQVSAWSHVDKYLAFLSMKDGM

SEQ ID NO: 232614 - protein, 355 aa, Glycine max
  Coding DNA Sequence Number=SeqID_115836
  Gene Ontology: Mol. function=protein kinase activity; Cellular component=integral to membrane; Biological process=protein amino acid phosphorylation
  Homolog annotation: Hit_ID=Q9FJT4; Match level="QueryCoverage=87%, HitCoverage=45%, E-value=1e-72, Identity=47%"; Hit description =Similarity to protein kinase
  Pfam annotation: Domain name=Pkinase; Domain location=59-323; Score =152.9; E_value=8.3e-43; Accession=PF00069.15; Description=Protein kinase domain
  Pfam annotation: Domain name=Pkinase_Tyr; Domain location=59-323; Score=157.8; E_value=2.8e-44; Accession=PF07714.7; Description =Protein tyrosine kinase
  Pfam module annotation: Pfam domain module=Pkinase::Pkinase_Tyr; Domain location=59-323::59-323
MSHLRTQVKQEKQLMNIQEAHETIAQPVCSVCNNTRPKFECNKKRDFTYAELYASTQGFSPKNFLSEGGFGSVYKGTLYGQKVAVKLLKLMCANHKGEKEFKSEVDALSKARHENVVKLLGSCTEGNHRLLVYEYVCNGSLDQHLSQHSRKPLSWKDRVKVAIGAAEGLLYLHENNIIHRDMTPNNILLTHDYDVLLGDFGLARTVLEDSSYSTDCVGNLTYMAPEYAEFGKVSTKTDVYSFGVVLLQLITGMRTTDKRVGDKGLVGWARPLLKDWKCQSLIDGRMINSHDCHQLYWMSRLVGNCLQRDPQKRLNMNTVVRALNQIGQGCSCIVRIDHTLAESSHSIPKDDIRSS

SEQ ID NO: 232615 - protein, 506 aa, Glycine max
  Coding DNA Sequence Number=SeqID_115837
  Gene Ontology: Mol. function=protein kinase activity; Cellular component=integral to membrane; Biological process=protein amino acid phosphorylation
  Homolog annotation: Hit_ID=Q9C890; Match level="QueryCoverage=67%, HitCoverage=53%, E-value=2e-79, Identity=46%"; Hit description =Protein kinase, putative; 86372-89112
  Pfam annotation: Domain name=Pkinase; Domain location=127-389; Score =135.6; E_value=1.4e-37; Accession=PF00069.15; Description=Protein kinase domain
  Pfam annotation: Domain name=Pkinase_Tyr; Domain location=127-389; Score=109.2; E_value=1.2e-29; Accession=PF07714.7; Description =Protein tyrosine kinase
  Pfam module annotation: Pfam domain module=Pkinase::Pkinase_Tyr; Domain location=127-389::127-389
  Subcellular localization annotation: CTP_CleavageSite=52; ConfidenceScore=5.32e-01
MIHHAVSRSSSSDLLTPTVVSSQWSTEVSTSSFGSLRHGCQYQEGKFYSNIEQETTWNRSLFHISENEETSQIEVNQKEQNSRNNEASHMEEEFTNPFCSVCNNRRPKIGLKRDFSYAELHTATQGFSPKNFLSEGGFGSVYKGLLNGMKIAVKQHKYASFQGEKEFKSEVNVLSKARHENVVVLLGSCSEKNDRLLVYEYVCNGSLDQHISEHSRSPLSWEDRINVAIGAAKGLLYLHKNNIIHRDVRPNNILITHDYQPLLGDFGLARNQNQDSIHSTEVVGTLGYLAPEYAELGKVSAKTDVYSFGVVLLQLITGMRTTDKRLGGRSLVGWARPLLRERNYPDLIDERIINSYDVHQLFWMVRIAEKCLSREPQRRLNMVKVVDALTDIVEGRTCDIRLRDYSPARSDSTNGVSDSDESKDEMQEPFRFEEELLSHSSESIENNNISQMMQMIVRQPPSPPIQSIFSCISSSYKFHYESTSDGEAQNEGEIEISNSNGGLLYS

SEQ ID NO: 232616 - protein, 138 aa, Glycine max
  Coding DNA Sequence Number=SeqID_115838
MMTTEAETERVVVIQDASRDVNSNAILRALEWFSVKAGDQLIIVAILDWISSPMGYMVRVDSSSMISTNKKIIEKRLTKIKEEYLRNQNIEEISNYCKLNEIGFQLEVLVGSTAEVASNAAKEFQATRLILVRSVSNF

SEQ ID NO: 232617 - protein, 271 aa, Glycine max
  Coding DNA Sequence Number=SeqID_115839
  Gene Ontology: Mol. function=sugar porter activity; Cellular component=integral to membrane; Biological process=carbohydrate transport
  Homolog annotation: Hit_ID=Q9LEG2; Match level="QueryCoverage=77%, HitCoverage=53%, E-value=3e-52, Identity=50%"; Hit description =Putative sugar transporter
  Pfam annotation: Domain name=Sugar_tr; Domain location=1-241; Score= -154.9; E_value=0.051; Accession=PF00083.14; Description=Sugar (and other) transporter
MVGAITSGPITDFIGRKGFMITAAVSVSFTIGNAKRGRQKDFVAALQILRGKDADISEEAEEIQIGIGLMVCQQFGGINGICFYTSSIFELAGFSPTIGTITYACLQIVTTGLGAALIDKAGRKPLLLISGSGLVVGCMFAAVAFYLKVHEVGVAAVPALAVMGILIFPVNIKGLAGSVATLVNWFGACLCSYTFNFFMSWSSYGNNSRRLKFGNVQPVNSFVYGLQKPRGKAWNNYKQTLTHRKQEFCNLQNSVRWKKKKKKPTALTAVS

SEQ ID NO: 232618 - protein, 451 aa, Glycine max
  Coding DNA Sequence Number=SeqID_115840
  Gene Ontology: Mol. function=sugar porter activity; Cellular component=integral to membrane; Biological process=carbohydrate transport
  Homolog annotation: Hit_ID=Q9LEG2; Match level="QueryCoverage=99%, HitCoverage=99%, E-value=1e-166, Identity=61%"; Hit description =Putative sugar transporter
  Pfam annotation: Domain name=MFS_1; Domain location=36-409; Score =48.8; E_value=1.8e-11; Accession=PF07690.6; Description=Major Facilitator Superfamily
  Pfam annotation: Domain name=Sugar_tr; Domain location=39-449; Score =301.1; E_value=2.1e-87; Accession=PF00083.14; Description=Sugar (and other) transporter
  Pfam module annotation: Pfam domain module=MFS_1::Sugar_tr; Domain location=36-409::39-449
MAIKEDVEDRTQKGIREPLVVGEQNHHANKGHPWMVYFSTFIAVCGSYEFGACAGYSSPTQDAIRKDLSLSLAEYSLFGSILTFGAMVGAITSGPLADFIGRKGAMRVSSAFCVAGWLVIYFSEGPVPLDIGRLATGYGMGVFSYVVPVFVAEIAPKELRGALTTLNQFMIVTAVSVSFIIGNVLSWRALAIIGLVPTAVLLLGLFFIPESPRWLAKRGHKKDFVAALQILRGKDADISEEAEEIQIGIGLMVCQQFGGINGICFYASSIFEQAGFSPTIGTITYACLQIVITGLGAAFIDKAGRKPLLLASPKHKTLSGSGLVAGCIFAAVAFYLKVHEVGVEAVPALAVTGILVYIGSFSIGMGAIPWVVMSEIFPVNVKGLAGSVATLTNWFGAWLCSYTFNFLMSWSSYGTFILYAAINALAILFIIVAVPETKGKSLEQLQADINS

SEQ ID NO: 232619 - protein, 576 aa, Glycine max
  Coding DNA Sequence Number=SeqID_115841
  Gene Ontology: Mol. function=phosphoglycerate kinase activity; Cellular component=cytoplasm; Biological process=glycolysis
  Homolog annotation: Hit_ID=Q948Q3; Match level="QueryCoverage=97%, HitCoverage=92%, E-value=1e-77, Identity=34%"; Hit description=GH3 -like protein 1
  Pfam annotation: Domain name=GH3; Domain location=6-563; Score=353.4; E_value=3.7e-103; Accession=PF03321.4; Description=GH3 auxin -responsive promoter
MMTDEELLQKLEDLTKNAQHHHLETLRSILLHNGIVHYLQSFKKGSLLHLDPSTFARVVPLSTYEDYVDYINQMAEGKDDPFLSVDPLRCFFYSSGTSSSTMKPKLIPYFDSSLSKAASFIGHRGSVAVRQRLFPPRPEVNKILWFLYADNITTTKCGLKVMAASTYPLQSGNATPQQLAAFSSPLEVILATNVENQMYCHLLCGLRNLDLIDGIATPYAIGLIKAFGFLESKWEQLCDDLDHGFPCNEISEGAMREAVTNTLGGPQPELANRIRLICEGNNWGGIVYRLWPNIRYIRCVTTGSMKQYYQKLKYYAGEVPILGGDYFASECCVGLNLDIMQPPETTRFVMLPTFAYFEFLPFNINEDNDASKEAVDYSSVEVGKMYEVVVTTYRGYYRYRLGDIVRVVGFYNSSPLVEYVMRAPKTPAEIVTEKDLISAVENFQLALRGAMRIEIVEFASFLDQESMPKQLKVFVEVQEESDFLEDKLEESVRVLRSCISSLESGLGAIYKVQKDKGQLRSLRIFIIRPGAFDQLSELAIKNGTSASQYKPPKIIRNHEVVKLLEKLAFVAVSFDG

SEQ ID NO: 232620 - protein, 346 aa, Glycine max
  Coding DNA Sequence Number=SeqID_115842
  Gene Ontology: Mol. function=oxidoreductase activity
  Homolog annotation: Hit_ID=Q7XH72; Match level="QueryCoverage=85%, HitCoverage=54%, E-value=7e-29, Identity=30%"; Hit description =Hydroxyproline-rich glycoprotein family protein, putative, expressed
  Pfam annotation: Domain name=2OG-FeII_Oxy; Domain location=125-221; Score=7.1; E_value=0.024; Accession=PF03171.10; Description=2OG -Fe(II) oxygenase superfamily
MQPNVMNTNICSNHEECEGRSSQIKLTKGFTAKESVKGHMAKICKLTDFVNEIHAAGQNGELSGETFILFNKQMKGNKRELIQLGVPIFGQIKDDTKNNIEPIPALLHDVIDHLIQWKLIPEYKRPNGCIINFFEEEEFSQPFLKPPHLDQPLSTLLLSESTMAFGRILTSENDGNYKGPLMLSLKEGSLLVMRGNSADMARYVMCPSPNRRVSITFFRVRPDSNHCQSPTPTMTTAMTLWHPSISSPFTLPKGPLNGYEAMDMMPQWGLLSAPMVMLTPMRPMAVNTRKLPRGGTGVFLPWKGASRKHTRHLPPRAQKGRLMELPSPVESHMGESTSEPSIAVEG

SEQ ID NO: 232621 - protein, 370 aa, Glycine max
  Coding DNA Sequence Number=SeqID_115843
  Gene Ontology: Mol. function=endonuclease activity
  Homolog annotation: Hit_ID=Q9ZU86; Match level="QueryCoverage=78%, HitCoverage=65%, E-value=2e-89, Identity=59%"; Hit description =Expressed protein
  Pfam annotation: Domain name=Exo_endo_phos; Domain location=80-366; Score=-13.8; E_value=0.09; Accession=PF03372.13; Description =EndonucleaseExonucleasephosphatase family
MKYFIIENLTCRSPVLILLIIWNNGRLMGEGTTAQARVENSIMLKFLNKNLRRLSSHLRWPPRHRSKPTPKPPPPPPKPIRIATFNAAFFSMAPVLPEADGKTTTATTTTSDDNNNIGRPRSILKQSKSPLLGKSSKLRVSINLPDNEISLRQTSFSEHERSKLGSFAEGRIEEGGKERQRRTVVEVLRELNADVLGLQDVKAEEENGMKPLSDLASALGMNYVFAESWAPQYGNAVLSKWPIKRWKLQKIFDHHDYRNVLKATIDVPQEGELHFYCTHLDYLDENWRMKQINAIIQSNDEPHILAGGLNSLDETDYSQDRWTDIVKYYEEMGKPTPKVEVMKHLKSRHYTDAKDFSGECESVVMIAKGQ

SEQ ID NO: 232622 - protein, 426 aa, Glycine max
  Coding DNA Sequence Number=SeqID_115844
  Homolog annotation: Hit_ID=UPI00005869D4; Match level="QueryCoverage =44%, HitCoverage=40%, E-value=4e-13, Identity=27%"; Hit description =PREDICTED: similar to Bsdc1 protein
  Pfam annotation: Domain name=BSD; Domain location=159-224; Score =58.9; E_value=1.6e-14; Accession=PF03909.7; Description=BSD domain
MEQAPKCQTDSSTWQCYWVDFPGNAFHQKRHLSDSPTSDGGAWEFSGLWKTLSAKSESIIDTYRRDLQEFGTGLKKEIEVAHGSLETVGHVIDQFGNTVVKGTSHIKSYLDSDNNNRNNNPGGNEEKKSFNSKRYYNRFDAQVRAIQGDVSTYTEVPEDSDEYTDWKSGFSLEGKSDEIEDFLKESEAMESVFKRVVPSVVDRDTFWCRYYYRVYRLKKAEDVRARLVRRMSREEEELSWDVEDDDDDGDGDENKGKEGDSELHGDGTKKLNVEEMHKSGEEGSKEEKRGDLLQSKGDECVEESKVDKNKEVVEKMGDGSSKKTINEDDERKDSGVDSGKKVIMESKVDDGKDSLVANKHSGNKKEEEDLEWDEIENLSRIDEEKEVRTGSPTKVDLRKRLSAAQEQDEEDDLSWDIEDDDEHAKA

SEQ ID NO: 232623 - protein, 59 aa, Glycine max
  Coding DNA Sequence Number=SeqID_115845
  Gene Ontology: Mol. function=protein serine/threonine kinase activity; Biological process=protein amino acid phosphorylation
  Homolog annotation: Hit_ID=Q9M6N2; Match level="QueryCoverage=98%, HitCoverage=18%, E-value=2e-22, Identity=78%"; Hit description =Abscisic acid-activated protein kinase
VWSCGVTLYVMLVGAYPFEDPNEPKDFRKTIQYSIPDGVQISPECGHLISRIFVFDPAE

SEQ ID NO: 232624 - protein, 336 aa, Glycine max
  Coding DNA Sequence Number=SeqID_115846
MSSFLSNSAIDMSGSDSGISIEQSMMDREVISIGGSLLEDTPCGAFNSEFSFLERVRASRHIGRGTSRPRGRVRPSTTSDESVSVNVILLPFAFRGLRRGSGGGDARASPRLQCSHSTRSSSSTPVVVGCEWTCGSDDFTFLRAASISLPFFFMYRYLFEGQGALLLLVILPYQVKSFDEDLLTLVEKVDKAILELLSASLDEWAILFFPSTSSPSMPWMVGPGSETVPPSASTLILGERGQPASEVGLVVIFAEVIPSAHSSVLAKRKLDDGTGSSNCKKSKTSRKLDNGAEESATTALASTVVMPLFIIVAHLLSVSVATTSTRVVPLLLLQLQ

SEQ ID NO: 232625 - protein, 178 aa, Glycine max
  Coding DNA Sequence Number=SeqID_115847
  Homolog annotation: Hit_ID=Q7XH72; Match level="QueryCoverage=38%, HitCoverage=11%, E-value=7e-11, Identity=49%"; Hit description =Hydroxyproline-rich glycoprotein family protein, putative, expressed
MAAVPASRTDPPPAMVAPPPLLVSDSFAKDAILAWFRGEFAAANAIIDSLCGHLAHLAAASSDYDATFTAIHRRRLNWIPVIQMQKYHSIADVTLELRRVAEKKTETEAAKKSESSFDEEGKLEKQAVENGGNDGGDDDAAPVYDSPDSEITDSGKKVIFVPCCVAKKNNQRIFAYLA

SEQ ID NO: 232626 - protein, 95 aa, Glycine max
  Coding DNA Sequence Number=SeqID_115848
  Gene Ontology: Cellular component=nucleus; Biological process=red or far red light signaling pathway
  Homolog annotation: Hit_ID=Q9ZNU6; Match level="QueryCoverage=77%, HitCoverage=14%, E-value=7e-22, Identity=66%"; Hit description=Light- mediated development protein DET1
MDTTEIVSFYQNSPYELYLLFEQFCDHFHATSRNSMYMNFISSHSNNIHALEQLRSIKDKASSSAQFVKNIFESRFIADKAIAEIEAKCGQKIEE

SEQ ID NO: 232627 - protein, 84 aa, Glycine max
  Coding DNA Sequence Number=SeqID_115849
MVQGFSRTTARRVLMVVCTGDEVGGRSRGADLVAACGAMTMVVEDLICEKIARRVGSGVVRNNSLLIIIQVQTLLNILTSNWDR

SEQ ID NO: 232628 - protein, 104 aa, Glycine max
  Coding DNA Sequence Number=SeqID_115850
  Homolog annotation: Hit_ID=Q9AWW1; Match level="QueryCoverage=82%, HitCoverage=26%, E-value=7e-22, Identity=57%"; Hit description =Esterase/lipase/thioesterase family protein-like
MKKLGSRSFDFRVTEESLMDRLGINIHEACLKIDKECRVFTIHGSSDEIIPVEDAFEFAKIIQNHKLHVIGGANHMFSNHQGELSSVVVNFIEETLHQVKGTAS

SEQ ID NO: 232629 - protein, 201 aa, Glycine max
  Coding DNA Sequence Number=SeqID_115851
  Gene Ontology: Mol. function=hydrolase activity; Biological process =response to stress
  Homolog annotation: Hit_ID=Q9AWW1; Match level="QueryCoverage=88%, HitCoverage=55%, E-value=6e-48, Identity=50%"; Hit description =Esterase/lipase/thioesterase family protein-like
MALPPQNPPVQRHRVIIPNKHGEKLVGTLHESGTRDIVILCHGFRCTKDTNLILNLAVALENAKISSFRFDFSGNGESEGLFQFGNYWTEVDDLHAVAQHFHESNRVISAIVGHSKGGGVVLLYASKYSDIKTVVNLSGRYDMKAGIEEHLGKDYLERIRRDGFIDVKKRRSGKDFRIGLGRVQVPQTARVSHTHSFILDS

SEQ ID NO: 232630 - protein, 78 aa, Glycine max
  Coding DNA Sequence Number=SeqID_115852
MGRSRGKGKKLTISNEEDAISEEEEKVPKQKRRGRPHKLYKEDFDEEEIEEILEEDATSGDNVMNVVSSKEMNGCGFH

SEQ ID NO: 232631 - protein, 104 aa, Glycine max
  Coding DNA Sequence Number=SeqID_115853
MAFENGSKKELEKVGLKISKSFPLTRTTLASMESLSLPVVQEIVLSADMQCEKCQKRLEKTWQLQHQEDLGGATTLLLLPPPGSFTTPVGDPLPGGTLNPILLT

SEQ ID NO: 232632 - protein, 146 aa, Glycine max
  Coding DNA Sequence Number=SeqID_115854
MGNTTSSSNSKVHGQVTRVASTEPSYDPMMGMPVAKFRDEYIGKSKAETRGTLKGQHGTGVYSGNTALDNDETFNSFIRHAKYKIKTVSHIDGEQSNVASSSLPDDEANAKDSRQNDQFSTFIQSAKKKLRATSSMRKNGSFFKRG

SEQ ID NO: 232633 - protein, 152 aa, Glycine max
  Coding DNA Sequence Number=SeqID_115855
MGNKNSSNSKVHHGQIITRVASTESGYDPGMGRPVAKFRDEYIAKPMMAKTPSTSKGQHGTWVYSNNTPLDNDETFTTFIQHAKSKYKTTRTGSHISREKSFVASASTPDDEATASPRDNQNDQFSNFILNAKKKLRTAPSMRKNGSFKISG

SEQ ID NO: 232634 - protein, 92 aa, Glycine max
  Coding DNA Sequence Number=SeqID_115856
  Homolog annotation: Hit_ID=Q1RXP4; Match level="QueryCoverage=49%, HitCoverage=3%, E-value=1e-10, Identity=76%"; Hit description=AAA ATPase
MMYPQNRKLAQPPEETYTVTCLQAYTNAHRINLYLQMTDKLWELALPNIGSIHKRANLSKKLSVLSPEELRDFVSCKIVQESSGEIQYGGER

SEQ ID NO: 232635 - protein, 71 aa, Glycine max
  Coding DNA Sequence Number=SeqID_115857
MWGTIANFKENLNKIALDVHYAAYDDDDEDDVVSPAAVSDRRNSHSSAHSISLPRSPPATNGTSDHPYAPE

SEQ ID NO: 232636 - protein, 573 aa, Glycine max
  Coding DNA Sequence Number=SeqID_115858
  Gene Ontology: Mol. function=protein binding; Cellular component =nucleus; Biological process=ubiquitin cycle
  Homolog annotation: Hit_ID=Q8H3E5; Match level="QueryCoverage=68%, HitCoverage=90%, E-value=1e-169, Identity=72%"; Hit description =Putative zinc finger POZ domain protein
  Pfam annotation: Domain name=BTB; Domain location=228-347; Score =96.7; E_value=6.9e-26; Accession=PF00651.21; Description=BTBPOZ domain
  Pfam annotation: Domain name=LSM; Domain location=440-553; Score =53.1; E_value=9.2e-13; Accession=PF01423.12; Description=LSM domain
  Pfam annotation: Domain name=MATH; Domain location=75-204; Score =62.6; E_value=1.3e-15; Accession=PF00917.16; Description=MATH domain
  Pfam module annotation: Pfam domain module=BTB::LSM::MATH; Domain location=228-347::440-553::75-204
  Subcellular localization annotation: CTP_CleavageSite=59; ConfidenceScore=5.08e-01
MTPESFLFLNIVTIPMYFTTIVAKQPWSGYRMGKILQETAKPSANSTSAYPSAAPGTTSSMSVTETVRGSHQFKITGYSLSKGIGIGKYMASDVFSVGGYNWAIYFYPDGKSVEDNATYVSLFIALASEGTDVRALFELTLLDQSGKERHKVHSHFERTLESGPYTLKYRGSMWGYKRFFKRTALETSDYLKDDCLSVNCSVGVVRSRTEGPKIYTIAIPPSSIGQKFGHLLESGKGSDVNFEVNDDIFAAHKLVLAARSPVFRAQLFGPMKDQNTQCIKVEDMEAPVFKALLHFIYWDSLPDMQELTGLDSKWASTLMAQHLLAAADRHGLERLRLMCEASLCEDVAINTVATTLALAEQHHCFQLKAVCLKFIATSQNLRAVMQTDGFEYLKESCPSVLTELLEYVARFTEHSDIMCNHRNDALLDGSDINGRRLFFSYFKDLVGREVIVELKNDLAIKGTLHSVDQYLNIKLENTSVVNQEKYPHMDLTEAANAHLSYFFYVEYGEIEMVKLISRRLLEIGKYDGILEFIYLLSVRNCFIRGSVVRYVQLPPEGVDIELLHDATRREARG

SEQ ID NO: 232637 - protein, 115 aa, Glycine max
  Coding DNA Sequence Number=SeqID_115859
MALPAQTSEVDAWEAVLRQTKVAVDTNADPNAWALGVTSTLRSSAVTLPSVELAYRLVSFFFWDNHCATAWKLLHTAMSLNLLPSSLLMALLSATCRMGEIRTVTSRFCSIRLHT

SEQ ID NO: 232638 - protein, 83 aa, Glycine max
  Coding DNA Sequence Number=SeqID_115860
  Homolog annotation: Hit_ID=Q15KI9; Match level="QueryCoverage=78%, HitCoverage=3%, E-value=1e-13, Identity=56%"; Hit description =Chloroplast Phyllo
TEFPSSYWFSVGLITWHRYLCIAPGSRPSPVAVAAASHKLITCISCFDERSLAYHAVGYERGSHIPAVAITSSGTAVSNLLPA

SEQ ID NO: 232639 - protein, 145 aa, Glycine max
  Coding DNA Sequence Number=SeqID_115861
VVQGEQGRAHPLWIFACKGLYKVEKKAQGPQVAWGLNVGSGCCRTSHLIQHKPALEPISDFVELKEINEEAEDDKEEETLIKEEEKEKEKKLKNEKQKEKVVVDEMRRGKSEANIEKKKDTTSNEGKEVPYPLVPSRKEKERHLA

SEQ ID NO: 232640 - protein, 136 aa, Glycine max
  Coding DNA Sequence Number=SeqID_115862
  Homolog annotation: Hit_ID=Q6UUF7; Match level="QueryCoverage=48%, HitCoverage=34%, E-value=1e-13, Identity=53%"; Hit description =Putative defective chloroplasts and leaves (DCL) protein
MAARHFLLHRLRLRSFQGFTVAAPKGHRLWCSATSAPEEAASNAEVDDPEWRKKEEKIVRDVEPIVSLTMQILYSSRYMNGEILTMEDERAVVENILIYHPDYEDKIGSGLNSIMVLSEILDTNEGNYSNNLDKKV

SEQ ID NO: 232641 - protein, 329 aa, Glycine max
  Coding DNA Sequence Number=SeqID_115863
MTLLLGLTDTRAVEMVKEENQFGTTPFYSLKKWNPNIRTGNRLIWAWCWGIPIAAWDIANIRKIVSAIGDLVDIDDDAEERRRLDRTRVLIRTPWRPTIQHLVNLPIGGEMHQVHIVEKTSKDIRRCTCDGRSCLGSSEEISSFDDDDDWLIWGPANGLDIDNASAWINGDPSVGGKTLGNAPLTGVIVPNGTNTAVGPVGINPGTRKSPKINLSEVSGVEAQKGTMLEACPVLVTGGSCNKEERIRAGREPRDQNMEEQPMTGDLHPSGNVDSTRCQHQNRDDESNGSQLAVLNDPSGTRRDFQSSTSCNAPHHQKLHPASVPAQLKS

SEQ ID NO: 232642 - protein, 510 aa, Glycine max
  Coding DNA Sequence Number=SeqID_115864
  Gene Ontology: Mol. function=transcription factor activity; Cellular component=nucleus; Biological process=regulation of transcription, DNA-dependent
  Homolog annotation: Hit_ID=Q9FR97; Match level="QueryCoverage=98%, HitCoverage=93%, E-value=2e-76, Identity=36%"; Hit description=MYB65
  Pfam annotation: Domain name=Myb_DNA-bind_2; Domain location=37-90; Score=-5.3; E_value=0.039; Accession=PF08914.1; Description=Rap1 Myb domain
  Pfam annotation: Domain name=Myb_DNA-binding; Domain location=35-82; Score=52.2; E_value=1.7e-12; Accession=PF00249.21; Description=Myb -like DNA-binding domain
  Pfam annotation: Domain name=Myb_DNA-binding; Domain location=88-133; Score=45.5; E_value=1.9e-10; Accession=PF00249.21; Description=Myb -like DNA-binding domain
  Pfam module annotation: Pfam domain module=Myb_DNA-bind_2::Myb_DNA -binding::Myb_DNA-binding; Domain location=37-90::35-82::88-133
MSQMTNEVDNNVHYDDQTGSQLNDDGNGVGVVLKKGPWTAAEDALLVNYVQKHGEGNWNAVQNYSGLSRCGKSCRLRWANHLRPNLKKGAFTAEEERMIAELHAKMGNKWARMAAHLPGRTDNEIKNYWNTRMKRRRRAGLPLYPPEVLLQAFQERKHGQGTGEISDGDGGHRDFLKKNNYEIHDAIFDSLKENQGILPFLPDLPAISANSFLPNGLGSPPYCNLLPSTLPNHDHLQESTMSFIGSSELNSNRFYPFDHIKDNTSDKISESFGLYSPLDRGVSHGSICYSHSLSNGNSSTSKPTSEAVKSELPSLQIPETEFGSWGTSPPPPLNESLDVFIHSPQPPNALDSGSSSPLNSGLLDALLYQANTLGCSKNNSSDKSSNSSIATPGDRAECSALNMYETEWEDYADPLSPFGATSILNEHPVVSTNGNSWDEWELFQTFSGNNERLQSIDQVWTPKSENQSMSLLNFTLPDVLITSDWHELYSDHDSTNQAIMTEASDDISGQ

SEQ ID NO: 232643 - protein, 112 aa, Glycine max
  Coding DNA Sequence Number=SeqID_115865
  Gene Ontology: Mol. function=metal ion binding; Cellular component =integral to membrane
  Homolog annotation: Hit_ID=Q9M2V1; Match level="QueryCoverage=67%, HitCoverage=18%, E-value=3e-28, Identity=80%"; Hit description=RING finger-like protein
MGDASSAVAYFEESVQFLSKLPKDDLEITHTLSVSLNKIGDLKYYDEDLQAARSYYFKSLNVRRDVVKHNSNVPSQQIMAIQTNLEQTDCIEGREWEERIRGKETRMCSHTE

SEQ ID NO: 232644 - protein, 67 aa, Glycine max
  Coding DNA Sequence Number=SeqID_115866
MTNFMGTTKKVIHFATLFLALRGAVVVNGGEAKGNKKKNLIVVVENHLQQQQTMAEGIGGGGVARWD

SEQ ID NO: 232645 - protein, 273 aa, Glycine max
  Coding DNA Sequence Number=SeqID_115867
  Gene Ontology: Mol. function=nucleic acid binding
  Homolog annotation: Hit_ID=Q69MN8; Match level="QueryCoverage=76%, HitCoverage=74%, E-value=1e-51, Identity=54%"; Hit description =Putative MADP-1 protein
  Pfam annotation: Domain name=RRM_1; Domain location=65-136; Score =82.6; E_value=1.3e-21; Accession=PF00076.12; Description=RNA recognition motif. (a.k.a. RRM, R
  Pfam annotation: Domain name=zf-CCHC; Domain location=158-175; Score =26.0; E_value=5e-05; Accession=PF00098.13; Description=Zinc knuckle
  Pfam module annotation: Pfam domain module=RRM_1::zf-CCHC; Domain location=65-136::158-175
  Subcellular localization annotation: CTP_CleavageSite=91; ConfidenceScore=5.09e-01
MSKSKAKKKNSDSDEDDDVFYYRYSSVNPTQTQTQTQTLQHNPNPKSNNNKGSSSSSLAPSKSTLYVSNIDYSLTNSDLHTLFSTFGRVARVTVLKDRHTRLSRGVAFVQFVSRHDAHDAAAQMDGKVLNGRTLAASIAADNGRAPEFIRKRVYRDTDRCFECGEQGHLSYDCPRNQLGPRQRPEPKRPRRGPHPHPHRHRHNDNDDAGGDDDDYDGGAERFEDDNWASVVDDGAGERLLAGNQHDGDGVVAGKSKKKKNKGGYFSDESDDDE

SEQ ID NO: 232646 - protein, 130 aa, Glycine max
  Coding DNA Sequence Number=SeqID_115868
  Gene Ontology: Mol. function=histone-lysine N-methyltransferase activity; Cellular component=nucleus; Biological process=chromatin modification
  Homolog annotation: Hit_ID=Q1SJT8; Match level="QueryCoverage=74%, HitCoverage=14%, E-value=5e-23, Identity=57%"; Hit description=SRA -YDG; SET-related region; Pre-SET; Histone H3-K9 methyltransferase
  Pfam annotation: Domain name=YDG_SRA; Domain location=2-91; Score= -42.7; E_value=0.0084; Accession=PF02182.8; Description=YDGSRA domain
MAWPNLFEAFRKVYQHRDDLTSYSVTINTLYGSSRKHNEVRVIRGMRDGVNPNNKIYVYDGLYKIQDSWIEKAKGGGGGVFKYKLVRMAGQSSAFAVWKSIQKWKSGTPSRTFPMEMRVFLYHLSVRSIM

SEQ ID NO: 232647 - protein, 102 aa, Glycine max
  Coding DNA Sequence Number=SeqID_115869
MATKCPRKSSEEDREIKSCQNSYRSLQIGLDTLSCTMKRPKNAISKHEKVCNIDTPIINHIKASHPYPLQNNTCMLTCGGFQSIQSRNPGQVETILSTCAVG

SEQ ID NO: 232648 - protein, 107 aa, Glycine max
  Coding DNA Sequence Number=SeqID_115870
  Gene Ontology: Cellular component=integral to membrane
  Homolog annotation: Hit_ID=Q7X990; Match level="QueryCoverage=75%, HitCoverage=33%, E-value=9e-28, Identity=71%"; Hit description =Putative Mannose-P-dolichol utilization defect 1 protein homolog
  Pfam annotation: Domain name=PQ-loop; Domain location=51-104; Score =24.6; E_value=5.2e-05; Accession=PF04193.5; Description=PQ loop repeat
MDPGIAVSYLLAEELDFILAINSIIEYCAVAPTILAGQIDPLLFEALYASQHAIFLFARIPQIWQNFSNKSTGELSFITSFMNFGGSMVRVFTTIQESAPKSGRLAS

SEQ ID NO: 232649 - protein, 177 aa, Glycine max
  Coding DNA Sequence Number=SeqID_115871
  Subcellular localization annotation: CTP_CleavageSite=55; ConfidenceScore=5.06e-01
MMQSDSSSRRSVKRGDIVWVRVHFPHKWHPALVLSSRDNLGVQVTFSFSPNDAVSVSPATTYFVESEVVPFEEAFPSLITRRNVDAPPLHSALRLLGQRVLSGLRCHCLTGRAQAQQQSAREFDPVGVLGFVLDAAVSPWVESPRFAHAVRVVAQVHAFRRYSSMQHKKIYKQNKET

SEQ ID NO: 232650 - protein, 261 aa, Glycine max
  Coding DNA Sequence Number=SeqID_115872
MLSVPVVLLPGDDNVKLLLISSLSQTVHKVTQESVALEPKEKCQIISKNGEKNKAIGAIKRLNSTVPVWEGNSAHLFKNKHLIISQNLVHSPALDPLYMVRESLKSARLSLLGFKNRSDQGIVDICFEDFSTMSRTHISVPSNFIIHLRNYIDKRKDNVLGLCWRLPDKETTVIYLNRGKRRRLDNKPASCNDFPQISEVQESERDGDISKHTTPRISDIKMLEPEGSIQKGHEASTCVCETNMNFTEEVQKVDSKRTRPF

SEQ ID NO: 232651 - protein, 52 aa, Glycine max
  Coding DNA Sequence Number=SeqID_115873
  Gene Ontology: Mol. function=transporter activity; Cellular component= integral to membrane; Biological process=transport
  Homolog annotation: Hit_ID=Q2PF04; Match level="QueryCoverage=98%, HitCoverage=13%, E-value=5e-10, Identity=55%"; Hit description =Putative transporter-like protein
MLSGFTLYAAIYIASILNNVIIEQQQRGIANGISMTAMSAFKVIGPAAGGAM

SEQ ID NO: 232652 - protein, 177 aa, Glycine max
  Coding DNA Sequence Number=SeqID_115874
  Gene Ontology: Mol. function=nucleic acid binding; Biological process= DNA integration
  Homolog annotation: Hit_ID=Q1SIY6; Match level="QueryCoverage=76%, HitCoverage=13%, E-value=9e-38, Identity=51%"; Hit description =Integrase, catalytic region; Zinc finger, CCHC-type
MDVDSSFSQIAHLVFDGKSYDLWKVKLKSYMESFDLWDAMEENYEHHKKIKTKKVKVKTCLFASVSQTIFTKIMNVNSPKEIWDYLKKEYEGYEHVRGMQVLNLMREFEVQEMKEFKTIKGYSDRLFDIANKKRLMWEESIVEGALPAKHQNATKYKKNKNFDGTGSSSTSTNAKGN

SEQ ID NO: 232653 - protein, 83 aa, Glycine max
  Coding DNA Sequence Number=SeqID_115875
MDLECFNNALVAKWMWKEGEDLLSNPTTSAWWKEVHNVCSKSGQQHWFWKSSRWKIGNGGFEMEKNSLCLGRGIKKKSYVVYE

SEQ ID NO: 232654 - protein, 39 aa, Glycine max
  Coding DNA Sequence Number=SeqID_115876
MRMKLRCLGLEPTGGLQEAVVQGTQAKNCAIINPKPFEQ

SEQ ID NO: 232655 - protein, 303 aa, Glycine max
  Coding DNA Sequence Number=SeqID_115877
  Gene Ontology: Mol. function=transporter activity; Cellular component= integral to membrane; Biological process=transport
  Homolog annotation: Hit_ID=Q2PF04; Match level="QueryCoverage=76%, HitCoverage=49%, E-value=1e-74, Identity=57%"; Hit description =Putative transporter-like protein
  Pfam annotation: Domain name=MFS_1; Domain location=1-295; Score= -6.2; E_value=0.00061; Accession=PF07690.6; Description=Major Facilitator Superfamily
SAFMLGRCLTSMLWGMIADRYGRKPVVIISVISVVIFNILFGLSTSFWMAVITRLFLGCLNGVMGTIKAFSSEIFREEYQPLGLSTVSAAWGVGLALGPALGGYLAQPVEKYPYLFSKGSFWDRFPYFLPCLVISTFAFSVAIACIWLPETNHNHNPEALEIRSRAPDKDKVVQNNESVFRNWPLMSSIIVYCVFSLHDNAYSEVFSLWAVSPRWLGGLNFTTNSVGNVLVVSAKRKDISKKGYKVKSHHLPHPTTGDHLFPSNDRKIFCVLNASQTSSQSFHSQPIKICSLIINCLKISTHH

SEQ ID NO: 232656 - protein, 153 aa, Glycine max
  Coding DNA Sequence Number=SeqID_115878
  Gene Ontology: Mol. function=phosphotransferase activity, for other substituted phosphate groups; Cellular component=membrane; Biological process=phospholipid biosynthetic process
  Homolog annotation: Hit_ID=Q39810; Match level="QueryCoverage=84%, HitCoverage=32%, E-value=1e-44, Identity=70%"; Hit description =Aminoalcoholphosphotransferase
MTYFILVVMSNCPFDGILDVSNVYKVVKGKNGSMPLALAMLYPFVVLVGGVLVWDYLSPSDIMGKYPHLVVIGTGLTFGYLVGRMILAHLCDEPKGLKTGMCMMLDLVVVPHYKTYENTMMTRAKSSLHSVNFTFIYVYCSFQISQILGVSSP

SEQ ID NO: 232657 - protein, 103 aa, Glycine max
  Coding DNA Sequence Number=SeqID_115879
  Gene Ontology: Mol. function=transporter activity; Cellular component= integral to membrane; Biological process=transport
  Homolog annotation: Hit_ID=Q2PF04; Match level="QueryCoverage=68%, HitCoverage=16%, E-value=1e-15, Identity=53%"; Hit description =Putative transporter-like protein
MTEETNIGEPLLKKQYYENCPGCKVDRAKELEKDVSIRNLVHIWIVVLCGALPVSSLYPFLYFMDAEIAYHFKCQSRLIREKYSFNPDTLAQTCLIFLNPCVS

SEQ ID NO: 232658 - protein, 114 aa, Glycine max
  Coding DNA Sequence Number=SeqID_115880
  Gene Ontology: Mol. function=phosphotransferase activity, for other substituted phosphate groups; Cellular component=membrane; Biological process=phospholipid biosynthetic process
  Homolog annotation: Hit_ID=Q39810; Match level="QueryCoverage=55%, HitCoverage=16%, E-value=6e-27, Identity=89%"; Hit description =Aminoalcoholphosphotransferase
YFTNTLILPVINGPTEGLMIIYICHFFTAIVGAEWWVQQFGKSLPFLNWLPYLGATYPIFNLTLDSACSLDTQWQDALVSSDACLLYELGILVVYSNNINKQGGFHLLVQYDLS

SEQ ID NO: 232659 - protein, 109 aa, Glycine max
  Coding DNA Sequence Number=SeqID_115881
  Homolog annotation: Hit_ID=Q9XIA7; Match level="QueryCoverage=38%, HitCoverage=77%, E-value=6e-11, Identity=69%"; Hit description =Mitochondrial import receptor subunit TOM6 homolog
MFPGMFMRKPDKAAALKQLKSHVVMFQAWVVVIQVTPYVLHFLSTEKEELKLELYLLTLPRQSQSNKRHTVQASASHPANTVENIFINNKQENHHDQRAPPMGLRNLFV

SEQ ID NO: 232660 - protein, 43 aa, Glycine max
  Coding DNA Sequence Number=SeqID_115882
METNLVTPAGSLMPLAGQSYGDSWSSLWLPIDLILEDALDGAQ

SEQ ID NO: 232661 - protein, 76 aa, Glycine max
  Coding DNA Sequence Number=SeqID_115883
LFQADNSTLLLTDFIWNSSSNLMICLHVISVLYIMKSWNVNCIIALVQFELNKSRMIQPKPNLASDVALSLCLCLV

SEQ ID NO: 232662 - protein, 120 aa, Glycine max
  Coding DNA Sequence Number=SeqID_115884
MGKFPCVFLNTNDYISYQWVLRIMKSIDEVLQLSQVYSQKLLAASLDDEGLLDHTAENKPRWLSRSHDMNIDGPDSFTEKKTEQAEGFQKKNTAIAIEIIAEFLQQKMTSRILSLVHWNM

SEQ ID NO: 232663 - protein, 160 aa, Glycine max
  Coding DNA Sequence Number=SeqID_115885
MVKTLHVVNGTMWHNTFLGLWVAALRLVQRVGIILTEKERDLKEGPIPRLDTCMCMLLSITTLVVTNIIEEEEGQLIEEPEHSPTNQGKNKLALGKCHGELITSLQLLGDYESLLTPPQLVLVEANQAAAKAIVFLSGNPVGSGCFKYMSTNDMPMKCCE

SEQ ID NO: 232664 - protein, 192 aa, Glycine max
  Coding DNA Sequence Number=SeqID_115886
  Gene Ontology: Mol. function=oxidoreductase activity; Cellular component=proton-transporting two-sector ATPase complex; Biological process=response to gibberellin stimulus
  Homolog annotation: Hit_ID=Q9C936; Match level="QueryCoverage=94%, HitCoverage=59%, E-value=1e-72, Identity=69%"; Hit description =Putative oxidoreductase; 38288-39393
  Pfam annotation: Domain name=2OG-FeII_Oxy; Domain location=46-141; Score=60.8; E_value=4.5e-15; Accession=PF03171.10; Description=2OG -Fe(II) oxygenase superfamily
METQVLGIKTIQSFSEQLSELDQIIRKMILESLGVEKYLEEHMNSTNYLLGVMKYKGPQTSDTKVGLTTHSDKNIVTILYQNEVEGLEVMTKDGKWISYRPSPDSFVVMIACSNRRLHSPFHRVMMSGNEARYSAGLFSIPKGGNIIKAPEELVDEEHPLLFKPFDHVEFLKYYYTEKGQRDQFALRTYCGV

SEQ ID NO: 232665 - protein, 340 aa, Glycine max
  Coding DNA Sequence Number=SeqID_115887
  Homolog annotation: Hit_ID=Q10G00; Match level="QueryCoverage=39%, HitCoverage=16%, E-value=2e-17, Identity=42%"; Hit description =Expressed protein
  Pfam annotation: Domain name=Bromodomain; Domain location=65-137; Score=14.8; E_value=9e-05; Accession=PF00439.15; Description =Bromodomain
MALRSSKGTFSKISINCVCVKGRKVESKGLHSVPVSGALVILQSGIPLPDKRTLELILDKLQKYVSFPVLKFFFGKDAYGVFADPVDPEELPDYHDVIKHPMDFATVRKKLGNESSYTTLEQFEQGQKTRASVAGVTSINLAEYVPAAVDKETEIVLSLSLLKLEALQEYLDAVHRSTIAKKASSKDEGSDGRSSNRSEDFENRYTSDVDSLDNDAAIKSEVNEEDSCVRHSLSYETLAFGNYAGGSPYSGSTINGKHECWIYYSSQKSDYGGAHVENYNTCDQVEHQNSKHRILSWRKRKLHFRSSKILGKASGGGVIPVSAVLADKDVMLCIQPGQHG

SEQ ID NO: 232666 - protein, 173 aa, Glycine max
  Coding DNA Sequence Number=SeqID_115888
MIREAEHSPTNQGKNKLALRKCRAELITSLQLLGDYESLLTPPQLVLVEANQAAAKAIMFLSGNPVGSGCFKYMSTNDMQMKCSGNLRHLIVEACIAKKLLDTSAYLWPGYVNTCSNQIPCSISNHVSGWSSLMEGSQLTPALVNVLVATPASRYCTVFFCNSKGQLNTTFCY

SEQ ID NO: 232667 - protein, 757 aa, Glycine max
  Coding DNA Sequence Number=SeqID_115889
MDFDGSLAEIEKIYEIAINGSDEEKISAATILCGASLEHTVLFITKLLSPIDPPNYSGAESHLTSQAPFLNVLLIGISSMDCVHIFSLHGLVPLLAPGLMLICEVFGSCVPDSSWTLASGEKLTHWEVFCNAFTLLLRFWRFDHLPIEQVRSDATTPPFGSLPSPECLLLVRNCKLASFGRTEKDQQRLKRWPKILCFSVEPVFMDSFPKLNFWYRKHQECIASFRSGLVPGRPVNQIVDALLSMMFKKVSNGVKPSTPTTSGSSNSSGNALDDALMKLKVPAWDILEAIPFVLDSALTSCAYGKTSTRELATGLKDLADFLPASLVTIASYFSAEVTRGIWKPSFMNGTDWPSPAANLAHIEQQIKKILAATGVNVPSLDIDGDSPATLPFPLAAFVSLTLTYKLDKATEPFLALIAPAMNAVASGCPWPSLPIVTSLWIQKVKRWSNYFVLSASSTVFHHNKDAIAQLLKSCFTSTLGLGYGSIYNNGGVSALLGDGSVSRISNGISPVAPGILYIRVYRSIGDITLLIKEIVPILMLSVTDIASSDLMPKGVVRKPKKTKFGVKYGQVSLARSMARVKHAALLGASLVWISGGQKLIQYLMRETLPSWFLSATMFEQDGGESGVMVAKLKGYALAFFVFLSAAFAWGIDNSYSPKQRAEVVGLHLKFLASTLNRNGAMFSRCTTWKAYVSGLVSLMVGQAPSWVREVDADLLKRLSWGLSQMDEHKLALRLLEIGGIGVMGAAAEMIIGFEHRS

SEQ ID NO: 232668 - protein, 500 aa, Glycine max
  Coding DNA Sequence Number=SeqID_115890
  Gene Ontology: Mol. function=hydrolase activity, hydrolyzing O -glycosyl compounds; Cellular component=cell surface; Biological process=carbohydrate metabolic process
  Homolog annotation: Hit_ID=Q105A1; Match level="QueryCoverage=92%, HitCoverage=58%, E-value=0.0, Identity=75%"; Hit description =Isoamylase isoform 2
  Pfam annotation: Domain name=Alpha-amylase; Domain location=8-378; Score=-73.9; E_value=0.0024; Accession=PF00128.14; Description=Alpha amylase, catalytic domain
MEKLVVYRLNVKRFTQHESSQLPSGLAGTFTGLAKKVQHFKDLGVNAILLEPVFTFDEKKGPYFPSHFFSLMHIYGPSGGPVSAIASMKEMVKTMHANGIEVLVEVVFSNTAEIGALQGIDDSTYYYANGVGGLKGQSALNCNYPIVQSLILDSLRHWVTEFHIDGFSFLNASHLLRGFHGEYLTRPPLVEAIAFDPVLSKTKIIADCWDPHGMVAKEIRFPHWMRWAEINTNFCNDVRNFLRGENLLSNLATRLCGSGDIFSGGRGPAFSFNYIARNFGVSLVDLVSFSSTDELSWNCGEEGPTNNTAILERRLKQIRNFLFILFVSLGVPVLNMGDECGQSSGGFTAYDGIKPFSWSSLKTGFEENIEWYGSDGAPPRWEDLSCKFLAMALKAEEKEFLESSVSSDISGDLFIAFNAAGHPETAVLPLPPEGMLWYRLVDTALPFPGFFSASGEVVPEQTAAMRSPPPQSPFLTDFHQVQGALEMVFLMLTPPVKIVD

SEQ ID NO: 232669 - protein, 339 aa, Glycine max
  Coding DNA Sequence Number=SeqID_115891
  Gene Ontology: Mol. function=hydrolase activity, hydrolyzing O -glycosyl compounds; Biological process=carbohydrate metabolic process
  Homolog annotation: Hit_ID=Q105A1; Match level="QueryCoverage=98%, HitCoverage=37%, E-value=1e-77, Identity=51%"; Hit description =Isoamylase isoform 2
  Pfam annotation: Domain name=Isoamylase_N; Domain location=222-315; Score=50.6; E_value=5.2e-12; Accession=PF02922.8; Description =Isoamylase N-terminal domain
  Subcellular localization annotation: CTP_CleavageSite=59; ConfidenceScore=5.38e-01
MTSLAPRFSFSVIPGSHHSKPKFSCFHEPFIQRKHLWPKLGLQNPISPFSRNPTSSKLCATSRLSIEETEQQLGTLSRPEYLKGSSAYLFRTETGGGLVKVYVTKRKDRYFVYTEISSLDISGSVGETLLLCWGVYRSDSSCFVDLDTIGLRENAATGMNVSPLVQNSDGNFAVELEFDAKHVPLYLSFFLMSSLDAGMEIRSHRGTNFCVPVGLLPGYPGPLGLFCSPDGSVNFAIFSRRAESVVLCLYDENDMEKPALELDLDPYVNRTGDIWHVAFESAKGFMSYGYSCRGGVLKRNKDDGFAEHVVLDPYAKIVGNSYPDGVGFVKNLGWVGEGT

SEQ ID NO: 232670 - protein, 73 aa, Glycine max
  Coding DNA Sequence Number=SeqID_115892
MAVSDTGGEGTRGVRASVVVWVSRESRGAGEERERGAALRGRDTWRLFEGFEKATRGRWRFYGDGDFTRVLGG

SEQ ID NO: 232671 - protein, 350 aa, Glycine max
  Coding DNA Sequence Number=SeqID_115893
  Homolog annotation: Hit_ID=Q9SFV5; Match level="QueryCoverage=41%, HitCoverage=16%, E-value=2e-22, Identity=40%"; Hit description =Putative RNA-binding protein
  Pfam annotation: Domain name=DUF1675; Domain location=6-343; Score =17.8; E_value=2.4e-08; Accession=PF07897.2; Description=Protein of unknown function (DUF1675)
MVEVEEIELDLALSIGGSFGKYTVEKPAPDSEARVSNSDSRDGMRVVMEPREKREIQAFRRMEARKKRERLREPSEPESQLRDFKREKTECGNGVSGSWTAATTTPYRMHQFATVQYLPLNNGFPLPCWVGGEKNVGGVDGVDGINGGGDRKAKSNGSSRCSSSVVSDYQSSSREEGGSTDSHSHSVHSLAEPAQLNTSKEISIGTSQPEESASASSHPIRPKQGNTTIQEIKKHIAKETRPKPNPNSPEPIENKPLSNENLTKVEIMGKPPKPLSHTSYSLPPMPYVSTKGDNGRTVNGFLYRYTKSEVSIICVCHGSTFSPAEFVQHAGGTDTTHPLRQITVIPSVFG

SEQ ID NO: 232672 - protein, 231 aa, Glycine max
  Coding DNA Sequence Number=SeqID_115894
  Gene Ontology: Mol. function=oxidoreductase activity; Cellular component=mitochondrial respiratory chain; Biological process =electron transport
  Homolog annotation: Hit_ID=Q39640; Match level="QueryCoverage=46%, HitCoverage=31%, E-value=2e-40, Identity=79%"; Hit description =Glycolate oxidase
  Pfam annotation: Domain name=FMN_dh; Domain location=13-227; Score= -99.5; E_value=1.7e-08; Accession=PF01070.8; Description=FMN -dependent dehydrogenase
MGGAGLGLGRVAMVLAKEDGSGEKEGDHEEATDRGDDSLLVTQCVGLGVEPVQNFRFKCVAILSHKGDCYFVEGVVGDQGDVHHGIFRWSSKSVRGFIAERARFKAIALTVDTLRLGRKEADIKNRHNSPLKPYLGKMDKADDSGLASYVVGQIDCTLRWKDVKWLQTITKLPILVKGVLTAEDTRIAVQSGATGIIVSNHGARHLFMCWDNSIAYWRKFVAEYYSPRAKK

SEQ ID NO: 232673 - protein, 628 aa, Glycine max
  Coding DNA Sequence Number=SeqID_115895
  Gene Ontology: Mol. function=amylo-alpha-1,6-glucosidase activity; Cellular component=membrane; Biological process=carbohydrate metabolic process
  Homolog annotation: Hit_ID=Q5JLH8; Match level="QueryCoverage=99%, HitCoverage=88%, E-value=0.0, Identity=60%"; Hit description =Putative ERD4 protein
  Pfam annotation: Domain name=DUF221; Domain location=284-628; Score =370.7; E_value=2.3e-108; Accession=PF02714.6; Description=Domain of unknown function DUF221
MATIGDICVSASINLLSALAFLFAFGILRLQPFNDRVYFPKWYLKGIRGSPTGSNRVKKFVNLDFGTYIRFLNWMPAALHMPEPELIDHAGLDSAVYIRIYLLGVKIFAPITLLAFMVLVPVNWFGKTLQARGPKDLTFSSIDKISISNIPFGSDRFWVHIVMSYVFSSWTCYSLYKEYKVIAEMRLRFLAAERRRPDQFTVLVRNVPPDPDESVVYNANKLACIAAEKKKLINWHVYYQNKYERNPSKRPTTRTGFLGFLGNKVDAIDHYTAIIDNLSKQEAEERESIINNPNAVIPAAFVSFKTRWAAAVCAQTQQTSNPTIWLTEWAPEPRDVFWENLAIPYFDLNMRRLLMAVALFFLTFFFMIPIALVQSLANIEAIEKVLPFLKPIIEKPSIKSVIQGFLPGLALKIFLIMLPKILMTMSKMEGITSLSGLDRRFTKTVGSTIPMKATFFITYIMIDGWAGIAAEILRLAPLITFHVKNTFLVKTEQDRQNAMDPGSLEFATSEPRIQLYFMLGHVYAPVTPFLLPFIVVFFAFAYMIFRHQIINVYNQQYESGGSFWPDIHGRVISGLIISQILLMGLLSTRGTDKSTLVLIAQPILTLWFHRYCKGRFESAFVKFPLEVG

SEQ ID NO: 232674 - protein, 116 aa, Glycine max
  Coding DNA Sequence Number=SeqID_115896
MYFILFNFLVAKYPMKSYHGSSVQDAMKNFFLKDNDVDIPNNISEACDGKTDDADYVEPSFAVGKSPKNVNVASNDLWLWSNVSSSPCRQVYLVLTLLKSCTLAGRAVRLRRSKVL

SEQ ID NO: 232675 - protein, 795 aa, Glycine max
  Coding DNA Sequence Number=SeqID_115897
  Homolog annotation: Hit_ID=Q1S7H5; Match level="QueryCoverage=98%, HitCoverage=59%, E-value=0.0, Identity=52%"; Hit description=PWWP; Regulation of nuclear pre-mRNA protein
MEDWRVEGKRIKAFCNHADVEAFTEEKKQSLAKRSGRGGEFACAVKEIIECYEKLRTENQDGDTSSGGEVAIANVSYSLDPSANTGLKDQTDAPFTINSQMKSSNCVIDRPEDAVALKDESYNIEASLEEATDNAIMTATVKSPFSITQRNAPVRRSRTRSTLQVQNFVVPCGDGGNNVGNSDDNISADAIQDTSIRSKRIRKSPDLLRCDDTDSPAFAPNVSMEDNGSEIITINSDAFTLNEGSTIDSNLKFEQSEPIVCPEGEGLDLEIKAVINKNKRKPNQKKETNDSGAQNASQSLQNMGGNSKERCPDQDGDEHLPLVKRARVRMGKSSTEAELNSISQVQVKSGEEDITDSPHQIITCSNCENGLAEGGPSVLNSTLVNVSPSNLIASYSENGSQICKIKKDQMFGCSVDDEAALPPSKRIHRALEAMSANAAEEGQACMESSSSIMTFSGRCCISAIKRCPCMTVNNQGVNELELQSFSTRSNTIISTENELSTEVDKHLVKFQHESGKDVIPGASQQGGEDISDSVVCHPAKIDSLIQSHGKISPNLDVKCCQVGNNKDSPGPSLLLNDDDNARTSNHSDASDTVEHVGISLDPVAGNSESDKLVPKNSINVTQNVVVACEDMMKHAVGDSSKPNDTHEVIKEVKFKGQEEDMNSVSISNDYSDEKGNLGILSSPSLTDVRVCLPLGSPPITSVCNISTSDSSNILQNGSCSPDVHQKNTLSGPTDGWKDGIVENEQSRSEGKSTEAGDAALLYFEATLRTLKRTKESIGRATRIAIDCAKFGIATK

SEQ ID NO: 232676 - protein, 208 aa, Glycine max
  Coding DNA Sequence Number=SeqID_115898
  Homolog annotation: Hit_ID=Q9FEV2; Match level="QueryCoverage=27%, HitCoverage=34%, E-value=5e-18, Identity=70%"; Hit description =Putative phospholipid hydroperoxide glutathione peroxidase
MPLFTVGGVHSWSRYDRAWAYYTKSNKVGDRGSGNPFSSGHLSPVKEIFNVLSLRGETIRERLDLNPEKVRVNGPDTAPVYKFLKANKSGFLGSRIKWNFTKFLVDKEGNVLRRYGSTTSPFSIEVQSLSISLHGAYVRLCSFHLDFDVSALNNAKSCHLRLRFQDTNGARQSHIALQGYATISCVNVCGYCYVTRGLNDIKRALGEA

SEQ ID NO: 232677 - protein, 494 aa, Glycine max
  Coding DNA Sequence Number=SeqID_115899
  Homolog annotation: Hit_ID=Q1S7H5; Match level="QueryCoverage=94%, HitCoverage=35%, E-value=1e-139, Identity=53%"; Hit description =PWWP; Regulation of nuclear pre-mRNA protein
  Pfam annotation: Domain name=Extensin_2; Domain location=179-469; Score=-120.6; E_value=0.013; Accession=PF04554.4; Description =Extensin-like region
VMEIVVHNLEIESSLHRRVDLFFLVDSIAQCSRGLKGDIGGVYPSTIKAVLPRLLSAAAPPGNAAKENRRQCLKASVHARRSSRRERPFDDPVRDMEGMLDEYGSNSSFQLPGFCMPRMLEDDGGSDSDEGEFEAVTPEHDSETYEVQETTHAIEKHRHVLEDVDGELEMEDVAPSVDGELNLICNIDRGNATEFEKNLPVSFGPPLPQDLPPSSPPPPSSPPPPPPAPPPPSLPLPPPPPPTLHFKSATSDQYHVAVDSKGFEDSLTVEANVLHPMAQPLAAPRNSQSIGDAVQYTVPECRDMPIQMPESTCSFNTFPVQPTDNSRNTDGATMHNKGYSIPPPHHVPSNQFSFVNGEHQMKSRREVPPPPSYSNGHHFMPSMMREYGYDSHERSRPPYDYQERWNVPPPCSGPRYSDRGVPAPYGCHPSESVGFPGHGWRFPPPSMNYRDSLPFRPHFEDAIPVANREEVVVVPSFCTCKKESLENAEQEESL

SEQ ID NO: 232678 - protein, 43 aa, Glycine max
  Coding DNA Sequence Number=SeqID_115900
MRKLIKERMENKVVNFVGLNKVKWWLDRNIEMAITEATRLQMR

SEQ ID NO: 232679 - protein, 65 aa, Glycine max
  Coding DNA Sequence Number=SeqID_115901
MQEEIVDKTDVYIDVHRRTRVAAVAAATSVALVPSGRKFTGHKPVEGESSTKNDLHLRRISSKDH

SEQ ID NO: 232680 - protein, 132 aa, Glycine max
  Coding DNA Sequence Number=SeqID_115902
  Homolog annotation: Hit_ID=Q67XQ0; Match level="QueryCoverage=46%, HitCoverage=12%, E-value=5e-10, Identity=74%"; Hit description=MRNA, complete cds, clone: RAFL25-31-I24
MQLLERCSDIPSGIMFCLTLGLMSLGLIDLEILQRFIHREETSCCCYFAGCSETALVACDLVTLQLLCHGECQVRWYQLVSDEPLCWRISRSMKLRDINPKVRQDMIPNGISSASFTKLPGRNSIVPRFWDR

SEQ ID NO: 232681 - protein, 122 aa, Glycine max
  Coding DNA Sequence Number=SeqID_115903
  Gene Ontology: Cellular component=integral to membrane; Biological process=mitochondrion organization and biogenesis
  Homolog annotation: Hit_ID=Q67XQ0; Match level="QueryCoverage=75%, HitCoverage=18%, E-value=1e-39, Identity=89%"; Hit description=MRNA, complete cds, clone: RAFL25-31-I24
MRPDKYKPHKISTNIEPISCAYSLWDNLSPSGIVLDVLLGHNHALFRRAQLKALGSIHSQEAGKGGELTHDEATIISGALDLTEKTAQEAMTPIESTFSLDVASKLDWEAIGKILARGHSRV

SEQ ID NO: 232682 - protein, 479 aa, Glycine max
  Coding DNA Sequence Number=SeqID_115904
MGVKRLKVINQGLHVDNNCPWTKLGEESLRFIGLDRLWMTKVRITMRYLRMLSGPRVTITKLCVGITIRYLRMLPDPQVLIAELCVRITIRYLCMLPDPRVTYLRMLSDPRVMISDGRLFHDLGRKTLTSRGRVQMTTLVFGCQRARFPLVDESLGRKMLTSSGRVQMTTLVSACQRARLPLVDERVQMIPLVSTCQRAHLPLVDERASPRVTGLTGHDSKMCVGLSTKARLLLLRILNCDEELIPTAKKSPTHKILDEDGNSHPGSRFMVSWDFGSRGGKLDDMRGYRMIIHTFHHPEAASPMTCGGANKPVDEQRDLHRLLHLLSSRGDELDHMWGYRMVIRTFHHPEAASPMTCGGDEPDDMQGCCMTIRTFRHAEAASPMTCGGANEPVDAQRLTSSPAPFANQGQTSPLTHRDLHHLLHLLSSRGGKPDDMRGYRMGYRMVIRIFRQPGANKPVDAQRLTSSSAHFVIPRRQAR

SEQ ID NO: 232683 - protein, 99 aa, Glycine max
  Coding DNA Sequence Number=SeqID_115905
MGLWVGFYRGKVMFWFAMVGERSKCWSKGGFDEVKMKKCNGLHATNALAKYCKSKLHDESGLIQRSFDDNKGDDKKLKSQEYFMITKMMISRIKEWVQD

SEQ ID NO: 232684 - protein, 79 aa, Glycine max
  Coding DNA Sequence Number=SeqID_115906
MEGTFYPELVKVFYTCAKDDTKGEQPTTKNIDPMDEEEAQQELAHQWNCFESLMSGSWQESNQQQQTLIRWMKKKLSKS

SEQ ID NO: 232685 - protein, 144 aa, Glycine max
  Coding DNA Sequence Number=SeqID_115907
  Homolog annotation: Hit_ID=Q68Q09; Match level="QueryCoverage=32%, HitCoverage=15%, E-value=7e-07, Identity=46%"; Hit description =Hypothetical protein RP2
MEIFNLIALALTLFLAIVPKMESQIKPIPKTPRPLCASQFALVNYACSRLPFSPGVPPDSPSPDEENNNHHNRSHRHGHRHGHRHRHHQTPDEDNCCRWAKEVDHQCVCELLLRLPPFLIRPSHQYTLKVGASCDITYSCGAPI

SEQ ID NO: 232686 - protein, 109 aa, Glycine max
  Coding DNA Sequence Number=SeqID_115908
MVWGRRWLGRGRGSKGHDNMTIQNRLQFVVNGGMGLGEGGLILGEPRHRFLQSFGGGELHIVVRHGWQVGPLGRWWLQLQILTNYRQSSGEHGQPNQAAVKAQWSTKSL

SEQ ID NO: 232687 - protein, 144 aa, Glycine max
  Coding DNA Sequence Number=SeqID_115909
MLYGHAKRSCVLTAKKIIRYYLRQLPFHSCALRPHCICPYLASSPCIPAPLLFFAFIFTIQMNALSQAVALSTFIFSVELSVELAKGGCALSKYCMVLQPTLRREGDAGLTGASSKKGKCAESPPTFIQEKRQKNRKRCVVYEL

SEQ ID NO: 232688 - protein, 95 aa, Glycine max
  Coding DNA Sequence Number=SeqID_115910
MVRWPGPERLTVVSFYMEGPVLCWYQWMTRNGFLSTWPAMLQALESRFAPSYYDDPHSALFELEQRSLVNNYLMEFERLANRVVNLVLYNSYGST

SEQ ID NO: 232689 - protein, 62 aa, Glycine max
  Coding DNA Sequence Number=SeqID_115911
MRPRRYRIAIVIDFYIVLCSSSGKKEPFQRSAKGVIALSELNALSTHQRLSPAPACLVRIKG

SEQ ID NO: 232690 - protein, 152 aa, Glycine max
  Coding DNA Sequence Number=SeqID_115912
MHACGLITHLCVLFGTLALGNALFPQNLIEQGLNNCIARDSVQGELVPLDLEIETTFRRNNVERKRKLLHDKTVASILEEAHFSESSSSNSHTSRESQTAEFEAEVMAEEQPRRVTLEDYSSTSVPQYFSSVARPEVQAQNLTYPPSLIQLI

SEQ ID NO: 232691 - protein, 87 aa, Glycine max
  Coding DNA Sequence Number=SeqID_115913
MQPRLSGAALMVARVMLWGEYERGMGLGRNREGTTSLVEFAENHGRFGLDEETPQDRPDWVQPCPPGFELGNWQIVERPKISMTNSM

SEQ ID NO: 232692 - protein, 106 aa, Glycine max
  Coding DNA Sequence Number=SeqID_115914
  Gene Ontology: Mol. function=RNA-directed DNA polymerase activity; Cellular component=intracellular; Biological process=RNA-dependent DNA replication
MKLEMSLKIKEEVKKQFNVGFLAVAQYSEWVTNIVPVPKTDGKIKMALEDMENTTFITLWATFCYTVMSFGLKNTGATYQQCRSKLHDDESSMIQVVLMMKKIPKE

SEQ ID NO: 232693 - protein, 40 aa, Glycine max
  Coding DNA Sequence Number=SeqID_115915
MVLLVKGDTGLLRSMLLYGNCCGGGSCSYGHEGCGDNGCG

SEQ ID NO: 232694 - protein, 185 aa, Glycine max
  Coding DNA Sequence Number=SeqID_115916
  Gene Ontology: Mol. function=pepsin A activity; Biological process =proteolysis
  Homolog annotation: Hit_ID=Q8LF70; Match level="QueryCoverage=85%, HitCoverage=36%, E-value=9e-44, Identity=55%"; Hit description=EDGP
PLYINSSILTVDQTGFGGTKISTAEPYTVLETSIYRLFVQRFVNESSAFNLTVTEAVEPFGVCYPAGDLTETRVGPAVPTVDLVMHSEDVFWRIFGGNSMVRVAKGGVDVWCLGFVDGGTRGRTPIVIGGHQLEDNLMQFDLDSNRFGFTSTLLLQDAKCSNLKVGGDKGPTRHEGEAKGPRCAA

SEQ ID NO: 232695 - protein, 67 aa, Glycine max
  Coding DNA Sequence Number=SeqID_115917
MSTSLAGPSDREELPPEPAMDALDLPEDDEDPLPDVDSLEDIMSASEADSTEENGPGGTVNSDDSSS

SEQ ID NO: 232696 - protein, 100 aa, Glycine max
  Coding DNA Sequence Number=SeqID_115918
MEEEFSLQEKNITMKIMCRLEDETIIHLFRDCAQVRWIWQSLGFDINLGFYNQDDNNWFYTQLCDNDGIPLVVCVGSSSRQETHKSLRMWFGLTCIPCLK

SEQ ID NO: 232697 - protein, 90 aa, Glycine max
  Coding DNA Sequence Number=SeqID_115919
MSHSLSSTNVQEQEGMQNPFEFSEDKILDDVYRTHFDCFEKCDVTSLQTVASNVINHSIDISEKVISKIRQMGVDVFAKDTPHLSMCMLM

SEQ ID NO: 232698 - protein, 93 aa, Glycine max
  Coding DNA Sequence Number=SeqID_115920
MSHLLIVRVQRHELSKSFEPKLDSILGKFKEFLERCSKEIVRIEDYTRREKIVIHTGKNIVKVLKALIISRENRDLRQNVFNVLTGEQVATRI

SEQ ID NO: 232699 - protein, 205 aa, Glycine max
  Coding DNA Sequence Number=SeqID_115921
MCENQIEEDCYLFIYGGMDTKWIQEFATAIETLKRDVAKLKLNINTTIESYQLGKDDPKAIPHFWIAIDSLLTRRKQMKKGIDFATSEEIKRLLFLKQDPKGWTILSKGHNVKLLGHGEAMCRTVKDFGMWHGKLHEEVSFDVAFREYYEEIMKDNKDCSKKCLNVISAGYAMDILERIVCPKKDCRRPMEVASVSYKCCHDRKK

SEQ ID NO: 232700 - protein, 97 aa, Glycine max
  Coding DNA Sequence Number=SeqID_115922
MIRPTCFSFSSCEIEIKNPNTPALEEEEGILKKLKSNHAEEDHEEARVSLYTLPVLLALRRRRQDTRRKGVSNPATKSVEGESEPKDKEEKKIDFNL

SEQ ID NO: 232701 - protein, 76 aa, Glycine max
  Coding DNA Sequence Number=SeqID_115923
  Homolog annotation: Hit_ID=Q9AYM4; Match level="QueryCoverage=67%, HitCoverage=6%, E-value=1e-10, Identity=67%"; Hit description=VuP5CS protein
MDSLHRRSPDVTVHDLLQDFKRINYHKAYLAALLRSINFSDLQKPQGELDGKACADVGQSNLMALYDTRFSQGFWL

SEQ ID NO: 232702 - protein, 80 aa, Glycine max
  Coding DNA Sequence Number=SeqID_115924
MDKDTLGYSGQRGSKNQGELEWRTYRCNHQFQGEVREHSQRMFTWISRYHYSYTVEGEGWKISILSVVIFGCINPFGDTV

SEQ ID NO: 232703 - protein, 80 aa, Glycine max
  Coding DNA Sequence Number=SeqID_115925
MSKSLSNTNNVQQGKTNLLQNPFEFSDEQILDNVYRTHFHCVEKCDVTSLHTVASCVINHSIEITDTVITKLFIKYFLIS

SEQ ID NO: 232704 - protein, 97 aa, Glycine max
  Coding DNA Sequence Number=SeqID_115926
MEHGHAYIPIVRFPDPNYVRWQATTAHGGHQWLWVVEEEVLGLGWTFGEKKKVKIMFFHAEERIYNLQISLSEWESTFGVKRDFSRLAQFLSGWDFH

SEQ ID NO: 232705 - protein, 296 aa, Glycine max
  Coding DNA Sequence Number=SeqID_115927
  Gene Ontology: Mol. function=protein tyrosine/serine/threonine phosphatase activity; Cellular component=nucleus; Biological process= protein amino acid dephosphorylation
  Homolog annotation: Hit_ID=Q2R8T5; Match level="QueryCoverage=88%, HitCoverage=38%, E-value=8e-89, Identity=63%"; Hit description=MRNA capping enzyme, C-terminal domain containing protein, expressed
  Pfam annotation: Domain name=mRNA_cap_C; Domain location=154-253; Score=139.2; E_value=1.1e-38; Accession=PF03919.6; Description=mRNA capping enzyme, C-terminal domain
  Pfam annotation: Domain name=mRNA_cap_enzyme; Domain location=1-151; Score=154.5; E_value=2.7e-43; Accession=PF01331.10; Description=mRNA capping enzyme, catalytic domain
  Pfam module annotation: Pfam domain module=mRNA_cap_C::mRNA_cap _enzyme; Domain location=154-253::1-151
MDKSIVFNHNHFKGTPERNHHYTLLDGEMIIDTDPHTHKQERRYLIYDLMAINQVSLTELPFYERWKLLEKEVIEPRNMEREGLSKSINPYYRYDLEPFSVRRKGFWLLSTVSKLLHKFIPQLSHSSDGLVFQGWDDPYVPRTHEGLLKWKYPEMNSVDFLCEVVQVGAGDRPLLFLFERGRKKLMEENVIFKDASDISSYSGKIIECYWDSAEHHWVCMRIRIDKAAPNDINTYRKVMRSIKDNITEEVLLNEINQIIRLPLYADRIQRDIKAHQHMISSRRKYQVHKIILEKAQ

SEQ ID NO: 232706 - protein, 279 aa, Glycine max
  Coding DNA Sequence Number=SeqID_115928
  Gene Ontology: Mol. function=protein tyrosine/serine/threonine phosphatase activity; Cellular component=nucleus; Biological process= protein amino acid dephosphorylation
  Homolog annotation: Hit_ID=Q8GSD7; Match level="QueryCoverage=76%, HitCoverage=32%, E-value=1e-55, Identity=51%"; Hit description=MRNA capping enzyme-like protein
MWAYMEMVVCVKCLTCSAWTSYFVEVLTICCRNCDIHYAGWLDCPPHGQEIGCIIPSKVPLGDSFNDYIPSQKYAPKQAIHQQRVLGRELGLVIDLTNTTRYYPVSDWTKEGIGHVKIRCTGRDAVPDDESVKFFCDKFMSITSTHSFAQCSHLIVKYCLLVSVLSNAGYMIVHFLVRTESLSVTEAINEFACARHPGIYKQDYIDALYMFYNEKKPEDLVCPQTPEWKRISDPDFHGTAVPAVDNSAHIPEQCCHWVEYLTSWHVIYFQQVCPSMNLP

SEQ ID NO: 232707 - protein, 160 aa, Glycine max
  Coding DNA Sequence Number=SeqID_115929
  Gene Ontology: Mol. function=transporter activity; Cellular component= integral to membrane; Biological process=transport
  Homolog annotation: Hit_ID=UPI00005F867C; Match level="QueryCoverage =73%, HitCoverage=27%, E-value=7e-40, Identity=69%"; Hit description =COG0477: Permeases of the major facilitator superfamily
MLQFTLYPLVVALANDLIEPERRVSLAACLLMAFGVGASIGPLAVGALIEPLGGNILYAFFALCGVLLAALSRTAKAEEPQLAQDAPVPHIPLPDSLASSPLSPALNPTFDEQIIHDTMPPPEAAPDVDEPQPEEQETEHLPQGADPQEDTGLKKAHAML

SEQ ID NO: 232708 - protein, 121 aa, Glycine max
  Coding DNA Sequence Number=SeqID_115930
MPMNICTNFHCIALFHMRSASPNFTTKVACVCIPKNHVNYIDSYISWMTEPLDESISFFLIKVDPWVLVPITFRGPYVLAIRGLHILVCRGLHTLAFRGLHVLIFSVLHIHTLREYKVLCP

SEQ ID NO: 232709 - protein, 246 aa, Glycine max
  Coding DNA Sequence Number=SeqID_115931
  Gene Ontology: Mol. function=DNA binding; Cellular component=nucleus; Biological process=regulation of transcription, DNA-dependent
  Homolog annotation: Hit_ID=Q9ARE4; Match level="QueryCoverage=99%, HitCoverage=98%, E-value=3e-53, Identity=46%"; Hit description=ZF-HD homeobox protein
  Pfam annotation: Domain name=ZF-HD_dimer; Domain location=53-112; Score=130.0; E_value=6.4e-36; Accession=PF04770.3; Description=ZF-HD protein dimerisation region
MEFQEHHVEAELGMPAAAASYEEFGMPPNHGQEEPVVAAVPVPPPANTMARNSGKGKYQECLKNHAVGIGGHALDGCAEFLPAGEEGTLDALKCAACNCHRNFHRKETPDGTYLLPFHHRHQPPPPPFAPYYRAPAGYLHMTGPQHATLALPSTSGGGGTQSPREDQGDLSDPPTSGATTHGGSSSKKRFRTKFTQQQKDKMLAFAEKLGWRIQKHDEGVVQEFCSETGVQRHVLKVWMHNHKHTL

SEQ ID NO: 232710 - protein, 176 aa, Glycine max
  Coding DNA Sequence Number=SeqID_115932
MSWIQAMGPLLASPVDHFLQFCDGFGAEKNHSTCCGWWVALTSTIWKHRNFLIFQDKPFEPQKVMEDAMFSIWSWLKARQKGYNISFNHWSSNISKSFERRIKVELCYKPRTTDEQKGSAIWKVQLLPRFSGCNCQENLWHILALLEFYTFVIVMLIPYNYSTISDEPYDSATSTS

SEQ ID NO: 232711 - protein, 179 aa, Glycine max
  Coding DNA Sequence Number=SeqID_115933
MSTTSSTFGRIVKGYQRFVALYFLYPSINGDGVLLQLENDRDISRMCRIGLAHLDKDVYVYFEHIVDDYLNIVGGVPDEVMVNQTKDGVEDIDVDLNKDKEIERITNRIRNQFNDFVIEDAQNGTLAPIRPLAPIKMSFPSGPSPKMSFPSGPSPRMIEPSFMSFIPTLELPRREDMNK

SEQ ID NO: 232712 - protein, 412 aa, Glycine max
  Coding DNA Sequence Number=SeqID_115934
  Gene Ontology: Mol. function=transporter activity; Cellular component= membrane; Biological process=transport
  Homolog annotation: Hit_ID=Q7DFZ6; Match level="QueryCoverage=98%, HitCoverage=47%, E-value=1e-135, Identity=55%"; Hit description =Fimbrial usher protein
  Pfam annotation: Domain name=Usher; Domain location=1-412; Score= -145.1; E_value=5.2e-14; Accession=PF00577.10; Description=Fimbrial Usher protein
MLPDSRRGYAPVVRGVANTNARVEVRQNGYTVYSTVVPPGPFALTDISPSTLSGDLAVTVIEADGSRHSFTLPYSSVPNMLRDGIWEYQVTAGKYHDGTNNYQPQFIQGTVAHGAGSDYTPYGGIIMAEHYRSGVVGLGKNMGEYGAASVDASWSDTDLASGENKRGASVRFLYSKSLNTLGTDVQIAGYRYSTSGFYDFSDAVAERNNWQNGFYHTQYYDQSDDKTGAPDWATQNQRRRYYDSQQYNNKRQRVEMTVNQHIAGASLYATFIRQNYWNTSAYDRTIQTGFNTTWNRVSVGVFYQNSRSNYGYSDNSVNLNVSVPINIFGPDHESTVNFNATNSKQSGSGYSAGMSGTLLDDNRMNYFVQSGHTQHGGDTSLVNLGYLGSMGNVDLGYSYNNNYQQTSLTSPA

SEQ ID NO: 232713 - protein, 97 aa, Glycine max
  Coding DNA Sequence Number=SeqID_115935
  Homolog annotation: Hit_ID=Q1SJY4; Match level="QueryCoverage=88%, HitCoverage=21%, E-value=8e-08, Identity=33%"; Hit description=Zinc finger, CCHC-type
MKEGESLDDMFGRIQVKINLKVLDNFPKVWEPNTSTIQEAKDLKNLEWDKLLGILGIHEVHLQNKDHMQKKDYATLKYGETIFRREETKSLSKALKV

SEQ ID NO: 232714 - protein, 147 aa, Glycine max
  Coding DNA Sequence Number=SeqID_115936
  Gene Ontology: Mol. function=electron carrier activity; Cellular component=membrane; Biological process=electron transport
  Homolog annotation: Hit_ID=Q1SKJ9; Match level="QueryCoverage=99%, HitCoverage=90%, E-value=2e-54, Identity=64%"; Hit description=Blue (Type 1) copper domain
  Pfam annotation: Domain name=Cu_bind_like; Domain location=23-104; Score=78.7; E_value=1.8e-20; Accession=PF02298.8; Description =Plastocyanin-like domain
MGCYRIEGRDPTLHRVGGGRYTWSPKVNFTKWASHEHFYKGDWLYFGFDKRIYNVLEVNKTNYENCIDTGFIENITRGGRDVFQLLEARHYYFICGRGFCSQGMKLLIDVKEPTTTLPPPILPNKALLNRLSNTLMLVVTILAWIFI

SEQ ID NO: 232715 - protein, 105 aa, Glycine max
  Coding DNA Sequence Number=SeqID_115937
MKRAKDEKVEKAKVDKAQATSMIMEVRATSRVRSQIQTETEENLSMKSRSDSPSSCRMSVTTIKFICMTNVSTCPSEFESPSYRSIVSIFHPGGSYASMIFSMKR

SEQ ID NO: 232716 - protein, 86 aa, Glycine max
  Coding DNA Sequence Number=SeqID_115938
  Gene Ontology: Mol. function=protein serine/threonine kinase activity; Cellular component=nucleus; Biological process=protein amino acid phosphorylation
  Homolog annotation: Hit_ID=Q9FFQ3; Match level="QueryCoverage=95%, HitCoverage=17%, E-value=2e-35, Identity=81%"; Hit description=Cdc2 -like protein kinase-like protein
MRQKIIRHHRDKLNHSINQYIVKSLLWQLLNGLNYPHSNWMIHQDLKPSNILVMSEGEEHGVVKMADFGLARIYQAPLKPLCDNGV

SEQ ID NO: 232717 - protein, 106 aa, Glycine max
  Coding DNA Sequence Number=SeqID_115939
MLLDGRIYRNRDRAWHNRRQDGGGGDVVVVLGLLELFYGNGFGGSASGDLVQVSKMRPTSFLCLILLFVVDELLLTNDVVNGTPNCFEEYIVQEIGKRREPRIRAL

SEQ ID NO: 232718 - protein, 49 aa, Glycine max
  Coding DNA Sequence Number=SeqID_115940
MVVDVGQEDDQSSRCRPGKMTDPGLKQKNPRMTPIEDFLIDIVQILSGD

SEQ ID NO: 232719 - protein, 230 aa, Glycine max
  Coding DNA Sequence Number=SeqID_115941
  Subcellular localization annotation: CTP_CleavageSite=83; ConfidenceScore=5.74e-01
MGKRAAAVSATRMYTPPAASPSVKLGSPGMASRTVCVSAGKVSIGLAWQSYCRAGFRRLSANLPFTIPPEISCRISFHEKPFSASSDPVVDCRIHGGLFSPPCFPQCPNGCRRCRATSGVGTQVCAAQRGGLVFACLGAGGTRAYSNAAAFPSLRSRPLATPLRRCTDGSGAAVHLCRQRGMDACRRARPCAGAQALGRVPAQIQDSVSQALCGLAACPGAGGDAGASVP

SEQ ID NO: 232720 - protein, 208 aa, Glycine max
  Coding DNA Sequence Number=SeqID_115942
  Homolog annotation: Hit_ID=Q26UN3; Match level="QueryCoverage=62%, HitCoverage=37%, E-value=3e-12, Identity=30%"; Hit description=Twin -arginine translocation pathway signal precursor
GVKPPLRFQDQANTNRLKARITLYHLADKAGPVHLQAGQPGFGHFRRHGCREPDQQTCYGIRFLAAGGHLQLIPAARLTMHTFSFRSILRTDLAALAFCGVVLVLCALMLPGAQAAPAHASPVVIGKDGWLFTPYEFATEADKVDTEASLSMLQKAHALFAQRGIAMVLVLIPHKIRVYAHHLPDDKPLDAYTAQKYDYAVQTLRAGG

SEQ ID NO: 232721 - protein, 123 aa, Glycine max
  Coding DNA Sequence Number=SeqID_115943
MTKLHGLSESAPLSHKRLIREMNVHPQKMNSLSAVGELSECVEMQKVSKNAQCMNLGEGENASNALRILAKRTAALSEPERPLVSQRAGLSAKKGSLVNSADHKNLQLSLSLTPGQLSEYDAS

SEQ ID NO: 232722 - protein, 123 aa, Glycine max
  Coding DNA Sequence Number=SeqID_115944
MEQQLKRKHSSKSYRFHSYPRKDQAQGIFGDEPSKPKENKGKTIEKSTPKTSSKVRTSNIKCFKCLGKEDSKRIGLELLNKALGDAILLPRALDRRLQEDWVRNARECPRVLMSFRVDFGSKG

SEQ ID NO: 232723 - protein, 296 aa, Glycine max
  Coding DNA Sequence Number=SeqID_115945
  Homolog annotation: Hit_ID=Q1SAK3; Match level="QueryCoverage=61%, HitCoverage=13%, E-value=2e-07, Identity=26%"; Hit description =Integrase, catalytic region; Zinc finger, CCHC-type
  Pfam annotation: Domain name=zf-CCHC; Domain location=264-281; Score =10.3; E_value=0.02; Accession=PF00098.13; Description=Zinc knuckle
  Pfam annotation: Domain name=zf-CCHC; Domain location=95-112; Score =9.6; E_value=0.026; Accession=PF00098.13; Description=Zinc knuckle
  Pfam module annotation: Pfam domain module=zf-CCHC::zf-CCHC; Domain location=264-281::95-112
HGHELSQDEGIKKGKSLALTIQRPKCNSTSKDSSSKAFAMNDALEEESDGDDSNEEDDELSVITRKIQKMWRNKNSSRFNELSKRSFHKKEKIPIICYECKNPGHLKLKYPDLEKQQIRRYDPSFDEDSEEQAKLCLMADVSTSKVDLTLDTSSDDEDSQLDDTVNSDGEEEVRELQDEKVFSGLKTLLKDFQDLEDRGCEVLKESPLEIVKLYKEIETLKDKLGKFVGCHEAFNKIIKVQRHPKDKFDHGFKGKKIVYGEEVIVCYFYGKVGHESHKCKDLLKKGNPSRGPCSAY

SEQ ID NO: 232724 - protein, 444 aa, Glycine max
  Coding DNA Sequence Number=SeqID_115946
MQEELNQFQKNDVWKLVEFLKGKYVGAKWVFKNKLEKTGKVMGNNARLVAKGYSQQDAYVGRVQNEYDGRIEVLPWTLNQASGRRNMHTSNHVVKKLLKKFKVDDAKHMKTPMHPTIVLGLDDESTKNPTQTIQVELDFKNNPPSASFDEGEALQIARPAPVTIIVVEVSLKDKEPNVHIEHFFDIESLENDGYMINAHLMLCGIHHFFEDPKDKSIGKDIYRGVILINVFEAYGVIRKLLYETPEEVQDIIYFYGVFLLKQKAFSQENISKMRLADDGSFQQTPRDDSIFSELDLKFGLNTRSNKMMDTSSSKAAPAPHRPPPILVAPKAIGAMAYILRRATPKKQQLSSTAECLLELSEIDDEDGLMIWKHPQLVNKTFALHPIPYDWGKYFTWDAAIKTITLKLDAEFDQNDAMLFYFKDIAIVTAWARHLELKDCSSSPD

SEQ ID NO: 232725 - protein, 221 aa, Glycine max
  Coding DNA Sequence Number=SeqID_115947
  Gene Ontology: Mol. function=protein disulfide oxidoreductase activity; Cellular component=outer membrane-bounded periplasmic space; Biological process=cell redox homeostasis
  Homolog annotation: Hit_ID=Q6M2R5; Match level="QueryCoverage=97%, HitCoverage=81%, E-value=4e-25, Identity=32%"; Hit description =Predicted dithiol-disulfide isomerase
  Pfam annotation: Domain name=DSBA; Domain location=28-200; Score =58.2; E_value=2.7e-14; Accession=PF01323.10; Description=DSBA-like thioredoxin domain
MQPRGVERLKKAINDLQTDEKINIIMRSFQLEPNLPSDKRLNDLEFVKFTQNLSDDQYENMRSRFKIYADNLKEAGKEENIEFNFDKAIYINTRKAHQIIQFSKKFAKSLEMEQLLFKAHFSDGLDIGSDEVLLNFAEQLGLDRSATIQALKENSYEYEIQQDVQDGLSGGLRGVPFFRINNRNTLSGAQSVDNFKAFLNENIDNNSSRQNMSCDINGDCY

SEQ ID NO: 232726 - protein, 39 aa, Glycine max
  Coding DNA Sequence Number=SeqID_115948
AKEEKVQVVDDSLSEADPLSEWHPLSEAYSSLSRFGNPK

SEQ ID NO: 232727 - protein, 259 aa, Glycine max
  Coding DNA Sequence Number=SeqID_115949
  Homolog annotation: Hit_ID=Q1T493; Match level="QueryCoverage=92%, HitCoverage=45%, E-value=2e-26, Identity=31%"; Hit description =Nucleic acid-binding, OB-fold, subgroup
MARIPNKIRSIDGSKETLKLAVRITDLWFVGTPNKSEQEEMIFVDSEGDQIHAICKSDHLKSWKADLKENCTYVMHNFKVVKNDGQFRVCEHEYKLFFIGVTVVREADLHELPFKLDLLNLQMSLLAILWLACWLVVFRHVSSKNTRVVFRMKDLSGEILSCTLWENYCIQFLSYLNERGNDGPMVIILTHARIKDAQDKYDILFTNLGSYPALVSNSFKALKLLINDPILEIQEFKERLLDLGVQVTPVLLPGDQASS

SEQ ID NO: 232728 - protein, 58 aa, Glycine max
  Coding DNA Sequence Number=SeqID_115950
  Subcellular localization annotation: CTP_CleavageSite=17; ConfidenceScore=5.18e-01
MGSFSSFSLFLLFFFFSSSHSKYGSGVRHREERRRGCVDGSRRSWIDFVLGILHLLCS

SEQ ID NO: 232729 - protein, 63 aa, Glycine max
  Coding DNA Sequence Number=SeqID_115951
MAKGAEDDVGLFASTGSFAPWLTKGAGNHKGQFVRDCGADDKREALAPTYPQFVMRNSDLRSS

SEQ ID NO: 232730 - protein, 261 aa, Glycine max
  Coding DNA Sequence Number=SeqID_115952
  Gene Ontology: Mol. function=chitin binding; Cellular component =extracellular region; Biological process=chitin metabolic process
  Homolog annotation: Hit_ID=UPI000044A8F0; Match level="QueryCoverage =88%, HitCoverage=99%, E-value=6e-34, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
VDPWVLVPIAFRGMHALTFRGLHVLAFRGLHALTFRGLHALALRRLHALALRGLHALAFKGLHTLAFRGLHVLTFRGLHALAFRGLHVLTFRGLHVLAFRGEYRSLAFRGLHVLTIRGLHVLTFRGLHVLTFRGLHTLTFRGQHVLPFRGLHALTFRGLHLFAFKGLHALAFRGLHVLTFIGLHALAFRGLHVLTFKELHTLAFSGLHALTFQSSHLRPKADMTGRLLVGSLTFDCRIMHFIIVRILLPVLLTLLKPPRRI

SEQ ID NO: 232731 - protein, 136 aa, Glycine max
  Coding DNA Sequence Number=SeqID_115953
  Homolog annotation: Hit_ID=Q1SKD7; Match level="QueryCoverage=72%, HitCoverage=26%, E-value=1e-09, Identity=33%"; Hit description =Ankyrin
MAPKKLSTKRCRRDATRDGSSTTPEFDSHRFRSAEHQQRFEAIRGWSFHRERRVQLREDEYTDFQEEIARRRWTPLVTPMAKFDPEIVLEFYANAWPMEEGVRDMRSWASSVSSAKGGIGLTGSTRKPLPSCYAHR

SEQ ID NO: 232732 - protein, 150 aa, Glycine max
  Coding DNA Sequence Number=SeqID_115954
MGGGAWPFLVGGAICLVNSVNERDLSLLNSYVEVCDALRCSGPHARYTDVFNESIALADSPARVDYVPALCTHRPSLLPIEWSGEVFGLRRREPAEGSLSMPHNQIDPRTCLFIYRREGGDDHGAPCARPPRPRDKHKPRRFVRQGTQIC

SEQ ID NO: 232733 - protein, 520 aa, Glycine max
  Coding DNA Sequence Number=SeqID_115955
  Gene Ontology: Mol. function=oxidoreductase activity; Cellular component=membrane; Biological process=electron transport
  Homolog annotation: Hit_ID=Q9FF18; Match level="QueryCoverage=99%, HitCoverage=99%, E-value=0.0, Identity=67%"; Hit description =Cytochrome P450-like protein
  Pfam annotation: Domain name=p450; Domain location=45-513; Score =235.6; E_value=1.1e-67; Accession=PF00067.12; Description=Cytochrome P450
MTMVVLTPLLAIVGIILLLKLVYDNLSCYWLTPLRIKKMMDMQGVRGPKPCFFTGNILDMASLVSKATSQDMKTISHDIVGRLLPHFLLWSGQFGKRFLYWNGSEPRLCLTETKLIKEFLSKHSTVSGKSWQQRQGSKNFIGEGLLMANGEDWYHQRHIVAPAFMGDRLKSYAGHMVECTKEMLQSMKIALESGQTEVEIGHYMTKLTADIISRTEFGTSYQKGKKIFHLLTLLQTRCAQASRHLCIPGSRFFPSKYNREIKSLKMEVETLLMEIIQSRKDCVEIGRSNSYGNDLLGMLLNEMQKKKKGNGNNNSSINLQLVMDQCKTFFFAGHETTALLLTWTVMLLASNTSWQDKVRAEVKSVCNGGIPSLDQLSKLTLLHMVINESMRLYPPASVLPRMVFEDIVLGDLYIPKGLSIWIPVLAIHHSEKLWGKDANEFNPERFTSKSFVPGRFLPFASGPRNCVGQAFALMEAKIILAMLISRFSFTISENYRHAPVVILTIKPKYGVQVCLKPLEP

SEQ ID NO: 232734 - protein, 88 aa, Glycine max
  Coding DNA Sequence Number=SeqID_115956
MCPVVGFGPWLGLGKPLVEILPPGQLRGFCPLLAWLGSAVLGYGPVLSFGLVGPPPPPRETVLLPGFCQLWLAPRWLSLCLGGGIIMS

SEQ ID NO: 232735 - protein, 227 aa, Glycine max
  Coding DNA Sequence Number=SeqID_115957
MDMNLGSFISSQITLMAQHDSSRLGFPTLITALCKAWGVHSVSLTYERLSPTINLAYIKKNCWNLDNLSVTFRGPRKAKGKRYEAPPSFEVPSSVPSASISVFPVSISAGPLDFIFTPQMLHSMLQSIHRGQSIIMQSLQGLGLPSIMSMEEFDAQVACPGDQLSSSGEGGASAAQEPVTEEPPAPAPTTTEEETTPQETQPSTLVAEPEQPIQDSSAALALDLNED

SEQ ID NO: 232736 - protein, 281 aa, Glycine max
  Coding DNA Sequence Number=SeqID_115958
  Gene Ontology: Mol. function=nucleic acid binding; Cellular component= integral to membrane; Biological process=protein amino acid phosphorylation
  Homolog annotation: Hit_ID=Q9FNZ2; Match level="QueryCoverage=97%, HitCoverage=62%, E-value=3e-66, Identity=48%"; Hit description=Zfwd1 protein
  Pfam annotation: Domain name=WD40; Domain location=124-162; Score =31.8; E_value=2.4e-06; Accession=PF00400.22; Description=WD domain, G-beta repeat
  Pfam annotation: Domain name=WD40; Domain location=203-239; Score =8.9; E_value=3.3; Accession=PF00400.22; Description=WD domain, G -beta repeat
  Pfam annotation: Domain name=WD40; Domain location=248-279; Score =6.8; E_value=5.9; Accession=PF00400.22; Description=WD domain, G -beta repeat
  Pfam annotation: Domain name=zf-CCCH; Domain location=12-36; Score =12.8; E_value=0.027; Accession=PF00642.15; Description=Zinc finger C- x8-C-x5-C-x3-H type (and similar)
  Pfam annotation: Domain name=zf-CCCH; Domain location=93-118; Score =12.9; E_value=0.026; Accession=PF00642.15; Description=Zinc finger C- x8-C-x5-C-x3-H type (and similar)
  Pfam module annotation: Pfam domain module=WD40::WD40::WD40::zf -CCCH::zf-CCCH; Domain location=124-162::203-239::248-279::12-36::93 -118
MDTKFARRTERIGRTTCSYWRAGRCNRNPCRFLHIETPSPPAACGYGNTAYSYGKKPHSSSENTPKYGSKKALLRDNGDRGDATRVAKAFKKSSPRICKYWINNNCVHGEQCLYLHSWFCGDGFSTVTKLQEHKKVITGIALPVGSDKLYSGSTDGTVRIWDCHTGQCAKVINLGAEVTSLISEGLWIFVGLQNAVKAWNIQTMSEFTLDGPKGRVRAMTVGNNTLFAGAEDGVIFAWRGSSKADSPFELVASLTGHTKAVVCLAVGCKMLYSGSMDQSIK

SEQ ID NO: 232737 - protein, 542 aa, Glycine max
  Coding DNA Sequence Number=SeqID_115959
  Gene Ontology: Mol. function=transporter activity; Cellular component= membrane; Biological process=oligopeptide transport
  Homolog annotation: Hit_ID=Q9FRU4; Match level="QueryCoverage=92%, HitCoverage=87%, E-value=0.0, Identity=69%"; Hit description =Putative nitrate transporter NRT1-3
  Pfam annotation: Domain name=MFS_1; Domain location=1-471; Score= -0.5; E_value=0.00033; Accession=PF07690.6; Description=Major Facilitator Superfamily
  Pfam annotation: Domain name=PTR2; Domain location=54-455; Score =412.1; E_value=7.7e-121; Accession=PF00854.12; Description=POT family
  Pfam module annotation: Pfam domain module=MFS_1::PTR2; Domain location=1-471::54-455
MTYYGISSNLVLYLTRKLHQGTVTASNNVNNWVGTTYITPILGAYIADAHLGRYWTFVIASLIYLLGMCLLTLSVSLKSLQPPECHELDLTKCKKASTLQLAVFYGALYILSVGAGGTKPNISTIGADQFDDFDPKEKAYKLSFFNWWFSSIFIGTLFSFTVLVYIQDNVGWALGYGIPTIALAIAFITFLAGTPLYRHRLASGSSFTRIAKVIVAALRKSTVAVPIDSTELYELDEQEYTNKGKFRISSTPTLRFLNKACAKTSSSTSEWMLCTVTQVEETKQILRMIPIWVATFIPSTMLAQTNTLFVKQGVTLDRHIGRFNIPPASLIAFTSFTMLVCVILYDRVFVKIMQRLTKNPRGITLLQRMGIGITIHIVTMIVASMTERYRLKVAKEHGLVENGGQVPLSILILAPQFILMGLGEAFLEVSKIEFFYDQAPESMKSLGTSYSITTVGLGSFISTFLLSTVSHITQKHGHKGWILNNLNASHFDYYYAFFAVLNLLNLIFFMIVTKYFVYRAEISDSIDVLAQELKEKTANASN

SEQ ID NO: 232738 - protein, 305 aa, Glycine max
  Coding DNA Sequence Number=SeqID_115960
  Gene Ontology: Mol. function=ubiquinone biosynthetic process monooxygenase activity; Cellular component=membrane; Biological process=ubiquinone biosynthetic process
  Homolog annotation: Hit_ID=P25534; Match level="QueryCoverage=99%, HitCoverage=77%, E-value=1e-109, Identity=64%"; Hit description=2 -octaprenyl-6-methoxyphenol hydroxylase
  Pfam annotation: Domain name=FAD_binding_3; Domain location=6-260; Score=-137.3; E_value=0.0066; Accession=PF01494.9; Description=FAD binding domain
GFVQLQAEDYQLSALGNVVELYDVGQRLFKRLREAPGVTLCCPDHVTSVTRSADSVQTTLSSGATLQGALLVAADGARSPLAASCGIRWQRDDYQQLAVIANVATQLPHQGRAFERFTRHGPLALLPMSGNRLSLVWCHPAAAEATVKQWDDATFLHELQRAFGWRLGRFTHAGQREIYPLALQTAERQVTHRLALVGNAAQTLHPIAGQGFNLGLRDVMSLAETLAAAHRHQQDPGSHAVLHHFAARRQPDRAATIGVTDGLVRLFANRYAPLVAGRNLGLVAMDHLPWLRNPLAVRTLGWVKR

SEQ ID NO: 232739 - protein, 43 aa, Glycine max
  Coding DNA Sequence Number=SeqID_115961
MTISDSFTVDRREISAPAIRGKIEESQELARDATITVGRHEHV

SEQ ID NO: 232740 - protein, 121 aa, Glycine max
  Coding DNA Sequence Number=SeqID_115962
MTKSKGKDPLEGLGGPMTRARARKAKEALQQVLSILFEYKPKFQGEKSKVVSGSLLKSAVKLLYKLNHFINKDKLSFIQKIRVYLFYLSESDSPKFLSDSRTPWLYQRTFTTFVCCPRWKE

SEQ ID NO: 232741 - protein, 230 aa, Glycine max
  Coding DNA Sequence Number=SeqID_115963
  Gene Ontology: Mol. function=DNA binding
  Homolog annotation: Hit_ID=Q1SFS3; Match level="QueryCoverage=70%, HitCoverage=31%, E-value=2e-57, Identity=65%"; Hit description =Lambda repressor-like, DNA-binding
NAVPTLLADTYHSIHDRTQAGRGTISCCAPLLYQWFTFHLRQSRALKINDDKLSWPRRIMTLDPSDIVWYQAASDVGEIIVSCGEYPNVPLLDMRGGISYNPLLARRQFGYPIKTKPNNLALTNEFYLNHGDHSNKRERFAQAWSAIRRLNRSHLGKKSDYELEQENETLKGKIAQQSRELFIQNQRMIEKDDLLRRKDVLLHQDARRKRKFMDLFSRAHSDSEDPSTPG

SEQ ID NO: 232742 - protein, 222 aa, Glycine max
  Coding DNA Sequence Number=SeqID_115964
  Gene Ontology: Mol. function=transition metal ion binding; Cellular component=cytoplasm; Biological process=protein amino acid phosphorylation
MGDRLEDMIRDLGQESFQQAHAPVYEGLQSDSKKPLYTGCKNSLTLLSAVLSLVNVKARYGWSDKSFTSLLEVVHNLLPKDNTLPKSYYKAENILCPMGMEYQKIHACPNDCILYRHEFQEMSKCPTCGTSRYKVKDEKENSSDENSNKGPPAKVLWYLSIIPRFKRLFSNEDDAKDLTWHANGRISDGIVRHPADCSQWKKIDAKIHDVVYDDIGPKKDIK

SEQ ID NO: 232743 - protein, 109 aa, Glycine max
  Coding DNA Sequence Number=SeqID_115965
MAIKKSCNILVWIIVIHFFQELPFEEGVSKSHIKYYGVLGEVLVEWLGSHPSQLAFKGEFPKCPQCGHQALTLKDGANCYDRNLGITTGYLSLTMRCSVEYLKWLGSPS

SEQ ID NO: 232744 - protein, 111 aa, Glycine max
  Coding DNA Sequence Number=SeqID_115966
MGWPLVMILTLRNFWTVTGGEELPLFQGGVLIKVKDVAVARVVEGNEKGNDFAKDKVGETRHKVRKEIVDDNAIVVHATEGMDLRQSGRATCGDGDLGLQWFQGSDGGKHN

SEQ ID NO: 232745 - protein, 284 aa, Glycine max
  Coding DNA Sequence Number=SeqID_115967
MLWDRKGVFKDKQKRYGSPARQKHSSSHYGFLKFKNQESTRFQRVGPKTPGGGGGGGAMHQFPKELGQGSCSGYGITFRSPRDPRHKFWEITNDASLRLSSKRSIDNVLSTPSHACSMNNGEKPYSRAQCHDNKKKNYERESSSLKRRIDDVLSTPSHACSINTRQKLNSSEQCHDNNKKNYEREDSLGWKPLNKGNNTFERERKRPRLNWGEGLAKFEKNKIEGDGVSVATAATPASGAFNSFTGILLDSINYSLSYPNFVRGPLLDDMRLLFGPCKVLGTHH

SEQ ID NO: 232746 - protein, 109 aa, Glycine max
  Coding DNA Sequence Number=SeqID_115968
  Gene Ontology: Mol. function=protein serine/threonine kinase activity; Cellular component=phragmoplast; Biological process =protein amino acid phosphorylation
  Homolog annotation: Hit_ID=Q53VE2; Match level="QueryCoverage=90%, HitCoverage=18%, E-value=6e-50, Identity=92%"; Hit description =Ser/Thr protein kinase
IVNWRTTLKFPEEAKLSAEAKDLICRLLCNVEQRLGTKGADEIKAHPWFKGVEWDKLYQMKAAFIPEVNDELDTQNFEKFEEADKQTVPSSKAGPWRKLVYKNCCNCTI

SEQ ID NO: 232747 - protein, 275 aa, Glycine max
  Coding DNA Sequence Number=SeqID_115969
  Gene Ontology: Mol. function=protein serine/threonine kinase activity; Cellular component=phragmoplast; Biological process =protein amino acid phosphorylation
  Homolog annotation: Hit_ID=Q53VE2; Match level="QueryCoverage=85%, HitCoverage=43%, E-value=1e-133, Identity=96%"; Hit description =Ser/Thr protein kinase
  Pfam annotation: Domain name=Pkinase; Domain location=9-272; Score =181.3; E_value=2.4e-51; Accession=PF00069.15; Description=Protein kinase domain
  Pfam annotation: Domain name=Pkinase_Tyr; Domain location=7-267; Score=-41.9; E_value=6.7e-10; Accession=PF07714.7; Description =Protein tyrosine kinase
  Pfam module annotation: Pfam domain module=Pkinase::Pkinase_Tyr; Domain location=9-272::7-267
MAAPTHISYLTLVRICREKATGHVYAMKKLKKSEMLRRGQVEHVKAERNLLAEVDSNCIVKLYCSFQDEEYLYLIMEYLPGGDMMTLLMRKDILTEDEARFYVGETVLAIESIHKHNYIHRDIKPDNLLLDRNGHMKLSDFGLCKPLDCSNLQEKDFSVGMNRSGALQSDGRPVAPKRTQQEQLQHWQKNRRMLAYSTVGTPDYIAPEVLLKKGYGVECDWWSLGAIMYEMLVGYPPFYSDEPMLTCRKDLESIEFCKTPVLRKGHLVILDFRNS

SEQ ID NO: 232748 - protein, 151 aa, Glycine max
  Coding DNA Sequence Number=SeqID_115970
  Gene Ontology: Mol. function=transition metal ion binding; Biological process=regulation of ergosterol biosynthetic process
  Homolog annotation: Hit_ID=Q9SK39; Match level="QueryCoverage=49%, HitCoverage=75%, E-value=1e-25, Identity=72%"; Hit description =Putative steroid-binding protein 3
  Pfam annotation: Domain name=Cyt-b5; Domain location=64-150; Score =18.0; E_value=0.0064; Accession=PF00173.18; Description=Cytochrome b5-like HemeSteroid binding doma
MADTIHGEELIEGEEILVKKKIKLPRRGCQLCRESEKQRVTRKVKWLPRRGCQLCRESEKQRVTRKVKWFDDQKGVGRVYDVSTGKSFYGPGGPYAMFAGKDTSRALAKMSKNNDDISPSLVDLSNKEIGVLNDWENKFQAKYPVVARVLN

SEQ ID NO: 232749 - protein, 847 aa, Glycine max
  Coding DNA Sequence Number=SeqID_115971
  Gene Ontology: Mol. function=protein binding; Cellular component =nucleolus; Biological process=ribosomal small subunit biogenesis and assembly
  Homolog annotation: Hit_ID=Q1SI78; Match level="QueryCoverage=97%, HitCoverage=85%, E-value=0.0, Identity=64%"; Hit description=Nop14 -like protein
  Pfam annotation: Domain name=Nop14; Domain location=2-834; Score =601.4; E_value=8.1e-178; Accession=PF04147.3; Description=Nop14-like family
MSSDYKLPYVLNMKLSKKSKYHLSDGEEDDFEGIDSLGRDDFEDEMLPDDVDAETDEKLNLVQRSMQIPGEISADDGEENRHKSKKEVMEEIISKSKFYKAQKAKDKEENENLVEELDKDFTSLVHSEALLSLTEPNKMNALKALVNKSISNEQSNKDCMFATRTMGNSVQEKPDDYDKLVKQMGLEMRARPSDRTKTPEEIAQEEKERLEELEWLWILIMDYLHEEERQKRMVAAEDSSDEDSEDSEKPSEQKPRSISGDDLGDSFSVNKQIMTKKGWVDEILKRRDEKDSASEDDDGEDSDNLGSSGDADEGSDEDLDEHEKDLSLKDWEQSDDDDIGADLEDEDDSDEDIETASEDLDEVKGLDAAVHIKAKRNASVESVKKDKDSSDAKKIDVGGKQSKELDIPYIIQAPKTFEELCSLVDKHSNDNIILIINRIRKSNPITLAAENRKKMQVFYGVLLQYFAVLANKEPLNVELLNMLVKPLIEMSMEIPYFAAICARRRIETTRKQFIESIKQSESSSWPSSKTLCLLRLWSMIFPCSDFRHPVMTPVILLMCEYLMRCPIVSGRDIAIGSFLCSMLLSVFRQSRKFCPEAIIFLRTSLLAATESKHVSDEDSQLYHLMELKALKPLLCIHEIVNEISPLNFFKIIDMPEDSSFFTSVSFRASVLVAVVETLQGYVNVYEGLSSFPEIFLPILKLLNEIAEQKNMSNALRDKIKDVAELIKLKVDEHHTLRRPLQMRKQKPVPIKLLNPKFEENYVKGRDYDPDRERAELRKLKKHLKREAKGAARELRKDNYFLLEVKEKERSLQEKDRAEKYGRAKAFLQEQEHAFKSGQLGKGRKRRR

SEQ ID NO: 232750 - protein, 100 aa, Glycine max
  Coding DNA Sequence Number=SeqID_115972
MGGGWLLYVAIAVGVALAAIAVVWLLWKLISGVVWLLWKLISGVVLWLGKVIRKIFCCCCKRGRTMKAPGRNIRIYRNVFERSPRNYFRILRSDQRMLLV

SEQ ID NO: 232751 - protein, 520 aa, Glycine max
  Coding DNA Sequence Number=SeqID_115973
  Gene Ontology: Mol. function=zinc ion binding; Cellular component =cellulose and pectin-containing cell wall; Biological process =metabolic process
  Homolog annotation: Hit_ID=Q9LW67; Match level="QueryCoverage=99%, HitCoverage=82%, E-value=0.0, Identity=74%"; Hit description=Ankyrin- like protein
  Pfam annotation: Domain name=DUF248; Domain location=101-519; Score =846.7; E_value=1.2e-251; Accession=PF03141.7; Description=Putative methyltransferase
  Pfam annotation: Domain name=Methyltransf_11; Domain location=228 -323; Score=34.4; E_value=3.9e-07; Accession=PF08241.2; Description =Methyltransferase domain
  Pfam annotation: Domain name=Methyltransf_12; Domain location=228 -321; Score=12.1; E_value=0.037; Accession=PF08242.2; Description =Methyltransferase domain
  Pfam module annotation: Pfam domain module=DUF248::Methyltransf _11::Methyltransf_12; Domain location=101-519::228-323::228-321
MTRGRYDGSPKKHLVASVCGVAVFLGLLYVFQRSIFGSQNSGSSALEYGSKSLKRLGASYLGSDDDADSKQDESSSSIAQGDGEADIVPKSFPVCDDRHSELIPCLDRHLIYQMRLKLDLSLMEHYERHCPPAERRFNCLIPPPAGYKVPIKWPQSRDEVWKANIPHTHLAHEKSDQNWMIVKGEKIVFPGGGTHFHKGADKYIASIANMLNFSNNNLNNEGRLRTVLDVGCGVASFGAYLLSSDIIAMSLAPNDVHQNQIQFALERGIPAYLGVLGTKRLPYPSRSFELAHCSRCRIDWLQRDGILLLELDRLLRPGGYFAYSSPEAYAQDEEDQRIWREMSALVGRMCWRIAAKRNQTVIWQKPLTNECYMEREPGTRPPLCQSDDDPDAIWGVNMEACITPYSDHDNRAKGSGLAPWPARLTTPPPRLADFGYSNEMFEKDTELWQGRVENYWNLLGPKISSNTVRNVLDMKANMGSFAAALRGKDVWVMNVVPRDGPNTLKLIYDRGLIGSIHDWY

SEQ ID NO: 232752 - protein, 1115 aa, Glycine max
  Coding DNA Sequence Number=SeqID_115974
  Gene Ontology: Mol. function=zinc ion binding; Cellular component =membrane; Biological process=defense response
  Homolog annotation: Hit_ID=Q1SIN6; Match level="QueryCoverage=72%, HitCoverage=97%, E-value=0.0, Identity=64%"; Hit description =Regulator of chromosome condensation, RCC1
  Pfam annotation: Domain name=DZC; Domain location=1051-1086; Score =62.1; E_value=1.8e-15; Accession=PF08381.1; Description=Disease resistancezinc fingerchromo
  Pfam annotation: Domain name=FYVE; Domain location=600-668; Score =52.5; E_value=1.4e-12; Accession=PF01363.12; Description=FYVE zinc finger
  Pfam annotation: Domain name=RCC1; Domain location=275-324; Score =20.9; E_value=0.0038; Accession=PF00415.9; Description=Regulator of chromosome condensation (RCC1)
  Pfam annotation: Domain name=RCC1; Domain location=327-379; Score =26.5; E_value=9.8e-05; Accession=PF00415.9; Description=Regulator of chromosome condensation (RCC1)
  Pfam annotation: Domain name=RCC1; Domain location=382-431; Score =16.1; E_value=0.013; Accession=PF00415.9; Description=Regulator of chromosome condensation (RCC1)
  Pfam annotation: Domain name=RCC1; Domain location=446-493; Score =18.1; E_value=0.0078; Accession=PF00415.9; Description=Regulator of chromosome condensation (RCC1)
  Pfam annotation: Domain name=RCC1; Domain location=496-545; Score =25.1; E_value=0.00024; Accession=PF00415.9; Description=Regulator of chromosome condensation (RCC1)
  Pfam annotation: Domain name=RCC1; Domain location=550-597; Score =27.3; E_value=5.3e-05; Accession=PF00415.9; Description=Regulator of chromosome condensation (RCC1)
  Pfam module annotation: Pfam domain module=DZC::FYVE::RCC1::RCC1::RCC1 ::RCC1::RCC1::RCC1; Domain location=1051-1086::600-668::275-324::327 -379::382-431::446-493::496-545::550-597
MDAWGGKLSLNMAFITLKKGTQLVKYSRKGKPKLCTFRISSDETKLIWISHGREKNLKLSSVSRIIPGQRTAVFRRYLRPEKDYLSFSLIYKKGERSLDLICKNQAEVEVWFSSLKALISPGERIRRGTSDLSNDSVDLIPNDRPYAGTLEFASSIARGRFSFESVSHESTSSWSRSETNMPVRTSCGDGSRVSVSSVSHSSSVGSGLDDIESLGDVYIWGEVWADGNSFDGLGSQLQAFCKTDVLTPKPLESDVVLDVHQIGPGDRHIALVTRQGEVFTWGEDSGGRLGHGFEKDFGRPHLVESLAITNVTFVACGEYHSCAVSTSGDLFTWGDGTHGAGLLGHGTDVSYWIPKRVSGPLEGLQVVAVACGTWHSALATSNGKLFTFGDGRFGVLGHGNRASVAYPKEVQLLSGYKAIKVACGVWHSAAIIDVMDLSGSKASAKRLFTWGDGDQYRLGHANKETYLEPTCVAAVAEYNFHQVACGYTMTVALTASGHVFSMGGTTYGQLGNPNSDGKVPILVRDKLVGEFVEEISCGANHVAVLTSRSELYTWGRGANGRLGHGDTDDKKSPTLVEALKDRHVKNISCGSTFTSCICLHKWVSGVDQSVCSDCRQPFGFTRKRHNCYHCGLVYCHPCSSKKASKAALAPTPSKPHRVCDACYAKLKGSDSASDFNREISRPSSSVYGRESFHRGEVRSSRVLLPPTTEPVKYLEIRTNKPGNMHDFSSIVRAAQVPTSLQLKDVAFPISLSSAQNVYKPVIQPTPPTPATPIPMSPYARRPPSPPRSTSPGFSRSLIDNLRKKNDHLNQQVSKWQNNNQNLKQKSDMQDMKIRELQKNIEEAVSRVGEESSKLRKAKELIKSLTDKPYPYICKEAVSGFEPMTNKSPRHNFTAAPGLALYPQMTIKKKKEVTEKLPLEIPDNETLRTMHAQAEEFLHEEKDFESSSSPQSLESEQQSAPDVPASESDSSKLQEQRMEGNDDAFGVVPSIDGENILEESSNSSVSGPVVTSPSSGNGSKLRDTGIPVTEGEKSVIEQFEHGVYVTLVVLPRGYKVFKRIRFSKRRFNEKQAEEWWNQNKDKVHSKYNLPITKNATTGSSIIPPQAEEKCEALPSS

SEQ ID NO: 232753 - protein, 344 aa, Glycine max
  Coding DNA Sequence Number=SeqID_115975
  Gene Ontology: Mol. function=protein binding; Cellular component =integral to membrane; Biological process=lipid metabolic process
  Homolog annotation: Hit_ID=UPI00005F9914; Match level="QueryCoverage =52%, HitCoverage=60%, E-value=2e-82, Identity=80%"; Hit description =COG1752: Predicted esterase of the alpha-beta hydrolase superfamily
  Pfam annotation: Domain name=SEC-C; Domain location=193-211; Score =19.0; E_value=0.0043; Accession=PF02810.6; Description=SEC-C motif
  Pfam annotation: Domain name=SEC-C; Domain location=326-344; Score =27.3; E_value=5.3e-05; Accession=PF02810.6; Description=SEC-C motif
  Pfam module annotation: Pfam domain module=SEC-C::SEC-C; Domain location=193-211::326-344
QIDRDDDIGTHGATKRHRHGIDHRAIHQPIAVGPHRCQQARHAAGGAYRLMNITFGQPQLTPGAEIGRHGAELQRTFGDIIDLQQLSDGVKHPLAAQQAATVPGKIHQANHVPIAERSHPLLHRRQTVAGERRPHQRADGATGHDINLNPQFLYRINHADVRPAFGRARPQRQSDLDLPHSAILAVKGVILPESCPCGSGQAYNACCAPFISGNQPAPTPGQLMRSRFTAYVSHNVDYLIATWHPGCGAEAWRNAIVDSFKNTEWLGLTIVEEKAGHEPEEGFVEFIARFIDGESGEPQAMHERSRFLRRDQRWYYIDGTKPQPGRNAMCPCGSGKKYKKCCGR

SEQ ID NO: 232754 - protein, 218 aa, Glycine max
  Coding DNA Sequence Number=SeqID_115976
  Subcellular localization annotation: CTP_CleavageSite=69; ConfidenceScore=5.31e-01
MSHKRLGKKLQPAKKAWKSFSNTVQHKLHKLNIPNSMKTTLQRLLQSFYSLGTVIHSRLHRSFTTIRPRGGTATSNYYHVQYKHCAAIHIDDLFDNKTNNSAVSVHATNKTSAPHATQVQGETTKGKEIKGKEKEEPGIYKGNNLVGQCRNQSRSGGGEGSSSGLNTIEDAWKVVVAKSPQLHVDQKAEEFISKFRQDMRLQKERSMLEFQEMLARST

SEQ ID NO: 232755 - protein, 95 aa, Glycine max
  Coding DNA Sequence Number=SeqID_115977
MPICVRPMKFERMKSVTEFARRRPTASARRQRVPVIVAHDESVLPAPDVEADVFPDDPMALTDVEDTGADIPTDSGTQATEDEPEGFSGGPSDPS

SEQ ID NO: 232756 - protein, 83 aa, Glycine max
  Coding DNA Sequence Number=SeqID_115978
MNTKEGIPLWFIACKGFYKDSGNLKRVAWGLDVGTGCGCRRASFMKGKIWFKYICPKFGGVYWVKASNEKEKLSAERQVIELE

SEQ ID NO: 232757 - protein, 104 aa, Glycine max
  Coding DNA Sequence Number=SeqID_115979
MSLTIFFIRRRIFEEGDKNIRYFHGTTIIGGRRNKVEMLQDMLRIGAPIENGEIFEVICWMGGFKPLRLDGFEAIFYQTPSNMVKPSLCKLIHDFEDHPGRIRY

SEQ ID NO: 232758 - protein, 178 aa, Glycine max
  Coding DNA Sequence Number=SeqID_115980
  Gene Ontology: Mol. function=unfolded protein binding; Biological process=cellular protein metabolic process
  Homolog annotation: Hit_ID=Q6ASR1; Match level="QueryCoverage=41%, HitCoverage=13%, E-value=2e-27, Identity=83%"; Hit description =Putative chaperonin
MVLRFRCCSNTVLLWLGGSRCVAEFHVIEIHTAIADYCGCGQHSTAIFRLQFRTMVQSHILCQVFFSFFLCCIVVTEDIEEQRIQDNSARSSSEVNSGFFYSSAEQREAMVAAERRQVDEKVTRIIELKNKVCSGNDSNFVVINQKGIDPPSLDLLAREGDIIVGLGMGESCFGRVEM

SEQ ID NO: 232759 - protein, 125 aa, Glycine max
  Coding DNA Sequence Number=SeqID_115981
MTHESGKTMKGKYYLREFMESVFSEIGVAEFENEVFHKHHPVTILAGGRRSSKQHVACRVFFSFVGGYFPSPTTTNEKSKSLRIVAQRGLSEIEKGSTEHFEEAMDGTEECWPLVRHLRKGSQGV

SEQ ID NO: 232760 - protein, 260 aa, Glycine max
  Coding DNA Sequence Number=SeqID_115982
  Gene Ontology: Mol. function=chitin binding; Cellular component =extracellular region; Biological process=chitin metabolic process
  Homolog annotation: Hit_ID=UPI000044A8F0; Match level="QueryCoverage =91%, HitCoverage=99%, E-value=7e-38, Identity=28%"; Hit description =PREDICTED: similar to activated in Blocked Unfolded protein response ABU-10, ...
  Homolog annotation: Hit description=Prion-like Q/N-rich domain protein PQN-33, Prion-like Q/N-rich domain protein (40.3 kD) (abu -10), partial
HVLAIRGLHVFTFVGLHALTFKGPHVLTFRGLHALAIRGLHVLTFRGLHALAIRGLHVLTFVELHALTFRGPHVLTFRGLHALAIRGLHVLTFRGLHALAIRGLHVLTFRRQHALAIRGLHTLTFRGLHVLTLVGLHALTFRGLHILAFRGLHVLTLRGLHVLALRGLHVLTIRGLHALTSRGLHFLALRELPALALGLHALAFRGPHILTFRGLHALAIRGQHVLTFLGLHALAIRELHVLTFERAAHPHLERTYTSSP

SEQ ID NO: 232761 - protein, 124 aa, Glycine max
  Coding DNA Sequence Number=SeqID_115983
GVIFDFMHRFPQMLKNNMFNGATHEDRMQHLRKFIKLTNMMHPLTLKIKTLMKAQAQVPITTPSFPTCDKCGIEEVNVVSIKSGQPMTKLKKKKKATPPQEKEALTEESQKAKEGEKEVLAPPQ

SEQ ID NO: 232762 - protein, 147 aa, Glycine max
  Coding DNA Sequence Number=SeqID_115984
  Gene Ontology: Mol. function=phosphotransferase activity, alcohol group as acceptor; Biological process=response to antibiotic
  Homolog annotation: Hit_ID=Q2K622; Match level="QueryCoverage=58%, HitCoverage=33%, E-value=1e-14, Identity=47%"; Hit description =Putative aminoglycoside 3`-phosphotransferase protein
MGAPDPFTDGLPLPLPWAWQEALADARIERQSIGVSRADVARVHRPGQADAFLKSEVIDAFSAGAARTDGDGHCRRIGSALAADECAAWPRPGLVAGARAPAPGGAAGRCAAGPACPAGGELSVRPAAGLAPAGCTGTGRGGPGRRR

SEQ ID NO: 232763 - protein, 67 aa, Glycine max
  Coding DNA Sequence Number=SeqID_115985
MEEKGWKRKQKLMEEKKEFPKGEFSDFRCALECSETRCVLSPWLDPHFRVARMDLGLRTRAKPVLLA

SEQ ID NO: 232764 - protein, 79 aa, Glycine max
  Coding DNA Sequence Number=SeqID_115986
MMITIRSSGVVHVLQLSKAIKLLKDICTKMCTTAVVKSDAKALSHYGLTMALLIEHDPHELTTTMVTLTLPLSDFDIVL

SEQ ID NO: 232765 - protein, 113 aa, Glycine max
  Coding DNA Sequence Number=SeqID_115987
MEYSLPYYHSQDTMLSTSPNPLFFIDTIETQWEHNDTLYVNHFYGFLCFRCASINILEYRQLLPKSQKPPGVDLVDFMLEDTGEELEEDTYFEKDSSMDEKAPITELEFMPKV

SEQ ID NO: 232766 - protein, 191 aa, Glycine max
  Coding DNA Sequence Number=SeqID_115988
  Gene Ontology: Mol. function=nucleic acid binding
MVCTMEQFLVMNVLGKKIKYRMLDNKLQLEWARVGSVRLVDMPNDHNIVQFTAMEDYQHALFQGPWIIADNYFVVQRRRPFFSLDTKVIQKIAMWTHIHRLPIELYKDKFSWMYGQKQTSCTKSFIEGIENTMAATGAVVEATTMEVEGGKTKVSDVDISPNGVTKGESVESKNPKKGGLYGLWMIVRRNN

SEQ ID NO: 232767 - protein, 85 aa, Glycine max
  Coding DNA Sequence Number=SeqID_115989
MQAKQGNQSLAREELPLELHNRSCFLKWSLLSLCFRDSGWLLESLAIAIESGVDARNRVSGTSFFTLELRGRLAEWKLHPYGACT

SEQ ID NO: 232768 - protein, 148 aa, Glycine max
  Coding DNA Sequence Number=SeqID_115990
  Gene Ontology: Cellular component=nucleus; Biological process =regulation of transcription, DNA-dependent
  Homolog annotation: Hit_ID=Q1SAU7; Match level="QueryCoverage=58%, HitCoverage=9%, E-value=1e-22, Identity=57%"; Hit description=Paired amphipathic helix
  Pfam annotation: Domain name=PAH; Domain location=82-128; Score=53.6; E_value=6.7e-13; Accession=PF02671.11; Description=Paired amphipathic helix repeat
MIKIVDVRGYWDEKNANPNTRRHLLTAYGSRLTAHGFIQQPQLLSTCCQPLVNGRGAKKQRPMTDSALAYLTTVKDAFKDDREKYDKFLELVKNFTAERFNLVRGIEEVKELLKGYRDLILGFNVFLPKGYEIKLPLEDEQPPEKKLD

SEQ ID NO: 232769 - protein, 41 aa, Glycine max
  Coding DNA Sequence Number=SeqID_115991
SHEGEYLYLSACHLVWNSLKTQADHHGDLPVNDRVTLTLTA

SEQ ID NO: 232770 - protein, 175 aa, Glycine max
  Coding DNA Sequence Number=SeqID_115992
  Homolog annotation: Hit_ID=Q38739; Match level="QueryCoverage=27%, HitCoverage=13%, E-value=7e-08, Identity=58%"; Hit description=Mixta protein
MGLDPVTHKPIKPNTFERYGGGHGQFKNTINTNHVAQWESARMEAEARGSVLQVGSHSSHQPQLVLSKIPTQPCPSSSDSVSTKHNTVYNMYALVLATNHDPLWPVSPLSIPGWKVPAVSTNVGQFTNTGSSLSYESDVNVTETNSQIQKIPENYLSNLQDEDIMVAVEAFRTIR

SEQ ID NO: 232771 - protein, 115 aa, Glycine max
  Coding DNA Sequence Number=SeqID_115993
MYRGFLLLLVDLHTLFLLALVHTNIISCGLVLGNVFHVELLGWHVVVDAPWMCIDHYMYQFKTFYHPFIMLPAKDLLSMPHHRAAPDPKRMINLIILQDLQTILDLRKVILGSEA

SEQ ID NO: 232772 - protein, 34 aa, Glycine max
  Coding DNA Sequence Number=SeqID_115994
MVEPLGGSSYGIQDRPHGPNLILTLSEASICRAQ

SEQ ID NO: 232773 - protein, 76 aa, Glycine max
  Coding DNA Sequence Number=SeqID_115995
  Homolog annotation: Hit_ID=Q1SCJ0; Match level="QueryCoverage=93%, HitCoverage=16%, E-value=1e-13, Identity=60%"; Hit description=TCP -domain protein
MVSEIGKGYVGEEGSSLMLLEGEIGVEVGGSELGGDKHGGAGTVYRDVQGGEGVGANGGDHSRLHLLEEPLNGFVV

SEQ ID NO: 232774 - protein, 166 aa, Glycine max
  Coding DNA Sequence Number=SeqID_115996
MEWKTQGLREKRRQRGWRRNGVGMRGVFFMIGGCLREGVGAGEEFDRNTFISDELTMLTAWKNMDDRSKVSFINPTEHMEQGLTILVWVMIMMKIWVVMTLICSCNLTISIATNYFMTGEHPGPLGPSGIFLQKAVASGGSNPARLGELSSPGRAGRQPPPLFCYK

SEQ ID NO: 232775 - protein, 170 aa, Glycine max
  Coding DNA Sequence Number=SeqID_115997
  Homolog annotation: Hit_ID=Q1RYE3; Match level="QueryCoverage=93%, HitCoverage=17%, E-value=8e-38, Identity=55%"; Hit description=IMP dehydrogenase/GMP reductase
  Pfam annotation: Domain name=DUF827; Domain location=3-169; Score =18.2; E_value=7.3e-12; Accession=PF05701.2; Description=Plant protein of unknown function (DUF827)
MVLAEFGGTKAQLEVAKARYTTVVSDLIVMKEELEPLHKEYASLVTDRDVAIKKGEEVVTASKEVKKSVEDLIVELIATKESLETTHAAHLEAEEQRIGAVMARDQDSLNWEKELKQAEEELQRLNQQISFAKELKSKLEIASTLLIDLKAELTAYMESKLKQQGGPKEP

SEQ ID NO: 232776 - protein, 114 aa, Glycine max
  Coding DNA Sequence Number=SeqID_115998
  Homolog annotation: Hit_ID=Q10BC8; Match level="QueryCoverage=46%, HitCoverage=6%, E-value=5e-07, Identity=45%"; Hit description=HAT family dimerisation domain containing protein, expressed
  Pfam annotation: Domain name=zf-C2HC_plant; Domain location=26-82; Score=36.5; E_value=9.2e-08; Accession=PF07567.3; Description =Protein of unknown function, DUF1544
MLSVEAPLSQASSTPNTSQNVRKKNDPAWGHCKQINEGATKVTMMCIYCDKRVKGGIINRFKAHLVGSPNDCFMPRKTPGAQPSLKSVLQNKQIVENYDKAIEECLAKDVVQTF

SEQ ID NO: 232777 - protein, 94 aa, Glycine max
  Coding DNA Sequence Number=SeqID_115999
MVSTWSGLKHETPLEDSYPHSTIMTDTNTLQQLQNCFAEMERRPDEELKKLKVNHDQIKARVKCPQGNEHSAHTLPKCTKGNHTPDAQSTLQMT

SEQ ID NO: 232778 - protein, 73 aa, Glycine max
  Coding DNA Sequence Number=SeqID_116000
  Subcellular localization annotation: CTP_CleavageSite=39; ConfidenceScore=5.30e-01
MKCQKWQLSLAHQWAKRSFRHQYQGRAKRKISVLRQQVSSARRSARLALSPNPLTHAKHEGGAKHNITNSEPI

SEQ ID NO: 232779 - protein, 339 aa, Glycine max
  Coding DNA Sequence Number=SeqID_116001
  Gene Ontology: Mol. function=transcription factor activity; Cellular component=intracellular; Biological process=regulation of transcription, DNA-dependent
  Homolog annotation: Hit_ID=Q8XPK3; Match level="QueryCoverage=97%, HitCoverage=95%, E-value=1e-120, Identity=65%"; Hit description =Probable transcription regulator transcription regulator protein
  Pfam annotation: Domain name=LacI; Domain location=10-35; Score=42.2; E_value=1.7e-09; Accession=PF00356.11; Description=Bacterial regulatory proteins, lacI f
  Pfam annotation: Domain name=Peripla_BP_1; Domain location=67-332; Score=14.6; E_value=9.8e-08; Accession=PF00532.11; Description =Periplasmic binding proteins and sugar b
  Pfam module annotation: Pfam domain module=LacI::Peripla_BP_1; Domain location=10-35::67-332
MATGKEKGSVTVDDVAAEAGVSIKTVSRVLNNEPNTSEKTRAKVMAAIALLKYQPNPSARRLASKRSDLIMLVYDNPSDNYLINVQQGALDACKRYFYSLLLHPCDYRAPDLAAQIEQSARQHACAGLVLTPPLSDVRALIDALDQGDVPFVRLAPSSPSARGLEVSTDDRSAARDMTRYLLDLGHRRIGFVAGHPDHGAVGGRLQGYRDALAEQGVAYDAGLVEQGLHSFDSGVGCGERLLDRADRPSAIFAANDDMAAGVLYAAHARGIKVPGELSVAGYDDTPLSRQTWPKLTTLRQPIRDMAYAAVEQLASREPQARVRTLGYEIVVRDSTRAPA

SEQ ID NO: 232780 - protein, 99 aa, Glycine max
  Coding DNA Sequence Number=SeqID_116002
  Homolog annotation: Hit_ID=Q1S8I9; Match level="QueryCoverage=44%, HitCoverage=8%, E-value=5e-09, Identity=63%"; Hit description =Probable integrase-common tobacco
MSHGRLYQRRIKNAFDKKVRPHKFNEGDLVLKKMSHAVKDNRGKGRIILSHGQKSRRVDGRNQLGYLGTDANGGYGHDRPIVVPSWRWASRERRCKTAQ

SEQ ID NO: 232781 - protein, 89 aa, Glycine max
  Coding DNA Sequence Number=SeqID_116003
TQERMSLEQTNQWLAPENPDESLETSNNSFQNCPIAQWNAPGLLHDMHMLRSSRILRKMEVEEPWLGLWLPLNYQVVFVIGSAVDRLCG

SEQ ID NO: 232782 - protein, 133 aa, Glycine max
  Coding DNA Sequence Number=SeqID_116004
  Gene Ontology: Cellular component=chloroplast
  Homolog annotation: Hit_ID=UPI0000E45228; Match level="QueryCoverage =35%, HitCoverage=22%, E-value=7e-11, Identity=75%"; Hit description =conserved hypothetical protein
MSISPSLSPRQCPDRYAFRAGRNLPDKEFRYLRTVIVTAAVHRGFGRRLPCHQVTNFLDLPALGRRQPPYMVLRLCGDLCFWYPFVEGRSSFSWEYGMDYFSAVAPGTRTLARGIFSTPYYPEKAGHLASLNR

SEQ ID NO: 232783 - protein, 194 aa, Glycine max
  Coding DNA Sequence Number=SeqID_116005
VIRGRENASSQSSSTRRYSAEVIHAILPGKARTTFNKWVPVPETDTGVPPHKGGRSDQARATVYQKHRSPQSREPTTEAPVNGGRNYNGPKVAKFLVGLGEIDMSVKMRTTCTWTERPYEASLFPGIGFGLFLRSLGGGQRRPPSGGARAISLPKGNGGVQRFPRARRRLALECKGRRELDCKTHPSSRDESRP

SEQ ID NO: 232784 - protein, 69 aa, Glycine max
  Coding DNA Sequence Number=SeqID_116006
MTHVGSYVVVLSCWGFAKGQKGPSEWAKSVSSKEGKRVESLSYPNFVRGPLLGGMQLVFGHFEVLGAHH

SEQ ID NO: 232785 - protein, 67 aa, Glycine max
  Coding DNA Sequence Number=SeqID_116007
MSGGIVATRRVVTRCATSASAAMMVKMTVKCVVVMGSFFHFRIYYLFILGDSEVHGRGEVQSRNATS

SEQ ID NO: 232786 - protein, 52 aa, Glycine max
  Coding DNA Sequence Number=SeqID_116008
MCDIRTTFMTPIGLSPFQLVYGKACHLLVELEHKIKTLPRKAEVKVVRTVHY

SEQ ID NO: 232787 - protein, 274 aa, Glycine max
  Coding DNA Sequence Number=SeqID_116009
  Homolog annotation: Hit_ID=UPI00006A1F94; Match level="QueryCoverage =27%, HitCoverage=12%, E-value=1e-09, Identity=49%"; Hit description =splicing coactivator subunit SRm300
  Subcellular localization annotation: CTP_CleavageSite=39; ConfidenceScore=5.81e-01
MYNGIGLQTPRGSESPTKRSLSMTASVRFNSSSPSLKTSSSIRATPMRRLLKSSWRLAKIWKPPLPPRKQMDLRLCLHQIRKGGLIGKEAWWKSWKVGEPCHNKEIKLISGYGREVTQGFFSVSSAYEQLYDIFKGPQVQGNLSQVWRMKIPLKVNFFVWRAFLRRLPMRQNPLLRNIQLGASNVFCPLCNSESESVNHILFRAQRFYKYGSSEARIQWVGVLTFMGLGKISGMARSSKLEKPQGIAFNYWLDAFCEIGVYAKDTFLLPWGSGL

SEQ ID NO: 232788 - protein, 462 aa, Glycine max
  Coding DNA Sequence Number=SeqID_116010
  Gene Ontology: Mol. function=transcription factor activity; Cellular component=nucleus; Biological process=regulation of transcription
  Homolog annotation: Hit_ID=Q2R3Q8; Match level="QueryCoverage=83%, HitCoverage=48%, E-value=6e-53, Identity=34%"; Hit description=GRAS family transcription factor containing protein
  Pfam annotation: Domain name=GRAS; Domain location=55-354; Score =276.7; E_value=4.6e-80; Accession=PF03514.5; Description=GRAS family transcription factor
MEDSEEDELLNLSLSVAADRERKKKGKTIREHNVSMSSTTTTTRNSYERKIFRLLQMREQMLRQDHHRRKGVVEDGNGLPLIHLLLSTATAVDDNNMDSSLENLADLYQTVSITGDSVQRVVAYFVDGLSARLLTRKSPFYDMLMEEPTTEEEFLSFTDLYRVSPYFQFAHFTANQAILEAFEKEEERNNRALHVIDFDVSYGFQWPSLIQSLSEKATSGNRISLRITGFGKNLKELQETESRLVNFSKGFGSLVFEFQGLLRGSRVINLRKKKNETVAVNLVSYLNTLSCFMKISDTLGFVHSLNPSIVVVVEQEGSRSPRSFLSRFTDSLHYFAAMFDSLDDCLPLESAERLRIEKKLLGKEIKSMLNNDVDGGVDCPKYERMETWKARMENHGFVATKISSKSMIQAKLLLKMRTHYCPLQFEEEGGGGFRVSERDEGRAISLGWQNRFLLTVSAWQSV

SEQ ID NO: 232789 - protein, 64 aa, Glycine max
  Coding DNA Sequence Number=SeqID_116011
MGPANFKALQRAHDSPSITPRHGVKLHEIATVNQPKLSRKQAPIPRGRPTILKNPLLRLVYGTC

SEQ ID NO: 232790 - protein, 240 aa, Glycine max
  Coding DNA Sequence Number=SeqID_116012
  Gene Ontology: Mol. function=protein binding; Cellular component =integral to membrane; Biological process=response to DNA damage stimulus
  Homolog annotation: Hit_ID=Q708X5; Match level="QueryCoverage=90%, HitCoverage=98%, E-value=4e-73, Identity=51%"; Hit description =Leucine rich repeat protein precursor
  Pfam annotation: Domain name=LRRNT_2; Domain location=25-65; Score =35.7; E_value=1.6e-07; Accession=PF08263.3; Description=Leucine rich repeat N-terminal domain
  Pfam annotation: Domain name=LRR_1; Domain location=132-154; Score =12.2; E_value=1.5; Accession=PF00560.23; Description=Leucine Rich Repeat
  Pfam annotation: Domain name=LRR_1; Domain location=156-178; Score =12.4; E_value=1.4; Accession=PF00560.23; Description=Leucine Rich Repeat
  Pfam annotation: Domain name=LRR_1; Domain location=180-202; Score =18.9; E_value=0.019; Accession=PF00560.23; Description=Leucine Rich Repeat
  Pfam module annotation: Pfam domain module=LRRNT_2::LRR_1::LRR_1::LRR_ 1; Domain location=25-65::132-154::156-178::180-202
MACHSFLLLATTILVVVCSAVSDCSPSDTAALLAFWKALNELYLGLFNSWTGSNCYLNWYGISCDATIGYVTDINLYGESEDPIFEKANRSGYMTGKLSPVICDINTLTTLVVADWKDIAGEIHACVTALPSLRILDLIGNKLFGEIPVNVDKLSHLTVLDLADNTLNGKIPTFITRLGSLKHLDLNNNQLCSEIPEDFGNLAMLSRMLLNRNQLTGMPLRESYGEYVCLREGERAGVRG

SEQ ID NO: 232791 - protein, 99 aa, Glycine max
  Coding DNA Sequence Number=SeqID_116013
ADISENGAGDDDSHCSLSRFEFYGLQMRLFRSLGWKTLHLRKGLGRKTLTSSGRVQVTTLVTACYRDAHISEKGASDDISVATYPSAGGRRETRGMRVP

SEQ ID NO: 232792 - protein, 167 aa, Glycine max
  Coding DNA Sequence Number=SeqID_116014
MEEPSKKHKGSSSRSQGHSEAQDIPIPSSISSSSLFSSEEKCIRYTNLFSSRSIIDPKFIDMDLFSDESFECIQAFQNSNLIPFMSLKLPVYSELVKAFYSNLEIQESALDDDWKFDFSVHDARRLVCTNQADMTGRLLAGSLALESRILHYLIVCILLPRSSNLAQ

SEQ ID NO: 232793 - protein, 198 aa, Glycine max
  Coding DNA Sequence Number=SeqID_116015
  Homolog annotation: Hit_ID=Q6CQF2; Match level="QueryCoverage=37%, HitCoverage=91%, E-value=8e-18, Identity=63%"; Hit description =Kluyveromyces lactis strain NRRL Y-1140 chromosome D of strain NRRL Y- 1140 of Kluyveromyces lactis
  Subcellular localization annotation: CTP_CleavageSite=37; ConfidenceScore=5.30e-01
AQLGTVTQLPGSSRIASSALPKNGPLGALDSMARLNRAAAPSYLCKSFAPIPKSDERFARQYRCGPPPEFPLASPRSGIVHHLSGPDRYALTRTLHRRSGSVGGATHRGIPPISFLAPYGPTPGARRCRGTPRARAAIHNRDDDVSTSISTARAWATIAIRVGQCPESIGGPALTVPHPTGTHRRPPSASLPTISSTL

SEQ ID NO: 232794 - protein, 290 aa, Glycine max
  Coding DNA Sequence Number=SeqID_116016
  Homolog annotation: Hit_ID=Q9AVH2; Match level="QueryCoverage=70%, HitCoverage=78%, E-value=8e-62, Identity=57%"; Hit description =Putative senescence-associated protein
GKTNLSHDGLNPAHVPYWWVNNPTLGEFCFTMIGRADIEGSKSNVAMNAWLPQASYPCGNFSDTSSFKFRRTKGSIGHAFTVRIRTGNQNQTSFYPFVPHEISVLVELILGHLRYLLTDVPPQPNSPPDNVFRPDRPAEADLGSKKRGSAPLPIHGITPTYPTPLKSFHKVGLESSSTGSSFPADSAKPVPLAVVSLDSRQGQWESLDCSTPGEEAPKGPFPIRPPTGTRRPALAAEAARAVHRQPTGSGLGPPCPALRANPFPEYDRAWEALGPPDFQGPPGAHRTPRD

SEQ ID NO: 232795 - protein, 170 aa, Glycine max
  Coding DNA Sequence Number=SeqID_116017
ALAPKMNGAKRSAEAVGCKKESVGERSALEGRTRASSAGRSGSENVGLSNANVGENPMPRKPKGSSARFVHGGVIRGRENASSQSSSTRRYSAEVIHAILPGKARTTFNKWVPVPETDTGVPPHKGGRSDQARATVYQKHRSPQSREPTTEAPVNGGRNYNGPKVAKFLV

SEQ ID NO: 232796 - protein, 270 aa, Glycine max
  Coding DNA Sequence Number=SeqID_116018
  Gene Ontology: Mol. function=nucleic acid binding; Cellular component= nucleus; Biological process=regulation of transcription, DNA-dependent
  Homolog annotation: Hit_ID=UPI00005103F6; Match level="QueryCoverage =97%, HitCoverage=22%, E-value=2e-64, Identity=50%"; Hit description =COG0553: Superfamily II DNA/RNA helicases, SNF2 family
  Pfam annotation: Domain name=SNF2_N; Domain location=14-270; Score =148.4; E_value=1.9e-41; Accession=PF00176.13; Description=SNF2 family N-terminal domain
VPVPAGVTAEHRPYQKEGPEWLAFLWGHRLGGILADDMGLGKTLQLLALIVHARESGERRPFLAVVPTSVLATWRSEAERFAPSLRVLLRGSTQGPSLADSLDDIDLVITTYAVARLDEEAFASEQWAGLILDEAQFVKNPATKLHRAVASFPADVTFAVTGTPMENSLGELWALLKLTAPGLFASARAFRQHYIQPIEQGKVPENEEGGEYRQRRLERLRRRIRPLLLRRTKELVAPELPAKQEQILEVELSSAHRALYETVLQRGAAE

SEQ ID NO: 232797 - protein, 69 aa, Glycine max
  Coding DNA Sequence Number=SeqID_116019
MASYGGELLLDSFSPCSGVSNHLSSFSILLAFIFKNQMTPLMKKIQGLQAPHKSYIMWFYHFSVIIFLC

SEQ ID NO: 232798 - protein, 222 aa, Glycine max
  Coding DNA Sequence Number=SeqID_116020
  Gene Ontology: Mol. function=hydrolase activity
  Homolog annotation: Hit_ID=Q5NA00; Match level="QueryCoverage=66%, HitCoverage=24%, E-value=2e-35, Identity=51%"; Hit description =Putative lung alpha/beta hydrolase protein 1
MDLNRWCSSTTNPYCLLFQALSLIPIWHYLLFVSFVFLSFFYRFLELHFLQDLFSLFSGSSVTLTYHHGSQFYDAVVSKCRILHGTYLATPWLSSPHLQTVFLNFFGRPPLFKYRRQLFTTPDGGTVALDWLLSSDVSAGAIHMEDVVSTDESTPIVVVIPGLTSDSSSASSLYNFIGIWKNHILIPLPVSNYLTARHTIQDRLGVDAFRGKVGVAPVAKRW

SEQ ID NO: 232799 - protein, 281 aa, Glycine max
  Coding DNA Sequence Number=SeqID_116021
  Gene Ontology: Mol. function=O-methyltransferase activity; Cellular component=intracellular; Biological process=lignin biosynthetic process
  Homolog annotation: Hit_ID=Q96424; Match level="QueryCoverage=98%, HitCoverage=71%, E-value=1e-128, Identity=81%"; Hit description=O -methyltransferase
  Pfam annotation: Domain name=Methyltransf_11; Domain location=123 -213; Score=12.7; E_value=0.003; Accession=PF08241.2; Description =Methyltransferase domain
  Pfam annotation: Domain name=Methyltransf_12; Domain location=123 -211; Score=23.9; E_value=0.00058; Accession=PF08242.2; Description =Methyltransferase domain
  Pfam annotation: Domain name=Methyltransf_2; Domain location=1-257; Score=331.9; E_value=1.1e-96; Accession=PF00891.8; Description=O -methyltransferase
  Pfam module annotation: Pfam domain module=Methyltransf _11::Methyltransf_12::Methyltransf_2; Domain location=123-213::123 -211::1-257
MVPTETVYGLSQVGQYFVPDGTRGYLASFTALSCYPPLLQVWSVILTPIYVYHIEDRLNFKEAVVDADIDLFKKILGVTMYQYMENDPKMNQIFNKSMANLCATEMSRILEIYTGFEGISTLVDVGGGNGQNLKMIISKYPLIKGINFDLPQVIENALPLPGIEHVGGDMFAKVPQGDTIILKAVCHNWSDEKCIEFLRNCHKALSPNGKVIVVEFILPEEPEPTEESQLVSTLDNLMFITVGGRERTQKQYETLCKLSGFSNFQVACRAFSSLGVMEFYK

SEQ ID NO: 232800 - protein, 144 aa, Glycine max
  Coding DNA Sequence Number=SeqID_116022
  Gene Ontology: Mol. function=hydrolase activity
  Homolog annotation: Hit_ID=Q5NA00; Match level="QueryCoverage=80%, HitCoverage=20%, E-value=1e-26, Identity=50%"; Hit description =Putative lung alpha/beta hydrolase protein 1
MDQYCLPADSSNAYWLLLQVLSLIPLWHYLLLAAFILFSILYNFLELYFLQDLFSGFSGSPVLLSYNTSSSILNAVVSKCKILHGRYFATPWLCSPHLQTLFLNYFGRPPPLKYTKQLFSTADGETIALDWLSTSHGSIEYFSL

SEQ ID NO: 232801 - protein, 75 aa, Glycine max
  Coding DNA Sequence Number=SeqID_116023
  Gene Ontology: Mol. function=nucleic acid binding
  Homolog annotation: Hit_ID=Q2I310; Match level="QueryCoverage=77%, HitCoverage=28%, E-value=4e-09, Identity=54%"; Hit description=RNA recognition motif-containing protein
  Subcellular localization annotation: CTP_CleavageSite=43; ConfidenceScore=5.35e-01
ISGRDKTTSNGSTAIAPTLNSSQRPRPYPVPINNSENFQHPARLSTPDRFSDYPVNNSQGIPMHVALQMGCCLQT

SEQ ID NO: 232802 - protein, 76 aa, Glycine max
  Coding DNA Sequence Number=SeqID_116024
MEKSDKMNFKEKKEKKGYITWEDNVINYSSDSEKKIISLGIMMKDYENGEDQSRYIDSNFSKHMACIKVYSYFSPR

SEQ ID NO: 232803 - protein, 113 aa, Glycine max
  Coding DNA Sequence Number=SeqID_116025
  Homolog annotation: Hit_ID=O64851; Match level="QueryCoverage=86%, HitCoverage=18%, E-value=4e-25, Identity=58%"; Hit description =Expressed protein
MDPTLNSHTGPASAINANDSNMHKKDDAATFNLSKRLPCKWFTGAGPRIGSVRDYAGHLQSRALEQVNLFPRPTSARLSSYGPIPSPRPSPKVRMPPRLAYIGLPSPRNPIPA

SEQ ID NO: 232804 - protein, 177 aa, Glycine max
  Coding DNA Sequence Number=SeqID_116026
ILPGPLPGDGVRIMRTSDHNCDLPLPKCQLMYTILTWMSVHMPPTRHPLDPDKSNRALGFPALITDAPPPPHQADPAGSFDTERYLRHLVHQQAANHRGHMQTHESLYQLSLSLQSQSFAPFPCPTPDQFRAEVAWPEDWPEAQAGEAPAEAPDDGEEAHMDEEMTDMLDFLGGSGA

SEQ ID NO: 232805 - protein, 284 aa, Glycine max
  Coding DNA Sequence Number=SeqID_116027
  Gene Ontology: Mol. function=motor activity; Cellular component =flagellum; Biological process=ciliary or flagellar motility
  Homolog annotation: Hit_ID=Q3BNW8; Match level="QueryCoverage=99%, HitCoverage=100%, E-value=1e-119, Identity=74%"; Hit description =Flagellar motor component MotA
  Pfam annotation: Domain name=MotA_ExbB; Domain location=118-243; Score=-42.4; E_value=0.054; Accession=PF01618.7; Description =MotATolQExbB proton channel family
MLIIVGFLVVIISVIGGYLGAHGRLGALWQPYELVIIGGAALGAFLVGTPAKTVKQTLQAMVGVFKGPRYKQQDYIDVLSLLYELLNKARREGFMALEDHVERPAESALFGNYPKVQADHHLIDFITDCLRLMIGSNIEPHELEPLLELELEKHHAEAMAPSQVLTKVADGLPGFGIVAAVLGIVITMGSIGGDIVEVGGHVAGALVGTFLGILLGYGFVGPMAAAMEARAEQDSRIYESVKTALLACMRGYNPKIALEFARKTLPSNVRPAFSDFEQHLKTVK

SEQ ID NO: 232806 - protein, 63 aa, Glycine max
  Coding DNA Sequence Number=SeqID_116028
MAEIWGGVVAEGSRTWRRAWISSGVVIEGSKRRRRRDKEEMGGEWWWSTVHRWRRWEREEEEG

SEQ ID NO: 232807 - protein, 58 aa, Glycine max
  Coding DNA Sequence Number=SeqID_116029
MNCVFVHASSTHEFGVMRSDCLVQFSILNPFSKPHELCFCSCVLHQKKKGVETRVVMD

SEQ ID NO: 232808 - protein, 94 aa, Glycine max
  Coding DNA Sequence Number=SeqID_116030
MCIVSSVISAYPIRASTPIVTSPLSIPRNVINAHQAIANPFVPEVVKAVDALHSEFRAVDNLVACNTTRVLKAFQNARVGSHLLEMSFTPLGIS

SEQ ID NO: 232809 - protein, 37 aa, Glycine max
  Coding DNA Sequence Number=SeqID_116031
MVMRLRGWRHQLGGTSMKYILSHISFIEQGKHMLFIM

SEQ ID NO: 232810 - protein, 156 aa, Glycine max
  Coding DNA Sequence Number=SeqID_116032
  Gene Ontology: Mol. function=RNA binding
  Homolog annotation: Hit_ID=Q4US87; Match level="QueryCoverage=61%, HitCoverage=71%, E-value=2e-23, Identity=60%"; Hit description=Heat shock protein 15 homolog
  Subcellular localization annotation: CTP_CleavageSite=78; ConfidenceScore=5.06e-01
MSAACNGAAASRDRHNSMRCMGRLPEGGLPACPALSECTVTHASFRAAIGTMHRNRRSVRARRYRPTRGSTAARACPVCALAVGTHRVRRCAAHAVRHDGPWRPRSRHTAAAPPVRARAGRSGRAPGSRNAPRRDPPAAAHPHAPRARISDAGPRR

SEQ ID NO: 232811 - protein, 329 aa, Glycine max
  Coding DNA Sequence Number=SeqID_116033
  Gene Ontology: Mol. function=protein binding; Cellular component =integral to membrane; Biological process=response to DNA damage stimulus
  Homolog annotation: Hit_ID=Q708X5; Match level="QueryCoverage=82%, HitCoverage=74%, E-value=1e-114, Identity=74%"; Hit description =Leucine rich repeat protein precursor
  Pfam annotation: Domain name=LRR_1; Domain location=118-140; Score =5.5; E_value=27; Accession=PF00560.23; Description=Leucine Rich Repeat
  Pfam annotation: Domain name=LRR_1; Domain location=142-164; Score =11.9; E_value=1.7; Accession=PF00560.23; Description=Leucine Rich Repeat
  Pfam annotation: Domain name=LRR_1; Domain location=166-188; Score =8.1; E_value=8.8; Accession=PF00560.23; Description=Leucine Rich Repeat
  Pfam annotation: Domain name=LRR_1; Domain location=190-212; Score =5.1; E_value=32; Accession=PF00560.23; Description=Leucine Rich Repeat
  Pfam annotation: Domain name=LRR_1; Domain location=214-236; Score =2.9; E_value=81; Accession=PF00560.23; Description=Leucine Rich Repeat
  Pfam annotation: Domain name=LRR_1; Domain location=238-262; Score =7.5; E_value=11; Accession=PF00560.23; Description=Leucine Rich Repeat
  Pfam annotation: Domain name=LRR_1; Domain location=46-68; Score =15.3; E_value=0.22; Accession=PF00560.23; Description=Leucine Rich Repeat
  Pfam annotation: Domain name=LRR_1; Domain location=70-92; Score =14.9; E_value=0.29; Accession=PF00560.23; Description=Leucine Rich Repeat
  Pfam annotation: Domain name=LRR_1; Domain location=94-116; Score =22.8; E_value=0.0012; Accession=PF00560.23; Description=Leucine Rich Repeat
  Pfam module annotation: Pfam domain module=LRR_1::LRR_1::LRR_1::LRR _1::LRR_1::LRR_1::LRR_1::LRR_1::LRR_1; Domain location=118-140::142 -164::166-188::190-212::214-236::238-262::46-68::70-92::94-116
KAGRSGYMTGKLSEAICGIDTLTTLVVADWKDIAGEIPTCVTALPSLRILDLIGNKLSGEIPADVGKLSRLTVLNLADNALSGKIPASITQLGSLKHLDLSNNQLCGEIPEDFGNLGMLSRMLLSRNQLTGKIPVSVSKIYRLADLDLSANRLSGSVPFELGTMPVLSTLNLDSNSLEGLIPSSLLSNGGMGILNLSRNGFEGSIPDVFGSHSYFMALDLSFNNLKGRVPSSLASAKFIGHLDLSHNHLCGSIPLGAPFDHLEASSFTSNDCLHLRARARQDKGFKEGIHVCVGGLEYPDGGAIMQLNYHLGGTWCCTSSLPISINYEP

SEQ ID NO: 232812 - protein, 124 aa, Glycine max
  Coding DNA Sequence Number=SeqID_116034
MLDGGMHGMLWSELFGLPEMRVLFGYYGGVVEFVTVGEWRGDEGGSWKVSKRVIVLLKCGVFPSIAIFRLIGDLIQTICGHQVLGLFQLLLNRKIASNANSWQKDSKVNQEYVIVYGVQGWKVF

SEQ ID NO: 232813 - protein, 254 aa, Glycine max
  Coding DNA Sequence Number=SeqID_116035
  Homolog annotation: Hit_ID=UPI000038DE7D; Match level="QueryCoverage =17%, HitCoverage=29%, E-value=3e-12, Identity=73%"; Hit description =COG0219: Predicted rRNA methylase (SpoU class)
  Subcellular localization annotation: CTP_CleavageSite=70; ConfidenceScore=5.84e-01
MDITAFKSLNIPFPTFPSKFSPFRPFSFFHFKPFRTPSSPRFISHCSLNGSAEITSKEGTLPRGVGEAVNEASSSKILQVVLVSPQDLAELVKRLELDYGLCLLPLPVRIHEVGTKGIVVKCMLDESGAFVDSLQKYFFFANALNILDMLSMLEEFSRASLLEVFPVEKLSKALLPLYPNSVNTTAQDLTGDEDHPVHGVIGREYESNEIPGNTGCIARTCAASAVGLHLVGPLGFQVDDTKLKRAGLDYWPYP

SEQ ID NO: 232814 - protein, 80 aa, Glycine max
  Coding DNA Sequence Number=SeqID_116036
MPLHCLQQGQRIEVIEDLCVFAPLTGKVYCERGNTAGTWKLKHTLTESYLSSYPYFIEHWLLKLVVLTELGHSDIRLYSI

SEQ ID NO: 232815 - protein, 240 aa, Glycine max
  Coding DNA Sequence Number=SeqID_116037
MDSSPTKVLLDSGATLPIEEFMSSSLNNTHDIRRKKEWSFTGIFGHSFCDERSCHCPGGIRFEWTGKDLLDLSTSEYVRSRPHLVIPEEDHADATMAGTLSPTNQNPEDQPITATDQTSGELIDAPFVTAFDMEIEHISNVAVTPPPTVPAHNVVEDDYMSADKRNDLTMKTLDLAASSGAHRSENMQTPAERMQTSDSDTPQLINSTDYKAPILITFLVEGICEEGASVPDNGQQHTSQ

SEQ ID NO: 232816 - protein, 336 aa, Glycine max
  Coding DNA Sequence Number=SeqID_116038
  Gene Ontology: Mol. function=heat shock protein binding; Cellular component=mitochondrion; Biological process=protein folding
  Homolog annotation: Hit_ID=Q1RSQ5; Match level="QueryCoverage=98%, HitCoverage=75%, E-value=1e-130, Identity=69%"; Hit description=DnaJ central region
  Pfam annotation: Domain name=DnaJ; Domain location=3-43; Score=44.9; E_value=2.6e-10; Accession=PF00226.21; Description=DnaJ domain
  Pfam annotation: Domain name=DnaJ_C; Domain location=198-319; Score =191.2; E_value=2.5e-54; Accession=PF01556.9; Description=DnaJ C terminal region
  Pfam annotation: Domain name=DnaJ_CXXCXGXG; Domain location=105-185; Score=87.6; E_value=3.9e-23; Accession=PF00684.9; Description=DnaJ central domain (4 repeats)
  Pfam module annotation: Pfam domain module=DnaJ::DnaJ_C::DnaJ _CXXCXGXG; Domain location=3-43::198-319::105-185
MGQLAKKLHPDTNKDDPKAEKKFQEVSMAYEVLKDEEKRQQYDQVGHDVYVNQESTSGFGGNSGFNPFEQMFRDHDFVKNFFHQNIGGEDVKTFIELSFMEAVRGCNKTITFETEVLCNTCGGSGVPPGTRPETCRRCKGSGVTFVQTGIFRMESTCGTCKGTGKIVSNFCKSCKGTKVIKGTKSVKLDIMAGIDNNETIKVYRSGGADPDGDNPGDLYVTIKVREDPVFRREGSNIHVDAVLSITQAILGGTIQVPTLTGDVVLKIRPGTQPGQKVVLKKKGIKTKNSYTFGDQYVHFNVSIPNNLTERQRELIEEFAKEEQGDFDKQRVASASG

SEQ ID NO: 232817 - protein, 107 aa, Glycine max
  Coding DNA Sequence Number=SeqID_116039
  Gene Ontology: Biological process=cell redox homeostasis
  Homolog annotation: Hit_ID=Q1S9Z6; Match level="QueryCoverage=97%, HitCoverage=88%, E-value=2e-42, Identity=85%"; Hit description =Thioredoxin-related
  Pfam annotation: Domain name=DUF953; Domain location=2-106; Score =95.9; E_value=1.2e-25; Accession=PF06110.2; Description=Eukaryotic protein of unknown function (DUF953)
MGFLTSSDQRLQQTKPISSSDPADCVRAEPVIYKKLEASPDDIALLRAYVGDRPTWRNPQHPWRMDPRFKLTGVPTLIRWENNTVKGHLEDHEAHIESKIEALVADK

SEQ ID NO: 232818 - protein, 100 aa, Glycine max
  Coding DNA Sequence Number=SeqID_116040
MVERERFGHIEERLRAIEGGRDYAFADMAELYLMPNVVIPLKFKVSNYDKYKGTTCPKNHLKMYNKKMGAYSKNENLLMHFFQESLTGATVTWYTNQEPS

SEQ ID NO: 232819 - protein, 88 aa, Glycine max
  Coding DNA Sequence Number=SeqID_116041
  Subcellular localization annotation: CTP_CleavageSite=82; ConfidenceScore=5.13e-01
MGGANRKFQNLGPSRGFWAKWGCSKDPSSPWLSISAVFGEKKNLCEENPSRGAFLMLPRCFRERIREGFSSFFTVLHPFFVRSSFFNG

SEQ ID NO: 232820 - protein, 147 aa, Glycine max
  Coding DNA Sequence Number=SeqID_116042
LPEIAPLSPPRLKSAKNRSLDTHIVVGRSHRTPYTAEKPTLSSLEPTESPTVPENPYCRCWNPTEPTLSWVEENPTYTVATRVLKHSSLLKGQSFFREAPLTCVCCWVLLIKRMNHDFCRWIHRGLEIACNCFNILLSNRGGLTVVV

SEQ ID NO: 232821 - protein, 534 aa, Glycine max
  Coding DNA Sequence Number=SeqID_116043
  Homolog annotation: Hit_ID=Q8D1H7; Match level="QueryCoverage=45%, HitCoverage=54%, E-value=1e-104, Identity=78%"; Hit description =Proline dipeptidase
WPSAANPVPPASSHRWSSAPRRIKEGVGQRQVGPFRKQERQCPHAAQHGPEQHDDQEAFAGFQFVFLFAVRPPQHQTDGQRHEEGLAERAPRPIAVNQCHQAGNKHRPGEQDDQQTNDTGYGAKMHFSTILSNSIGRNYCEMGLDLRGRQRQMQHDGGAVFALQDPTCGLLQQVLHQRQLRIVALQDIFGFRHLLSQRQLLQRLLNTVAIGFHQSAGAQLDAAVVTNDHGGHFPDAAAHELREDRFAGGTRRLSVVGESQLLRVIGAAGDERPTMVPRRRVLLPPVSDTAASSQVQIARHVLDALFVDYDVVFDADAAIRLQRIDAIPGEVLLELTAAARRQQRLDEVQTRLDGQHHARLQHAGATQERILGRRRQMGALLVLHKAGGVVHLQAQRVAQPVRQERRSDARFNHRLFAEAVHQLVILEQPGDALVHLHMVVGIAHAGFDGVDQRQLFTVEIFHQMGEFAAALRRVGAGQIGGVAVVFRAGVDQETQGFGRRLMIQLGVVQYRSVFVQRHDVVVRHVGIAVACRRE

SEQ ID NO: 232822 - protein, 47 aa, Glycine max
  Coding DNA Sequence Number=SeqID_116044
MALGWLRLNCGCNGICRELRAAPHAQRDEVGAPERCVKMTSFVLRHK

SEQ ID NO: 232823 - protein, 282 aa, Glycine max
  Coding DNA Sequence Number=SeqID_116045
  Gene Ontology: Mol. function=DNA-directed RNA polymerase activity; Cellular component=mitochondrion; Biological process=transcription
  Homolog annotation: Hit_ID=O47884; Match level="QueryCoverage=99%, HitCoverage=26%, E-value=6e-80, Identity=58%"; Hit description=RNA polymerase
  Pfam annotation: Domain name=RNA_pol; Domain location=12-282; Score= -190.7; E_value=0.0073; Accession=PF00940.10; Description=DNA -dependent RNA polymerase
MYLTATAFLYQSYKYEEDALNDIKNKLIPYLECKENLKTYFKTYLKTLVIESRMAKRPFQYLSNIYLFLLSVSDLMSFVDLYNCVPVTQDASASAYQLMAYFLLDKNFAKLTNLFDTGSGEIFDIYSHMRIELISFIKDSLSEENPELCAILDRVLTRSIVKQIYMPIIYGKTANSTTKDLIVSLCQDLLPKECTILSVLCFKFWQEKYSFMYSFIQLISLVGRVCSYLDRPVLYSTEYFSTSQDYKKMEKHSVRVFNSYLKKAHNVTLSFPSKERDKRKSG

SEQ ID NO: 232824 - protein, 172 aa, Glycine max
  Coding DNA Sequence Number=SeqID_116046
  Gene Ontology: Mol. function=pyridoxal phosphate binding; Biological process=carboxylic acid metabolic process
  Homolog annotation: Hit_ID=Q1SBV6; Match level="QueryCoverage=84%, HitCoverage=31%, E-value=8e-62, Identity=76%"; Hit description =Probable histidine decarboxylase [imported]-Arabidopsis thaliana
MSIYWGYPTNQDFDYDALAPLLHFHLNNVGDPFTESSFSLNSSKFEVCVLDWFANLWEIDKGEYWGYVTTGGTEGNLHGILTGREQFPDGILYTSQDSHYSIFKAARMYRMQCVTVGTLVSGEIDCVDLKALLLAHKDKPAIINLNIGEKLKFSSYRLLQETPFEMWSIVRA

SEQ ID NO: 232825 - protein, 81 aa, Glycine max
  Coding DNA Sequence Number=SeqID_116047
  Subcellular localization annotation: CTP_CleavageSite=47; ConfidenceScore=5.24e-01
MAVLPVPGWPTKSTTQFSQPCRPRRCVIPGRSLGQGRGYQSACLSTLCELDYHLRLLESFRCAIIEMAKLVRGRKRISEFI

SEQ ID NO: 232826 - protein, 48 aa, Glycine max
  Coding DNA Sequence Number=SeqID_116048
MKGISSQIQSQSFILILVMNDHELMTSHGSDPVLLFRKNRVGNHAGTS

SEQ ID NO: 232827 - protein, 244 aa, Glycine max
  Coding DNA Sequence Number=SeqID_116049
  Gene Ontology: Cellular component=integral to membrane
MGQECRPASSALLQYICMSRPSMENNLNRETEGHGLPKIPSLVQHISSNDEGNFDNGDLKNLSSSFKENETILAGSQGDEHAAINHRNKHSVSINIPFSCEEVQLHNTVRVLYSGENDFSSQSTTTDSKPPLPSQSMPNGSLHSEPASGVNFNNQESVISLNNKRIDFFKTWSSKLGGHISVMSGKVHTESAEDDNSLCNTNKPLPVDLFFKTLEGPQLQTPKLAVKQFFGKHWPRLLPLHFFT

SEQ ID NO: 232828 - protein, 247 aa, Glycine max
  Coding DNA Sequence Number=SeqID_116050
  Gene Ontology: Cellular component=integral to membrane
  Homolog annotation: Hit_ID=Q8L4G8; Match level="QueryCoverage=94%, HitCoverage=39%, E-value=8e-83, Identity=69%"; Hit description=C4 -dicarboxylate transporter-like protein
  Pfam annotation: Domain name=C4dic_mal_tran; Domain location=7-174; Score=58.5; E_value=2.2e-14; Accession=PF03595.8; Description=C4 -dicarboxylate transportermalic acid transport protein
  Subcellular localization annotation: CTP_CleavageSite=61; ConfidenceScore=5.39e-01
MDSPFVPSSWSSPISYQGLASSSLLKIYGQWMFGGKRLLSKVANPTNLLAIVGNFVGALLGASMGLKEGPLFFFALGLAHYMVLFVTLSQMLPTNKTIPKDLHPVFFLFVAPPSVAAMAWAKIQGSFHYESRIFYFTAMFLYISLAVRVNLFRGFKFSLSWWAYTFPMTAAAIATITYTNQVTNVLTQALSVILSLIATFTVTAVLVSTIVHAFVLRDLFPNDLAIATSERKQKPRRKWLPFKTWEP

SEQ ID NO: 232829 - protein, 35 aa, Glycine max
  Coding DNA Sequence Number=SeqID_116051
MEWRVNIEATPGSDYPMELNRNGMSYLSRRSEDKM

SEQ ID NO: 232830 - protein, 223 aa, Glycine max
  Coding DNA Sequence Number=SeqID_116052
  Homolog annotation: Hit_ID=Q9FLX1; Match level="QueryCoverage=98%, HitCoverage=96%, E-value=4e-35, Identity=43%"; Hit description =Arabidopsis thaliana genomic DNA, chromosome 5, P1 clone:MXC20
METSQPLSIESFSYSWLVNLRPSALESLESSLRTPLDASDETSSFIEMDPRMPPSKRFFKNSQDSKFDFPISQSPLTLVHADELFSNGYLMPLFVESLQMEEYESSDSNTSLVSSSSHAPKSEAPTGPSRCLSLKKCRTLSRRVFQKYLNFLRPLCRKLRVHKPSIDAVAKRGEAVKNRRYYSDTATSPRISVAFSADDWRYSCDSESSIYEAVLHCKRSIGE

SEQ ID NO: 232831 - protein, 252 aa, Glycine max
  Coding DNA Sequence Number=SeqID_116053
  Gene Ontology: Mol. function=peptidase activity
  Homolog annotation: Hit_ID=Q1RYI7; Match level="QueryCoverage=77%, HitCoverage=57%, E-value=6e-97, Identity=87%"; Hit description =Abortive infection protein
  Pfam annotation: Domain name=Abi; Domain location=131-211; Score =35.3; E_value=2.1e-07; Accession=PF02517.7; Description=CAAX amino terminal protease family
MVMLLWIASFWFVGTWIVPFLAYTAGFRKESLTYRGQALYSLLTDVAEGVIGIAILHHCLAKFQPLSSDWFKFELKGKWPFDVGLGCLMFPLINQLSQMNLNLLPVLQYTPVAISSVEQSIVARDLVAMALYAVIVSVCAPIWEEIVFRGFLLPSLTKYMPVWSAILVSSIAFALAHFNIQRVLPLVFLGMVMGTVFSIASQFSERLDAFKYSFEALSPQFEASFLRDLFAVTPYVEPNIKVFDNLSLKVRD

SEQ ID NO: 232832 - protein, 106 aa, Glycine max
  Coding DNA Sequence Number=SeqID_116054
MAHAWKGYYDSVQWYFGKGLVLVDIFERKTVKLARKGDLGEPSVGLDPNIYDAPFDGLEDYDEKENKWGLKGSDISQVLNHSRSDTTRSGYKWIKRNMDVDGDSWL

SEQ ID NO: 232833 - protein, 295 aa, Glycine max
  Coding DNA Sequence Number=SeqID_116055
  Gene Ontology: Mol. function=zinc ion binding; Biological process =protein amino acid phosphorylation
  Homolog annotation: Hit_ID=UPI00000482A1; Match level="QueryCoverage =80%, HitCoverage=15%, E-value=7e-18, Identity=28%"; Hit description =ATP binding / ubiquitin-protein ligase/ zinc ion binding
  Pfam annotation: Domain name=Pkinase; Domain location=28-243; Score= -113.4; E_value=0.083; Accession=PF00069.15; Description=Protein kinase domain
MCRVYGLWSERVEGPLYMVCERQRCNFLNKFGELGNGFLAVSEGGLELDKGGIFSFLMIGKGICEAVVALHLEGLVAGCLGLSCFSFDELGGICVDLNEALMLARKFVNVVSVEHEEEAMCKDCLENEVFASPEVLYGLLHKRGTAPDSGHSRYPTGYGSDVWSLACVLLRLLIGNALPWNTLEMKEENDGDSSASYACWVEKVSSVLEDKLGSEYLSLRQILCKCLDVNPGNRPDVVDVTVSRDYTGLCLVLGELCLLPKQSSNELIEHELWEKEIGGQPNVVQDGKGKFDEEE

SEQ ID NO: 232834 - protein, 50 aa, Glycine max
  Coding DNA Sequence Number=SeqID_116056
MPIRHTSLNVYMPNVGISPTHIYGVVTTLIGTLKGYKLHSLMSFPKATLV

SEQ ID NO: 232835 - protein, 692 aa, Glycine max
  Coding DNA Sequence Number=SeqID_116057
  Gene Ontology: Mol. function=nucleic acid binding
  Homolog annotation: Hit_ID=Q9LTX1; Match level="QueryCoverage=93%, HitCoverage=92%, E-value=1e-106, Identity=41%"; Hit description =Similarity to poly(A)-binding protein
  Pfam annotation: Domain name=RRM_1; Domain location=525-592; Score =53.3; E_value=7.8e-13; Accession=PF00076.12; Description=RNA recognition motif. (a.k.a. RRM, R
MVSPKILTLWQTSCSRGLFFKITGETLMHTVHYGHTLQDYVIVLLRNGRRKEQARNDLNVFLGENSYSFVSWLWDHLDMYLNLYVQPEALQDEAPKKKLTAEVQAGDDDSQHLNSQSERGKSSKLSRSRHNKDWKGLMKEEAEPPSIRSSVVDNAHLELEANHGPRSLSPKPPVQRKRGRADEQQRMKRDVVSQVNIAAPRRLLQFAVRDAVATSRTANSGMSVEPSLKRLRSVVSTSAGDSSLLERPPRMQLASRVANPMATVIKAVAEAAEDVIKSKPSGSVFDRLGRSMDTLDDNTQLEDSFQHQEQHHLFRSQKTEYNGQYAANMTMMGHETGYPSDSNSDNEGFDDINVMDRRVSGASQICPSAGNRGNDSLMVQYSVAKNVDDSLRQKRNREQEQLSTSSNTSHKIVNISVNVNAWKPPQHQEPREVTELDGNRTFYNERDPRSSTRPVKENANTLKVSNGNANPALDVQKEFSKAHLTASGSNAAGRPSEDVDSRTIFVSNVRTLTPLFLVWEGRLQGLVHFAATKDGLSRHFNRFGEVLKVIIVTDAATGQPKGAAYVEFMRKEAADNALSLDNTSFMSRILKVIKKSATTQESAPAMAWPRIVRGSPFPSARFSRHPFPRGIPGAFRARPPIKLGARSMQWKRDAQGSDSSSSVNTGSVTAPVARGFTYIRTESKPEGSLSTT

SEQ ID NO: 232836 - protein, 68 aa, Glycine max
  Coding DNA Sequence Number=SeqID_116058
  Subcellular localization annotation: CTP_CleavageSite=10; ConfidenceScore=5.06e-01
MASECKKSCNANGGWSNSRSAVPEFGLSFARKYAQKFPSLSELNDESRSSKAPKSRKSKLPQATTIHM
